United States Patent 6,833,447 (MYXOCOCCUS XANTHUS GENOME SEQUENCES AND USES THEREOF) - sequence listing, part 4

SEQ ID NO: 1262 - DNA, 34552 bp, Myxococcus xanthus
ctgggcctgtccggcttcgagtcccagattttctacgacaacctgcgggtggacacgccggaccggatgcccttcacggcggcgccgcgcgcgcccacgccgccccccgggccctacgcggacgacttcaaccgcgacacgctgggtgacgcgtggaacgccaccaacccctccgcggtgaagctggtggacggggcgctggtggtggagctgatgcacaaccggccggtgtggctgaagcagcccatccccaccaacgccaccattgaattcgacgcctggacggacaacccggagggcgacatcaaggtggaggtgtggggcgacgggcgctcgttctacgcgggcgacctgcggctgcagtacaccgccaccgggtacgtcatcatcttcggtggctggcgcaacacccagtccgccatcgcccggcagaacgagcacgcgaatgaccgggcggtgcgcgacggcgccgcggtggtgcccggcaagcgccaccacatcaagattacccgcaacggcggcaccctggcgtgggagctggatggccagccctacctgacgctcaaggaccccgtcccgctggagggcccacgcaatcagtacttcggcttctccggttggaagaaccgggttcacttcgacaacttgaagattcagccgctcggcccctagcggcgaaggacaatcaaacgtgcgcagagtaggcatcttcggctggggcgtggtcgccccccggtccaggaacatcgaggcgttcgagcgcaacctctcgtcgtccgaaagctggctgtcccccttcaacggcttcggccccgacaacttcctcgtcggcatgccggagttcgacctggccgactacaagccgtggattgacgcgcgcttcccaggcagccgcttctcgcagctcgagcggaagatgggtcagccgacccagttcgccattggcgccttcatccagtccctggcgcagaacccgggcctggagcaggaactgcaggcgctggggccccgcgcgcacgtctacgtgggcaccggcctgggcgacctgcccaccatccgctccatctccctggacctgtaccgcgcgcagcgccggtgggaccgcttctggtccgcgccggagcgcaacggcgccctgcggaagtggcgtgagacgcaggagccgctgcctggccttccgccggagccgtccacggtggacgaggccacgcgcgacgaggccgaggacgcgtggtggcacttctgggcgggccgctcgccggagctgcgcgagtacctggacgagctgcgcgaaatcgaagccattggcgtgcccgaggatggcgacgtggagtccgccaagctggccgtcatcaaggagaagcgcacgcgcaacgcccggctccagaagaagtggatgtcgccggagccgccgtggaacgccgtgtcctccaacgtgctgtggaacatccacaacacgccggcctcgcagatttcgatgatgggccgcatcaccggcatgacgttcgccccggtggccgcgtgctcgtcgttcggctacggcctgcggctggccatcaacgcgattcaactgggccaggcgaaggccgtcgtcatgggtatgacggacccgccgccgatgccgctcacggtgggcggcttctacaacgcccgcgtcatctccgcggacgcctccatctccaagcccctcaccgcgctgcgcgggacgcacatcgcgggcggctcggtggtgtgggtgctgggtgacttggagcacttcacggccaagggcttcaagccgctgggcatggagcccatcgcggtgggcgtcaccgcggacgccgaccacatcatcaccccgtccaaggaaggccccacgctggccatccgcgaggccctggccgcggccggctgcgccccggaggacatgggcagctgggacttgcacgccaccgccaccccgggtgactacctggaggtccagaacctgcgcgacgtgctgcccgagcaggtgctgattacggcgcgcaagggcaccttcggccacggcatgtccgccggcggcggctgggagctgacggcgcagtacctgggctacggccagggcaaggtgttccccacgccgctgaaggaagcggagctcaacaagcagatttcccgcgtgcacggccgcttcgtcttcgacgaagccgtcgaggcgcccgcgggctgcgcgggcaagctgtccatgggcgtgggcggcatcaacgcctgcgtcatctcccgcccctggtcgaagtaggggcggggtccgccgcgggactcaggggtgtgcggccagcgcgtccgcgtcgaagcgcgcggccgcctccgggtcactgcggcggagaatctccagctcgatttccaggtcccggaagtagttctgccgggtgggcaggacgccgctggcctggctgtcgtggacggcctgggcgtagtcctcgtccgtcttgatttccttgtccacgtaaccgacgccaatggactgggtgatgcggtctccgcgcatcacccgcagggccgtgccgccgccggtgagcacgatgccctgcaccaggaagcgagacgccgtgcccggccccaggctgccgccgccggagtccagccactccgtctccaggacgtagcggcccggcatctccttccaggagtagccgtggccccgcagcacctcctggacgtggggccatagctgcgccagctcctggcggtagacgtggctggccgccttgtcgcgcacgtagttcttgcgcatcgagctggaacaacccgtgagcgtcagcagcgtggcgacgacgagacagactcccgcgaggcgggtggagctgtgcatggggggctcctgaaggtgcgaggagaacggccgggcgccccccagcatatcgccagtgcccggccggctgactcgccccctcccccgccgtcaggccttgggactggccaccaggtcgaagtccgggatttgttcacgcatgaagtcacgcatccggttgatgagggccgcctcgatttgccgggcccgctcccggctgacgccgtacttgtcgccgatgtcctggagcgtcaggggctcgtcggagacgaggcggctctcgaagatgaagcgctccttgccctccagcgtccgggcgaactcggacagcttctcccggaagagggccttgagctgctcggcgcccaggcgctcgtccgctggcatcgagttggacggcaggtagcggtccgcacgggtggtccgcgagtcgtcgtcattgcccaggggcgcgtcgatggacatctcgtcgtgccccagccgctggtccatctccaccacgtcctgctcggtgacgttcaaccgctcggcgagcagcttgggactggcctcgaagccctgggcgatgagcttttcctgctcctggcgcagcttgaagaagagcttccgctgggcctcggtggtccccagcttcaccatcttccagttgtccatgatgtagcggaggatgtacgcgcgaatccaccaggcggcgtagctgctcagcttcacgccgcgctcggggtcgtacttcttcaccgcctgcatcagtccgatgttgccctcctggaccaggtccagcagggacaacgggttgcggtggtactcgtgggccagcttgacgaccaggcgcaggttggacgccaccagccggtaggcggcgttcacatccccggattccttgtagtgccgggccagttggagctcttcctcccgcgtcaggagcggatggcgctgcacctcggccatgtaggcctggagagggtccctgggcgtgagccccgtctccgcagagcggacgagcgctcgggggggcaccacgggggtgtccagctcggcctccggttcgacctccgccagctccgccgcgtccggctccagtgaatccgggtcggtttgagcctcgacctccaccccctccacctcggcgtccacgacgtcgccagccccgggcgaggccggccgcttcacgcggggtcggggggacgtacctttggttcttttcctcccattcgccatgggggctccatacagcaaagtgccgcgattgttgccacagggtaatgcaggggctatgcccatgcctgatgagcgacatccaagagccaaacgcgccggggagtccggcgcctgacgaagccctgacacgtcccggcgagtacatagcggacatcggcttcgactacatgaacctgacaaagcccatccgcctcgccctggcggagcgcggttataccaaccccacccctgtccaggcccgcgccttccggcccgccatcgagggaaaagacctcatcgttcgcagcaagacgggcaccggcaagacggccgcgttcggcctgcccctgctcgaaaagattcccgccgacgagcgccgcgtccgagcgctcatcctctgccccacccgcgagctggcccttcaggtggcggacgagctgaagatgctcgccaagcacaagggcctgaaaatcgcggccatctacggcggcgcctccatgaagcagcaggaggacgcgctggaggaaggcacccccatcatcgtcggcacgccgggacgcgtgttcgaccacatcaaccgcggcaacctgaagctcgacgcgtgtgaccacgccgtcctggatgaagcggatgagatgctgaaccagggcttctacgaggaagtcacgcgcatcctcgaccgccttcccaagacgcgccaggtgctgctcttcagcgccaccgtccccacggacatccagaacctcatcgcgcgctacacgacgaacgcggagacgctgctgctgtcgggcgacgtcttcacggtggagcacatccaccacatccgctacgacgtgtcggacgccttccccaagccgcgcaacctcatctacgtgctggagaaggaggagccgcagaacgccatcatcttctgcaacacgcgggatgacacggccctggtgacggcggtgctcaaccgcaacggcttcgacgcggagctgctcaatggcgacctgccgcagaaggagcgcgagcgggtcatgggcaaggtgaagcgcggcgaggtggccttcatggtcgccacggacatcgcggcgcgcggcatcgacatctccggcctggagtacgtcatcaactactcgctgccggaggacccggcggtgtacctgcaccgcgtgggccgcaccggccgcatcggcaacaagggcaccgccatcaacctcttctccgggcgcgagctggccacgtacacctcgctggagaagaagtacggcatcaagttcgacaagcgtgagatgccggccccggaagaggccatgcgcctgtggacggagcgccacgtgcgcgaaatccaggaggccgcgggcggctccgtcttcgagggcttcctgccgctggccgcgcagctcaagccccgcgcggacgccgacgacctcatcgccttcctgctgaagtacttcttcagccacctgcgcatggagaaggccgccgcggcgatggcggcggaagggcgtgagcctccgcaagagcgcaagttcgagagccgcgagggcggccggcgcgagcgcggcgagcggaaggagcgtggcgagcgccgagaccgtgagcgcgacgaccggcgcgagaagcgcggcgagtcctccgagcgcgagcgcgagcgccggccccgccgtgacgacgcgcggcgcgagcgcggcgctgagagtggccgcggcgcggcggcgctggaggccggtccgggcgaggcgaagctgtgggtgaacctggggaccgcggatggcctggggccgggcagcatcgccacggcgctggaagacgcgggcgccccggtgggcaaggtcgtgcgcgccgagctgcgccccaccttcgcctatgtcttcgtggcggaggaggacgccgccgccttcgagaccatcaacggcaagcagcacggcgccaagacgctgcgcgtggagaagagcaagccgcgcacggagcgtgacgccacgccccgcccgcccccgtccccggacgcgggccccggcgaggcgaagctgtggatcaacctgggcatggacgacggcatggacgaggcgaagctgcccgccgcgctggaggccgcgggcgctccggccggcaaggtgctgcgcaccctgctgcgccccacctacggctacgcctacgtggccgaggaggacgcgcccggcttcgaggccgtcaacggcaagccccacggcgagaaggcgctgaaggtggagcgtcaccgtccgcggggcgcacgcccggagcgccgtccccgcacggaggccctgccggaggttcccggccagacgcgcctgtgggtgggtctgggcaagcaggacgggctggacgaggcgggcgtcgccgccgcgctggaggccgcgggcgctccggccggcaaggtgctgcgcacggacctgcgccccacctacgcctatgtcttcgtcgccgacgaggacgtggcggccttcgaagccacgcacggcaagccccacggcgagcgcacgctcaaggtggagcaggccaagcggaagtagtccctcaggtgccgccagtccctggactggcggccttcctgcgccgctcgcggtggtaatgggcggcgcacaggccccgggcgagcactggcttctcacagccgggctcgccgcagcgggcaggctccggccggacggcctggatgtcctccgttgcccgcgtgggctcgttgaacatcacctccgccaccgacagcaaccggtccacgtccacgcgagccaggccgcgcccccggacgaaggcctccagccggtggacacccgcgtcctgcgtgtcctccagccgcaagagttcccacagtgggagctggagcgcggcggccacctggagcagcgtctcgtagctggggctgcgctcgcctcgctccagcagggacgcgaaggacacggagatgccgcagcgggcggcgaagtcctcctgggtgagtccccgccgctcccgcagtgtccggatgcgccgggccagtccctggaggtgtccactcacggtggaagcgtccggcggatcgggcggcatggcagtttcctatggtagcgcaccccttctgttaaggtctcgcgcgccgccatccaggagcttgccgacacatgagcgccgtcgagggtaccaactactacttccgcaaagccgcgcggatcatggacgtaggcacccccatcgaaacgctgctcgccacgccccttcgcgaggtgaaggtccaggtctccatcgagatggactccggagagattcgcaccttcctcggctaccggattcagcacgacaacagccgtggccccatgaagggcggcctgcgctaccacccgatgctggaccaggacgagtgcgcgtcgctcgcctcgctgatgacgtggaagacggccgtcgtgaatgtcccctatggcggcgccaagggcggcatcgcctgcgacccgtcccagctgagcatcaaggagctggagcgcctcacccggaagtacgtggaccaggtgcaggacgtcatcggccccacgcgcgacatcccggcccccgacgtcaacaccaacccccaggtgatggcgtggatcatggaccagtattcgcgctaccacggccactctcccgcggtggtgacgggcaagccgctggagctctacggctccaagggccgcgaggccgccaccggccgcgggctgctctacgtggcgcgtgaaatcctgcgcgacctgggcctgccggtgaagggcacgcgcttcgcgctccaaggcttcggcaacgtgggcggccacaccgcgcagctcctctgggaggacggcggcgtggtggtggccgtggcggacgcgctgggcggcgttcgcaacccgcagggcctggacatcccctccctcttcgagcacgtgaagcgcaccggcacggtgacgggcttcagcgggggcgcttcgtgcagcaacgatgacgtgctgggcgcggactgtgaggtcctcatccccgcggcgctgggccacgtgctcacccgggagaatgcccacgcggtgcgcgccaagctcatcatcgaaggcgccaacggccccacccagccggaggccgacgaaatcttcgagaagcgcggcatcttcgtggtgccagacgtgctcgccagcgcaggcggcgtgacggtgagctacttcgagtgggtgcagaacctccagcacctgtcgtgggaggaggaccgcgtcaacgcggagctggagaagtccatgaaggaggcctacgagcgcgtggcgcaggtggcgcgctcccggaaggtctccatgcggacggccgcgtacatcctggcgattggccgggtgggcaaggccaccgtgctgcgcggcatctgacgcggcccgccgtgtcacgcgctggacgtagcgcggcgcggcaggcagccggcggagcacgctccttcctcgtgtctcttccgcccggggcgcgcttccgatagaggcgcgcacatggtcaccctcgaggacatccaggccgcgcgcgagcgccttcgctcggccatccgccccacgccgtgcccgcagtcggactactacacggagcggacggagtgcgccgcggtgttcttcaagctggagaacctccagcgcaccggggccttcaaggagcgcggcgccctcaacaagctgctgacgctgaccgaggacgagcggcgccggggcgtcatcgccgcgtccgccggaaaccacgcgcagggtgtcgcgtaccacgcgcgtcggctgggcgtgagtgccaccatcgtcatgccggagcgcaccccgctcatcaaggtgtcgcgcacgcgggatgactacggcgcgcgcgtggtgctcaagggcaccaactacgacgaggcctacgcggaggcgctgcgcatccagaaggcggaggaccgcgtcttcatccaccccttcaatgacgcgcacgtcatcgccggccagggcaccatcggcctggagctgctggagcagtgccccgacctggaggtggtgctcgtccccattggcggcggcgggctcatctccggcatcgcgtgcgcgctgaaggagacgcggcccgacatccgcgtggtgggcgtgcaggcggagaccatcgccagcatgaaggcgtcggtggaggcgggcgagcgcgtgctgctggccgccgcgggcaccaccatcgcggacggcatcgccgtcaagcgcgtgggcgacctcaccttccccatggtgcagaagtacgtggacgaggtggtggccgtggacgaggaggaaatcgccgccgccatcctcaccctcctggagcaggagaagagcgtggtggagggcgccggcgcggtgggcctggcggcgctgctcagcggtgacgttcccgccgcgaggggccggcgcaccgccatcatcttgagcggtggcaacatcgacatgaacgtcatcagccgcatcatcgagcgcggtctggtgaaggctggccgcttggtgcagttggaggtccggctgccggaccggcccggaatgctggcgaagctcaccacgcaggtggccgacctgcgcgccaatgtcgtggagatccaccacgagcgcgccttctccaaggcgggcctgggcgaggccatggtggaggtgacgctggagaccaccgggcccgcgcaaatcgaggagctggagcgcgcgctccaccggctgggctggcaggtggcccgcaagtagcgccccatgcgggggcagggccttgcgcccgtgcgcccgtgtccggcgatactcagggcatgagccccgccgccctgctctccgccctgctactgaccgccgccccttcttctcccggacagaaggcgaagtcgctcgccgccagccgcgcgtgggaggagctctatctggccttctcggccggagaggcatcggacgtgcccaccccgcagcggggcaccgtcgccacggcgctccagaagggctgcgaggcgctgaaggacgaggacccggtgatggcgtactcactgggcgagcgggccaccgtgtacgaggagtccgcgggcgcgctgcggtgcctggcccgggccgcgcggaagacggaccagcgggccaccgcggaagccgccctgcgcaaggggctggcccagtaccccaaggacggcgccttcggcctggagttggggcggctgctgatggaggaacaggacgcggcgggcgccgtggcggcgctggagaaggtgccggcgaagtcgaaggaggccgcggaagcgaagcggctgctcgtgcaggcccgcgccaagacgacggaggagaccgccgcgcggcgggaggcggagcgcctggagctgcggatgaatggcgccacgagcgggcggcctaccgtcatggtcgaaacccagcccacggtggccggccagggccggggctccacgcgctcggccagcctcaactacgagtcgggcaccggcgcggacggcatgcggacgcgctccaacagccgcttcgtcatccggtacttcaacaacgatcgcgacttcggccaacgcgcggagtacgagggccgcatcgtcgccgcgctggacgaggcctacgacttcacccgcagcatgctgggcgaggtgcgccacgcgccggtggacatcatcctgtacaccctcgcggagttccagacgcacttcggcgcggcgcgggcgcgaacagtcgccgggctctactccgacaacgccatccgcatcaacgacgccgcggagctcacgccgcagaccaaggccaccctggtccacgagtacgtccacgccgcgctggatgagctctgtggcggctacgggaacaacctccccgtctggctcaacgagggcctggccgagtacgtcgagtggcgctacatgggcggcgaggaccccgagcggtcggtccggaactacatggcccgggccgccaaggcgaactccctgcccaagctggcgcagatggagggctcgtccctcatcatgcagcgcaacccgaccgtcgcctatgccacctccgccgtggcggtccgcgagttggtgaagcggggcggtacgggccggttcctcacgatggtccgtgaggtgggacagggaagacccatcgacgaggccctgacggagcactacggcaagacgcgggcgagcctcgacgaggacgtccgggccgctctccagtaggggaggctgccagccgggcccgggccaattggtttacccgttcccgggagtcccctagactcgcagccccctctatttacgctgcgacagaagctcggctgtacgctgtccgcagcaaggtgacggatgtcggacacgcgcgcagcgatgagagaattccgctttctcgacgagaagcggaagctgggaagcctgtctccggtggaggaggctcgctggaacgagctgcgcgcacagctgggcgtggatgacgcgccagccgcggacgccgccgcctggcagcagcaggccgcgccccagggctactacgccgacgatggccagtggtacccctaccccgccggctacgagcagcaaccccagggctactacgccgacgatggccagtggtacccctaccccgccggctacgagcagcaaccccagggctactacgccgctgacggccagtggtacccctaccccgccggctacgacccgaaccaggggtacgatccgaacgcgcaggcttacgcacagcagggctacgacccgaacgctcaggcctacgcacatcaaggctacgacccgaacgctcaggcctacgcgcagcagggttacgacccgaacgctcaggcctacgcacagcaaggctacgacccgaacgcccaggcctattcgcagcatgcgtatgacccgaatgcgcaggcttacgcgcagcaggcgcatgacccgaatgcgggctacgctcagggcactgccgaagcatggcaggcggatccgcaggcctatgccgcgcagtccgcgcagcagcagtcctaccccaccgctccggcacaccagccggctgtcgagccggacaacctcagcctttcggacgacatcgacattcccgcgctgagcgagcccgtcgccgtggatcacgccaggcgccggtggacaggctcagtatgcaatgagcggggagcaataacccagcatcgagccgatgtcctcggacaagcagccgtccacggtggatgaccagtctgcgtcgttcgcggacgtcaccgcggacatccagcagaatgcgcagcccgtattcgaggaggcgcagccggaagccctgagcgttgcggaggatgacttctccgaagtggggtcggacaccccagcggtggccgccagcgccgaacccgagacctcgctggaggcatcgttcgccgacctgtcgatggaggtcgagtcggcaccggatgcgccggtggcgcccacgggcgatgccctggcctcgacggaagtggaggtcccctcctccgaggtcgagttgctggacggcaccgccgacagcgaacctgtccttgcccacgagcagtctcccgccccaatcgatgatgcgtgggcctccgcgccgctcgccgtcgagacggagcacatggacgtcgccgatgcgggcgacatcatcgacgttgccgccatggcggagccggaggcggcctcgcaggctgcggattccgaaatcgcgctcgattcctccgaaatggtcgaagcgtcggctgcggactccgcggatacgacggatgcgtgggacgcgggtgcgacgaccgacgtgacggctgatgccatggcgacggccgaccacggcgcgacagatttcatcgcggccagcgcgggcgatacgtacgaggcacagcccgccgagattgcactcgacaccgcggatgaggcttcggccgaagccgagcccaccgagattgcgctcgatgcagcccacgtgagcgatgcggcggttgagcacgcctcggagatggcgttcgacgcatctgcggggtccgagccgggcgccaattactcgcccgctgaaatcgcgctcgacgcgtccgatgtcgccgtgccggaggcctatcccgagacggccctcacggcgtctgacgccagcgatgccgcgacggcggaagcctaccccgcggcagacttcgcgacggcggaggcctatcccacgacggagttcgcgacggcggaggcctaccctgaggcagacttcgcgacggccgatgtcagcgatgcctcgacggcggaggcttatcccgaggtggcgctgactgcctccgaggcaagtgatacgaccgcagccgctcccgagttggcgctctcggcttcggatgtcatcgaaacgtctgctcccgagccggagctggccgccgcggatgccagcagcgaagtcgtcgccgaggcttccccctacggcagcgcagcagcctcgttcgaagagcccttcgccgagactgccttcagcgaaggcgatgcaaccgccgctggtgaaacgtacgccgaagcggtgctcgacgccgcagaggtcagcgacacggctgtgagcgagcacgctttcgcgacgtccgaaacgagcgagtcggccactgccgaggcgtatccggaagtggcgctcgacaccgccgatgtcagtgatgcggccacgatggagttggactcggtggagaccgctgccgaagccacctccgacacggcgctcgcatccagcgcatggggcagcacggacgcggccgaggagtttgccaccacggagtatgcggcctccgacgtcagcgaattggctgccatcgagactgcgcccgagacggctcacagcacctacgaccactcgagtgaggccttcgatgggaaggaggtcgtcctcgacgcgaccgagatgagcgagcccgaaatcgctctcgatacgtccgacgtcgccgaatcgccttccgcccagtcgccctccgaaatcacgctcgacgccacagacgtcgccgagtccgccccgattgagccggccgcggagatttccctggaggcctccgacgtcgccgagccgcagtcggctgaaatcgccctcgatggctcggaggtgagcgaagagtctcccgcgcagcagggaagcgtccccacgctggagctcaacgcggccgaggtgtcgtccgacgagccctcgctcgatgtcatcgatgtcgagtccgcgcccggacacgccggggacgaggcatcgttccaggccgctgacggcgggagcgagcagcccacgctcgaggttatcgaagtcggtacggaggccaccgcttcggaagtggacttcccgccggaggctgcgcccttcgcgtcgtcggatgtcccgtcgctcgagatccggccggtccaggtgggtccggacctccacgcggaaacgatcgaggtggcgggagatccgccgcagtcgtccgcgcgcacgccttccgccgaggagatgttcgacctgagcgggaaccccgaagaggccgtgcctctcgccgcggcgaacgagttcctggcccacggacacttcgcgccgaccgatgagcgcagtgtggcgatggcggagggtgacgcgggcgccatcgagctgcagcctgaatgggcttccacttccgagcagcccgctgcggaagcggctcagacggaatgggccacttccggtgagcaggccgctgccagcgatgcgtatgcaggctgggaggatcctgtttcggaaaccgtcgaactccaggcggagtgggcggagcctgtcaccgcttccgagtggacgacctccgaacaaacggcggctgccacgggccacgcggagtgggcggcttccgatacaggcatcgcctccgaggctggccaggccgagtgggccgactccaccaccgagctccagcccgaatgggttgcggccgaaggcgcggcagcccctgaagcccaacccgagtgggccacctccgcggagcaggcgcacaccgaggcgcaggcgcagtggaccgagaccgccgcgcaagctgccctcggcagcgagcagacagaatgggctgcgaacacgcccgaggcagcccaggccgactgggcttcgtcctccaccgagaccgcgcccggcgaaatccaagcggagtgggctgagccgatcgccgaggacggccaggcccagtgggccacggctgaagcgcccccaagcgacggctggaacacggcgtcgactgaagcagcgcccgtggaagtccaggccgagtgggccgagtcttctgaggcctcgcccactgaggttcaggccgatgggtcgacccctacgctcgacgcagcgccggtggaagtgcaagccgagtgggacgaccccgcccagcaggatggagctaccctgacggctgaacctgcggcgacggaggcccaggccgaatgggctgcgccagaaatcgctgacgccactacggatgcccaggcaggttggacgacgccgggcgccgacaccgctcagtcggaatggactgcctcttctgaaaacgggtgggcgaccgccgaggaagttcagaccgaatggactgcgcctgcgaccgaaaccgccgcgcagcccgagtgggctacgacgcctgcggctgaagcagcacgaaccgactgggccgctcccggtaccgaaaacgccgggcagcccgagtgggccacgcctgcgaccgaagccgtgcccggcgaaggtgctcagcctgagtgggcttcgcctgcgaccgaggaagtccaggccgagtgggccacgcctgcggccgaagccgccgcatcgtcggagtgggcttcgcctgcggccgagggcgcccaagccgagtgggccacgcctgccaccgaaaccgccgcatcgtcggagtgggcttcgcctgcgaccgaggaagtccaggccgagtgggccacgcctgcggccgaaaccgccgcatcgtcggagtgggcttcgcctgcagttgaagaggttcagggcgagtgggccacgcctgccaccgaagccgccgcatcgtcgcagtgggcttcgcctgcggcagaaggcgcccagtccgagtgggctacgcccgcgaccgaggccgcgcaggccggctgggccgcagcgcccgtggaagccgcgcagccggagtgggcttcgcctgcggcagaagaggctcagggcgaatgggcttcgcctgcgacggaagaggcgcaaggcgagtgggcgaatcctgctgccgaggaagctcaggccgaatgggtaacgcccgcggaaggcgctgcgccagcaccggagtgggcttcgcctgcgaccgaggaagtccaggccgagtgggccacgcccgaggaaggcactgctccagcaccggagtgggcttcgcccgcgacggaggatgtccaggccgagtgggcgaccgatgccgctgcaccggcgtcggaatgggcttcgcctgcgaccgaggaagtccaggctgagtgggccacgcctgccacggaaaccgcagcccagcctgagtgggcctcgcctgcgaccgaagccgcccagcctgtctgggccgcccccacggaaggcgcgcaggcagagtgggccgcccccgaggcagaagaagtccaggaagagtgggccgccgctccggcggagggcgctcagcaggggtgggcaacgcccacggaagccccccacgcagagtggtccacgcccgccaccgaggaagtccaggccgagtgggccgaccccatcgaggaagccgctccggccgccgaatgggcctcaacgagcgcgcctgccgcctcgcagtgggacacgcccgcggacaacgcccccgcggccgcggaatggtccgcgaccagccacgacaccagcgcgacctgggacgcccccgccaccaccgagtggtcgtcggagcagacggcgaactggaacgaagcatccgctgaagaggtctccctcgcggacacggccacgcctgcctccgcggagtggaatgacgcctccgtggacgtggagcccgtcatggaggaggccgagcccatcgaagcggcgtccgcgtgggaggccgagcccatcctggacagcgcccccgtgacgtcgcagtgggccgccgccagcacggacagccccttcggcgctcaggcgcaggacttcaccgaggccatgcccatcgaggaagaagaagtctcgatggagctcgagcaggaggtggccgaaatcgacgtcgaggaagaagccgtggtgccgccgcccgcccccatggccgccatccccgtcgtcgcgtcggcgcccgtgcacttcgcccaggcggcctcactggccaccgccgcgcaggcgcagcacaccgccgtcgtcatgccggccgcgcccgccaaccacgtcgccgtggagcgtgagccgctcttcgatgacaccgccatcgtcggaggcacggccctcacctccttcgtggaaggcgagcaccgcgtcatcatccacaccgtcgaaggccaggtgaagcgcggcaccatccgcgacgcggacctgctcgatgaggtcatctccctcgagcagcagagcggcttcgccgccgagcagattccgggcaagcgcgtgaaggccatcttcttcatgctcgccgccggtgcgcgtcagccgcaggtggagggacagaagattcgggtcaccttcaacgacggacgtcaggtcgcgggcttctcccaggacttccagggcagcacgccgggcttcttcgtcatccccgccgaccagcgcaccaacaccgcgcgcatcttcatctaccgctccagcgtgcaggcggtggccgagggctgaacgggcgcgtccccgaaggacgggcggggccaccgtgctccgcaaatgaaagaggggcccccaccaccgtgggaggcccctccgtcatttcagaagaagcgaaggtttacttcttgtccgtcgcggcggcgtcggcctgcttcaccagcgacagctccaggttcacggtgacttcctcacccaccgcgacgccgcccgcctccagcgcctggttgtaggccaggccgaagtccttgcggttcagcttggtggtcgccgtcacgcccgtgcgggtgttgccccaggggtccttggactccttcgacgggcccgtgacgtccaggacgaccggcttggtgacgccatgcatggtcaggtcgccggtgaccttcagcttgccctggcccgccttctggaccttggtggacttgaaggtgatctccgggaacttggccgtgtcgaagaagtcaggagcccgcaggtgctcgtcgcgcttggcgttgccggtgttgacggtggacgcgtccagcacggcctcgaccttggacttggtgatgtccttgtcatccaggttcaacgtgccgctcttcacgttgaacgagccggtgacgttcgacaccatcatgtgacggacggaaaagccggcgctggagtgcgagtcatccaccttccaggtggaggccagcgcgatggacgggagggcgaaaaacagggcaacggcggtcttcatggacgtcttcataagaagtgtgctcctgggagatacagcgaagtcaggcgcgcagcgcgaagctgcgcatggacaaggttccgtgatggaagccctcgaatacgggggtgagacggtcctcggggagggcagctccgaggacgaaatagagcggcatcaaatgttcggcccttggatgcgcgagccgcgcgttcggtgcatccaaccatgactgaaggccggtgaagtctcgcgcctccagcttctgcgcaatccacgcatcgaaggccgctgcccacggctcgacggacgccgccttctcctgaaaattcagccggcgcaggttgtggacgatgccgccgctgcccatcaacaacacgccctgcgcgcgcagcggccggaggaattcgcccatccgcgcgatgtccgcggggctcgcgcccagcggcatggagacctggacgacggggagcttcgcctccgggaaggcatgcagcagcggcacccacgcgccgtggtcccagccgcgctccgcgtcagccacggtgggcaacccgcccgccttcagccgggcgaccacgtcctcggccagggacggcgcacccggcgcgccgtagcgcaggcggtagagcggctcgggaaagccatagaagtcatggatgagggacggctgcgcgctggcggtgacgcgaatctcgccgggcgtctcccaatgagcggacaccaccaccagggcccgcgcctgggcctcgccgccgaagcgacgcagtgcctgcgggtaggcatccgcgtccagggccaccatcggtgagccgtgagagatgaacgccgcaggggccacggcctggccgccgccagggccacccgcccccagcacacccaccaccccggccgccgccgcgccttgaagcaccacgcgtctgtcgagttcgtcgcccatgacggccgccttctaatgcaaccggaagaccacgacacccaaaactccaacctattggatttgctccgccccctaaaccttccgtgcaacgggcctctcaaaacgatagagactccactcattttggaaggagtcctacagcgtgggtggccgtttcgagctggacttgagtgagctgctgtcgttcgacccggggggtggactcatccacttcggaggccagcgcgtgctgctgatggacccggtggcgctggggctgcttcgcaaggagctcatcaagctgatggggatgacggcggcgcgcggcaccttcacgcgcctgggctacgcgcacggctggcgtacagccgaagcgatgaagggcgcggttccctggaaggacgaatccctgtggcgccgtgccggcgggcggctgcacaccctccagggacaggtccgggtggagcccgtccagcgccgcgcggacgaaggcccggagcccttcgccgaagcgcagtggcacgactcctatgaagccgagcagcacctgctgcacctgggccagtccgaccagccggtgtgctggagcctcaccggcttcgcgtccggctacatgagctacgtcaacggcaagcccatctacggcacggagctgcgctgcgtgggcaagggagacgcggcctgccactacgtgggccgtcccgccgaggagtggagcactgagtgcacggaggtgctgcgcctctatgaaacccagtgcatggaaggcatgttggcgcaggtgacggaggcgctgcggcaggcggagcgcaagctgcgcgcgaagcggcagtcgctggcgcgcgcgggcgtgacggaggacccggcgggcatggtggcgcgctcggaggcgatgcagcggatcatcaacctggcgcgaagggtggcgaaggtggactccacggtgctcgtcacgggcgagagcggcgtgggcaaggagcgcatcgcccgcctcatccatgacgagtcaggccgcgcgcacacggccttcgtcgccgtcaactgcgccgccgtcacggagagcctgctggagagcgagctgttcggccacgcgcgcggcgccttcaccggcgccacccacgacagggccggcctcttcgaagcggcccatggcggcaccctcttcctggatgaagtgggcgaggtgccaccgtccatgcaggccaagctgctgcgcgtgctgcaggagcgcgaggtgcgccgcgtgggtgagaacaccagccgcaaggtggacgtgcggctggtggccgccaccaaccgcgacctcgcggaggaggtccgccaggggcgcttccgtcaggacctctactaccggctgcgcgtcatcgagctgaagattccgccgctgcgcgagcgccgcgacgacgtgctccccctggcgcggctgctgctcgccgaggccgcggagcgcctgggccgcagggtatccggcctgtccccggacgcggcggaccagttgctgcgctatgcgtggcccggcaacgtgcgtgagctgagcaacgccgtggagcgcgcggtggcgctgtgcgagggcactcgggtggagcgggaggacctgccggaggaggtccgcgccgcgcctcccagcctggtgcccaccggcaatccgcagcggctggaggacatggagaagcactacatcctggcggtgctggcgcagaacggcggcaaccgcgcgcgcaccgccgagcagctcgacatcggcgtggcgacgctctaccgcaagctcaagcagtacggccacccggaggcggcccactgagtcgcgaagggcccggcgtcagttgaggtactggtcccggtccggccggtcctgccgcaccacctgcaggtgcttggagcggcccttcaactgacgctgcagccgccagtgctgcaggtgcagccacagcttgcgcgggctggccccgcgcacgtaggcgaacgccatgcagaggcccagcaggtccggcacctgcgtcagccagccactggtgctgtctgacagcatcatgaagcccgtaccgatgcccgccagcgcgttgcccgacagcggcagaccccagaagttcgtctgtccccggccaatggagagtccgtaggacacccagagcaccgacgtcatgacgttgccgcccgcgtacgcctgcaccgtcgcgccgggcaccagcatggccagcagcgaggtgatgaggcccgcgctcaccgcgatgcccagcgccaccatcaacaggcgcctgctgccccagatggactccaggtagccgccaatggaccaggtgatgatggcgccgaagatgatgccgatggggctggactcgatgaaggcatacgtcagcggctgccacaggtagagcttgccgaacaccaggtccgggaacagcagcagcaaaccacccgactgcgacttcgtgagatggaacatcacggagcccgccaccagcgccaccgccaacttggacgccgtggtctccaggccgggcagtcccatgccgccgcccccgcctccgaagctcctcatcggtcgcattcagtacaccatcctctcgttgctcagagccgtccaaaggtggtggaacaccgctcgcttcgcaaccccaaatgacgaagggcgcccatccccgacaccggggaaagcgccctcgaacacccacgcttcgtcaactgcctcgcggccaatcaggccttcggcttgtagaagagcgtgatggtcaagcagtggaactccttgtcggaggactgcgtcaccacccggtcgaccacctcgaggttggagttctccttgagccacttggtgatgttctcacccatgttctcgcggtcacgcgcgagcgtggtggagaacaccttgacgcccgtgaagctgataacgcccattccgaccctcgtcataaaccagagattctggacgtttaccccgagacgattccgccatcaagaatcgggcccgacaatccggcccttgcgcgtcctggcaccccacccgggaggtgggctcccgagcctcgcacggagcgcgcgggcccgggggctggaacgtcaccggccgctggcggccttgcgcgacaggcaggtgacctcgtccttgcaggccgggccaatgccttcggggtgtgccgtcaggggcgtcttgtcgctctcctccacgctgcacaccacgcacttgcgcttgcggttgcgacgctcggcgcggcgctgctccgcgatggccttggcccgctcacgcgccgtcttcgcgtccacctcgttgctcatctcgcgtcctggttggaagtcctgtgccatcagagcgcctcgacgagcaccgcgatgccctggccgccaccgatgcaggcggacccgataccatagcgggcgccgcgacgcttcagctcgtacaccagcgtggtggtgatgcgcgcgccggaagcccccagcgggtgccccacggcgatggcgccaccgttgacgttggtgcgctcgcggggcagccccagctccttctccaccgccaggtactgcggcgcgaaggcctcgttgacctcgaagaggtcgatgtccgacagctgacactgggcgcgctccagcagctggcggatggccggcgcggggccgatacccatgattttcgggtcgcagccggagacgccccagttgacgagccggccaatgggctgcaggccgtgcttcttcacgaagctgccggtggccatcaccatggagccggcgccgtcgcagatgccgctggccgcgcccgcgtgcaccacgccgtccttcttgaagaccttgggcagcttgcgcaggctctccaccgacgtctccgggcggttgtgctcgtcccgggacaccaccgtctcccccttcttcgtcttcagcgtgacgggggcgatttcatcctggaagcggcccgcctcctgcgcggcggcgaagcgcttctgggtgaggacggcgtactcgtccacctggtcctgcgtgagcgagtagtccaccgcgagctgctcggcggtgagcgccatcggctggccggtgtagctgtcggtgagggccgtccacagcatgtcctccaggctgcccttgcccagtggcaggccccagcgggcgccgcggatgacgtggggggcctggctcatggactcggtgccaccggccagcacgacggcggcctgctcggtgagcatcagctccgccgccgtgatgaaggcctggaagccggagccgcacagccggttgacgcccagcgcgggcacggggacgggcacgccggtgcgcaggcccacgtggcgcggcaggtagatggcgtccgcgctggtctgcaccacgttgccgtagacgacgtgctggacgtcttccggagacaccttcgcctgggccagcgcggccttcgccgactccacggcgaggtcggtggcactgaggtccttcaggcttcccccgtaggtaccgaacggggtgcgcttgccggacaggaagtagatttcctcgttcttggacacgctcttcatggtggtcgtctacctactctcatggggcgcgcggtgcacgcgcgccgtgacgtcgtgacgtgtgggacgggcggccctagggcgcgcgcggcccgaaaaaggcgctggcgacgatggcaagcgcgatgacggtccacaacaaaccttgaaggttctgtttccggatttccttgcgaccgagcccctggtaccaggaacgcccggctgccaccctgccttcccaggtgaaatccccggcgggctgcaacccgtccaggcggcgcaggtgcgcgcgcagcaggcggtcgggcggagcgtcctccagtgaacccgccaggtagacgccgggcacctccagcgccgggcgccggtagtccgcggtgatgacgaagcccccggaggccaggggcgtgaggaggtacagccggggcgcgccgccctgcccctcgtggagcgtggcgaagacgcactcacccgggtgggcccaatcgtaggagcgcgtggcgcgctggaggcgcggtttctcctcgtggctgcccagcggcacgaaccccagcgcctggagctggttggcgcgccccgacagctccaggggcaaatccatctggtccgcgggcgcctcaggctccacccgcacgctggacgggaagaggaagaggatgctgcgccacagattcatggacagcagcacgagcgccagcaccaggccggcgacggcgatgcccaactcggcgaggacgttcatgaagggaggacctccaggtgcattgccccccacgccacgggcgcgaggagccgaacgagggaggtcaacaaggcgggccgaccggagaccatgactccgggaccctagcggaaagcggcgcccgcgtgcgctggcttcagcgccgggacgcgctggctggcagcgtgcgccagcgctcgacgtccgccggggtgagcgggtcttcgccgcgcaggaactgctccaggtgccccagcgagtccacgccgaagaacagctcgccgtccgccagataggtgggcacgccaaaggccccggcggccaccgccgcctcggtgttccgccggacccggtccttcacctcctgcgtctgggccgccgcgagcagcgcctgggcgtccagccccgctgcctgaatcgccgcgcccacggcctcgggcgactccgcccccttcccgccgccccaggcggagacatacagggcgctcaccagccggctccgggcctccacgtcatccacggcggccgtcactcgcagcgcgagcagcgggttgaagggatgcgtcggtggcggcgcgaagggcacgccaaggtcatgggcgatgcggaaggtctgcttgaagatgtaggcccgcttgggcacgacctccgcgggaccgatgtttcccgtcgcgttgagcacccccgcgagcagcacgggcaccggctccacggtgcggccatggcgcgcggcgagcgccggcaggcgcgtccaggccaggtaggcatacggcgagatgaaatccagcaggaaccgcagtggggtcggggccatggcccgagtctaacgccccgcgtccgggccgtgaggacacagtcccgtcgactttccagcgtcacatcaggcgctctgacgcagctccccggcccggcgctggagcgccccccgcagggagctggccagggccagcaggctggaggcccgggcatccatgaaggccgcctcggccgcctccagcgccaccaccgaggactccgcgtcccgcgcgcgctccgcgagcgccagccgcaccagccccacctggagcacgttgcccgtcagctccgccagcgcgagcgcccggcgcaggtgcgtcaggccctcctcaccgggcagcagcgccgccagcgcccggcgggagaggatttcatcccacggattggccagcaccgggtccgtggcccgcgccagcgccgcctccgccgcgtcctgcgccgccaccaggttgccctgctcccgttcgaagcgggactggtagacgcgcagcagcgtctccatgcgcacgccgccctcgcgcgcggcggcaagggccgcgggaagtgagcggcgcgccgcgcccgcatcctcgaagagcacgtcgcggcaggcctgatacacccgcaggtgacactggagccaccggtcctccggcagcacccgcgccagcgcctcggcgcgggccaccaccgcggccacgtgctcgtgctcgccgcgctccaggtagtacggcggtgtgaagagggccaggttgcgctccatcaaccgggggttgcccagccgccgcaccagctccgtcttctccgtgaaggccgggacgaacgccgcgccgtcgcccgtgaaggccgcgcgcgtcaccaccgcgaacagatggaagccgcgcacatccgtgaacccatgggcctccgccacggcgtacccgtcgcgcagcgcctgcgcgtccagcggctcgccgcgcagcgccaggttcatgttcatcgtgaagccacccatgcccagcgcccacgccaggcgcttgggcagccggcccatcacctcgcacagcccgcgaagccggttcagttgctcgtactgcgtctccagcacgccggagaagcggcccgtgtaggcacacaactgggcaggcgccagttgcaccgcggcgcggtagggcgacacctccggctgctcggcccgcacgcgctccagcagcgccgtcagctcctccgtgcggcccacgctggccagcgccatggcctggaggatgcgcagctcggcctgcttccagaagacgtccgcggtgctggcgaacgtgtccgcctcccgctcgcggaacaacgccttcaggcgcgcgggacgctccgcttcgggcgcggcgcacgcggcctccagcgcggccaccgcctgcgttcgcccgtccaccaggtccaccgtggaggcccaatgggcgctcagcttccgcgcgaagacgagcgaggtgggcgggtcgctcgaatagcccacctccaccatcgtcacccagatgcgcaagagcagcctgtcacgtcccgggaagtccggcgcggcctccagcagcatcgccgcttccttcagcagcagcgtcgcttccagcagcgcctgcgcctcgatggcggcccgtcccgcgtccagcagcgggccaatggccagctccggctccgacgagcgcaggtagtgccaccccaccgtgcgcgacagctccggccgcgacgagtgcagcgtctggagcgccagcgccacgcggccgtgcgccacgcgccgcgcatcctcgggcgtgctgtcgtagacggcctggtgcacggtgtcgtgcgtgaagacgtagcggccctccacctcctggaggaactgccgctccacgatgccgtccagcaccgcgaacagctcggactcgggcagctccgccagcgcgcggagcatgggcagctccaggctgcggcccgcgggcgccaactggcgcagcagcgacacctgctccgccggagcactgcccaggcgcgcgagcaccgcgtcgtggatgctcgcgggcagcggccgtgtgtccagtccctcgacggcgctccaccggccgcccacccgcgtcagcgcgccttcctccaccagcgcgcgcaggcactcggtggcgaagaaggcattgccgcccgtggtctcatgcaaccgcgtgacgaaggccgcgggcacggccagccccggcagcgccagctccaccagcgtacgcacgtgctcggcggccagcggctccaggtccatgcgggtggtgattttctcgtccaccgtctggaaggccaggctcaggcggctcagctcgccgttccggaacgtgcccaccaccatgccgcgcgtgccgtacagcgcgcggatgaggacgttgagcacctccagcgtggcgctgtcggcccactgcaggtcctcgaagcacagcaccagcgtcatccgccggcccagcgcctgcacccactccgccagcgcgccgaagaaggccagcttctcctcgcccgccaccgggtgcacttcgcccgcgtccggcgtcaggcccgggagcagttgccgcagcttcggcccgaggcgctccatcatctccgagggcgtgagcggcaccagacaccgcaccgcctggacgatgggcgtcagcggcgcctgtccctccgcgcggcactggccccggccgaagggcagctccgccagcttcgcctggagctcgaactcctggagcagccgcgtcttgcccacgcccgcgggcgcgccgatgagcaccgcgcgggactggccccagtccgcctcggccaggccgttcatcagcgcttccagctccgcggcgcggcccaccacttccggcacgtgcaggtagctggcgcgcgccgacagcggctcctccggcatcggctcgccgctggcgtggcagagcgcctccatcagctcgctggcgtcctggaagcgctcgcgcggatccttcgccaacagcaggaggatgatctcctccagctgcggatccaccggacaaatcgtggacggcttcggcggcggccgcgtcaggtggtccgccaggagcgccgccggggtgttgcgcttgaagggcagccggcgcgtgaccaggtagtaggccatgacgcccagcgaatagaggtccgcgcgcccgtcgatgctcgcgccgcgctgccactccggcgccaggtactccagcgtgcccttgagacggccggggctgggggtgcccagctggtgcatgacgccgaagtccatcagcttcaccgcgcccgcgctggtgatgcggatgttgctggccttgatgtcgcagtgcacgtacagccgcgagtgcaggaaggccaggacctgggacatctggatgagcacgcggtacagcgtgcgcgtgtccagtggcgactcacgccccagcgagctcaggtcctgcccgtccaccacctccatggtgatgaagcggttgccggcctccgtcatgccccagtcgaagaccttgagggtgccggggtgctggagcttcttcatggcgaagaactcgtgccggaacatcagcaccagctcctccgtcttgcccgccgtcaggcccgcggggacctgcatctccttgagcgccacccggcggtgctcgtgcaggtccgtggccagccagatgcggcccatgccgccttcgcccagcagcccttccacccggtagcgccccgtcaccaccatgcccacggccaacgagcggcgctccccggcgcgcgctcccggcagggtgatgggcgtgcggatgcggtccccccatgaacttggaggacggctgcgctcgtccaggactgctgtcttctcctcgtcgctcacgaaggggaaccggcggggtcagcgaaatgcagaagttaatgggatatcacgtttccttgcgacaggcacacatcatcagtgccgtgtcggcgttgagtgtcgtaccgcgcatgcggccccaggcgacaagcacctgacaacaggggcctcggctggacggcggcctggcagccctgcccgaagccccggacgcgtgggtgcacatcctccctcgagaaggcgccggccgggtgagcgggccacgagggtgacggatgagggacgcgggctggaggacgtggctgggggcgggcgtgggggcgttgctgctgacggcatgccacacgtcggaagaggagacaccgccggacctcgacgacgtggcggcggcgacggtgacgctggagccgggccactgcgcgggcgtggtggtggaagacggccggcacattctcaccgccgcgcactgcctccggaatgaggacacgcgggtgcccttgtccttcctgggcggacgccggatggacggcagcgccgtgcacgtggaccggggccgggacatcgccgtcctccgcctggacgcaccagcgccggtgcgtccactggacgtcgcccaggccctgcccgctccgggcgaacagttggtgttcgcgggccgcaatgaccgtcccgacgaacctcagcaggccgtgctggaacggctgggccgctgcccttcgcttcccgaggtgcccgccgtgctcttcaccaccatccggggccggccgggagactccggcgcgccgttggtggacgcgcgcatgcaggtggtggggctggtccacggcggggccgcctgccgcgtcgccgcgcccaccgcggggctcgcggaggtggtggcacaactgtcgcgaaggggaccggccctggcccggcaggcgccgcctccgcctcgctaggccgccctcccatcaatgggccctggcgtcgttgccccaggggccgcccgctctgaacttgaagcgaacggggcggcacctcacgccctccctacccacggagacggcaccatggctggcaagaaggacaagggcccccaggacgcgcggcccagggacattggcgatgaccagcaggcgggcttccacgccggagagaatttccaaccgcgcaaccgcgggcaggtggcggacgcgcaggaccgtggcgcggcggacgcctcccggcacctcgcccacgagcacggcgacgcggcgccccacgccgacacgccgtgggaggcgcgcgtggagcgcggcgaggagtggacgtcccaagatgtcccggacagggaggcccgaggcgacgaggagcccgactccgccgtctcgcgtcagggcctcgtgagcccccctcccgaggagtaggcgccgcgccacggaccccacggccccaaggggtgctgagcaccccctcttgccccggctggcccgtggggtgatgctgggcctttcgccgggggagagcgtgtgcaccgggcaccgccgggcggctgcctccctgagagtcggggtgtcgtgaagccgaaggtcctcatcgtcgagaattcgtggacgatgcgggagacgctccgtctcctgctctctggcgagtttgactgcaccacggcggccgacggcgcgtcggggcttcagcaggccctggcgcacccgcccgatgtgctcatctccgatgtgaatatggacggaatggacggctacgcactctgtggccacttccgctccgagcccacgctcaagcacatccccgtcatcttcgtcagcggctatgcgcctcgcacggaagggcccgcggaccagcccgtcccggacgcctacctggtcaagccggtgaagccgcccgtgctcatcgcccaacttcacgcgctgctggctcgcgcggaggccgtcaccccggccgcgcccaccatccagcccgcgtggaagagctgagcccgcccaccccgaagccccccggcacggcgcgccccgagtgagaagacgggcgccggcctcgctggagcgcgggacggtcgcagggcgcacgggcgttgccaccaacgaacgggtgacacgcgaggtggtccagtgacgattcgactcaagcgagcgtacgaagcagcaagccgcacggatgggcggcgcttcctggtggaacggctgtggccgcgaggcgtacggaagacagcgcttcccctcgaagcctggctgaaggacgcagcccccagcaccgagctgcggaagtggtttgcacacgaccccgagcgctggtccgagttctgccgaagatacaccgccgagctcgcggcgaatcccgcagcatggcagcccctgctggaagccgcgcgccacggcacggtgacgctcgtctacagcgcccatgacaccgagcacaacaacgcggcggccctccaacagttcctcgaagaggcgtccggcggcgccgctccgaagaagcctccatgcctcccgcggcgaggccggggccgctcgacgcgacacacctgactgccgccaagggaaagcgcgccgtggctcaactccctcggtacgtggaggagccgaaggaactcagcagcagcgggacgcggtagtgcgcgtccggcgccgacgggtagaaaccgcgcacgccggaaggcagctcggcggggcgtgaggggacgcgcatgggcctcatcgtccccgcgcactgcgtcagtgagccaaggcgccccggaatgacagggaattgtccaaaaccccaagggttcactggagatgacgcaaccttccacgcttcccccgctgggctgcttggctatgctgcgcgcccttcgtttccgcccgaggtgaatccgcgtgatcaacgcccatacccgcgtcccgccgccgaagaacgagcctgtcctctcctatgcgcccggcaccaccgagcgccgggaggtgcaagccgagctgaagcgcatggctggtgagcagatcgacatccccgtcatcatcggcggcaagcacatccgcaccggcaagacggacacggtgcgcatgccgcacaaccaccagcacgtgctggccacactgcacgaggcggacgccagccacgcggagcaggccatccaggccgccctggccgtcaaggacgactgggcgcgcatgcccttccagtcgcgcgccgccatcttcctgcgcgccgcggagctgctggcctcgcgctaccgccccatcctcaacgccgccaccatgctggggcagggaaagacggcccaccaggcggagattgacgccgcgtgcgaggccatcgacttcattcgcttcaacgtgcacttcgccgagcagattctcggctggcagccggaggccgcgtaccagacgtggaacatgacggactaccgcccgctggacggcttcgtcttcgcggtggcgccgttcaacttcacggccattgccctcaacctggccaccgcgccggccatcatgggcaacgtggtgctcttcaagccgtcatccaccgcggccctgagcgcctggtacatcatggagctgctgcgcgaggcgggcctgcccgacggcgtcatcaacatgctcccgggtgatggccccacggtgggcaaccccgtgctggccagcccgcacctgggcggcatccacttcaccggctccacgccgacgttcaacgccatgtggcgcacggtgggcgagaacatctcccgctacaagcagtacccccgcatcgtcggcgagacgggcggcaaggacttcatcgtcgcccacccgtccgcggcggacgacctggaggcgctcgcggtggccatcgtccgtggcggcttcgagtaccagggccagaagtgctccgccgccagccgcgtcttcatccccgaatccctgtggcccaagctgaagccgcgcctccaggcgctcatcagcgagattcgcatgggcgacgtgtcggacttccgcaacttcatgggcgccgtcatcgacgagaagtccttcaagaaggtctcctcgtacatcgacctggccaagagcgacagcggggccagcatcgtggccggcggcgacgtggaccgaaagcagggctggttcgtgaagcccacgctggtgcagctcgacagccccacccaccgcatcctccgcgaggaaatcttcgcgccgctggtgggcctgcacgtctacccggatgcgaagtacgaggagacgctgcgcgaggtcgaccaggccgcgtcctacgccctcactggcgccgtgttcgcgcgcgaccggaaggccatcgacacggcgctgcgcgagctgcgccacgcggcgggcaacttctacatcaacgacaagcccaccggcgcggtcgtgggccagcaacccttcggcggtggccgcgcgtccggcaccaacgacaaggcgggctcgggcctcaacctggtgcggtggaccagcccccgcaccatcaaggagaccttcgtcccgcccgtgaaggtgccctaccccttcatggacaacgacccgaacgaaggcgccatctgaggcacgtatgaagggtccgttccccggcatcgcagggctggacacgtacgcgctggtggacggcgggtgccgcgtggaggtccttccttcacgcggggccctcgtcagccggatgtgcgtggacggtgacgagctgctgtacctcgacgaggccaccgtcgcggacccggccaagaacgtgcgcgggggcatccccgtgctgttccccaatgccgggccgctgccgggggacacctattccgtggaccgtcagcagtacacgctgcctcagcacggcttcgcgcggaaactgccgtggaaggtgcggcaggcggacacgtcacggctggtggtggagctgtcttccaacgaggagacgctgcgccacttcccgtggcggttcgacgcacggctcaccttctcgctggctggccaacggctcacgctggagagcgcgttcgagaaccaggacacgcggcccatgccgctgcacctgggcttccatccgtacttccgcgtgccggacgcggcgaaggcccaagcaggcgtggacacggacgccacgcacgcgtgggacaactggcgcaagcaggacgtgaacgtcaccgggctgaacctcaccgaggaggaagtggaccttcacttgaaggaccactcaaagccgggaacgacgttggagcggggccctgggctcaagcccattcgcctgtcgtggagccccgagtaccgcgtcctcgtcgtgtggacgcaacgtgggaaggacttcgtctgcgtggagccgtggaccgccgccaagggtgcgctagccaccggcgaagggctgccgcacgtgcagcctggaactcggacgtcgcttcgcttcgacatccaaggctgaacgcagggcccggagccccccggggcgactcctgcaccttgctgttcggaaatgtcgggggttttgcgggcggtctcaatcggtgaacgcaccagtcaggatgcgcggaagggagcgcatccgggagaggtgtccggtgtagagtccagtgcaagct

SEQ ID NO: 1263 - DNA, 34953 bp, Myxococcus xanthus
tcgtcacccgttccatgggcatcacgagccgaccgtagagcttttgttcgcgaggcgatagagcgtggtgttctgctcctcgatgggtccgtccagccagccacagagatattcgttggtgccttggacccggcacgcctggtcaggcgtgctggcgggattgtcccggttgcagccttccaggtattggcacccgatgttgcgctcggcaacgatagtgccgccctcggggttctggtccatgttccacgccgctttggagaagaagacgttgatggacgtgcgcaggtgcagggcgcagcggccatccgggtcctgcttcacacatggatagacgtagccttcgttggggccgtgattgcggcttgaatagaacacgacgacgaagaagatgacttccttcccgccctcgatcatccccaggtccacggtccggtcgtagggggagattcctcggtccgggttgttggcgcgtggtagcccccgcgggtcgtaatgggagacgtcgtagtcagggataccgtcggggtagtcgccggtgtctgggaccggcgacaggtttccgtaggtggagcggccgtcgtcatcgtcggcgagcaggaagaccattcgccccaggcccaggtttccattgcggtccgaaggaggctccaggaggttggggatatggggaaagagccctctatctgaaaaggccccgccggggttgtcgcggtcgttggcgaaagcccctaccacgtccgtgatgttgtactcgaaggtgtaacccgggcgggcgtccgcgatctcgcggtggttctcgtcgaaggtgttgcggcactcggagttcatcgccagttcgggctggttgtacgtctctccgtccgagacgaagttccgcgtgcagcgccgactctcgccaatgtaggggcgggccttgtcgccgctccggggcgcgaggttgaacaggtcctcgtgcaggtcgaagatgccgttgttgttgctgtcgacgaggttgccgttgctgtcgacatagcccctgacgcggaggtcatccatgtacatgtagccgagcgcatgcgaggcgcctgccgattcgtacacgtagctgatggtgacgttctgatcgaacgggaagtagatgttctcgacgttcagtgccgtgcggttcgtgttgagctggagccgggccggtgattcctcggtgatgaggacggtcgatgactcgatctccaggttctcttcactgaattcgggctgcttgttctggtcgagctggttttcgcacaactgggccggtgccgactccggcgtggtctgggcggaggccaacggcgcggtcaacaaggtgacggcggccagtgtctggatgagggtgcgcatcacttcttcccctgcgaacggcgggacggttcatccgcctggcgctgcttctgcgcctggcgcgctgcgaggtcctgcttgagctgcaggcgaagctgctcctcgcgcgtaggaggtgtggggtggaggctgagcgccaggtagctgaggagcagctccctgtcgccatcgggtagcaggcgcgtatcgcaacccgtcttgggtttgatctggttggggcctgccagccatgcgcgcagttggtcgggcgtgcgcatcgggaccacggggcccaggtcgacgctcggcccgcgcctgcgggagttcggggccttggccgcggcctttgttttcttctgtccttgcgcggtgacgacgtgacagcgggcgcaggccttctcgaaggcgagcttgccttcatccgtggcgctgctggccagtcccggcaggagcaggagggacaacaggatgagtcggttcatgggggcgctcaacgagaggtcaaggggcgggggtgatgtccacttcatttccgacgtcggtcaccgtgccggagccgtcgaaggtgcctgcggggccgcctccctcctgagtcgggccagggctggtgacggccggcgcgttctcgttggagatgagggcctggatgacagcgcgtgtgggccggcttccatcgcggcccacgacctctccgacggcgatgagccagacctgcccattgtcatcgtcgagacctgacgtggtggcgtcctcgtcatcccggacgaagacgcgatagcgcacgttcgtttggagcgggaaggcggcgtaggcatcgcccgaggggctctggcgctccgtgggcgccaagtccgactcgtcgatggccagcgagttccagcctccgaccccgcctggcccttgaaggacctcgagatagggacggtcgccgcctgccggcaggcccggttcgttgacttgcggcatcgccgcgagcgcggacgaatagctctgcagattgcccagccggatgcgcatcgcctcgcgcccctcggccagtcccgcctccgccgcgaagtaggcctccttgtagcggcggccatcaccctggacttccgcctcgcggctcaccacgccgtagctgagaagcaccgcgagggtgaccatcgtgacgacgcccatggcgagcagcagcgtgaagccaccttgccgccgtcgggttgtgggacgttgcaccatgtcgcgggactcccttggactccggcccgtgagggcgataccagtgttactcactaggcaattgccatgcctgagcggcggcactgtaactggccggaactcgtgggcaacgttagggtcgcacctcagggttgggtctcaagagacctcgcaagagttgcggagttgcaattgcttgcgaggtttccgttacgccctggtgacttctcgggttccaatgttctgagcgaaccggacgcctagggggcgccttcgagctcgcgcagtcggaccaccagggcctgcattcgttggtggtgcgtgccggcccagtagacgcgctggcagtccggacactgttggaagcgcgagtgccgttccgccacgcgctcggggatgcggccggccacctcggatggctcggcggaggtcagcgcggcgttgcaggcgacgcagcgcgagaagggatgcatgcgggacgtcagcccgtagcggcgcaccacctcaaccagttgctccgccgggtccgtcgagcgggggaagtagccacgcaggacttcgccgcgcttgagcaccccgatgtcacgcgagaggaggatgcggtcctcgtcatgtgagagccgcgcgagcgtgtcgtccgcgaagtcgttgcgccacagggcgtcgaagccgagcatccgcaagaagcccacgagccgtcccagccccacgtcgagcacgaagcggggcgtgtcctggagcggaggccccacccggacgccgggctcctcgaccatggacgtggggtagacctccacgcacgcgcccggctgcacccggtgcgtgaagcccacggcctcgccatccacgcgcaccacgtccatttccgggtggggcggacccagggactcgatgaggtccttcaccgacgggcggcctctcagcgcgtggctgaacgtctgatgccggtgcgcgggagacaggaagtcattcagcgcgccatggaagcgcatcgtcacctgggccttcggctgtcccatgtccaccctccggcccgcgttgtcgcggccctccgtgcttcacggggatgtttctgtgactgccgggccgggtccgccagacttcccgtgacgtttcggagtgactgcgtagataaaatcgttcagctgtgccataagtcacaagatcgtcacatcgagggttcctatactcccgccgccgtccgcacctgggtgtcgtcggcgatttcccccctctcgactcctgagtccgacagcatgaagaagacgctcacctccctcctgtgcgcggcggtttcgctcacccttctttccctggcgtgtggtgagggcaacccacctcaggtgccgcagccgctcgaggacggaggggttctctggacggagtgcagccccgagggcgccagggaagactgctcgcagggcgaatcctgcatcttcgtcgcgtcccatgaccgccacctgtgcgtccgggcctgtgattcgcagaccgcgtgcgagcacccggatgcggtctgctgcccctcgtccggagagggggccgagggcggccactgcgtgccgagcaacgcgtgcgtgccgaccgacgcgggcgtggacggcggctcgaacgaggagacggacggcggcacccaggaagaagacgcgggcgtggacccggagccggatgccggcaccgaccccgagccggacgcgggcgtggacccggagccggatgctggcaccgagcccgacgcgggcacggatgccggtacggacgcgggcacggatgccggtacggacgcgggcacggatgccggtacggacgcgggcacggatgccgggactgacggtggcacggacgcgggccacacccccatccgggtgatggcgtccaacctcagcagcggcaactaccagtcctacgacccggggcacggcatccgcctcatcaagggcgtgcacccggacatcgtgctgatgcaggagttcaactacgggagcaactcggcgtcggacatccgctcgctggtggatcagattgcgccgggcttccactactcccgtgagacgggcgcgcagattcccaatggcatcatcagccgctggcccatcatccagttcggccagtggcccgacccgcgcgtgtccaaccgggacttcgcctgggcgcgcatcgacatccccggtccccgcgacctctgggcggtgagcgtgcacctgctcacgtccagctccagcaaccgcaacgcggaggcgcagtccatcgtcaatgaggtccgctcgcagattcccgaggacgattacctcgtcatcggtggcgacctgaacacggacagcttcagcgagtcctgcttcgccaccttccggcaggtcgtgacgacggcggggccgcacccggcggaccacaacggcaacacgggcaccaacagcaaccgcaacaagccctacgaccagattctggtggaccaggacctgcgccagtaccagcaggcgaccgtcattggctccagcaccttccccaacgggctggtgctcgacagccgcacctaccggccgctgtcggagattgccccggtgcagtccggcgacagcagttcctccaacatgcagcacatgggcgtggtgaaggacttcctcgtccccaacttctgaggggacgctctttctggcgggttcgcggcggccatcctgggccgccgcgggcctcggctcagaagctccacttgtgcttgttccgctcaatgaagcgcgccacgggaggaatccgggcgatgagcggcgtgagcacgaacaccgcggccaggcgcagcggcttcaccacctgcgacgccgcgtaggccgccgcccaactgcccgccttctcgccggtgctgctgggctggaagccgaactcgatggcggcgtagaagcccacgactaccaagccgaagatgacgtagttcaccaccaacgccagcggcccgaattcgagcatcaggttcttgaagcgggccatcagcgagggcttcgctggcttggtcgcggcctcggtgggtgggggcgtgtcggagactgaaggattcacgtcgggctcaacaggcggcatggtgacaccatgccccaaacccgtgctggccgggagatggagcgagcggacagggaaggggcgggtgggcactcttcgttgtcaggactccgaggagcgggatagaggagggcgcgcgacatgaaagtctcccatcgattcgtcctcctcgtgattgtcgcggtgctcgccgcagaccaggtgaccaagtacctagctgtctctcggctgacggatgccctggatgggcgggaaggcctggcgcgggtgacgggcttcgtcaccgagcagaacctggacaaccgcccgccgcccgaggacggctcgtaccgggtgttgcggccctatcgcttcatcgaggactactggcacttccgctacgtggagaacccgggcgcggcctggggcatcttcggcgacatgcccgagggcgtgcgacgcctcttcttcctcgtggtgagtctggcggccatgggcttcatcttcgtgatgtaccggcgcacgcccatggagcagcggctggcccgggtggccctggcgctggtgacgggtggtgcgctgggcaacttcgtggaccggttgttgcgtggctacgtcatcgacttcatcgactggcactggcgcaaccagccggggatgcgctggccgaccttcaacgtggcggacgtggccatcagcgtcggggtgggtctcatgctgctggactcgctgcgggcgccgaaaagccccaatccgtgacgggcgggcggcggctggtgtaagtcccggcccgtgccgcgcaaatacatcatcctcctcgccgtcacccttggcgtcatcgtgctcgaccagtggacgaagtacctcgtcgtccgcgagctgaccacccagatggaaggcaaggagagcctgggcgagcgcctggcctcgatgtactccgagccgccccccaaggggcttcacggggatgcactatcagccccggcggcacatcgagatttcggagtcgttcttccgcatccgctacctggagaacccgggcgccgcgtggggcatgttccggagcatgccgcctgaggcgcgggtaccgctcttccacgtggccatcattggcgcgctcatcctcatcactttcagcttccgcaagctgaccggcacggacccggaagagaagtgggcgctgtgggggctgccgttggtgctgggcggcgcgctgggcaactacatcgaccgcgtcgcccgggccttcgtcatcgacttcctcgaggtccactggttcgacaaggcgaccttcccgtccttcaacgtcgccgacgcggccatctgcattggcgtgggcatgctcatcatcgactccttcgtccgcaaggagaagccggcccaggcccccacccaggcctaggccgccgcatcgggccgagcagccaggcggcccggatgcgcgcatgcgtgtcgtcccgcccgcgcaacgagggtagccttcgttgccatgctccccgtcctcgtccacctcaccttcacttcgctctggtcgcagctcctgctgtacgcgatggccgcgggcacggtgggctacgtcgtcttcaatggctggcgcagcgccgagggtgagttggatgcccggacgggcacgcgcgtgccagtgtccgcgcaagaccggctgctgcgggccgcggggtatggcgtcgtgggcgcggtgctggcctggttcgccctgcagtactcgctgccgcccggggcctttccgggtgccaagggcgagggcatccccgtgcacacctatggcctgctgctggccctgggcttcatcaccgcggtgacggtggcgggccggctggcgcaggacgaatggcgcacgctggagctgaaggacggggcgtgggtggacgtggaggggccgaagaagcgcgagcaaatcatggacatgacggtctggattctgctcggcggtatcggcgggagccggctgctcttcgtgctcgtgaactggcaggactacgcccgtgactggacgcaggtgttctccctgggcggagggctcgtcttctatggcggcctgattggcgcgtccgtggccgcgttcgtgttcgcgcggatgcatggtctggatttctggcgcctcgctgacgtgtgcatccccaccgtgtcgttgggccagtgcctgggccgcctgggctgcttcagcgcgggttgctgctggggggacgtggcgcccgcgcatgccgccaccgccgtgcacttccccggcagcggggtggcgcaggacctcctgggcggggtgggcaacacgtccagcctggcgtattcatcccaactccaggacacgcggtacgtcgtggaagctacgggtgaaatcttccaccacgccgcgcctggcgcggtacgcatctcggattgggtggcgcagcagggctacaccctgggggtgtaccccacccagctcttcgagtccgtcgggcaactggtgctcttcgtggggctgctgtacgcccggcgctaccgccgcttccatggccacgtcctggcgttctggctgatggcctatgcggtgctgaggagcacggtggagctgttccgtggggacgtggagcgcggcaccctgcacggcctgctccagtcgctgggggcgggggagctggcggcggcggtgccgctggaggcgtggtacaatgtctccaccagccagttcatctccctgtgcatgttcacctttggcgcggtgctgctcgcccagaagggccgccgccgggagagcgaggcggaaagcctggggcctaccccctcggctgcgtgaggttgaatcgcgcgggcctcttggggacactctgaggagtcatgccgccccccgacgcccgacagtccgcatccaagagcttcgctggcaggtccaccccggccgaccccggctccagcgaggccgtcctccaggagtgcgaagccctggaggcggaggtcgccgtccttcgcaatctctacgaacagtacttcctgggcaacgagcgtcaggcgccgtcgcgcgctcacgaagacctcaagaagcggatgaacaagctgaagggcgcgttcatccgcagcacctccgccaagttccgcgtcgccggcctgtacaacaagttcctcacgtacgaacggttgtggatgcgcacgctccaggaaatcgaagcgggcacctatcgccgggatgtcttcaaggcgcgccgccgcgcggagacccggaaggccggcgcgacgggcacggcggggcagaagggcgtggtcgagttgccggaggacatctccgacatggacttcgaggaggtggaggagttgatccgcccccgtcccgtcaacgagccgcaggtggccgccagctttctccaagccacgggtggagcgccgtcgaagggcccgcctgcggtcgcgccgctgacgcccgccattgcgcccctcacgcccgcggtgggaagcacgccgctgcgaggcgcccccgccgttgcgccgctgacaggcattccctccgtggcgcccgtggcggggacacctccgcgcgggcagcccactgtgacgcccgcggcgggtggcacgcctgcgcacggcacgtcggtggcgccgccgggcatggcggcgaaggcaccgggcgccgtggccagcacgccgcctccgtcgaggacttctgccgtcggcgcgagcagcacgccgcctccgtcgcggcccgtggccaccggcgccgggagcatggctcccccgccgagggcgcccggcacgggcacggccggcaacatccctccgccgtcgcggcccgcttcgatgccgccttcctctgccgcatcccggcccccctcggcgagcggcggaggcgggttggcggatgacaagctgcgtgccgtctacgacgcgtacgtcaccgcgaagcgccgctgccaggaggacacgtcgaagctgtcctacgagtcggtggcggccacgttgcgcaagcaggtgccggagctgctcaagcagcacaacgcgaaggcggtggagttcaaggtcgtcatcaaggacggcaaggcatcgctcaaggccgtgccgaagtagacgtcaccggacagtgcgcgggcggccgcacgtcgttggctggacgcaggtgtgcgcgcatccccttccgccgccgacctgccccccgcgccaccagtgtcgggaatcgtcgcctgctgaaagaacgactgcctctgctgcttgggcgggttgtcgccccgggggtgcctccctagcttgcgtttcgcgtaagcggccggtgggcggcgcgagacactgcgggaggcgacgtggggattcggcggaggtggctcgggctttccatggtgatgggactctccctgggcacggggtgcatgtcgccctctcaggaggctcaggagcgtctcgcggcgctggaggccgaaggcgaggcgatggacgcggtgctcgactccgtcgaggagcggctcctgggcaaccaggccatgctccagacgtggcaggagcttggtcgccgccaccagcaagtgacgcagctgcactgcgagacgtccgacccacacatgatcgcgatgatgaagcactacaagaagcaggaggaccgcgcgcgtcagctcaagcggcgcggcagtggtgtcgcctcggtggacaaggcggtgctcacctccggcaaggcgccgcgcggcaacaactgacggcgctcagacgctgagcctttcgcggaagcgctgcgactggcggcgggacatctccacctcgcggcaccgcgcaggcgcagcgacaggacgaacagcgacgaaagggcgtggcgaaaatgcagcccatcttcaagccgggcgaggatgggatgctgccgtcgagcctcatcgagcgcggcctctgtcggccagcgccttgaaggggctcagcgtcgtcgcagaagccacgcgcgagcggaggggttcatcgcggcgacggcgcggaggaagaggctgggggccatgcggcgcaggcgccagccccagcgcgcatccgccatggggacggtgtagaggcttcgcgcgtccacggccttcaggagcctgcgcgcgacgacctccgggcccaggcgggcttcatccagcatcaagccggcgagggttcgaagcgtgtccttggtgtagtggcccgtgctggcgattcgggtgcgcaacaagctggggcacgccgcggtgacgccgatgccggtggccttcagttcggcgtggagtgtttcggagagcgcgatcacgcccgccttggacacgttgtaggccgccaggtcgggcacgtacacgagtcccgccgccgaggcgatgttgaggatgtggccggacccctgcctgcgcatccgggggacgaagacatggcagccgtggatgacgccccacaggttgatgtccagcacgcgcttccattcggagagtgacagctcgcccactgggcccgcgctgacgacgcccgcgttgttgaccagcaggtccacgccgcccagggcctgctccgcggcgtcggccatggcttcgacctgggccggctcggtgacatcacagacatggacgtgcgcttcgcctcccgcgcgggtgacgcgcagcgctgtctcctcggcggaggcggcgttgatgtcggtgacgagcacgcgggcccgtctgcgtgcgagctcctcgcagagcgcgcggcccaggccgctgcctgcacccgtgatgacggctcttggatgggatggaaggctcatgcgtgtcgttggcgctcagcatgtccttgtcgcggccttcgccgccatctccccggcggtgccttgacgcgagcgcccagaacggccctgacaccgggtgctccatgacacacccgacatccctgtcccaaaatcgcgaacgcggctcctggcgccaggcgagcgagcggggcgtcagtgacgacgcgggcgaatccgggtacaaccgccgccgtgagacgcgccttgtgcggagcgttcgccgccatcgcggtgggcctcttcggatgcaacgacttggaagtctgtggctcgacggccagcgccatcacgcgtgatggcggggagccctaccgctgcgtcacgtccgaggactgcccgcgcacctcgcgggtcaacgtctgcgtcaccgacgtctcgccagtggaagtctgcgtccgctgtcaggacacgaagtgcgtcaccgtgacgccggaggcctgcgactgatgaagtccttgcggctcgcgctcgccgtgctgtccctggccgccacggcgtgccgggacaagcccgtggaccatctccagcgggcccgtgacgccaccttcgagaagcggcccgacgaggcgctcgtcgagtaccgcaaggccttcgacgcgcttcgccacgactcctcaccggaggcgctggtgctccgcgcgcgcgccctcaagggggccgcggatgtctactggctggagcagcgcaaggtgaaggaggcggtgggcgtctaccgcgagctcatccagcagtgccccgagtcgccggaggcgctcgagtcccgcatcatcctggcggacctgctgcgcgtgcattaccgcgacctgcgcggcgccatcgaccagctcactgcggccctcaagctcaatccgccgcagggcgcggagctgcactacctggtcaccaagctctacttcgagttgggcgactatcagcagtgcgagctggagacccgccgagtcatggagcgcttccccacgagcgcctacgtggatgacgccctgtacctccaagcccaggccatcgcgatgatggagggccgccgccaggaggcctcccgcaccttcgcggacctgcgcacgcgcttcccggactccgagctggcgccgcacgccctcttcgagatgggcaagctgcgcgccgacgccggagagaacgagaaggccatcgagacgtgggtggatgcgctgaagacacaccctgaccccgcgctggtgcaggactacatcgcgagggcgcgtcggcgcatcgccaacaccacggccgcgggcgtggggcagcgcgaggtggccttcgaccgcgtccgcccggcgcgtacgtcgctggaagccgtcggtggccgccccgaggaagccgcgcacgagcacgactgacgcggggcggacgcgccgccctacgccgggacgtccagcgtcgcttccagcaggttcgcggggcccgccccatcttcggagagggccgccaggagcagccgcacgcgcccctgttccacccgggcatccacgcctgtcactgtcacgtggccctccagcgcgtcgaggaactgcggcgagccatccggcgccagcacgcccacgacggagccgctcacggttgccgtcgggccggtgctccccgcggtcgcggtgaagaccatccgcccgccaggaagcggcgacgccgccgtgaaggacagccgcatgcctccggcctgtcccagctcccatcggcgcgtcatgcgcactacgtccgggcccagcgcgccggcttccagtccgcgcagtacccgctccgcgtccaggtccacgagggcgtcggtgccgggctcgccgctgccgcgctggagcaaccgcatcagtccgcccgacatcgccgccccggcgatgcggagcggtccgaactcccggctgatctgggtgtacagcgccgtgacgtccacggcccgggcatctcccgccagggtgccgtccgcgcccagggcgaccagcgcgccgcgctgcctgcccgcggagatgcccgacggcagcatcagcagcgaaccgtggggcgagctgccctggggcgccagcaggcagggcacctccaggtcgggctgcgacgacttgagggagacgggcgcttcgggctggtggttcgcgaagagcaccacgccatgaccgggacttgccctcgacagggggaacgcggccaggtgcagcggctcatccgcgacggtgtagagccagtcgcccgagcggaccagtccgatcgaggcggtgacgtgagacggacgtcctggcgcggcgggcgcctccaggtcgagggtgcgccgtggggtcaggtgaagcatggccgtgtctcccgcgaagccgcggcctcacgggccccggcgcttcagagcagcgtaccgcgcagcaggaggctggcgacggtgaagtagatgaggacgccgctaacgtccaccagtgtggccacgaagggagcggaggcgctcgcggggtcgaagccgaactttcgcagcaccaagggcagcatggagccggccagggtgccgaacgtcaccacgcccagcacggacagggcgacggtgatgcccagcaccaaggcgtgctccccgtagacgccggagatggagttccagatgaggatgcgcgccagacccaccacacccagcaccacgcccagcaccagtccggagagcagctctcggcgagccacgcgccaccagtccctcagtcgcatctcgcccagcgcgagcgagcggatgatgagcgtggaggcctgactgccggagttgccgcccgaggagatgatgagcggcacgaagaggctcagcaccacggcggtggcgatttcgtcctcgaagctgctcatcgcggtggcggtgagcatctgccctaggaagagcaccagcagccagccgatgcgcttcttcagcatgccgaagaagccggtctcgaaatagggcgcctccagggcctccataccgccggccttctggatgtcctcggtggcctcttcctggacgacgtcgacgatgtcgtccaccgtgacgatgcccttcatccgctgctggacgtcgagcaccggcagggccatgaagccgtgctcggtgaacagccggctcacggcctcctggtcggtgtcttccgacacggtgatgacgtcgcgctgcatgacgtccgccacgcgcttgtcgctggccgtctggaagagctgacgcagggacagcacgcccagcaggtgctgttcggcgtcgagcacataggcgtagtagacggtctccacccgctcccgcgcctgcttgcgcaggtagctgatggcctcgtcgatggacatgtccggccgcacgcgagcgaagcgcggattcatcagaccgccggcgtcgtcctccgcgtaggccaggagcacgttgacttcgcggcggctggcgtcgtcgagctgcgagaggatggactccgcctgctcgggctccaccgcctgtaccaggtcggccaggtcgtccgggggcagcagccggacccaggtccgtcgctcggccggctgaaggtggaggatgagctccgcctgctcacgcgccgacaacgccaggaagaagtcgtccgccaccgaagcgggaagcaaccggaagccctccagccgctcatcgacggagagcacgggccacgcctcgtgcagttcctccatggagagcgcggcgctctgggggctttccatcatgggggctcacctccgggcgtgtagggtggagcgcgtggtgccgcggcgcgcgggcctctctacacccggaaggccaggtatcgcgagaggcaggcaggcgacatttcgcgctttccttccgtgtgtgccccaaccgtctcgttatttcaacgaagacgcacgccgttcgtacacccgcgtgccgccgaggccctgcccgccgccggcctcccagtagaagcgcggagagagggttcgcagtccgggagacaggtccgcgttgcccggcagcagctccagtcccagcgggccctgtgactcgggcggcacgggcactgcggagccgatgcgtgactgccgccactggatgaaggggatggcgaagccggggcggaggggcgcgctcaccaactcgagcggcgcgtccacgaccagggtgcctcgttcggtcagcgcgccatccaccgcggcccaccggtacagcgtctgtcctggctgcggcgggagcagggtgtccacgcgggtccacaccgcgccagcctcgatgcccgctggcacgcccggcaggcgctgacacggcgcctccgaggcgacgaaggccccgctcgggcccaaccggaacgtgcacgcgcggctgtcgggttcctgcgtcacctggatgacgctgaccgtgtcggggcccagacgcacgagcaggcccagcaccatgtcgacgccgaagggcaactggttggcccgtccccacggagtgggggtggcaccaacgacgacaccttctgaggtgaaggcaaagcggtgcaggcgctccgagtcgagcacccacagctcatccgcggtggcgagccggttctggatgaccttcatggtgtcgcgctggttgagcaggagcgagccggtgagttcgagttccgagcccgtgtcgacgaagcggcgcacccggtcctcgcccacgacccagacgacatctcccgcgacggccacgtcgggcatgccggagacgccgccgagtggcgtctgggttccgttcgccgtgtgcaccgccacaccgtcacacagccaggtgccatgcgtggtgcggtccagttgcgtgcagcggggcagcgggagcactgtcggctctcctccggtccacgcgcgtgacacgtaggcgccgaactgctggaggctgcccaccggggcgaaggcgacgcggacgtggtggcgtccggtggtcgtcggggtgaagcggacggtggccgcctgtccattgccggtgagggacgcctccgaggccacggcgtggttgttcgggtcgaacacctccgccgtgatgctgtcggggacctgggaagtatcgaggccctcacaggtggagttcaggctcggctggacatggagctccgccgggagctccagcgacagcaggggcgggagctgtcccaggcctcctggcagcgggacgaggtcgcagtcatcgccggtgtccgcacacccggacaggaacaacatcgcggaccatgcgagcaggcagggaacggtcttcatcgaggggacgccgcccgggtgacctcggcctgggggaggcggcgcaggctccagggccttcttaccccatccgctggccgggccggtgacaggcgtggtgccgtgtcaggccccgcgcttccagcgcgtcatttttcacagaaaggagcggtgacatgcagacgacgaacctgacgagcccgatgaatcccgacaccttgaacgacactgtcatcggcatcggcgtgctcgcgcccgtcgccctgctgcccgctcccgtgctgcctggtctacccattggcggtagatggcccggactctgacgcctttcgcccgtccatcgacgtggcatggcaggccagaggtcgggctccccgagggaacccggcctctttcttttccgggtcgtggcagcacatgcggtcgtggccgagtggtcaggcccctggtcgccatccaggtgaacacgggttcgaatcccgtcgaccgctttccggcagcccacccgggttgccgtcatcgaagaacgccgcggtagcccaactggtagaggcactgcactcagaatgcagatcgtgcgggttcgaatcccgcccgcggcaagttttccgagtccaaggacgcatggttggcaacggccttcgtccgtgttgcacctgtgtcgcatgtgggcgcaacaggcaggtccccaggacgctgacggcgttcctccgcgtatccggcctgagatgggcgtaccgcttttccgtcatgtcgatggcggcgtgtggcccatcgatcctgaatgaccttccgcggaacgcctcggaacgcctcgcatggcgaggtggcttgcgtcggtgtggcgcaagtcgagccagccgatgattcccacctcgcgagtgatgcccgctcgtcgaagcgagtgctgaagcggcctgtccatcctgtgggcagtcagcggcttgccgtcatccaggcagaacacgtagggcccgcgcaggtgccggtgctccttgatcgcgtccgtcacccaacgccagatggcccgcctggttcgacgactacaaccgctgccaccctcatcgcggtccgtattgccaattcccaagcctgagctgtccgatttgacgagggcagctccactgcccagcatccagcctgtcgactcacaagctactgcggtggacaaaacggcctcgccgggctagtaggccagccgcaccagctgcaatcagttcagattgcagccctgcccggacgagatgcgccgtacccggttacgtaagacgacgccctgaccaggggtgcgtcatgtcgtggctgcttgttctcgttgctgggttgctggagacgtgctgggctgtgggcctcaagtatacgcagggcttcacccggccttggcccagtctctttgttgccgtcacgttgattagcagcttggcgctgctgtccattgcgatgcgcacgctgccggccggaactgcgtacgcggtttgggttggaattggggccttgggcgccgcgcttgttggcatcgtgctcttccgtgagccggccacactggggcgcttcttcttcctcggactcatggtcgtctctgtcatcggcctgaagttcaccagcggcggggacgcgcactaggggctgtctatccgagcgcgcgcagtacgtatcgagccctggcgacgacgcgcgctgcgcctatcggctgagcctcatcaacgccatggtggcgcaccacggttactcggccgtgtgcgacggccaggtgaaggagatgtcccatggaccccatcacgcctccgctcgccctcggccagaagcacgtcgtcgtgctgggtgcgggcttcgccggactcacggccgccaaggcgctcgcgcgccactcggcgctgtacgtgacggtcctcgaccagcgcaaccatcacctcttccagccgctgctctaccaggtggctactagcggactgagccccgcggacatcgcggtgcccatccgctcgcagttcgcacgcaagcccaatgtgtcggtgcacttgggccgcgtcacgtgggtgaacctcaaggaacgctgggtgggcggtgagggcgacgtgcggctgcgctacgactacctcgtcatcgcgtgcggcgcgcagcacagctacttcggcaagtcggagtgggaggacttcgccccgggactcaagacgctggagcaggcgacggagttgcgccgccgcatcctcagcgccttcgagcaggcggaaaacgagcgcgacgccgagcgccagcgcgcgctcctgagcttcgtcgtcgtgggcgcgggcccgacgggcgtggaactggcgggcgccatcgcggacatcagccgcacggtgctggtgcgcgatttccgtcgcatcaaaccgtcccgcgcgcgcgtcttcctcgtggaggcgggcccacgcattctgccgtccttcagcgagaagctgggagtgcgtgcgcaccgcgaccttgcggccctgggcgtggaagtgcgcacggaggcacgcgtgacggcggtggacgccgagggtgtgatgctcggctccgagcgcctggcctcgcgcacggtggtgtgggctgcaggtgtgcaggccgagtacctcacgcgcgggctcggcgtgccgctggaccgcgcggggcgcgtgcaggtggcggcggatctcacgctgcccggccacccggaggtcttcgccgcgggtgacgtggcccacgtggagctggacggtaagctcgtgcccggtgtcgcgcctgcggccatgcagatgggccgggccgtggcgcgcaacgtcctcgcggacctgcgcggccgcccccgcacgcccttccgctacaaggacaagggcgcgatggccaccatcggcaagcaccgggccatcgcggagacgggccgcgccaggctgacgggcttcgtcgcgtgggtggcgtggctcttcatccacgtctggtacctggtgggcttcaagaaccgcttcggcgtgttcgtcacgtgggtgtggagttacctgttcagcacgcgcggcgcgcggctcatcacggagcgcgagtggcggttgagtccgaaggtcgcgtctgagcgcgcgccgcacgcgggcaaggtgacggcgggcgaccccacggcgcccaccagtgatgcacggccgccggacgggacgacgactacggccgctgccgccctcgtcgcggactgaagatgatgtcaccccgcgaattccgtactgctaattcccaaccccgagctgtccgatttgatgggggcaactccaggcgcgctcctgctggggtttcgctccacccggtcgcgggttcgaatccagtcgtcccgactgccactacccctccatcggcgagcagagctccaccaggacgccgttgatgtctctcacgtaggccaccgtctgtccccagggcttctgcttgggaggttgcgtggcctcggcgcccgcctccacggcgcgtgtgtacgcggtggccacgtcgggagtgacgagcgccagttcgatggccgcggcgtcttccttcggccgcagatggcgcacggtgaagccatgctccttcgccgcgccttcctcgacgaaggcgagggcggtggtgcctgtctccatctccgcgtagccaccgctctcgtggatgaagcggcgcgccagtccgaaggccttctcgtagaagacgatggcggcgctcacgtccggtacgtagaggatgatgtagccgagcttcatggcggactcctgttggtcagtgggacgtctgtgtgagtgcgtcgtcacacggatggcacgggcctgtcttgaaggaatcggacagcgctcaacccacgagtgcggtgggcgacacgccggccagttcccgcacgtctcgtgacaaatgcgcctggtccgcgtagccgcattcgagcgcgacgtcacacaggtccgtgccctcacgggagcgcagcagggacaccgcccgctggaggcgcagcacgcgcgcgagcagcttcggcggtacgccggcttcgtccaggatgtcccggtgcagggtgcgctcactcacgcccagctcgcgagcgagcgcggccatgcgcacctgtcccgacgaggcttggaggtgtcccagggcctggacggcgcgcggcttcgccatgctccggaacgaagcccagcgtcgggcgatggtgcgctggagcagggccatggcctgggcgggcgaggcgcagtcttccatccgccgctgaaactgcatgagggcgggcgagcagtcctgggcggagacgttgagtccgcagagttcacgcggactgacacccagcagggcctgcgcccagccagggcggagcctgacgcccaggctcaccccgccgggctcgaggtcgacgaggatgaagcgcttcatggggccgacgacggccagccggggtgcggccagccacaccgggcctggggcgtgttggaatccgaagatgaggtcggtgcagccatccggaaggacccggtgctgccgggggagggggacgtcgtggggctttcggggcacccagaactgccagaacgcgtccaccgcatccgccatctcgataggcggtgcccactgggtgtagccctgctgctgtgcgtcctccgccatcgcgtccctgtcttcagcccgtgcacagcctgtcaggccctgtgcggccattgcgtccatttcccatgaaaggagcggtggccatgaagacggcgaacctgacgagcccgatgaatcccgacaccctgaacgatactgtcatcggcatcgatgcgctcgcactcgctggccgggccaccgctcgtgattccaagcggggggcgacctcccgtcgagatctcccgcctgggttttgacccaccgtgccccgtcgaaggacagggcatggcagggcaagaggccgggctccccgaggggacccggcctctttcttttccgggtcaaccccactgctccgggatgcgattggaatcgcagcacggccgtctaccgtgtgaacagggttcgattccctgtcggagcgctcatccccgaggtgacgcccatgaatcccctccccatcgagtccgagccggaagacctgttcgacggcatcgcttccttctgacaccgcgcctcgtggctggggcgctctcgcagtcgcagttccggtcttgtagctcaggggatagagcactcggttgcggaccgagaggccgcaggttcgactcctgccaggaccactcctccttcagttgtctggtgcaccgtgggtatggcaagtgagggccattccgtcatggatgacgcgacctccctcttgctggacactccgtgagcccggtcaccctgcaaatcaacctcgcgccgacggactatccgcacgcgcgcctcatccttccgcatcagttgcgccagctcgggccctccgtgcaggaggtgctgctcgtgctggacctgcaccgcagccagggcagccgcttcgcgggggcatggctggagcgaaagccgaagatggacgcgctgctgtcggagctgtcctcggcggatccgcgcatccggctggtggaggtggactactcccccgccgtcacgaagtcactctccgagcagttcttcggaggctcccggctgcccatgaaggactcgcgcggcgggcccttccattcctacttcttcgggctcgcggcggcgaagcacccgcacgtgatgcacctggatgccgacatgctcgtcggcggagcgtcgcgcgcctggatggcggaggcggccgcgcagctcgcgtcacgcgaggagttggtgagctgcagtcccttgtcgggcccgccgcgtgcggacgggacgattgcgggagacagtcgctggtacgagcccgatgcacagggctcccacgcgttccgtttccggcgcttcagtagccgggccttcttcgtggaccgcgatgcactggtgcgccggataggcccgctgcaggcgaagctggcgccgcccattcacgtgctgcgtgccttacgcgcgggcaatccgccgtaccgcgagccggagaacctggtcacccggaggctcaagcgtcgcgggttgtggcggctggacttcctgggcgccgcgccgggcctgtggacattgcatccccagtaccgttcgcccacgttctacgagcggctgccggagctggtttcgcgagtggagtcaggggacatgcctgacgcccaacgcggccaggagaacgtgcacgactgcctggtggactggtccgatgtgagggccgcgcggcggaagtggtggcgacgcgggtagtgcccgcacttccgcccggggcctctggcgtcagcccaggggcgactcggaggtgacgatgccgtccagatccgcgtagacgtagtggccggggcggaaggtgactccggcgaagcggacctccacgtcacgttgtccctcgttgcgtttgaggctcttgagcgggtgggtgcccagcgccttgacgccgatgcgcatgcggcccacgtcctcggcgtctcggatgcagccattcaccaccacgcccgcccagccattctgctgggcgagcaacgcgagctggtctcccacgagcgcgcagcggcggctgcctcctccgtccactaccagcacccggccctggccgggctcctccaaggccttgcgcacgagggagttgtcctcgggtgcccgcaccgtgctgatgggacccgcgaaggtccggacgccgccgtagtcctggaacccgggctcggcaatctggaaccgcggcgtgcccgcgtgggcatcgcagaggtcggccgttttgaagtcggtgaacgtgctcatgggcttcgagccttctcaggcctcgcgggacgacgcaacgtccagggcgcggaggtcctcctccgtcagttgcaacgtgaacgcacccagcagttcctgtgtctggctggcggacgtcgcgctcgcgatgggcgccacgatggtgggctgagccgcgagccacgcgagcgcgacctgggcgaagttcgctcccggatgccggcgcgttacggcctccagggcatcaatcaccgcccagcctcgcgcgtttccatactgcttcagcacgccttcggcgcgggccgacttcggaggtggctggtccttgcggtacttgcccgtcaggaagcccgaggccaacgcgaagtagggcgccaccacgagcccttcccgttcgcagatgccccggagcgatgactcgaagtccttgcgctcgacgaggttgtagtgcggttgcagcaccgcgtaccgggcgaggttgttgcggcgggacacctccagcgactcggtgagccgctgcggggagtggttgctggtgcccagtgcgcggaccttgccggcgcgcaccagcgcgtcgaaggccgccatcgtctcctccactggcgtgtccaggtcctcgtagtgcgcgtagtagaggtcgatgacgtccacctgcaaccggcgcagcgaggcctccacgctgcgctggatgtgctcgcggcccaggcccttccccagctctgtttgcgagcccaccttggtggcgatgacgacgcgctcccgagcgccgcgcgacttcagccacttgccgatgagcgtctccgactcgccgccgcggttgccggggacccagctcgaatagacgtcagctgtgtcgatgaagttgccgccgttgtcgacgaaggcatcgagcaccgcgaacgaggtcgcctcgtcggctgtccaaccgaagacgttccctcccaggcacaggggggatacctgaaggcccgtggttccgagtgccttgcgtgcttcgagcttcgtctggggcattgcctgtcgctccctcggtgagtggtcggcccgcgggccgtggccggcgtagctaacgcgtcccgaggcagggtgcaggtcaaaatgccccgttcatcggtgagagtgtctccgtgcggtatcgagcatttcccaccgctggggatgctccgcgagcagtgcaatccagggattcacttcgtctcgagccgcggcgttcgtgtcacggagccgctcgaggacgggcacggcgcggctcaggcccagccgggagatggattccagcagcgctgcgcgcacgctcgcctcaggctcagcgctgtagcgggcggcgagtgcatcgaggctcgcggagagctctgtcacgggcgaggtcgccagggcccgtgcagccgcggcacgcacgacgggggacttcggtgactggagcaatgtacggacctgcgccacggacggccctctcaccgcttcgatggaagacgcgcccaggagtcctgctgccgtggccgggtcttccgcgacggtggccagcgacaccgctcgctccgccaccacgcggtagcggccggcgttgcgagcagcttcctcccggaagttctccaccgcggccgcgcggacttcgggcgctgcgtccgtcacccagtcgcggtagacgtctcggccctggaggacctggatgcccaacagttgggtggagggctcccccgtctgttgcagtgaacgaatcaacacggcacgcaggcgcgcgtcgggtgtctcacttacgcggtccaccagccgctccaggatgcgggcctgtccctccagggcgtagcgcagcacccaggtgtcggagagcaaggccagcacgtcagcgtcctgctcgtcgctgaggtgctgccaatgcacgtcctcggacagggactccacgagtccgcggagctgttctcgcacgtaacgccgatacgctggtgaggcgtggccctggcgatattccgcgaggagcgcggtgaactcacacggcacttccttcagcggctgcgcatgggcgggcaggggcgggcgcgtcgaaggtccggcgtcagcggcctgcggcgtcgaggcatcgaggacaggggcggtgttcctttctggagcacgcccgaggcgtgtgcccaccacggctgcgcccaacgccccggcgaggaggacccagccgaaccttccacgcggattcctcatggcgttcgggcctccacgtcctcagggcagcggtgatacacgcgcttgttcagccacagccggtcgaagtccacgtgccccgcgtcgtagagcgcctggaagtcggcgacgtctcgagcgaatcggcggtcctgcttcgagtagtcccgcacttggggaagggcctcggcgccaccggcccggagcgtgtagcgcaggagcgcccagcgcacgcacaggcgctgctctccaggaaacgcggcactgaagtgattcagcaccgcgcgcgtgtcgcggccatcggacagcgccagggccgccagctcccggacgttggcgtctgcgtcattctcgagcacccaggccaattgctccacggcccgcgcatccagtcgcacggacaaggatgcagccagctccaccgccagggcgcggatgtgacggtcctcggactcccgcgccagtgtcaggagccgcgtgaggtagggctcctccgagccccctgcctggaagtcattcttcatcaccctgcccagggttctcaccgcgagcagggacacgccctgtggggccgtgcttctcctggccaacgccatcagccggtcctgcgcaggggcgccgaagcgcgcctgtgtctccagtgcctgcagcgcctgtgcgcggtggtcgatggatgcgtgctgctccgccatcgtgaggagccgctcggccacccgtgcatccctcaccgcggaggcttcacgcaggcccgccagcagcacggaggcttcgggccccggtgcggtgtcagcccagtcgagcacctgaagcgcggccagggcgtcttcacccaggacttccggaatccgttcggtgaggaaggtgagggcggcggggtcgttctgcgccagggcctgctggatggcggctcgcaccgtcggcagcccgtgaagttgttcgaagtccaaatagcccgcgcggcaggtgaggcgtggaagacgttggaggggcggcttggcggccatggcgggagggacgccacacacgaggagcggcaagagcgcgcgggcccagcctcggactcgtgcgcgaagggcctggctgtagggaggggaggcgggcatggcgcgtgtcgagccccggacgatgcgtcgctgaaaccatccaatttagtcagatttacaagaaagacggtttcttccgcactgcctgagactgtccataatgtgtcgacgacggcacgaagaagcggggggcatgggagcgggcgtgcggggacacagactgcctcgtgccgcatgttatggaacgagccatgaaccacgctcacagtcaggctctcttcgctcgcgcgcaggctcgcatccccggcggagtgaattccccggtgcgcgccttccgaggcgttggcggcgaccctgtcttcttccgtgaaggcgcaggtgcctggctcacggatgtggacggcaaccgctacgttgacctcgtggggagctggggtccgcttatcctgggccacgcgtatccgcccatcttggacgccatcatcgacgccgcgcgccggggttcgtcctatggcgcgccgcatgcggatgaggtggagttcgcggagctcatctgcgccaccatgcccgcggtggagatggtgcgcctggtctccagtggcaccgaggccacggtggcggccatccgcgtcgcgcgaggcttcaccggccgcgagcacatcctcaagttcgaaggctgcttccacggcgcgggagacccgttcctggtgaaggcgggcagtggcgtggagacgctgggcctgccggactctccgggcgtgccgtcggcgctggcgaagctcacgctcaccgcgcccttcaacgacctggccgccgtggagcgcatcttcgcggagaatggccaggacatcgcttgcgccatcatcgagccggtggtgggcaacatgggcgtgctggtgccgaagccgggctatctcgaagggctgcaggcgctctgccagaagcacggcgtgctgctggtgctggacgaggtcatgacgggcttccggctgtcgcgaggcggcgcgcaggagctgtacggcctcaagccggacctcaccaccatggcgaaggtgattggcgggggcatgccgatgggcgcgtatggtggcccccgcgacatcatggagaaggtggctcccgcgggcccggtgtgccagtccggcacgctgtcggggaacccggtggcggtggcggcgggccttgcgtgcctcaaggccctggcggcccccggcacctacgcgcggctggaggaggtcagccgcatgttggaggtcggcttgctcgccgaggcgaaggccgcggacgtgcccgtcaccgtcaaccgcgtgggcagcatgctcacggtgttcttcaccggtgagcccgtctacgactacaccagcgcgaagaaggcggacacggcgcgcttcgggaagttcttccacgccatgctgaacgaaagcgtctacctgccgcccagccagttcgaggcggcgttcgtgtcgctggccattggcgagccggaagtcgcgcacgtcctcgcggcggcgagaaaggccttccgttcgcttggcaagaccggttgagcccgcgcccctcgaggggcccgttcgcttcggtccctataccctcgtgcgccgcatcggcgccggggggatgggagaggtgttcctcgcgcgtgaggaggcgcctcgtcgtgcctgtgtggtgaagaaggtcctcccgcagctcatggcgagcccgcagttcgccggacgcttccgggatgaagcccgcgtcgtggtgcggctgcaccatccgaacatcgcgcgcgtgtacgccatgggcgaggtggaagggcagctctacctgtccatggagtacgtgcagggcaagacgctcagccggctgacgtaccggttgcggcagctcgggcggacgctgccgctgggcatcatgctccacctggggcagcggctctgtgagggcctggcctacgcgcacgacgcgacggatgagttcggcaatccgctgcacctggtccaccgggatttgtctcccgcgaacgtgtgcatcagctacgcgggcgaggtgaaaatcatcgacttcggcgcggcgcagtccacgctgaaggagcagcagacggcgccccgggtggtgattggcaacctgacgtacatggcaccggagcaggcgcgaaagcgcttcgtggaccggcgcgcggacgtgtacgcggtgggcgcgctgctgtgggagttgttcgcgtggaagcccctggcgcagcggggcgacccggtggagcggtggcggcgcgcggcctaccctcagtgggagccagcggggagtgtccggcagggcgtgcctaccagcgtggatgcgttcctgatgcgcgcgctggcctcggagcctgacaatcgcttcccggacgcggccgccatgggcgcggaactggcgcggatgaaggcgaagctggcgcccaacgtgggggatgcggatgtcgcgcgcctcatcgcggccgcgttcccccgcgagaagaaggcggaggagctcgtgctccgcgaactgctgcgggagccgcgttcccgcgcactcaccgagcccgcgttggccaccgtgctcgctccgcctaccgcgctcgcgttcgagcacgaaggcatcgacgcgcccgaggactacgtcccggccgagcgtggcgacgctgagacctcgaaggcaccgtcgtccgcccacccgcctgatgcgaatgtcccagccgcgccggatgcctccgtgcgaggcacgccagcgaaggccgcgcacgccgcggatgagcttgaagtcacggtgcgagggattcctggaagggcgccggaggtgcctcgtgctgtgaatgcacctcgcgtcaccgcgctgtacgggacggaggacgaggcgaccgtggtggagggcggggcctcgcgagcgcgccggggcctccccggcggcgaacgggcacacctcggtgtggaggaggaggccaccgtcgtccatccatcgcgaggcccggtcgcgagcgtgccactcgatgcggacgaggagaccacggtcgttcagcccgaacgtgcccggatggcggcggacgctggcgtggcgtcgaagtccgacgtgggctctggggccgcgaactccggagcgagcctgggcggagacgcggcggccacagaagccgtcgatgcggcgaagctgatggtcgcgctcgaacgggcggaggccagccgaagccagggcgcccgtgccacggcgtccgaggatgtcaccgtgacggaggtgaatcccgccagggcgctccagtccttgtcgccccaggccgcgcagttgcgccgagctacccgtgagacgcaggtgggcttcggcgtggacatctcccaagcggtggatgctgcggcggtggaggcccgtcgtctggagttggtgcgcgccatcacgggggatgaagcgctgcccgtgccagagcccgaggaggacttcggcacatggcttcgcggcggtcgtccctggctcgtcgcggggctctgcgcgggtgcgtgtgccctggggctcgcgctggcttggacgctggcctgaagccagccgtgggcgtcagcttccccagggtagtcggtagctgaagcccaggcggatggtggcggtatcaatccagttgctggtgaagccgtcgccagactcgtcctcgttgtcgtccgacgtgcctcgcgccgccgcagtgtcccgtccgccgaggtgaagacatggttcgcgttgctcaggtggagtgacacgcccacggacagctcgcggtccggaccggacagcaggtcatacagatagctggcccggtagagcgggaagcggtagctcacgtccagcggcgtgcccgccgtcgtccgtgtggcggaacagggtgccgtcacggccctggcggatgctgtgagccagcacgtccaggaagcccagctctcccacgaacttcagctgcacccgaggctcgtctggagctgtgggcgcttgggcctggccggtgagggtgctcagacaaagaaggactcccaggacggcggttaccagccttcgcttaccgccgcggcggaggtgtccagcgggagatagagccggaaggtggtgccctggcccggctgggattccagcgcgacccggccctggtgcgactcgatgatgcgcttcaccaccgccagccccagtccggtgcccttggccttggtggtgaagaagggctcgaagatgcgcgcccgtacgtcaggggagatgcccggcccgctgtccacgaactgcacttcgacctcgggagtccccgtcgcgcgccggacactcgcgcgcagcatgccgccctgaggcatggcctgcacggcgttgatggcgaggttgaggaaggcctggcgcatcatccgctcgtccacggtcaccgaggggacatcgtccgccaggtccagttccacgcgcacctggcccggggcctccgccagcgcgcctcgcaccgcgtcctccaccaggggcgacagcggcacggcatagggatgcggcgcgggcggccgcgcgaaggtgagcaggtccgcgacgatgcggttgagccggtccgactcctccccgacgatgtccagcagcggcaccgccgcgctgtccggcccgacgatgcggcggatggacgcgactgagttgaagatggcacccagtggattgcgcacttcatgggcgaccacggcggacagctcgcccagcgcggccagccgttcgcggcgcaccaactgggcctgggtccgggccagctccacgtagctggcttgaaggtcctccaccagccgcgcgccctcgcgggccagcgccagttggttggcgatggcactggctcgctccacctccgcgaccgtgaagcgccgtggccgccgcgtctccaccgccatcatcacgcccatggggcgctcgtggaccaccagggggagcaccaggaatgctcgagcaccgggcaggcgccgcacctcctcgttgacgcgcaggtcggagcgggcgtcctctaccatcaccacctcgcgcgtgtggaacgccaccgacgcgagtgacgcatcggccgggaggagtggcagggcgggcccttgaagctccggtgagcctcccgtcatcgcgcgaagctggagccgttcccccgagacatccggcaggaacacgtatgcatccgacgtgtccacgatgcgcgccaggctggtggcgccaatgtgcaggagcttgtccagttccagggtggccgccagcgccttggccacctcgtgcagcaacgccaggtcctcggcgcggccacgaagctcatgcagcagccggtgggattcgatggccgccgcgaagtggctgcccatggcctgcaacgtctcccgttcgagcggcgtcaggggcctccgttcccggaagagggcggacagggtgcccacgccccgcgagcgcacccgcagggggacgaccaccacggtgcggaagccctgccggcgcagttcctcgcttagttcgtccggacaggactccacctcgcgctccagcgggatgccttctcgttgcgcctggaggcacaggtttccggctcgccagcgccgcgtgaagtcctccgagccttcggtgtccaggccgctcgagtacgcgagctccacttcgccgtcgtccgctggcaggagcaccgccaccgcgtcgcaacccaggagcccggcgatttcgtcggtccccggagcgaacagcgcctgtgggtgcggcgcggaggctgtcaccgaggccaggcggttgagcgccgccagcgccgtgttttgcgcggacaggcgggagatggtgagcgccgcgtccagcgccgcggacacctgcgcgccgaagagccgcacgggtggaagctcctcctcgcgcagccagtccgccaccagcgcgagcatggcccggggctgtgcctccacgtcgatgcgcaccgcgatggcacgcgtctgtccggcgcgctggatgccctggcgaaccagcacgccccgggcgcctcggaggaagcgctcggcctcctggggcaactcgtctgtataggccgcgccgtcgcgccaggcgcgcttcagcaggggaggccactggcccaccacatcccgtacccagcggccactcagtgccgcggcttccgtgggcaccatgccgggcggcacgaacgtctgtcccagccggacgcccagccggtctggcgaaagccacgcgcagccaagtcccagctcctccacgctggagaacatcctgcgcagcacctcgccctcggtgcgcagggagggcaggttcgcgcccagctcggccaaccgctggagcacgctgcggcgccgggccctcgccgacacgtcgcgcaccagcaccacccactccgtgccgctggggatgacggtcagctccacccgccgctccccttcggtggtgcgcagcatcgtttcgtacgtggtggggacgggctcgccgcgcttgcgtcgggcatggcgggacgccagctccgccgcgctttccgccgagacgaggagcgtggcgggctcacccagcacgccctcgcgcgggtagcccgacatcgtcaccagcgcttcgttcacatagacgaagcggccgtcacggacgacgcagacacccacggacatcgcatcgaaggggccgtaggctgccccgatttcggcggcggttttcacggcaggcctgactcttccaccgctgccagtccgtgcgaaattgctgacccgccgcttcgcccaccagcctacatcccggtgccagccctgcggcttgtacttagaacgggcccggccgcgcagggcagccgagcccgtgtcctcaggggtgctgtcgcccgcgccgaatcaggcgggagtggccccgggggactccgcgccgcggtggtggaccttggtgtacaggccgatgagctccgcctgtcccacgatgtggccttccatggccttccggagctgtgtgcgcgagacgcggcccaggtccggcagcaccgtgtccagggcgaacaggcggaagtagtaccggtgcatgcccacgggcggcatggggcccccgtagttctggcggtggaagtcgttctggccttggcgggcgccctccgggaggacgtccggcgtggcgccttccggtaggccctgcgccgaaggtgggatgttgtagacaacccagtgggagaaggtcatctggggattgcgcgggtctggcgcgtccggatcctccacgatgagggccaggctcttcgtcccggcaggcatgtccgtccattgaagcggcggtgagatgtcctcgccctcgccggtgtaggcaatgggaatgaggtcgccgtccttgaagcggggggacgtgagcacgagcggcttcggcatggagtcctccagaggtgtcgcggtgggttgacgcgtatcgggtgcaagctggcgacgcaggcgcccgggtgccgaggagcgggccggcgggcgttcggaggctggccacccggacgttggggcaggcgcgcccatccccatgcgcctgctctggccgccggaccccagcgcctcacccagagggggcccggaccctggcgagcccacgggaggggccctcgattccatgcggggcagatcggcggtagctgagcttgccgaagcggcaatcgccactgggggccggggggccgctgcccatggtaccggttgcgtgtgccgcgtgttcggtgttaagcggcgccccgcgtagaggggttggggcgacggggttggaaaagcgaggttttcccggggtttggggaggcgtccgaatggaagtgaaggagccccggaaaccgggcggttcggacggcagcgagctgggggagacggcccggcagatgagggcggcgcaaccctacatcgcggcggtgtggaagctggtgggtggagcggtggtgggcgtgctgggcggctactggctggatgggtggttggggacgggcccctggttgctggtggtgctgagcctggtgggtatctgcgtgggcttctatgggttcctccatgagatggcccggctggggatgcggaagtgacggcgcggggcggcggtagcgggacggactcgttcaagagtcatgcggcgctggcgggtggcgtggcggtggtgggcctggcgctggcggcgttgatgccgcaggtggtggaggaccgggtttcggcggtgtggggcgtggggctggcggcggtgacgggcgcggtggcgctggtgctgaaacggcgggcggtgcggcaggacctcaatgccgcgctgaaggtggtcggaatcatctttggccttcgggccgtgggcgtgttggcggggctgttgggcgtggtgtcgcggggaatggcggcggtgccgttcatcgccggcttcttcggcgtctacttcgcgctgcagtggattgaagtgagctacgtgatggccgcgtcgaaggaatcggcgggcggagacgagtgatgcgcaaggcaatggtgctgttcgccagtctgtttgctgccacggcgtgggccgcggggtctgaagacgacgtgccggggtacatcctccaccacgtcgtggactcaccctacctggagatcgaggtcccgcttagcagccccatccacgcgattg

SEQ ID NO: 1264 - DNA, 41310 bp, Myxococcus xanthus
  unsure (1)..(41310): unsure at all n locations
cacaccacgaccgcgggcacgacgcgcgaccacgagttgaaggtgtggtccgacgcttcgggtgcgagctacagcttcgtcttcaaccacgcgggcaaggtgcagtgcgccaccccgggcttccgggcggagtcgcgcctgcgggtccgcgccaccggctttgccgcccacaagagctgccgcttctgcgacccgctggcggccgagctggtggactccgacggccacgtcctctacccattcgccacgcagctcgatgacctcgtgctggtgcgcgagtgcattcagaccgacatcgtgctggagctggcgccgtgcgccttcgccgagtcgctgcaggcctggccggacaaggcggcctacgaggcctcgcgcaagccggggaaggcgctgctgggctcgcagttcttcatccccaaccctgcctcgctcatgtcgaagggcagccctcctcggcccgtcgagccccgagcccacttcaccgggcacgtcgaggccgcggacgtgcgcaccaacggcgtcaccggccacccgttccagcacgccctcgtgcggacctatggaggcacttatgacgtcctcgcggcggccgacgaggcgacgccccggctgcggcccggcaacatcgtgagggggaccttctggctggtggcgcgcgtgacggcggggctgggctgaacccggccgcgagagtggccatgaccttgcgcaggaagggcaccagtccattgtcgaggggaagcaggtcccgcatggcagccccgcttctcgctccacgactacgggcccttccccgccctcgcctccggtggcaaacacgcagtcgacggcgaagtgtacgaagtcgacgcgctcatgttggcggcgctcgacaggctcgagagccaccctcgcttctaccggcgcacgcccattaccctcgacgacgtcggccgcgtcgaggcatacctgtttcccaaggagcggttggctggccgccccatcatcgagtccggttgctggcgtcgatacctgaaggagaggaagcaatcgtaatcgtcatgcgcgacggtcgtgtcttccagggcacggccgtccaaatcgtgaaaggaatgcaggatatcgccttccgcgtggagcgcctctcgctgcccgagtacatcgactgggtggtgggcaacgcgcgcaggttcgacggagtggagctccaggcgcagggcaacatcggggaggagaaggcggcctcgctggtggacgaaatgctgcgtaccgggttggcgtcgaaggggtgaggccgcgtcctccctggtacccctccatccggagtccgagaagtccgtcctgacggccacgctccagcgtgagagtgcccgcgccgtcaaaggaggcgccgaagattcacatctttcccaagactcggtatgccagggcgcgacactttcgcgcgctcttctcatccgagggttcaatgaaacaacctactcgactgacagtcaggcctcaaacgttgattgcggtgcaggacgtgaaggcaagcagcacctggtaccagaccttgctgggagtccgctcggggtgcgagccggaccatccccatcgtctcgtctatgaccgactcatgagtggggacgccctcgttctccaactgcaccgctggaacgccgaggagcaccccaacctggttggtcccgacctggccccccatggccatggcgtccttctctggttcgaagttgatgaatttgatgttgccgtggaccgcgccagacatctgggcgctcaggtcatcgaagagccgcacgtcaaccctgcgccgcagcaccgagagatttggctcaaggacccagatggctatgtcgtcgtcctcgccagtccagacggagagtccgctgaggcgtgaagcctcgccgagtccgtcgcgtgcgcagcgtaggtcctgagtgctcccgggcccatgctcgactcagacccgtgggtggggcagaaggatgcgctggccgtccaggacggcgtcgagcacatccattggggtagcgattgaggctccacgccgttcagcttcaccgtctccaccgaggcgtcatttacgctgacacagaaagtctcatgcaccggcgcactcgcccggctgggcgccgcaaggattcaccctacgcttaccggagtgcctgcgagctcacgctccgcaagggccagggcatcgcggactcccagcgcatgaatcgcagccggctccgctgctcggtactcggccttcgcacggactagaggtgatctcagaattgcctcaagaggatgaggatgcagccgaggtggaggaagccgaggaagttctccaccttcacctcgtagcgggtgacgagacgacggaagttctgaagccaggcgaaaagccgctctaccttccagcggcgccggtatcgacgcagctcacgttcatcctgagtcttcgtcttgcgccctcgacggtgcggggcaatcagcttcactcccgctggcgccacagccgctcgtcgagtttgtcagcgtcataggccttgtcgccgatgagccgcgcgggaagctcgtcgatgaggctctcgtcgagggtggcttcgaggagcttggtttcgtggggagaagcgcttgccgcgccaatggcgagaggaagaccagcgcctcggggcgtcagcaactccgccactccagcagccactcgcgggggggcaagcgcgacattctgcagcagcagtacaacgggcaaactcattcccacgagagaagacgcgtcatcccatcgcacaacgaaacctgcctatgtgctcgctcgcgggcagtgctgagcgatcagttcgaggagttcgtcgaaatccatcggtttgcgcaaagaaggccactacgcccggaggtctgggtagtcctccaggagcaatacggatgcgcgtggcggcgtcggcatagtcacagggagccgctggtcatcgaagcgaatcccaacggcccctcctctcgttcaggctcggtctacaccagggagcgcctccgtgtccgcccagcccctgtactcactccgccgttcagaaacaaacacgccgcgcaacgttgacggaaatgtcgctcgctgcttcacgggtacaccgatttcagagtgggcagtgcgtcaaggcgagcaggagtccagtggagatgccccccgggaacgagggactcccgacgtcccgctcagcgagtcttctcctggtaggctttcaccagcgcgttgaggcgccgcccgctagggtcttccttcttcgggtcggcgataacgagcatcatcttgccggagaccgccgcggccccgacagaattgccgatgagactccaggccgcctcctcggcctgctgtgccttctccgcactttcgaacacgcataccgtggcatccaagccactcaccttgcccgcctgacattttccgcccgggagcttctcaccggcatcagtgaacgcggagggcgactctcccgactgcttgcacgcatccaccacgtcgtccacgccgctggagcagcccgccaacagcaacgtcaccattccaagagccacgctccgcacgctcagtcccgtcccttgaacttcttgtgcttgtgcttcttgtgcttgtgcttgtgcttgtgcttcttgtggacgtggtgctcgcagtggtcatggtgcacgtgcacatgctcatgccggatgacgtctcgctcccactcgggtgggggaggaggcggcgnccgtggtgtcccgacccgcacctcgacagagggcaatgggatgttcaggcccacctggatgacagggccgtggtactccggcggcggggccaacgtcaccaccgggcgtggggcactccaggagcggtacaccgtattgactcgcaccaacttcggactttcccgccggtactcctgggggtactcgcccgcgtagtagtggacgtcctccttgtccacgaactcctggcgcggcggaggcggataggcgtggtagtgcggcccgtcgtggtagcagtactccaccacgtccacgtcgacatcgatgcgcacgagcacgttgagcacgacggggtggtgcccgtagtacgcatgctgcggcccctcgtagccaaagggcgtcgggtctccaatgaagacatagacgttgtcgcgcgtgcggtagagcgtgtcggcgtgcatcggcgcggcggtgtgcacatgcatcatctcgatgtgacacagcccatccgccggcagcccggtgcgcgggtgcatgcccgcgtacctccactgcttcgcctcgaccacaccggaggaagcgagcatgagtatcgcgaccaggccggccagattcatccgtgacatagtggggttctccctcggaacgacacgttataccggacccagctccctcaaggtcgagcacgctcacggtcagccatactcgcggtgtcttcacatgtgctccgcgcgcagcatgaaaacagccagcacgaaacatttccgccgcatgacatttcgccccgggacgcgagctcccgagtaacctttagcgccagcctccgatgctcccggctccccacaccctccgccgctggctcctcgctgtggcgagcctcctcaccctcctgggcgcgggagtcgaggtcgcgtactacgcgctcgacgcccgggggctggagccattcgtcgcgttcctctcgttgagctacgagcggaacctgcccacctggtacgcgtcggctttgctgctgagctgcgcgctcgtgctcgcgtgtatcggccatatggcgggacagggccgggagcagggatggcgtcattggcgggcgctggcgggcgcgttcgcgtacatctctctcgacgagagcgtgggcctccacgagcacctcggggggcagctctccctgggtggcgtgctcttcttcacctgggtagtgcccggggctgtcctcgtgctgctcggcgggcttgccttcctccccttcctcgccgggctccgcccgcgccgacgccgacagttcatcctcgctggggtgctgtacgtgggtggggcgctggtgatggagcttccgctggggtggtgggcggagcaacacggcaacgacaacctcgtgtacgcactcatcgaccacgtggaagaggccctggaactgattggtgccagcctgttcctcgcggcgctggcagaggaactgggcgagcgggtggtgctcacggtacgaaaggaggagccccatgggcctggcccagccgctccccgctgagacacagcgcccggcggagtcggtgcgtgtgtcgcccccctcttcctcgcgcgcgccctacatcgccgggcccctcttcgactgggccttcttcctgcttcctccactactggcgctcgggctgggcatcgtcatctcgggcacgcccttcagtgacacccccgtccagcgcctcggtcaggagaagacgtgggccgggttgatggtgggcagcctcatccatgcccacctggtggcggtgttcttccgtagccacggcaaccccgccatcttccggctctacccgcttcgcttcatcctggtgcccgtgctcgcgtgggccgctattcgtggctcggcagtggtggccgccggcgccacggtgctcgcgacgttctgggacgtgtggcactcgggactgcagacgttcggcctggcccgcatctacgaccgcaaccaaggcaacccacccgaggtggggcgccaactcgacttctggctgaaccacctgctgtacgcgggccccatcctcgcgggcgccaccatgctggaccacttcaacagtttcgagtccttcgacggggtgggaatgccgtggctcgcctccgtgcccgcgcgcatgacggccacccaccgcgcctggacacttggcgtcgtggcggtgggcggcatgttcctcctcttctacataggggccacggtgcgcctgttgcgccaaggccaccgcccctccttccacaaggcgttcctgctggtcaccacgggggcctgctccatctacacctggggcttcaactcgtggggtgaagccttcttcatcatgaacctgctccatgccatccagtacctggcactggtatgggccatggagggcgagcgcctccgtgagcggctgcggctgaagtggcgctggctcgcgctcgcgctgttcctcggcaccgtgctcacctatggcgtgtgggccgaacttctcgacgccagcgcggagagtctctgggctctcaccctcgtcgtctccctgatgcacttctggtacgacggcttcatctggtccgtggcgcgcaggcaggtgtgagcaccgccccacggaatgtgccactccgtcgcaaaactgccaccaggcggagtttcccaccccacgacaatgcccaagccggcggcgcgatggttcaacgaatgccgtggccgtttacccagaattagagtccctcagaggagatgccattcatgatctgacagtgggcagccgtagcggtggcgggtctggcgatgatggggggtggaggcgacacacccaggtcaccggggcacttcggcgaggtgacgagcgcggtggtgctggtcaaccccgtcatcaacgagggctctacttcctcggtggccccctcgctatggggagtggtgtgggtgggccttatcgctctcgcgggcttggacgaagagacggggggatgctgctctatctcaccctcgcccatcgcagggtgatggagggctgcatttcaagggggaagctgtcggaagccattatcgatgggagcatccaagcgcatccgccccaaactgatgaccgtggcggcgaacaggactggccgcttgccagcgctcatgggccacaggcgcacgggctccgacgtgatgaagcgtatcgcggcgctgatggtgggcgggcctgcaacgtctttcctacttggagagaaagcgaacagccatgccccgacagcctccgcttcatggcgggaggggctgcaggccatttcccgaccccggcataagctttcttatcttacaggcgaacaatgccaatttccgggaggaattagcatgaggaagcttggatatggactactcgtcaccacggggctgcttatcggcacacttgctgaagcccaaggggcttcccaaccaccgtccgcgggacgccaggcggatgactcgacacggcaacagccaggctgcgcctgtgggatgacgggcagcggtatgatggcccatggaatgggcggcgcgggaatgaactgccccatgcgaggaatggcggacgtgcaggtggagcagacgcaagaaggggccactctgcacctcaccgcaaagaaccccagtcaagtcgaggacgtccagcgcatggcagaagggatgcagcgctgcatgagtggaagcggcgccccgcagcagggccaaccggcatcgccccgtcatcaacaacgctgagtacggcgcgtcgttccccggtgtgcctacccaaaattcggtcgccgcgtcatgggcgcgtcaaagtcccgctcagcagtgcgtcaatgcgcgagagcgaggcgcgcgaggggccattgagatcctgtactggcgaggcggagtcggaatcaccaagggtgcaggctattctggagcacctgggctcgcccatgacatgtgcaaggttgttcccgccgcgccccccccggccgcgtggtgttcccgcgtgaggtcttcccttgtcgagggcccgtcatctgggcttcagtgggtgcatggccttcgtgctctggcttcccgtgcttgtcgccgtgctcacggcccccccggctgttccccaggtcgcgcctgcgcatccgtccttcccggtctggttcgacgcccgcgtgaacgaggagcagccgaaggtcttcacgcggttccaggtggacctcgacggtgatggtcgggacgacgaggtggtctgctacgggttcatgcgaaaggacatcccgcaggtcatggaggcaggcttgctcatcctggtgggcctggccagtggcgagcgctttgccttcaacgagggggcaggccccgacggactctccgcctgtcccatgccgcccgacaaggcggagggctccggcaaggcggtgctcatcgtggagcgacagggcggggggacctcctcgcgggtgaagcttcgcttcgaccggaagggccccctcctcgtgggcagcgtggtgaatacccggttcagctcgaacagcatggacctgttgacccagcgtacccattcgtccaactacacagcgccgatgtcggacgacgagaatgatgagggagatgagtccgagtcggacggcatggcgcatggcgtctctgatttagaagccacggttcttccttctcctggacaggtctcctggggccagaagcactggaaggggcccgaggacgcggacctgaaagtgagcctgcgccgacgcggtgacctgctggtggtgagcgtccggttgcgagatgacaagatggtgaccgcgacggatggcagccccaaggccattctcgccgcggaccacctcgagctgtcgtggacggagtgggccgccaccaagtccgggacgaaccagtatgtgcagctgggggtcgcgcgcaatgcgcgagggactcccgtggccacctggttccgtcctccgtggaagaaggacacgccgctgcccaccatccggtggacctcccccgatgccgtggaggtggaccttcgcctgcgctggctcatgccgacgcccgcgaagctcggctactacgacccgacaagcgtcactccccagctcaaggtttccttctccgatggagacgggaaggggcaggagacactggtggacgtcaacgcgggcatgctcttcttcgccgagccggggcggccgtttcccaccgtggagcaatacgttcagccgtggatgcgcgtggcggacgacgccaccctgcgcagcctcacgctctaattggagtcgaagggccaggaagacagtgactcgcgcgcggccagccagggtgctggtccccactgtgcctgcctaaaagtcactcgctgcgtcatgagtgcgtcaatgcgagtgagcgaggcgcgcaggggccaggagtctggccttccatttacaggacgcgagggcagtcggccgtggagatagggacagagtcgcgtataccacggcgggctcacggcccagtaggcgccagggtgagctccattgccgagcgaactccgcgtgcgagtgcgtctgccggccccactccccaatagtggaggaacagcatccgtggctcttcgcccgtcatgtggttatgaatggcaacgatgtcgatgttcgccgcccgcagggccttgagcacgggctgcagctcgctctccagtatggcgaagtccccgtctacaacggcctgctgcggcgtaccagcgaatgccgcccaggtgttgacgcccatcgccttgcccatttcatgcccatatatgcgcacggtgcgccccacggtgaccttgtagacgccgtccttggacgtgcccttctggcctagcaacgcgtcgagcttcgtgacatccagtttcgagcgggccgggtccaccgaggcgcgaggcacacggcccttccctcccgccgtctcacgcaggcgggtgaacaccttgcccaccgcgtcggcgagcctggccgtctcccccatgccgctgatgtgcatgaacatcaccttcggctgttcccagaagaagtggttgtgcagggccgtgacctccagcccgttctggagcgccacgtccatcaccgggttcacctggtcctcgagcaggacgatgtcgcccatcaccatggtggcgtcccccacgcgcttgaaggcggcccaggcggtcaggccgaggggcgggatgagcttcacgccggccgcgcccaccttgaggtcagtacggggcagattcaccttgaacaccccctcgtcggcgctcagctcgcccttggcgccggttctccgctcgatatccgcagtgtcaatccccacgtctttgggttggtcgcccttgcgctgctgggcatgagccgcgccggtgaatagcagggccacgacgagcgccaggcacttccagcattcgcttctcagcatcatcacgagtcctccaacttcgggcagtgctacccaatcccacatgtcagcgaacgagcctcttggtgaagacggcgtacaggtcgaggcgcgtgccagtctcttcttgtcggcgcggggattgagagtgatgccagccaacaggcgctcgaagccggcagtcttgatgcgaccaaacttcgagtcattcaggccgaagtacgtgcacatgctcccaatgcgacgagcgcgccatcgtcgaggccaaagcgatgaaggagtacatcgaaagtgcgccgataccccccgtgtcgttgtttgcaaatgatgcgcgaaacagaactgttggcccctggatgccccacgcaaggcattaggtccgcggcacagcaacagcaccatggccaacatcatggggacactgaagctatctgcccccttgcgacgcgggagggcaaggccaccgagttcatcgccgtcgccccccgcctccgactgcgtcggcattcatgcggccaaggtaggggctggcttcgaggctcacgagcccctccgccagcgcgcggcatccgcctgtgcccatcccaaattcggtcgctgagtcatggggcgccactgcctcactcggcaccgcgtcattgcgagcgagcaaggcgcgtccgccgaggtgacgacttccctgacacaggggcttcccagttggtccgtgaaggcggcgcgtagccgacaaggcggaccggccgttcgcggagcttctggagctacggcgcatcgtgcagtgagaggcgcttcgcatcagttgcccgcccatgaagaccgcggcctacgccgccgccgtcagtctgctcgccccgttcaccctcgagcggcatgcccccggaccgcatgacgtcgccatcggcatcctccaccgctgcatctgcaactcggacatcctcggggtgcctcccggagaaacgccgcgcgcatgcgaaatagctcgcgttgagagttcgttgtgcttgagggtgagcaaccggccacgagagggacgatctgctcgccccctcacgcacgcgcagtcacatggagccgtcttcccctcagggagttgaacacatgagccgcctggcatccccctccactcagccatgtgcgacgacgttccgggctggcgcacgcacatggcgcatgcggattctctcgcttgcggtgatggggaccaccgcctgcgccgcgccgtccgcgctcgccgtgtctccggccggggtgcccgcgttcagcgaagacatgctgtcgcccgagttctggattcgccgcgcgccgtctcccgacgaggtgctgctcgatgccgaccaggtggcggcgaagcgcatgcgcgccttcggtccggatggcggcctggtcgacttgaagcgcatcccagccacgctgacgcgggcggaagtcgccagctgggtcaaggatgcgcagcagacgcccatccaggcagccatcgacgaacagggccggctggtgacggaggcgatgctcgaagagctgcgccagaacaccgcggccgagcacatccccgaagcatccaccgcgcgctacggcctcagcgtgcggcgcacgcccctgcggtccctcccgtccgagcggcgattcttcgcggcggagaacctgcgcgactacgagagccttcaggccggcatcctgttcccgggcgagccggtcgtcatcgcgcaccacagcgcggaccagcaatggctgttcgtcctgacgacccaggggcccgcatgggtccggcgcggagatgtcgcggaaggcacggcggacacggtgttctcctacgtggcgaaggcgcccgggcgtgtcgtcacgggcgaccaggtgcgcacggtcttcacgccggaagcacccggggtgtccgagctcgagctcgacatgggggtcgcgctgccgcgggccgacgtggcgcccggcgagcccgtcaatggcgccagcagctatgcgtcgtggccggtgctgctgccggtgcgtgagcaggacggcacgctggccttccagagcgcgctgctgcgccgtaccgccgacaccgcgccgggctatctgccgctgacacgtgccaacatcctccgccaggcgttcaagttcctcggcgagcgctacggctgggggcaccagttcaatgcgcgcgactgcagcggcctgaccagcgaggtgtaccgcagcctggggctgttcctgccgcccaactccgggatgcaagggaagagcgcggcgctgaaccaccgcctcttcacggcccaggactcacacaccgagcggctgcgcgcgctggcccgggcgcaggtgggcgacctcatcgtcgttcccggtcatgtgttgatgctcattggccacgtgaatggcgagccctacgtcatccaggatgtgccgtatgccgtattcaaggatccggccacgcagcagctccggaagacgaagctgaaccaggtgtcggtcaccccgctgctgccgctgtacgccgacgacacgaccctatacgtggacgcgatgacgagcctcgtgcacgtcacgcagccatagacccgaccgccgagcgcgtcgggtccctcaccgcggcccgggcggacgcctcctctcgcggacatcatcacgcgcggcgacaccatcgcggcacgccgctccggcagccagttcactggcaccagcggcgcggccaggaagggcaggggttgtgcctaccccaaattcggtggctgcgccctgagcgcgtcaaatccacgaaggacattgcgtcaatgcgagtgagctaggcgcgcacggggcaggtgtgcgtgtggctgtgatgcaggactatcaccgaggggtgtccggacttccgacacctcccccatctcggcaggcctgaacttccaagaccgctggggatgacggaggaatcgccatactggactcggtccccctccggtagttcccatctttggccccggtcaccgccaaggcatggagctggctgtgccgcccaggcccctctcgcgaagttccgctggccgtagctgatgcgcgaggcggggctgcccgtcccgaaccaggctgcgcctcctcagcctctggcgcagcatcagtcccccgttgaaccgtgcgtcagcgcaagtgagagaggcccgcacggcagaggcgacatcttccctgacccagggggctccatctcggaaacctcaaacttcgtctccccgcggcgctgagcttaagcgcgcagcggtcgcggcgctaaccgtcgaacgcgacacgctgcggctcgcctaccgcaacctgcagcaagagctggagttgatgcgaagccggctcttcgtcgccaaagccgagcggctcgatacgacccagctcggcctcgagtttgcctacaagctcgcggcactcgacgcgctcaaccaccagctcggacagcccgctgcgtccgcgccggcggatccaaccgagacgggcggggcgcgcccgcctggcggcaagcgcaagccgactgggcgtcgcgacctacgcgaggccgacctcccggaggaacgcatcgaactgaacgccccgctgctcgagggctccgccccgaggagcggctgggaggagagctgtcagctcgcctgacggcgcccgagccacgtccgcatggtcatcgcccgcgccaagtaccgcgacgccgacgcggcggacactgccgagccgacgagcgtgaccgcaccgctgccgccgcagctcctgccgcgcgcgctcgcgacaccttcgctcctggcgcacatcctcagcgacaagttctgcgacggcctgccgttccatcgccaggagtgtatggcttagactcgccgcatgggactcttgaccttcagcatcaacgtcaccttggacggctgcgtcgaccaccaggagggaatcgccgacaacgagacacacgccttcttcacccgcctcatggacgagggcggggcgatgctgtggggccgcgtcacctacgagatgatggagagctactggccagcggtcgcccgcggcgacgaggaggcgccgccggcgatgcgcgagtgggcggtcaatctggaggccaagccgaagtacgtggtgtcgtcgacgcgaaaggacttcccgtggaccaatagccaccacatcgccggcgacctgcgcacgggcgtgcagaagctcaaggacgcgaccccggccggcgtgctcctcggtagcggcaagctcgcgaccgagctggaccggctggatctgatcgacgagtacaagttcctcgtccaccccaggatcgccggccacggcccgaccctgtaccagagcgggctgcccagcacgcgacggctcgagctgctctcggcgaagccgctccgcagcggcgcggtcgccatgcactaccggcgcgcgcgctgagacgcccggccccgcccgccgggagcagggagccgaatcctcctagagcggggcggccccgtatactcccggcccacgttttctggctcacccaacgcatcagagtgatggggcctgttgagcgtcacccgattccgtggacacccccgatgtgatggaagggtgttcgatgtcggagcgcgagaaaaagaggcggcaacgacgtagcttcctccctgagttcaagtccggggcggtgaagttggtgctggaggagggcaagtccatcgcggaggtggcgagggacttggacctgacggagacggccttccgccggtgggtggagcaggcccggacggaccgggggcaaggcaagccgggcgccctcaccagcgaggagcgggcggaactctcccagttgcgcaaacgcctgcggcagctggaaatggagaaagagctactaaaaacgcggcggccttcttcgcgaaggagatgaagtgaaggtccgcttcatccacgtggagaaggcctctctgccagtagccctcctgcgcgccgacacgggcttggccatctacttctgtgacccgcacagtccatggcagcgaggcacgaacgagcacaccaacggactgctccgtcagtacttcccgaaagggacggacctgtcccgttactctcgtgcggagctggccactgtcgcccttgccctcaacagccggccacgcaagacgcttggctggaaaacacctgccgaggctctcaactcttatctatacttacttcaaccaaacggcgttgcgacgaccgcttgaatccgagcaatacgccagcgaggactaccgggagcggctggcagagcacggagtcacctgctcgatgagccgcaagggcaattgctgggacaacgccgtcgtcgaaagcttcttcagcagcttgaagatggagctcgtccacacgcgccgcttcctgacgcgagaagaggctcgacgagcgctattcgatttcattgaggtgttctacaaccggaagcgccgtcactcctcactcggctacatcagccctgtggaatacgagcgaacggctgagttgcgaaggcaggcagcgtagccaacctgtccaccgaagcgagtgatgctcacagccctgcgcagtggctcgagccagccttgccaggcagggctcaaggtcgcggtgaagaattctgcccaagactgaaaatacccctccatttacattctgcttgacgtagccttcaagggagtcagcgcaaagccctggcaatgcgggaaggccgcgctgcagcaagaacggaggaccatacgtgtccagtgaagtacttttcatcaggtataggacatggaggaccgcgcgaggaaggggtgtcctcgcagcgatgctcttcagttgctgcgtacttggcccccttcatgggcacgcacaggaacgggacgaggtgcaaacctacctcctctccgcacggcgccactatgacaacctcgagtacgagcaggcactcgcacagctcacccaagcccgcagcctcaccatccaagaagaggacagcgtgcttctctcactctatgaaggcatcatcttagcggaccttctgaggaacgatgcagccgatgcagccttcaaggcggctctcgtcctcaggccggactcaaagctacccgaaaaggcgtcgcccaaagtagagcgaaggttcgaggacattcggaagcaggtgaaacgcgaattagagaggcaccgccgcatcgcaacggtggagcctcgtgggagagtgccgccccccgccaatgagcggcctgccgacgacgtgccggtatctggccctgtcgcggaaatacatcccacgccactaactgtgtcagcgccccaagccacacctacagttgcagataagtctgtccccctaatcactcaggcatccgagcgtagcaccatgcgcagccgagcttggatccctgcagtagtaggaggcgcactgctggtcggtggtggagtcgcctattcgcaagcctggagcgagcgctcccgtcttcgaaacaacgatgcacgcctagggactctccaagacgcaaatcgcagcgcgtctcgcgggagcaccctccagacggtgggcttggggcttgccagcgctggcgtggtggggatgggcgtctccattggcatgtacctgttaggaagtccctcggtaccggacaggccgggagtcagtgtgacgacggatgggacatctgcattcatgattgggcgatggccatgagcacaatcctccgctactgcatagcactgggcgctctcctgcccctcttctccggctgtatagacttcgagcaagagaagagcgatttctgccgacgcaaccctgagcgatgtgacccacccaaggcggttgagccgaatccgcctcaactcatcgaggtccccagacactcttcatatgtggaaggaggaggccagctagacttccacgtctccgcagtggatccgcagggcagcacgctcagttttgattggttcgcgaacgtcggcaccttgagctccgcccaggaaacctccagcacgagccatgtcacttggcgagcccctgcgtgcctggcctcgggagtcactgcctccttcacaatcaccgcgagcaatgatttcaaactatctgcctcggcccagttctccgccattggcatcccggattgcccgacatgggaaccaaccggcagcatgagtgaaggccgctctgaattcacggccacacttctacgctcgggcaaggtactcgtggcaggaggatacggggcgacccaggggtacacagtcccgcctgagatttacgacccggtgacagacacctgggcagctaccgtcaacctttccatgggtcgcagaggtcacacggccacgctgctcccttcgggcaaggtactggtcgcaggtggctacggaagcactggattcctcgccacggcggaggtgtacgacccgttcgccggcacctggactgctactggcaatctctccgtgggccgaggccgccactcggccacgctacttgcctccggaaaagtcctgatcacaggcggcaatgccaacagcggcccccttgccacggctgaactctacgacccgaccacaggcacctgggcctccgccgcaagcatgacctcgggccggctcctccacactgccacacttctcccctcaggcaaggtcctggcaacaggagggactctcaataacgaactcctcgccacaacggaactctacgacccatacaataatacctggacctccaccggcagcctctctgcgagccgacgcgagcacacagctacgctgcttccctctggcaaggtactggtaacaggcggctatggcattggcggaaccctcgccacatcagaagtgtatgagccgaacacaggcacctgggcctccactggaagcctctccactgagcgaaacttccatacggccacgctcctaccctcgggcaaagtgctggtggcaggcggctccggcaagggcggataccgaacgaccgcagaagtctacgacccgaccccaggcacctggaccgcaacgagtagcctctcggtgggccgcaatcaggctacagccacattgctgccctcgggcaaggtgctgatggcaggcggcagaaacgaccttgtgacagcagaggtttacaatccggggacaggcacctggggctccaccggcaacccctccacgggtcgcattgagcacacggccacgctgctcacttcgggcaaggtacttgttgcaggtggctacgggagtggcgaaaagcacttcgccacggcggaattgtacgacccgaccacaggcatctggacttccactggcaatctctccgcgggccgaagcactcacaccgccacgctgctttcctctggaaaggtcctggtgacaggcggccagggaaatacccctgggtacctcgccacggcagaagtgtatgacccagacacaggcatctggacctctatcgaaagcatggcctctggccgtatctaccacacagccaccctgctcccctcaggcaaagtcctggtgacaggcggcgttctcggcacaacgaacctcgcctcggcagaattgtacgacccgcacactggaacctggaccactactggcagtctctccgcgagccgaagtgctcacacggccaccctgattccccctgggaaggtgcttgtaacaggcggtaattcattgagcggcactctcgccacgaccgagatgtacgacccgcacactggtacttggacatccacaggcaacctctctgcagagcgttttctccatacagccacactgctcccctcaggcaaggtgctggtagcaggcgccggcaccgcagaactgtacgacccagcaacaaatagctgggccttcaccggtagcttggtaacagaaagctatgagcactcggccacgctactcccctccggaatggtattggtaacaggtggcgtcaacaccgcagaggtattcaacccggaaacaggcacctggttccgcactggcagcccaaagttcagatacaccaatgcggtggtgttgctacactcggggaaggtactggcaaccggatacaacagcccgaacctcggggtggcagagatatacaccccctgagagcttgtccccaaaagtctccatatctcatgcccccccggggctgacgggccgcatccgcggcatgcgagtgcgggaggagcgcgtcctcgcggacaggaagctggcgaagagtggcggacaggtggatgagctgctctccgcgtgctgggaggaaatgcaggaggcaggcccctacgccttcactgacgggaaggtgaattggggtcaggtgcttcagggggaccgcctctacgcgctcccccaggtgcgcgtcctcacctacggccccgagtacgccttcgccgtcccctgtcagagcgcagcctgccgaggccgcatcgcctgggagctgaacttgacgcagttgccagtgcgtgccgtctcgaacacaagccgcgcggccttcatggccggcaagcgcttcgagacgacgctgcccgacgccggcaagcgtgggcgccggcctcggaatctggctctggaggatgcgaaggcggccggagtccgcctaaaggcaactctcgtcgagcacgtatccaacgtacagggaggtgttcgcgctatccaccacgagtccgcggaggaagccagttgcgccacagccgaaggagtactcgggcaggttgcccaccttgcagccagcgttcttcccgcccaccgtgggcatcaccgtgattctccccgtcttgagattcctgcaggagagctgaatcgtcgagagggtattcttactgcaccagtcttcattcgctgagtcctccgcccaaccgttgatgccggcgaccttctggacaacttctccctccgcacagtcctgggtgaagggattgccccccgtgccaccaatcgagggagcgcccatggccgtaccgatgatttctcctgagttgaagcgagcacagcgcatcccgagcgcatccaaccccgctccttcttgcccgtggattccaactgcgacctcgccccccccgcacgtgagcacctggacggcgtcgttcttcacgcacttcgtccccgcgccgtctcgcagatacccgggcttgcacgtccaaggacaggtggcctgagcagccgttgggctcgtataatccgcgttcgcgggagcattcgtgcaggcattgcggacattggagttcgcgggcgaccaatacccaattccgacgtcgacacagactccattggaaccgagaactgcagcagcgtcagcggcgcggtgggccgcgtgtacctcgagctcagcgacgctcgccgaggccgcgcgcgggattgcgctcctgacgaagctggtgggctgagcgctggctccgcgcgccgtccgtgacgatgccgcgccaatcgaaggtgcgctcggatggtgcgcggcagcgatgctcatcctggcggggagcgcccgggaaacttgccacccatcgcatcggccaccgacggcacccgcggctgactcttcaggaccctctcggtggcaggaggccctcagctgcaggacgacggtcgcggtcgcgtgagcgtctgccatccagcgaggggagctccttcagaccgtacgccccccgagcggatgtccgcggacgatctccttgacgcccgccgagcccttcgctagtcgttaggcggcatacgatatggcggcatcacaaatgaacctcgagcagaaatacgaagccctcctacacgaagcgaagcggcggcagctcccagacgtggccggcatccggctggtcttccagacgctctcgctagcctcggcgatcgaccgggattgcgcggcgttgctcgcgccccacggcctctcggagggccgcttcgtgctgctgttcctgctcgacgccgcccacgatgccctcgcacccaataagctcgccgagcgggcgggcgtgacccgcgccaccgtcacggggctgctcgatgggctggagcgagaagcactgatcgagcggcattacgacgcccaggatcgccgcgcgctgcgcattcgtctgacccgcaagggcaagcagacggcgaagcaagtcttcgaccagcacagccgttggatcgcgagcctgtacggcaacctgtcggcggcagaacgcgggcagctcacggccctgctcgacaagctcgctggcaacttgaccgcgaggaaggccgagccatgagtccgtcccttccccgcaagggcgcgacccgcgccaccgacattccgcctgacgtgctggacgccttgtcgcacggcgagatgcagaccgccacgctcgccgagtgcatggcgctcgaccaggcccgtctgctgcgggcggtctttcccgagctctcccccgatgcattggcggccgccgatgcagcctgcaagctcggcatcctcaagcgcatgagcgcgatcggtgcgctgctgctggaggagctcggcaccgccggcatcgagcgctctcggacgcacgccgcggacatggtgcgcggctgggcctgcttcatggtcggcgcgcggcccgagctggatctgcaggcccgactggccaccatccgcccgctcgccgatgactcgcatttcggtgtgcgtgaatgggcatggatgtcggtgcggcgccatctggcgcgagagctggacatcgccatcgccgagctctcggcctggacgtcttcgcgctccgaatacgtgcgccgcttcgcaaccgaggccctgcgcccgcgcggcgtttggtccgctcacatcgcagaacttcagcgagaaccagggcgggcgctcccgatcctctcgccgctgcgtgccgatccgtccgtctacgtgcaggactcggtagccaattggctgaatgacgccgccaagacccagcccggctgggtgcgcgatctctgcgaccaatggctgcgcggcgaccccgccgacgctacccgccgtatctgcaaacgcgcttcacgcaacttgaaatgagggatagccaaatgtctcagtatctcatcgaactgtatacgcccaacgcatcttggaaggcgctgccctccgagcgacgccagcagtaaccctcccccatctcaggaagtgccgacgtccccgggggcgctctccctccgagcaccccatcggggggagtgctcagttccgcggcgagcgcaactcgttcttctgccgcagcccccacgtcccgccaagtcgccaccagtcactcacgggcgaagcagcgccttgattgcgcgcctttcgtccatcgcgcgatagccctcggcgaccttctcgagcggcagggtgaggtcgaagactttcccgggattgaccttcctgctccagaccaggtcaatcagttgaggcatgaaccgacgtaccggcgcagggccaccgtggagatgaacgtgcgagaaaaagagcttctcgccgtccaggctcacgccatgaggcacgcccacgtagctgacgaagcctccgggcctcgcggcgccgatagcctggagcatggactcctgtgtgcccacgcactccagcaccgaatcggcaccaatcccccgggtcagttctttgatgcgagcaacgccctcgtcgcctcgcacggacacaatgtccgtggcaccaaactcacgagcgagcgcctggcgcgtctcatggcggctcatcgcgatgatgcgctcggctcccatctgcttcgcggagagtaccgccaggagcccgacggcaccgtcgccgacgaccacgactgtcgagccgggattcacgttggcggcgtcggctgcgaaccaaccggtaccaaacacgtccgacacggccagcaggctgggcacaagcgcatcgggcggcacctcggccgtcacgaccagcgtgccgtcggcgagcggcactcgcatccttggcgcctgagccccactcaccggctctcggtgctggcacgacgtttggtaacccgccttgcagtgagggcacgtgttgtcggaggcgaagaacgaaccgatgacgaactgccctggcttgaccgaagcgacagcgcttccgacctcttcgacgatgccgcagtactcgtgccccatcggcgtcggctcagtcaccgcctgcacgcctcggtagggccataggtccgagccgcagacacatgtagccgagagacggatgatggcatccgtcggcgcgagaatcttcggctcggcgcgctcctcgaagcggacgtcgccgggcttgtggagaacggtggcacgcatagcagctcctttcatctcggagtggattacggatggaacatgcgtacccgcgctcgccccgtgaagatgctggttgaggatgggctgtcaagctgcacttgacagccgccactcggctggaaacgtaacatgcaagtcctaatcgtgaatacttccctattccctcacctccaaacgttcctcgctgtggcgcgcacgcggagcttcagcgccgcagctcgcgacctgggtatctcgcgctccgcagtaagccagagcgtgcgcttgctcgaagggaagcttcgagtgcccctcgtcgcacgcacgacgcgcagcgtatccctcacagaggcagggaggcgcctcgtggagtccgcaggcccagccgtcacacaggttcaagcagcgctcacgcaggcctctgcaaaaccaggtgaggtggtgggccgcgtacggttgacagtcccccgcgccgcctttcatttcgtgattgagcccgtcttgccgaagttccgggaacgtcatcctcgtatcgaggtcgacctcgtcttcgaggaccggatggtggacctcgtcggcgaggggttcgatgcgggcgttcgcctgagcgagtatgttgagcgcgacatggtgagtgttcgtctcaccgatgcctttcgattcatcgtcgtcggctcacccacctacctaggtaggcacgggactccagggcgcccagaagatctcctcgaacatgagtgcttgacctttcgctcgtccaccacgggttcgctctacgcctgggaattcgaacgcggtcgccggacgtggcgggtgcccgtccgtggaagccttgtcgtcaacgacggtctgatttgcatacgatgggcggagcaagggctgggcctcgcgtatgtgatggagcctttggtcggcgagcagcttcgaaagggaagtctgcagcgcgtgctcgagccgtacgccgcaaccgttcctggcttcttcctctactatcccagccgcgcgcagagctcagctccacttcgtctcttcgtcgaaacggtccgtgagctgacacgcaagccgccagtggccacgaaacaactcgggccttgaggcggctcccggcgtcgggcaaccgcgcacaccgcaacctctctcaacacgccatcgttcgccattgagtcttcaaagaccgacgcgacctcgatgcccggctgacggctgagccccactcccagtcagccgatactggagtcatccctcccatgtcgcgttgcgagcgaagaggctcccgcatttggcagaagcgagggcaatggagagccgcgccggtgcgagcgccacattgccgctacggctggtgcgatgccggccccaacgccgtccgagcagcccgcccacagtccgctacccagtggtcctttcaagaaggcaccagctgacgaacggctgctcgacaccagacgaattggcaacggactgaggattgtccagcactgcttcctggcccatacagcagccggtgactggtttggcggagagaccgagcgaatactggtgtggcgatggcgacccatgaactgttcgcgcggtggaacactccgcccctggtcttcgagcacggagaagccgtcgatgccgcggagggtgtgcccgccgaactcccgctcgtcaggacagggctcacgagttcgacatcgtcccgctcggcaccttcagattctgttcgcgaagaccggggcttgaacgagcctctccgtgcacaaggtcggccgctgtcaagcagcgcttaccgggccatgtaataggcggcgactatttgaacaacgagggcgtgtgcatactccttctgcagcgctcgggagcgcagcatcagcgccgcgcgcgatagctgggccattcaaccgagggaagaaccaaacgtcagaacggagagcacgatgagcgactcagatcaacgtggtgagtcacattcactcgagagaagaagattgctgcttggtttggccgccgccccgcttgcagcgtgcgcgtcggcgcatggggggatgcgcgcgagcacgacaagcgcacccgccagctcggcccaatccgccaaccaggcctacaccctgaggtcccgcaagctgggccacctggtggtgtcggagcttggcttcggatgcatgagcaacagccctggccactacggtccgggcgtggaccgtccccagagcatccgtgtgattcgcgacgcctatgaccgcggcattcgcttcttcgataccgccgaggtttacggcccctacgtgaacgaggaactcgtcgccgaagcactggggccagtgcgcaaccacgtggtcatcgccaccaagttcggcttcaaaatcgacggcacgaacgggttggacagccgccccgaacgcatccgccgcgtggtcgaggaatcgctcaagcgcctgaagacggaccgcatcgacctctactaccagcaccgcgtcgatctgaccgtccccatcgaggatgtggctggcaccgtcaaggacctgatccagcagggcaaggtgctgcacttcggcctgtccgagccgagcgcacgcaccatccgccgtgctcacgccgtgcagcccttggctgcgatccagaccgagtactcgctcatggaacgcagcgtggaggacaacggcgttctgcaagcgtgcgaggagctgggcatcggcttcgtgccgtggggaccgctcggtcaaggcttccttcccggcaagctgcccctggatgcacaggccaggttcgatgcgaagacggacctgcgcaagaccttcccccgcttcagtcgggaggtcatgcaggccaaccagtccatcctcgacttcctgaaggccttcggcgagaagaagggcgccacgcgcgcgcagattgccctggcctggctggcagcacagaagccttggatcgtccccatccccgggacaacaaatctcgatcactcgcgcgagaacctgagctcgctcaacgtcaacctcacgccggaagacctgcgagaaatcgaagcggccttcgccaatatcaccgtgcatggcggccgtatggacgcgaagcagatggaccagatcggcaaggactgaaatccatcggaatcggatgggcacagccgggcacagctccacgccgggcggcatgagggcccacctgaacgacaacggcaagaggagcgcaagtcgccggattcgcggggcacaggacatgatcgacttctgcgaactcaacaacatcaagcccggaattgagtcccccatgacgggaatcaacgaagcgtggcccaaggccgtcgggaagaaggcccgctagcgtttcgtcatcgatatcaagaagcagaactagaggaaccgacatgaaccctacatacgacttcaaaggacaggtagcgctcgtcaccggcgctagctctggcatgggcctcgccaccgcgaaggccttcgccgcagccggcgcctccgtggtacttgcagatgtcaatacggcagcgctcacgtcggctgtcgacgccctgacatcggccggacattccgcgctcggtgtcacctgcgacgtgtccgacgaagcccaggtcgccgcgctggtccggcgagcagttgaggcctatggccggttggacatggccttcaacaacgccggcattcaggcaccgcccaccgatgcggcggatgagccttctgacctgttcgacagggtcaacggaatcaaccttcggggggtctgggcttgcatgaagcatgaactcaagcagatgcgtcagcaaggcagcggcgccatcgtgaactgctcgtcgctcggtggtctcgtcggcctgcctggtcgagcggcctatcacgcgtcgaagcacggagtcatcggcctgacgagaagcgctgcgttggagtacgcacctcgtggcatccgcatcaatgccatctgtccaggaaccatttctacgcccatggtcacggacatgctcgccaagggggaacttgatctcgccggggcgattgcgaatcagcccatcgggcgcctgggagaggctgaggagattgctgcctcggtgctctggctttgcagcccaggcgcaagtttcgttactggcgtggcacttccggtcgacggtggatacacggcgcgctgagcctgggcgatgcgccacgcgaggaggggtagcgtgcgccggtccagcgcgtcatcctgatgagcggccaagtcctcgacggtgaggacatttggctctgcaactggattcgaaatatctgacgacgtcgcgtcattggggctgcagagcagttcacgcggcgccggatgaggcaggaactctcctcgattgtccaatctcgccgaatgggccatgcccttctttaagccagggagccccgcatgttgcgtgcatacttaccgacgatgcgaaaattcagtcttgccttcttctgcctactcgctggatgtgcctgcacgaaccagccatcaccgcaacctgatgttttgaacccatcaataccacctatggaaggcggcgaaggtggcgacgatgcgggcaccactccaaacccggcgtctaccgacatgcgcatcacaattggtcccaaaccctttaccgtcaaactccacaacagtgaaacagcgacggccttcaaggcaatgttgccgaccacggcaaacatggccgacctgaacgcaaacgagaaatactaccgcctcccaagcgacctacctgtcaatgcatcgaacccagggacaatccaggtgggcgatgtgatgttgtacgggtccaacaccttggtgctcttctacaagacgttctccacgtcctacacctacacgcgaatcggcaaggtggagaacgcctcagaactggccgcgacactgggctcgggcaacgtaacggtcatgttcgaattatgattcgcttacgtgcttctccagccccttcattcacgacgggcgcagagggcactgagcagagcgtagttccgcccccttcatgaatgagagagggcccgacggtccgttggccccgttgcgctcagtcatggcgcacgttttgacgcacccgtgacgcagcgaccgatttttgggtaggccccccccccgcgctcacgctgcgcgtgcgtgtctgcgagcgaaacgtgacggcgtcggtggacgtatcgctcgagcggtgagcggctaccccatcaccttgaggactgcgagacgactgtgttcgaaaaatagctttgcggcaccgacacgcagacggcgcatgtcacattcgatgccttcgtcgaggctcaagccatcggcgcgcaggcgatccgacacaacggagtcatcgggaccatcggcgaagagccacagttcgagcgtgcgtccaggtccggcgttgaggccggcctgcgcggagtcgttaaagatcatccagcagcgaccatcctcgccgaagtgcagctcgaagttcccatagcgccagatcgacgcgcgctcgacggtctcctcgactccccactcgtccggcgctcccaaccgccggcgtacgtcgtcgcggcccatgccgacggcggcaccgccaagtcgggcttcaacgatgagctcgcgcagcgagaaacaggtcattcgccgttccattgccgcattctgccgtccccagaatctgtcgcgccagggctttgcctcctgtgcctccccccaattcggccgctgcgtcacgggtgcctcaaggcctcgccgggcagagtgtcaatgccagtgagcgaggcacactcggccgaggcgacaacttccctgacaaagggggcgaggcagcacagtcctcagatgaacggcacgcgtgttggacgggtgaacgcacggcttcgcgttgttggacccgcgcagagagtgtgagaacctttgccccatggcggacacgctcaagtcagacgcgaccgtttccgaggggctggaccgccgtcgattcctgacgtgggtcatgacctctcccacgttgatgattgccgcccggctggggcccgacgtgcccgaggccgaggcggcggagcgcccggaaggagcgacaacggcgatgagcctctatctcgccgtccagaccgatgggcgcgtcgtcaccaccctgcctcgcacggagatgggccagggcatcaccacggccgtggccatgctcgtcgccgaggaactcgacatggcgctcgaccaggtcgacgtgcgcagcgccgacgcggacccccgctgggccatccagctcaccggcctgtcgtcgacgatgcgcttcctcacgggccccctgcgcgccgcagcggcggaggcccgggcacggctggtcactgccgcggcgctgcgctggcgcgtcctggcccacaccctcgccacctcgcacggcgtggtgagcgcccccgacgggcggcgggccggctatggtgagctggcggaggacgccgctcgcgtgctgctccccgcggtctccagccagcccaggcccgtgagccggttcaagctggtgggccagcccaccggacgcatcgacgcgagggacatcgtcacgggcgccacgcgctatgccctggacctggacatccccgaggcgctaccgacggtggtggcccggcccccaacgctgcgcggcaccgtccagtcggtcgacgatgcctcggcgcgggcgatgcccggcgtggtggcggtggtgcccctgggcaccggcgtggcggtggtggcccgtaccttcggacaggcgcttgcggcgcgcgcggcgctgcgcatcacctggacgcccggacccgccagcgcactgtcggacgcggacatccggacccgcctgcgcgacggcatcggcccaaggcccctgccgccgctgttcaccacacggacgcttgagggacgcttcgacttcccctacctggcgcacgcgaccatggagacgcagagctgcctggcccgcgtgcaaggtggacaggcggaggtctggctgggggcgcaggaccccaaatacgcgcagcgcgaggtggcccgggcgctcggctgggagctcacgccgtggcgagtgacggtgcacatcgcccgggccggtggcggcttcggccgcaggttcttcaccgaggccgcggtggaggccgcgctcgtctcacgggccatcggcagaccggtgaagttgatgtggagccgcgacgatgacatgcgccacggccactttcgccccgccagccaccaccgcatcctcgcctacctgggcccgggcgggcgtgtcctgggctggcatcaccgcgccgccattcccaccgtggagttcccccacggcttcggtgacgccctcaccgcgctggccggcgaggtcctgcccgaggtgaccagtgcggtcttcttcgcgctctcccagaagctcccatacggattcggatgggtgagccaggagctgcgcgacgtggcgattccgattcccaccgcgtcgttccgctcggtgttcaccagccaggtgggcgtgtccaacgaggtcttcgtcgacgaactggcccgcgagctccaggtggaccccgtcgcgctgcgacgcgagcggctcacttcgaatcgcctcaaggcggtgctggacaaggtcgccacggagggacagtggggcagaagcctgccacccggtgtcgcccagggtgtcgccgtcctcgaggaatgggacagcgccatcgcccacctcatcgaagtggacgtcaccggagggacgcctcgggtactgcgcatcgtcatcgccgcggatgtcggcctgcccatcaaccccaagggcatcgaggcccaactccagggcgcggcggtggacgcgatgtccaccacgctgagcgcgggaatccacatcgacgcgggcaccgtgcgcgagggcagcttcgcggactatcgctggatgcgcatgaagcacgtcccgtccgacatccaggtgcacctggtccgctcggatgaccgggtggtcggcgtgggcgagctcggctatcccagcgcagcggcggccctgaccaacgccatcgcccgggcgcgaggctcgatgcccacccgttttcccatcctcgacgagggagtctgagcatggcggcacatcagttcatcctcaatggccagacggtgttggtggaggcgcccgaggacctgtcgctgctgtgggtgatgctccacgtgctgggcgtgacgggcccgaagtacggctgcggcgtgggcgtgtgcggcgcgtgcaccagccacctggacggcgaggccttccgcccctgcatccacccggtgggtgggctgtctggccgcgaggtggtcaccatcgaggggctgggcgcccagggactgcatcccgtgcaacaggcgtggatggaggaagatgtggcccagtgcggcttctgccagccggggcagatcatggccgccgtggcgctgctcaagaagaacgcccagccctctgacgcggacatcgacgcggcgatgagcgacaacgtctgccgctgtggaacctatgtccgcatccgcgccgccatcaagcgcgccgccctgctgctgcgaagcggcgcgggcggcgggtgataccgaggaggccagggcgcccgctacgtcgagacgctccatgaaaatcgggttccattgcgacaccacccgggatgcactcaggtgacgccatcctcgacataggcgtagccctggccgcgcaacccacggcttgcgtcctcgacgtgtgggaagtcctctgcggagatgaagggcgccttcgcggcgtccatggggttgggcctttgacgtgaatcacttccatggcgtgcaggactacctgccgcacgccaggagtatgttggcgctggttcgagagcgttctgtcattacaccgaacggcaccgagacaagccgcgaactgcacttcttcgtcagcacccgcaagcccaccgatgccgaagccatggcgacctttggactcggcaaacctcgcgacggcaccgggtattgactcctcgtccgtgcgggcctcgaaagggggccctcacgggcccaaacccgacggatagagcgaaggcgggcagtcagcatcatctgctcgtagaggcccagggactgccgctggccgagtcgctgacggccgccaacgtgcacgacacgcacgggcgcttcccggtgattgactcggtacctgcggtgaagactcccacgggacagcgacgctttcgcccgacgaaggcccatggagacaaggcctacgcttcgaggaagaacaggcgaggaatctgccagtccatctggacccgtccagttctcaattctggagcatgtcgcgggacttgcgacagggtaatagccccgaccgtggaaggttcgattcccgctggcgagcgacgagggcgatgcccagcatcgcgcgccttcacgtttgaaattgacacgaaccaacgacaaggagcgctggaatgagcgagaagaatcacatgatcgttcgccctgttgagaggggcgactttgaacaatggcttccgtactggaagagctaccaggaattctacaaggtcactttgccggaggaagtgacccaggcgacctgggagcgattcttcgacgaccgcgagccgatgcactcggccgtcgcggtggacggcgaacgaatcgttgggtttgtcaactatctctttcaccgttcgacgtgggcgcagaatgacttctgctacctcgaagacctcttcgtcgctccagagacacggggacgccatgcaggcaagaagctcatcgagttcgtacaggagcgcgcccgcgcaaaggcctgcgggcgtctctactggcatactcaagaaaccaatcacacggcgcaacgactctacgattggatcggagagaagcctggtgtgatcgaatatcggatgtcgctcgcttgaacgacagatgaccgtcgaagcgcgtcgcggccatgcgtgaggccctcggcatggatgaggcgggggcttcgacggtcgttacgacgtggggtctgaggtcgcgttcggctcaggccaatagtgactgtcgggcagcgcgcgcgggccgaagatcgcctgtcccacgcgcacgatggtagctccctcctcgacagcccactcgaagtcgccggacatccccatcgagagctcgttcatcgtgacgccagccggcgcctcctcacgcagccgcgcgcgcagttcccgaagcagcgtgaagcacggacgcacacgcgccggatcggccgacagcagcgcgagagtcatcagcccacggacgcgcagcgaggagaaggcgggcaagtcgcggaagaaacgggcgacctcatccggcggcaggccgaacttgctggcttcaccggacgtgttgacctgcaccaacacgtcgagcgcgcgcccctccacctgcaagcgtcgatcgagcgcctccgcgacacgaaggctgtccagcgcctgaaactcgctggcgaagcgcgcgacgaccttcgctttgttcgtctggaggtgcccgatcaccgaccaccgcaggtcggtgagatctgccatcgcctcggccttacccaacgcctcctggaccttgttctctccgagttcgcggcagccagccgcgtaggccatgcggatgcgggcctcgggcatggtcttgctgaccggcaggaggcggacctctactggatcgcgaccgactcgcgcgcacgcagcggcgatgcgtccgcgaacagtcgccaggttgcgccgaaagtcctcgacgctgtacgcagttgaatatgccggggtgttgatggttgcctcctggatcgcgcacgtccttgcgcgcgttcgtaaatggcaagagactggccccatggacagccccagaatcaagaatgatgagggtccagtcaggcgaccgtggcgcttcgacttcaccctcgaacgggacacgtccgtgtcgcagcagacgcagctcacccgagcgctcatccacgagatccagcgcgggaggctccctccgggctcgatgctaccgggaagccgaaccctcgcagaccagctcggggtgaatcggaaggtggtcgtcgcggcggttgacgagctcgtcgcccaggggtggcttgagacgcgccccgcctctggaacgcgcgtggcggcctccctaccgcgctcggcgttcgctgacgtcgaattgcccacgcagcgcaagtcggccttgctccgtcgggatacctccctcgtgtcgatcaccgatgggttgccggaccctcggctcgcgccgcaggcggagttggcgcgcgcatacgcgcgggcgcttcgctctctcagccgaacagcgggggctacggcgacgcagcaggagctccgagcctccgcgaagtgatttcgagcttcgtcaatcaggctcgcgggctctccacaaccatcgatgagatcttcctcgcacgtggatcgcagggcgcgctcagcctctacgcactggcgatgctcgaacgtggcgacgtggtcgctgtggaggtgccaggttacgcacctgcgtggcgcgcgttcgagttcgcgggggccaagatctcgcacatccccatcgatggcgagggattgaggaccgacgtcctcgagaagacggcgcggaggttgtcgggcaagctgaaggccgtctacgtgacgccgcatcatcagtacccgacgtcggtctccatgacgccggaacgacggataaagctgctacagctcgccgagcacttcgacttcaccatcgtcgaggacgactacgactacgagtaccacttcgaaggtgagccgctgctaccgctccacgcgaccggaggatcgcggcgcgtcgtctacatcgcgtcgctgtccaagctgctcgcgccgaccgtgcggctcggctacctcgtcgcgtcggaggggtgcattcgcaagctgaaggaaacgcgtgagctgctcgaacgacaaggtgacgtcgtcctagagcacgccatcgcggagctcttcgaagacgggacgctccagcgtcacgcgaggcgagcccgtcgagaatacaaagcacgccgagatcacctcctctcgcggctccgcgcgacgcctgcgctcgacgagtgcttcgactactccgtgccggcgggtgggttggcgctgtggctgaccctgcgcaagggaagcatcgactcgttggtggcaagggcgcgtgaggagcacctgctgatggctccaggctccacctatcttcccaaggggcgcttggacgccgttcggctcgggttcgccgcgcacacgccggacgagctttcgcgaatctgcgacacgctcgcccgttgcattccaagccgacctggtctgcgccccaatcttcggaccagttgaagcgagagcgagagtcctcgctgaccggaagctggcgaagagcggcggccagaaggatgagctgctctccgtgcgctgggaagaaatacaggaggaaggcccctacgccttcgccgacgcgaaaccggaacctcccgggcggtatgcgccctgcgctctcctcgcatcatggacacgacgagggaatcgttggcgtagcgcctgggacagccggagagggagttgcagtggaggctgcacttcgccgtggactcggagcgggccgtgcaggacggtgtccctccgggcgtcatcctggggggacagtgcctgtggcacttccagcgacagcttcatcaccgcacggctcgccacggcccgggggattgccacttggctgccgcgctgccccacctgccaccgcgcaaaccatccacggcctcgcgcagcccacctggtctccccgtccacccgtcggggccctgacgcagccgtgttagatattgatgcgggaactgacggtgcggatgtccatccccagcgcggagaactcggcggcgtgggcgcgcaggcactccacgaagcggggatgcacgtccgcctcctcgttggccagcaggaagccgtagctcgtcttcgagagcatccacgaaatccacagcatctccgtggcctcctccggaggcggcgcgacgtcatggtccgcctccgtcgacagcgcgcccgccttgccccagcgcaggcccaggcacgcatagagcacctcgcccgcgtcgtcccattggaggttgttggcccaggcatggcggaacgtcgcgaagtagatgacgtaccggcacaactgcttgagcgcctccatctctccgggctggggcgcgtccgtccgggtcaccgcgctgacggccttggcgtgggtcgcggcgaccttcgcgtccaggtccatgcgctcggagcgcacgaaccacggcgccgcccttcccggcaccgtcgcgcgcaggtagcggcacacgaaggcgggcgccgagtgccccaccaggtcgtccgagaagcgccgcacctcgctccactgcgcctccaacgccgcgccgtgctcggcgaagaaggcatccacgtgctcccctaccagccgccagaacaggcccgccgcgcgtgcgtagcggtgcgactcgcagatgggcggcgcgggcgcgaagcccttccagtcgtagctgcccatcaggtgcaacagccgcgtctccacgctgcgctcggtgagcgcgctggcgcgggtgatgtagccggtgggtcccacgaggaagccgttggcggagtggttgatgaggaccacctcccgcaggtgcggcatgagcagccagcgcagcggactgcggcgcagattgcggtgcgcggcgatggcgtactgctccacgttgaagtggcactgccccaggtggttgcccagctccgtctccagcgtcgcgctcacccgcgccatccgcttggcggcctcccaggcctcgccgtccgcgggcgtgtagctccgccgcgtcacgggagagcccggcgccgtcgcgcccggctcgcgcatgcccaggatgatgcgcaccggcaacagccgcccctccaccagccgcagccgcacgtccacgtccggcaggcagtggacgccgtcctgctcgtaagcgttccacgggaagtagagccggaacgcctccgggtccccgggagcctccgggtcgccatccatgagggtggagaacatgccgttgagcagccgctctccgaagaaggcgtcggtgcgcgtggagcccggcgactcgcgctccatccgcaccgtcatcgcctccggatagtccgcctgaatcctgtccaggctcggcgcctgtcccagccgtccctggagcaggtggcggcgcttgacgagctcgatgggcgccaccgccttcagcatcgccagcgcgcgccccggcgcgtaggccgtgggcggagtcccctcctcccgtgacaagcaaccgggccaacggcgtcgtggggtcgtactcccagtaaggcagccgcagcgtgccgaagtcgtagtggagcccaccatggtcatccggccccttctcagagccgatgcggcaccatgcctccaccacccgcccatccgggcggaagctgtgctggggctcgaagaagcgcacctccaggtcgggcaggtcattcacgcccgcgtcggccgggtcatagcgaatggaaaaacatccatccgagtccgtgaacccctcccccaggaagtcatccggcgtgccgaagtcccggtcccacagctccaccttgatgtgatgcatgggaatggggccctggggcccgtcctgctcgaagaccaaccgcccgaccgcgacggctggcagcgtgctgggctccctcgcgggacggacagcccggacgcgcggtgcgagctcgcggctgatggccagacgctcctcgagcgcgagccccgagtaccaccgggacagctcctccgcgtcgagcacctcgttgcttccgctctcgcgtcctttgcccccgagagcgcccatccatcggcgcagccctgcgaacatcatccccgtccccatgccgcgggcgcgcccgtcccaacgtctgtcatcagctccacctctccgggtcacactcgcgctcacgtcagacgctggttcaatgcgttcctgcgctgagcgacgccggcttcattccctgaggggaggataccatggcttgaggtcctactattctcgttctacggtctgcgcccgctacacagagggttccatgactgtcgagtacaaactcacgattcggacgggcacgaagctcggcgcggggacggatgccgacatttccatcgtcctcgtgggcacgcgaggagagagcgccccccgcgtgctggacaagcacttccacaacgacttcgaggcgggcgcggaggacgtctacgccctctcctccgaggacctcggtgacctggtcctgttgcgcttcagcaacgcgggcggcgtggcggccgactggctgctcgactgggcaatcgtcacggccggagagaagcagtggcacttccctttctaccggtgggtgctgagtggcgccacggtcgacgtgctcgaggggaccgcgaagctcgctcgccaggcaagcagcgagcgcgagtccacggcgcggcgcgagctgctcgaggcccgccagcggatgtacccgtggcgcgcgcctgagatgaccgaggggcttcccggcgcgctcgacctccgtgaggggaggccgctgccgaaggacgagctctaccggggcctgacggagggcagctacgaagtggtcatcgcgaagacgctggcggccatcaagctgaacctgcccatgctgacccgcgcctggaacgggctggtggacatcttcgacttcttcaaacacctggaggtgccccagctcgcccagcgctggaaggacgacctcgagttcgcgcggcaggccgtccagggcatcgcccccctccacatcacgctcgtccccagtctgccgcagggcatgccgctcaccgacgacgacgtccggggcctcttgtcgcccggcaccacgctggccagggcgctcgacgccaagcgcatcttcctgatcgacttcgaaatcctcgacgacatcaggatgtaccggaaggtcggcgaggacggagtcgaggagcggcgctgggctcccgcggcgcgctgcctgctgtacctggatgaccagcgtcaactgcgacccctggccatccagctcgggcgggacgcccagaaggaccctgtcttcacgccgaacgacgacgcgtacgactggctcgccgcgaaaatctacctccggtgcagcgagggcaactcgcaccagatggtgtcgcacgcgctgcgcacacacttcgtggcggagccgttcgtcatggcgacgatgcgcaacctgccggacccgcaccccgtctacaaactgctgcggcggcacttccgctacacgctcgccatcaacgagggcgcacgcaagggcctgctcgacgcaggcggggtgttcgacgacttcatcgcgacaggcggccccgacaagggccacctccagttgggcaagaagggcttccagcgctggacgctggcggacaacaagccccgtgctgacctggagcggcggggcgtgctggaccctgccgtgctccccaactacccgtaccgggacgacgccctgcccttgtgggacgcgttcgaggagtacgtcggcggcgtcctcaggcacttctaccggaccgatgccgacctcgaggccgacaccgagatgcagcaatggtggaaggacctcaccgagcacgggctgcccgtggacaagctgccctgccgggagctgcgccgcgtcgacgacctggtcgacatcctcaccaccgtcctcttcacggtcagcgtgcagcacgcggcggtgaactacctgcaatacgagcactacgccttcgtaccgaatgcgcccctgagcatgcgccgggagccaccccgccagaaggggacgctgcgtgcagaggacatccccgagatgattcccaccaagtcccagatgctctggcaggtcgccatcggccgggcgctctccagcttcggagacgacgaggagtacctgctgcacgagggcggctggcgcgaggagtacttccacgaaccggagctggtggccatccgccagcggttccaggagcgcctgcgcgcccagcgcgaggcggtggaggcgcgcaacgcgggcgccgaggtgccctacaccatcctgcgtcccgaccggattccctgcggcatcaccgtctgagcccttggagacacacgctcatgcccaacctgctctctcgaggtctcttcagtctgttcttcggtggccggcgcaagcccctggccagccttcctggccccgcgccggggattctgggtaacatcggcgacttcctcggcgcccagccgtgggacgtctgcgcccgctacgcgcgcacctacggccccgtcgccgtcgcctggctgggacccagcccggcgctggtgctcaatgaccccaccctcatccacgaggtgctggagacacgccggctggagttcgagaagggcaacatcggcgaccagattcgccactccgtgacggacgacacgcccttcatcgcacagcagggcgaggactgggctcgcaagcacgccatggatccgctcgcccagccgtggactcccgcctggcaggcggcccaggtggagcccctgcgcgcggccatcctcgagtcggtggaggcgctgctccagcaaccctccatcgacctgacgcccacgctgcgcaagctgacgttcgacgcgttctgcgtggccacggtgggcgagaagctgcccacgtccgtgtacgacgacttcatgctcctggcggcggcggccgacgcgcgcatccaggccaagctgccgttgaagttcgtctcaccgcccaagggtttcgcggatgcgaaggagcgcttctacggcctgttcctggacaaggttcgcgcggccaggaaggccccggcgccgcaccgcgtggacctgatgtcgtggacgctgcgcgagatgccccagctcgacgatgtggtgcacgcgaacctgctcggcgggttcttcttcggaggcgtgttctcctcgagcaccaccctggtgggcgccttccatcagctgaacaagtaccccgccaccgaggagcggctggcgctggagtcccccgcgctggggcaggggccgctcaccctgcagcgcctaaaggacgcgccctggggcgaggccgtggcctatgaggccctgagaatcctgcccgcggtgcgcatcttcctgcgccgcacgccgcccacaccgacgcggttggcggaagtcacgctgccgccgggcacgacgctca

SEQ ID NO: 1265 - DNA, 29899 bp, Myxococcus xanthus
tcgctgccggtgccgatgaggatgacctccggcttgccgccctccgcatcggacagcacgtagccgccgcgagccacgccggacgccgcgccgaacttgctgcggtccagcgtgggcacgggctggcgcgtgagcaccagcaccacggggtgcttgcgctgctgggcaatcacccgccacgactcgaccacctcgttggcgtcaccggggcgcagcacgatgatgccgggaatcgcgcgcagcgacgccaactgctccaccggctggtgcgtggggccgtcctcgcccacgccaatggagtcgtgggtgaagatgtggatggcgggcagctccatcagcgcggagaggcggatggcggggcgctcgtagtcactgaagatgaggaacgtggcgccgtagccgcgcagcttgctcaggcacaggccgttgacgatggagcccatcgcgtgctcgcgcacgccgaagtggatgttgcgccccgcgtactcgcccggcttcatcgcctccccgccggtgatgtacgtcttcgtggacgggttgaggtccgccgagccgcccaccagccacgggtagtgcttggcgatggcgttgagcaccttgccgctggagtcgcgcgtggccagtcccttggcatcggcggggaacgtcggcagctccgcgtcccagccctggggtgcgtcgcggcgctgcatgcgctccaactggtcggccagctcggggaactgcttgcggtactcggcgaacttctgctcccactccgtgcgcagctgcttgccccgagcgcccatgcgctcctggaagcgctcgcgcacgccgtcggggaccaggaacttctcgtcctcgggccagccgtagaagcgcttggtgcccttgatttcctcgtcgcccagcggctcgccgtgggccttggaggagccctggagcttgggcgcgccgtaggcaatctgggtggtgacgatgatgagcgtgggcttgccgcgcgccgtcttgaaggtgcgcagcgcctcacccatggcgttcaaatcgttggcgtccggcacgcgcagcacgcgccagccgtaggcctcgaagcgccggcccacgtcctcggtgaaggccaggtcggtgctgccgtcgatggagatgtggttgctgtcgtagatccagcacaggttgggtagctggaggtggccggcgatggacgccgcctcggacgccacgccctccatcaggtcgccgtcgccgcagatggcgtagacgtcgtacccgaacatctcgaagccggggcggttgtagtagctcgcgagccagcggctggccatggccatgcccacgctgttggacacgccctggcccagggggccggtggtcgtctccacgccgctggtccaccggtactcggggtggcccggggtggacgagtcgagctgccggaacttcttgatgtcctcgagcgacacggtgggcgcgtcctcgacggtgtactcccgcgtgacgcgcttcaccccggccaggtggagcagcgcgtacagcaacatggaggcgtggccgttggacaggatgaacctgtcccggtccggccagatggggtgggacgggtcataccggagctcctgctgccagagctggtacgccacgggggccagggacatgggagcccccgggtggcccgagtgggcctgctgtaccgcatccatggcgagggtgcggatggtgttgatggccagcacgtcctgcttgtcggttgtcatggtgtcctcgcggtcccgctcgcgtgcgcgcgcaccatgccgcaagtgacgctccaggtgctgcaccaaatgcgctggggcccgcccggccgtccgccagtccacgggcgcacccggaattcctgccctggggggcacgggaatgaatcccgcgcgcccaagggacacgcctcagcgccgcgccgccgcgcccctcacggtgcggccccgcgtcaggtgggtgacggcttcacccaggccctccaccgtcagggcgaacatggggaagatgcgggcaatcacggagatggtccccgagcgccacgtgcccatgggctccgggttgagccacacgttgcgctcgaagtgctgcgccagctgcatcagccacgtcagcccttccagcccgtccgtcttgtagtgcccctgcgcgtcggtgcggatggacagctcgtagggcgccatggaggcatcccccaccatcaccagcttgtggtgccgtcccacctgggccaccagctccggcaccgtgattccgcccgtgagctgcggcgtggcgtagagctttccgtagacgcagttgtggaagtagtaggtgcgcagttccttgaagtgcgtcgcctggctggccacgctgaacagccggctcaccagcgccgcgtacgggtccatggagccgcccacgtccatggccagcaccacgcgcgtgttggggcgtcgcggcggccgtgtcaccacttccagctcgccagcgttgcgcgcggtcgcggcgatggactcgtccacgtccagctcgtctggtgcgccgtcccgggcgaaggcgcgcagcttgcgcagcgccaccgccatctgccgggtgtccagcaccacgtcgtcgcggtagccggcgtacttccgggcgccggcctgcatcagcgcgcggccctggcggttgcccgcgccgccgcccacgcggatgccctcgcggccaaagccgttgttgccgaagggagacgtaccgccagtgcccacccagcggttgccaccgtcgtggcgctccttctgctccttcaggcgctcctcgaagagccggcgaatctcctccgggtctagctgctcgagcagcgcgacctcctcggggctcaggtcgggccgctcgcgcgcctcctccagccagttgagcagctcctgcgtcagctccaggctcgccgtctccacgccctggaagtgggcgaggaaggcctggtcgaacgcatccaactgcgtctccgagtgcacgagcagcgcccgggccacatggtagaagccgtccaggtggctgtcgtgcaggcccgctcgcagcgcgccagccagcgccagcgcctcctgggcgccgaccttcagtccgcgccggcgcagctcgtagaagaagggcaggaacatggcagcgcctcgctaggcccggggacggcgcccgcgcccgaaggcctccgccacggagaccaggtcctgctccttcttcagcagcgcgcccaggaaggggagctgttcgtccagcttgaggtcgttgacgccctgggccttgagcacggcaatccagtcgatgagctcgctggtggagggcttcttgcgcaggcgggtgaagctgcgcagctcgtagaagaccttcagcgcctgctcggacagcgcgctgtccaggcccgggtggtgcacgccgacgatacggcgcatcagctccgcgtccgggaagtcgatgaagtggaacacgcaccggcgcaggaaggcgtcgggcagctccttctcgttgttggatgtaatcaccaccacggggcggtgtttcgccaccacctcgtcacccgtctcggtgacgcggaagcgcatccggtccagctcgtggagcaggtcgttggggaactccaggtccgccttgtccacctcgtcgatgagcagcaccacgcgctcgggggaggagaaggcctctcccagcggcccctggcggatgtacttgcggatgtctcgcacgtccccgtcgttgaagcgcgagtcatacaggcgttgcacggtgtcgtagacgtagaggccgtcctgcgcgcgggtggtgctcttcacgtgccaggtgatgagccggtgccccagggcctcggcgatggcctccgccagcagcgtcttgccggtgccgggctcgcccttcaccagcagggggcgctggagggtgagcgcgcagttgaccgcggcctggaggctctcgtgggtcaggtaggtgtcggtgcctttgaagcggacgggagtgggcgcctggctcatgctccatccctttaacacccgccgcgttgtctggggggctcacgtacccggggctccggaaacgtcagacccgaacggcaagctcgttcgtatgtctcgggcagaagccgccgggcggactcgcggggaggagactcgcggggttggccggcattcacgtccgtcacttgctttgaggaggcgccatgggtcacctgtttgttccagcactgctgctcgtgggagccttctcgctggcggcgcgcacctgcgggacggccgccgtcacccggccgcccgagctccagcgggaggccccggagcgcgccctccctcgggtcgagccgccagccaccgtcagcgtccgggggtagacgctgctctggcgggaggggccgacctcacgggatgtatggcttcgcccgccggtcaacgattggtgcgagccaagcacaggttttcacaccggtttcccggggcccggtgtattctcccgagcaatgtccattgcgaatgctcttggcgaagtcttccggcgcgaactcgatgcgcagttggtcccgttgcagcaggcggtccggcgcatggaggaaggcctggaggccctggagttgctgcgtgaggtgacgcaccggttggcgccgctgaccagccgtctcggcgccatggcgggagtgcggacgcccacggagttgcccgcgtccacgcgcggaggccgcaagcaggtggtcgcggcgccaaagggccgcgcagccgtgggccggcccgtggccgcgaagccggtcgtcagtcaggcgcgcacggaggagggcacccgggcgtgcgccgtcatcggttgcgagcgccccagccgttccaagggatactgctcggcgcactaccagaagctgcggttgctgatgcggaccaaccgccggccgtcggcgtggaaggacgacgcgcttccgcaatcggtgggggacgtgacgctgccgcgtggccgcgccgccagcaaggcgctgcgcgagggtggcgccaggaagaaggccccggcccccgtggtggcgccgccgcccgccgaggagaaggcgccggccgccgcgaagaagtcagcgggacggaaggccgcgggcgcgaagaaggccgcacgggcgaagaaggccccggccgccgcgaagaagtcggtggccaagaaggcgccggccgcgaagaaggccgcggccaagggtgggcgccaggtcaagaccaccaaggcgaaggtcggagccggcaagcgcaagaagggccggtcctcctcccagggctcgttgttctgattcgaccgccgcgctccgcggattccctcgggccttcgggcccgagcggctcaagtggaatccagggagcgcggtgagcaggccggacgagcgaccggttcccggacatccccttcgagtctccgttgacagtggcggggcggggatgggattcggcccggcatgagcgagcaaggttatccggtcaccgtggcggtgcgtcgtcccgacgggcgggtggagcaggtgcgtgtgggcacggcgttcaagagcggtgagggcttcacgctgacgctgggagagatgtccatcggtggcacgccggacgcggcggccccggcggcgcggcgttcagcgcccgcaagcagcggtggcggcggtggtggtgatggaatggtcttccccaactacggccgcagcaagggcggacccattgtcggcgccagcatgggcgacctggagttctacgccaacggcgcgcgccgcacgctgaatgacgcgagcaagtcgcgctggcacgacaaggagcgccaactgctcgccgccatcgaggcggaaatcgcgcggcagcggggcggcgacgagggtggtggcagcgacggcggctatggcagccagggcggctacggcaaccagggaggctacggtggtagccggggtggtggcggcttcggaggcggcagctacggcggcgacgacatccctcctccgaacgacgacgacaacatcccgttctgagccgcgccaggtcggtgagtggccgccgccccccagtgggtgggcggccttcccgatgtgttgatttcagcacagccgtctcatcttctcttcaatccagatactcccagtgagaggctccgcgcccagattcgtcgcatgggtcttcaatcactcacgcgcgcagcggcccttttcacagtgcagtgaagtcatcggcgacacctggggtgacatgcgcagtcactgagaggaaattctcgtgacggagcgcttcattcgcaacggttgccgcttcatttgtgaagcactgaaaatctccagcaatcacagtgacttagtcgcaccgtaggctcgggcatgattcacgggtgaatctgtcctgttggccagcggcagttgtttcaatgacttcgtatatggcctgaatcctgctcaatcccccgtcgccagggaatccctcccatatggcgaggctgtgaaaaaacggggccattaaatgacacccaatgtctgtgtcgtcggagccggtgccttcgttccttcacgcgtggtgagcaacgagcggatcgccagggccatcccggggtggccggcggagcgcatcgaggagaaggtcggcatccgcgagcgccgcttcctctgggacatcgacgaggccacgggccgggcgattccgccgcccgagaatgacgggcacatctacccggccagcaacacgaacatgtgcgaggtggcgctccagaaggcgctcgcccaggtgggtgtggatgccaaggagttggacgcgctcttcgtggtgacgtgtacgccgaacgcgccgcacttcaaccacagacgccatggagctgcaccggcggctggagctgcgcgaggacgcgttcgggctcgtggtggacgacggctgcggtggcacgccgtacgtgttggacatggtgaagaagatgatggaaggagggcgcttccgcacggtggcggtggtggcctctgccttcacgtctccgctggtgaaccgtgaggtctacacggacgagctgccgcccgggccgggccgctcgaagacgctgcagggctacctctccatgtatgtcttcggcgacggcgcgggcgcggtggtgctccagtcgaagccaggagagtcgggggcggagggtatcctggcgtccttctccggcaacgcgtacggagacctggtcatccgcaagggtggcggcctgttgaagctgccgtatcagccggggcggatgcgcccggcggacatggccttcgtggtggatggcttccgcgtggcgcgcagctatccggagtacatgcagaagtgcctcgacgccgtcctcgggccgcgtccggagctgcgttcgaaggtggagcggtactacttccaccagccgaacaagcgggtgatggacgccttcgtggagcgggcgggactgccgcgtgaggcggtggcgtgcaacgtggaccgctacggcaacacgtcggcggcggggatgctcatccttctggccgaggacttggaagcaggacgcgtgcgtctgggaagtggtgacctggtggtggtggcagcggtaggcgcgaacgtccattacggcgcgcaactcgtgaggttgtaatgaacaagatggatccgaatatcgccaaggagttggacgcgcgattggcgctggcgacgaaagacgacacggcccgcgggctcttcttcaacggcgtggtgtccgccgttcgcacgatgggaggggacgcggcggtggagcgctgtctggcggccagtggcgagacgcgcttcatcgacttcttcaactacccggtggccgccttcctgcggatgtccttcacggcggcgcaggtgatgggcccggagcacggcggcttcgacggagcgctgcggcgcatgggcgtggtggccacgacggacttcctgtcttcggcggcgggcaagacgctgttgttgttggcgtcggacagtccgaagcggctcgtaggcaacctgcactcgggttaccgcgcggcggtcagctacggcgagcgcgcggtgaagtggacgggcgacaccagcggcatcttcacgatgaagcgggacttcatgccgcccgcctaccacgagggcacgctccaggccgtcatcgaggcggtgggtggcaagcaggtccaggtgcacggccggcagacggggccgctcgacaccgaatacacgctgtcgtggcagtagccctggcgcggggcgcgtcgaaggggtgcaagcggtgggctgaaaagcccctcacggtctggagggagatacgccatgtcgcgaaagctcggcggtgcggtggggatgttgggtgtcctgttgctgtcggcgcaggcgggggccaatgaggtggtgatgcagttccgcacgcaggaggacccggcgagccctgcggacccggcggtgtgcgcggcggcacccttcgaggtgaacgtgaagctgggcgggagtgtgtatgtgccagagcacaatcccaaggacggcaaggtggtggatgggggcggccgacgcgtgggctcggcgacggcatgcgtccaggtgacggacagcgcctttcccgccgggcagcagctgaatgtctacatgcgctacaacctgccggaggggcgcttcacggcgcggggcacgtgcacgctggtgagcaacgacgtgccagcggcggggctggtcctggctggctgcgcgatgcgactggtggacgtgcccaagggcttcgtgggtggctcggtgtcgagcaccagcgtcttcaatccccgcaagctgccgggctacgccacaggttcgtattacacgctgtacgcctaccgtgatggccaccagcgtgacgcgagcaaggtgacggaagcgcatgcggccgaggccgcggcgagagcgcgggagtagtcgccactcggccacactggagccacgggactgggcacggggcaagcgccggacagcggtttgcccagacacagcccacgtcggtccaggcccgacgaacgtgtcgagcatggcattccccgcgtcgggccaacgggcgatgatgcgcccatggaccgcaagcggatggagttctacacggcactcgggtaccgggctccttcagccgcggcaacggctcagacgacgtccggagtcgctagcgccgacgtatcggagttgccgccgctcggtccagacgacctgggcgcgctgcgcgagcgcttcctgcgcgagccggaagaggtcctgagcctcatccgccaggacttgggcgcgcccgtttcagagggagccctggtgcacgtgctccaggagctggagcagtccttacgcgagcccgaagccgcgctccaagccctgcggcaaccggcattccaggcacgggcctcggtgtcactgccgccggacttcaccttcccgttgatgacgactgaaattcccatcgacgcctcgcgaacccgctttgagcccgtggcggacctgcgcggatggctcctgttcagcggtcgcgcctggcttcacggcggctggcatcgggcggagttccgtcggcacgacgatgcgcatcacgccacgcgtttccgctacgagctccgcgagcccgcgccgggacggccggtggaggtcgcgttgttcggaggcttcggcacgggtgagtaccccgcgcgctatgtggcccgtcagctcatcatgcgaggcgagcggctggagtacgcggtgcacctcgggggcgtgtactacgcgggccgtcggggcgaattcgacgcgcatgtggccgagccgctcgaaccgttgctgcccgtcacaacgctgatgacgctgaacgcgggcccggagatgcgttccggaggcacccccttctaccgctacctggacgagcggcgaggtgcttcacgagcgaagcaagtccaggagggaagctacttctgcctggcctcggagcgcttccaactcatcggtctggacaccgcgtacttcgagccaggacggcaccaggagcccgcgctcctgagttggctggagtcagtgctgaaggagggccgccagcgaggagcaacgaacatcctcctgagccacgatgcgccctaccgatacggagaagcaaggcacgccggtttgctggaagacctccgggaactggcggtcgagcgcgcacaggtcgacgtgtggttctggggcgccacgccctacggagcactgttcgaccggagcgccgcgctcccgttcctgggaggaagcctggggcacgcgggtctcccggtgcgagcggtgacgccgggcctgaagtctccagcacccgtgcgcttcctggagtcgcacgcacgcttccccgagtggacagacctgaggcccgaactgggcaacaacggctatggctcgctgctgctgcacgaggacggaacgttgggcctccaactcctggactggcggggcaacgttcgctgcacggccaagctggcccgcgagggggacggcccgctgacgtaccagcacctcgagacgtccgaatcggcgctgtgagcgcgcgggcgcggtgtcacagccagacgcgcgtgtaccaaggcggtcgggaaggcacgctcctgctccgagccgggtcggcaggacgcggcacggtgacgtaccggagccggtatccgtgaggcagcgtcttccagtacgtcacctgccacggcgtcagcacctcgccgtgcttggactcgcccaccggctgatgcacatcgccgagtgactcatggaagtggaactctgcgtccgcggcttcaaggctcgcggcctcgatgacccaggcgtcctgggcctcgtcggcggagggctcctgccccgcgttgacgaaccggctccaatcgggcctggcgtggtgctcccagatggcgccgccggcatccgtgagcgaatagccaaagggagtgcgggactgccgggcatcaatggcgcttgaaatctcctcgggagagaacagctcctgcagcccgtccggaagcgcgtggacgcgaatgagtccgcgctcggcgagcagcgacagccgctcacacagttcctcccgggacagccgcggatcgtccgccatgttgagcgcgatgtgcgggttcggctccacgagcatgtgtaggggcgtgggcagctccatggcggcctccagaagccagaggtccagggtctccactggtgggctctcactaacgggcggtgccatgcgtcctcctcactcctggggaatgccacgctcgcgcatgaagatgtccagggacttccgggccttcgactggaccttcttcttcaacaggggcgtccacccgagcaccagcccggtggggcccagcgcctgacgggaccaggtccagaagtcgaagtggtcgcggtgccggacaatcttcccgtcgcggaactcgaactcggcatcgatgcggttgagcaccttcctgccggtgccgctgaacgtgtagttcgcatcccagtgggcgcggccccggtggtcatcggcctgcacgtcgcggaaggtgacctccaggtccttgccgcgctcgcagagcatgagccacatggcaccgggctcccggcgacggagtccgacgaaggcggcgtcggagaactccacctcagggtggtagcaggcggccatggcttgggcgtcccggcgttggaacgctgagtagaagtcagtgatgagttgggcgtgcgggtgcatgggacaggtgtagcagacctgtcagtgaagacgtgccaattgcccggatggcatcgtttgaagggtgaaactggggtggttccgctcgagcgaacaccccgcatggggtcccggtggggggagggccgtcgtgtgaaccggtggaccgttgccatgcggaatcgggcggcgcagaagaggcgtgcatggcagattgcggcccatggctcgcgacatcgtcatctggccccataaggtcctcacctcgtccaccaagcccgtgactgacttcggccctccgctcgagacgcttttggagcagatggccgagtccatgaaggaagccgaaggcatcggcatcgccgccaaccaggtcggcgaatccctgcgcgtggcgctggtgggacgggaggacggcaccttcttcgaaatcgtcaatccgcagattctggagaagaaggagccggtgacgatggaagagggctgcctgtccgtcccgcgcgagtgggagaagtgcccgcgcttccacaaggtgaaggtgcgttaccaggacaagtccgccgaatggcatgaactcgaggcggaaggtcggcttgcgcacgtgctgcagcatgaaatcgaccatctcgacgggcacgtcttcgtggaccacctgtccagcctcaagcgcacgctcatcctggaccggatgaagaagctccagaaagtgaaggcccgccagaagggctagtcaggatgacaggatggccgaagccgccagggccacgcgctccatccccgagcgcgtggcgcgattccgcgaggactaccggcgcaagcacgtgagccctcgctactctgggcgcgcacacttcgtcttcacgagcctgggctcgctggcggtcatcggcttcgccgtgtcccacctggagggaaggcggcccctggaatggctgacgctgcccgcggtcttcctgctgggcaacgtggtggagttcctggggcaccgagggcccatgcaccaccgccggtgggggctgggccttcttttccagcggcacaccgagcagcaccaccgcttcttcacgcacgaggccctggcctacgagtccgctcgggacgtgaagatggtgctctttcccccggtattgctgctgttcttcctgggcgccgtcgccgcgccactgggggcgctgtgcttcgtcctcatctcgccgaacgtggggtggctcttcgtcgcatcggcggtcgggtactacctgacgtacgagtggctgcacttctgccaccacctgccgcccgagcacccggtggcccggctcgcgctgatgcggcagctgcgccgccaccacgaagcccatcacgacccttcgaagatgcagcgctacaacttcaacatctcgttcccgttcgcggactggctcttcgggacgtcatggcggcccgacaatgaccgtcgctagaagccctgaacgccaggatcgcgcgtcctggctcggagggctggctgctccccgagcggtaaaccccggatttttcagtgtgcaatgctcttcgccggacctgggttgtccccaatgaaggtggggttcaccctcagggacggatgctggtacgcggcgccgatcatgatccattggcgggcagtaatcggcgcgttagtaagtggccccgtgctcaacgtctgggtgaccgtcacccaggagacgatgggcaagtatgggctgacgaagtttgatggccctcaacgcggtggtggtacaagccgcacccatcgcaaagaaacccgcgcactggcgcggaaggcacttcgagcgagtcagtacgacaatatggaatacggcagtcaacgcagcgagttgacaggagacgcggtggtggtagaagccgcgccccgacgaagaagcccggaagaaagggcggacgagtcgagggagtcaacgaagcagcggttgacagggagggcggcaaagcggtagaagccgcgcccctctggaggaaatcagcggaagccactgggcggcgctgaagactccggaagccagcaggacggcgaaaacagcagcttgacagaagacgccgaactgaaatagaagctgacaccctgccgggcagaagaagacggcgaggcagcaacgaagagagtggtagcaagaagtcgccggcaagacaagcggctcggtctttgaaaaccaaatagcaagcccaagaagaagctagattgcggaaaccgcagtcaatttcttaagacggtgccagccaggtcgcgctgcgaagcgcagccggcagcactgtaacgaatcagcgagtttcaggttccttagccgggcctgggactgacgccggttcaaatcttcaaaaattcaattggagagtttgatcctggctcagaacgaacgctggcggcgtgcctaacacatgcaagtcgagcgcgaataggggcaacccttagtagagcggcgcacgggtgcgtaacacgtggataatctgcctgtaagactgggataacttcgggaaaccgaagctaataccggatacgattttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacgagagtaactgctcgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgaccagggctacacacgtgctacaatggatggtacagagcgtgcaagaccgcgagggggagctaatcgcataaaaccggtctcagttcagattggagtctgcaactcgactccatgaaggaggaatcgctagtaatcgcagatcagcacgctgcggtgaatacgttcccgggccttgtacacaccgcccgtcacaccatgggagtcgattgctccagaaatcatctcaccaagaggtgctcaaggagtggtcggtaactggggtgaagtcgtaacaaggtagccgtaggggaacctgcggctggatcacctcctttctaaggagaccgggcatcggacagcgtcttcggacgcagtaggcgatgccagcggctttcgagtcgcgtcaggtcaaccaggtcaacgtttccgaataacaatctagcgacttactctgggcttgctgtttggttttgaaggactgagtccatgcgacttggctctttgagaatgaaggatgctgtagggtttgccgacgcggtggcctcctgggcctatagctcagctggctagagcgcgcgcctgataagcgcgaggtcggtggttcaagtccacctaggcccaccattttcctcccaaggaggagagaagcggtgacgcgcacccaatcagctccacacaggttttcctgaagtctaggaagcgttctttgacaagtgcatacgaagggtaagttcaatttctgctgagagaagttctcgcagaagccctgacgaaagtacccagccgacgccgtgaggcgaaggtgaggggaagaaagtcaggtgcttttaatcaagcgtaagtaacaagaagtcttccgggcttgctgcgaagagcaggagtctgggccttggtttcgagtttcgacaatccgccgggaggcgggcgtgaaacaagagattagggcaagtaagctactaagggcgtgcggtggatgcctaggtgccaagaggcgatgaaggacgcgggtggctgcgaaaagccccggggagctgtcaaccgagcgttgatccggggatgtccgaatggggaaacccagcgctgcgaatagcggcgttacctttcactgaatacataggtggaatggagctaaccaggggaagtgaaacatctcagtaccctgaggaagagaaaacaatgagtgattcccaaagtagtggcgagcgaaatgggagaagcccaaaccgaaaccacgaaagtggcgtcggggtagcgggtccacggtaggactttgacttgctagcggaagcctctggaaagaggcgccaaagagcgtgatagtcgcgtacgcgaaagcgagttggagctgagtgggttacccaagtagggcgggacacgtgcaatcctgcctgaatcagccgggaccatccggtaaggctaaatactccttggcgaccgatagtgaacaagtaccgcgagggaaaggtgaaaagaaccccggtaaggggagtcaaaagaacctgaaaccgcatgtctacaagcagttcgagcactacggggcaacccagtgcgagagcgtaccttttgcatcatgattcggcgacttaatatacgtagcgaggctaagccgttaggtggagccggagcgaaagcgagtccgaatagggcgtatagttgcgtgtattataacccgaagcggggtgatctacacatggccaggttgaagtgcgggtaacaccgcatggaggaccgaactcatgaaagttgaaaatttctgagatgagctgtgtgtaggggtgaaaggccaatcaaactccgtgatagctggttctccccgaaagatatttaggtatcggctcgggcaattcaatgccggaggtagagcactggaacggctaggggtctcaccagattaccaaaccgtaccaaactccgaatgccggcaattgttatcccgggacgcagtcagtgggtgataacgtccattggcaagaggggaataacccagaccgacagctaaggcccccaaatctagtctaagtgaacactagaaaggatgtggcaggtcattgacaaccaggaggttggcttagaagcagccatcctttaaagaaagcgtaatagctcactggtcaagacaggccgcgccgaaaatgtaacggggctcaagactagtgccgaagcttcgggtcacacgtaaagcgtgtggcggtaggggagcgtcccagttgcagcgaaggtcgactgaaaaggcggctggagcgactgggagtgctgatgccgaaatgagtagcgttaaagggggtgagaaaccccctcgccgtaagcccaaggtttcctgggtcaagttaatcttcccagggttagtcggaacctaagccgaggccgaaaggcgtaggtgatggaaagcgggttaatattcctgcaccatcttgtgagcgttgaactaagggaggacggagaaagctaggcgagctgaccggtggttgtgtcagtctaaaggcgtaggggtgtcgcgtacgaataaaggcgcggcagctatccccgagactcgatggcgccccgtaaggggtaagtcgctgatgctctgcttccaagaaaagtcccgtagggagcttacagggtgtccgtaccgcaaaccgacacaggtgggcgaggagaaaatcctaaggcgcttgagagaactctcctccaaggaactaggcaaatttccaccgtaacttcggaagaaggtgggcctctggtaggtgaaggcgtacagccggagctgagagaggttgcagagaaatggcggtagcgactgtttaccaaaaacacaggactctgcgaaggcgacaagccgacgtatagggtctgactcctgcccggtgctggaaggttaaggggattcgtcagccgcaaggtgaagcgatgatccgaagccccagtaaacggcggccgtaactataacggtcctaaggtagcgaaattccttgtcgggtaagttccgacctgcacgaatggagtaacgacttccgcgctgtctcggagagggactcagcgaaattgaaatagctgtgccgatgcagtttacccgcagcaagacggaaagaccccgtgaacctttactataacttgacagtgacactagggattgactgtgtaggataggtgggagcctttgaagccgggccgctaggttcggtggaggcaacggtgaaataccaccctgttgatttctggtgtctaaccatgtcccgtcagccgggattgggacactgtctggtgggtagtttgactggggcggtcgcctcccaaaaagtaacggaggcgcgcgatggttccctcagcccgattggaaaccgggcgtcgagtgcaatggcataagggagcttgactgcgagacggacacgtcgagcaggtgcgaaagcaggtcatagtgatccggtggtcctgaatggaagggccatcgctcaacggataaaaggtactccggggataacaggcttatctcccccaagagttcacatcgacggggaggtttggcacctcgatgtcggctcatcgcatcctggggctggagcaggtcccaagggtttggctgttcgccaattaaagcggtacgcgagctgggttcaaaacgtcgtgagacagtttggtccctatctgctgtgggcgtaggatacttgagaggctctgaccttagtacgagaggaccgggttggaggcaccgctggtgtaccagttgtctcgccagaggcatcgctgggtagccatgtgccgattggataaccgctgaaagcatctaagcgggaaaccgacctcaagaccaggtatcccgggcgcaagcccctgaagacccgtcgaagactacgacgttgataggccgggtgtgtaagcgtggtaacacgttcagctaaccggtactaattggtcgtgaggcttactttccccattctcttgcatgccccctcaaggggagtaagggactcggggccaaggccgaggctcgagtgcttcttgcactcgcctggaagactcacactgcgcacagcgagacttcgctcagcaacgaattgaaacttaccctttgtatgcactgtcacttgttttccggtggctatgtcggaggggtcccacccgttcccatcccgaacacggaagttaagccctccagagccgatggtacttcgcgggaaaccgcgcgggagagtaggtcgctgccggattctttttgagaaacccccggtgtcccttgtggacaccgggggttttccgttttggggcatgtggagtttccgcgcgtcaccgcgggcgttgggccaggcgccgcgtgcgcagtcggcgcaggccccccaccgccagcagggccgccgtcgtggccagcaccagcaggtgctcggctcgcgccgcccctttcgccaccgcgtccacgctgtgcgagaaggcgtaccccagcgccaccaccaccggagcgctgaggcatagcgccaacgcgtcccacagcaggaagtcgcgcagccgcatcccttgcaccgcggccatgatgaacactgccccgcgcaggaccgagagaaagcgtcccacgaagatgcagcgcccgccgtggcgcgcgtagagctgggccagtcgctcgcggcgttccggcggcaggagcttcttcatccgtggatgcgcgtacagcgcgggccccagcctttgggcggtgatgaagagggccgtgtcgccgcagagcactccggtgattgcgaccgcgaccgccagggcgatggggaggacgtcctggtgcgcgaggatgcccagcgacaacagcaccaggtcctctggaatgggtacccccaagcctccggcgaccagggcggcgaagagcagggccgctgtgccatgggtcagcagccatgggagtggacccgcggccatcgtgttcccctttcagggcctcattcaggttccgcggggtggatggtgcgcgccgccctgcgctcctgccggaagaggaggacctcccgggagatgatttgaagggtcgcggccacgggtaccgccaccaccgcgcccacgatgccggccagctccgcgcagaacaggactgccaggaggacgagcagcggattgacgtggaccgtacgtcggaagacgagtggggccagcacgttgccctcgaggggcccgtacagcaggaagtaggcgagcgcgaccgccgccgcccagatgccctgcgcggcccacgccagcaaggtgatgacgcccccagcgatgagcggccccacataggggaccaggctggagaagccactggctgatgcccaggggcaggaagtacggcaaacccaggagcgccagcgccaccgtggtcagggtggcgttgatggcgcagacgagcgccagcccggacaggaaaccgccggtggctctgcagacgttgtggaggacccggacctatcgcatccggcgctcggggccgaccagggccagccccctgcgaatcaggtgttcttcgaatgtcagcctgaacaccacgaggaagaagacggcgagggccgagatgaccacccccaccacgcctcctatggctcggatgagcaccgtggggagggcgccggtggcgagccggggagtgccctcctccaaccgtcgcgcccagccgagcgccttgcagccggtcgctgagcacctggatgggccgagagctccgcagttcctccatcaactgcggccactggcgaaccagggcatcgagctggtccgccgcggcgggaatcacgagcagcgcgagggcggcgacgacgaccagtaacgccgtcatcaccagggcaatggcggccagccgaggcagcctgccgcgctccagtcgcgcgacgccatgttccaacgcgagcgccaggatggtggcgatgcccgtcagtgtcagtgccacccgcgtcttcgccacgagagtgacgagtacgaccaccgcgagcacggaggcgcagacggtgaacaccgtcgtcggtgtgacttgcgagcgttgccccccgccgtctcgctccgccaccaccgcccacgctcccgtgcagtaacgctgcctccgacgtgcccaccctgctgggaacgggctacccaccccgcggttcagggtcgccgcggacctggaagtgttggctcatggggacggattcgcggcggccgtccgcgtggccccactgcgcctcgcacgcgtgagtggagcgaggcgctgagcccttggggctcacggtgcgtcagttgcgcgacgggtagatgccttccagcgcgatgatgaagttgatgcacaagaagggcgacatgttgttgtgcggctggcttccacccgagacgccgatggccgcggggttcatggtcccgtcgatgggggcagcccggtagttgagcacggtcgccgtggagtccgccgcgagcacggtgccaatgggcgtttccgtatcgccgtgctgactgctcacattcagggtgtgagtgtgcgccggcatctgcgtcgaaatcagcgtcacggtttcggttccgccctgttcgcccatcgtgcggggggacaggccggggccctggcccggctgcatgggatagcggccacgcaggtccggcagggcgaacgtcgtctgcccattgcctccataggtggtgccaagaatggagaagagcgccgagttctgggcgatggagagaagctgcccttggcagaatgcccagcccctcggagcgaagttgcctgcgaacatcatgatctgaccgatgaagggctctgacacgtgcgtctacctttcgaggagaggactgcctgactgggcctgctgcgcttcctccctgagcaaaggtccggccagtgctgaactcgcgcgtgtttcatgtgagggtgacggcggtatgcaatgaaacgtgaggcgtggtgtctccatgtcttgctgagtcacgcacgctcgtgcgtccgatacagacgcgcatgcgtccggcccagacgccgagacagatgcgcgtgccgatgaaacgcgggtgcgtctgacccggacgccggggcaatgtctcgcgggttctctctcacgagagaatctgcccggttatcgccgaacctcttggggtcgccccggtcttcttggcgtggcgtgcggcttgctcagtggcccgcggcgtgacgtttcacgacgaggaggccggcagatgacgcaagagaactggcgacgcccgctgtatcagaagtggtttcaggcgcttccgttgacggcactgctggtgctttcggcatgtgaggaaggcacgcccggaccgcaggggccgcaaggtcccgcgggcgcagaaggccctccgggagcgccgggcgcagaggggcccgctggtcctcagggcgagccaggtgcgcctggtgctacgggcccacaggggccgcaaggtcctccgggcccggcaggtgggccggagggacctccggggctgacggcgctggtccgcaccgactccgaaccctccggtgagaactgcgcccaggcgggtgtggtggtggagacgggcatcgacctcaaccggaacggtcagttggaggatgaggaggtcgacgcctcgctgacccgttacgtgtgcaacggtgcacaggggctcatggggcccgaggggccgcagggcgccatgggaccgcagggcctccgtggtgagcagggcgtgcaggggccaaccggtcttcagggtgagacgggcatgcagggggaccggggaccggagggtcccgctggcgcggtgggacctgccgggccggcgggaccgcagggctccgtaggacctgagggcccggtgggcccattgggtgccacgggcccccagggtgatgtcggtctgggcacggtgacgcgtaccacagtggagccggcggccggcaactgcgccaccggtggcgtgcggctggagatgggcgtcgacgtcaaccgcaatggtacgctggatgcgggcgaggagaatgtcgcgctcacccgcttcgtgtgcaacgggccggtgggaccgcagggcgggcaaggtcccgcgggcgcgacgggacctgcaggggctcagggcccttcgggatcggttggtccgcagggccctcaaggtccgcaggggcccatgggctcgttgggcgcctacggtgacgggtcgactggggcgtacaacgtccccagcggcaacaccgtggatctgaccacggccactggctacggcacgttggccggccggcagcacctccagttcaccaacgtcaccatctccggcacgcttattgtcccgagtggaacggtcatccgggccaccggcgacgtcaccgtcaacggtacgatcatcgtggaccccagtgccgaggacaacggaaccgggcctgcggaggcaggcgtggcgcgtgcggccgcaggcgagccccagggcgggcgtgggctgttgccgctccaggccgcgcaactcctgcgacccggcggcctgggcggcggcgcgggtgccaagcaggtcggtgtggccggtggcaggggtggcggctccctggtcatgctcgcgcagggagcggtccgcattcccccggggggcgccatcaatgccaatggtgaggctggtggaaccgcctccaacctgcccggctctggcggtggcgcggggggcgccatcgtcctcgtgggcaagggctccatcaccgtggggggattcgtccgagcggtgggggccaatggtggcgctggcaacaacgcggggggcgcgggcaagggcggcggcggcggtggcggcggtggcatcgtccagctcctctccaccacgacgcccagcgtgacaggcggcattctcgtgagtgcgggtgccgcgggcgccaccgcgaatcccacgggcgcaagccaggccatctccgcgggcggtgggggcggcgcgtgcggtggaaatggtggttcgggtggtggcgggacgctggccgcgcctcagccgtccgaggccggggccgccggctatgacctccggactgtcacgcccacgccggagaacgtgttcctgtaggtcctggcggtttgggggggatgcgggcggctcgcgggcaatcagctcgcgggccgttcgtgtttccggagcatggttccgctgtgcatcagtcctgatgtggtgcggggttccacgtcagggcgacgtaaggggcggcggcctcctcgggaggctcggcgtccacctcgaagcccaggcgctcgtacagcctgcgcgcggggttggttcgtagcactcgcagccggagggggacgcctgctttcccggcctcgtcccgcacctgggtcagcagccgggtccccacgccgctgccttggtgtgcgggtaacaaggcgatgtccaccacccgccacgccgccgcgtccttcgcgaccagcaggcgccccacgggttggccttggagacacaccaactggtggtcggcatgaggatggcgggccgcccagtcgtgcgactgcgccacccactgcatgcggaggaaggcgtcgcgctgtgcgggcgcccagccccaggcggcgagctcagactcccgggtgctggcgtacagcgcgaagaggaagggggcgtccgcagccgtcgcggcgcgcaggtcgatggacacggtggcgagcagcatgactcgacgggcgacgacgcgtccatcagcggacggcccccgcggtgctccgtcatccgcccaacggtggatgcaagcagcggtaaatccggacgtcctcgcaatcgtggttggacgtcagacccggatgagattttcgggagcagttcccgaaggagccacacgatgaagaagacgcgagacgaggcactgaacctccaggaagtgggggacatggaggcgcggtggcggggcctcgccacccagttgctggaattgggggacgacgcgatggatgcgcagctgctggtggccttccgcgccgcgcgtgaagaaggggtggtgcctcccgatgcgggcttcttcctggtggcccacatcctcaccgccatggcggacgaggcgattggtgacgaaccccgcgtgtgccgcctggcgctggagctggagttgatggagcgtgagtacggcgtggagcagggcgtctggctcagcggcgaggagactccacccgaggactgggaggccctgcgcgcggcgtatgaggccgcttgcgacgaggcccgcgccaccttcttcactgcctatggcgaggaggagatggcccgcctctacctggatgaccgcatctgcttccaccgccgcttcgagagcgggcgccgcttcttccacgggctgcccatgcttcccgagcatctgcactgactctcagttctcaaattctctcattcgaatgatgtgagccgtctttcacgcatctcaggcggaatgttgcggctacaaagtttggattagcaggacttcaagctagctcaacgctgcgttggtgaggcggcttgcagcgtcctggccttttccttcgccacaccctattccggcgctcgcttccgggtggcgggtggggtggcggggaagaagtcaatgcataccataccctcggtgtgaagactcgaaactccaaggcgagtcttcagcagcttcgctgctcggcggcgcgcgtctctggctgaagtcccctccaaggacccggggccgcgcgccgccgctcttttttccgagggacggtggcctgggccgccacggcgggtggtggcgctagattcgcgcgccatgaccaccgactccgcccaccgtctcctggacctgctgtgggagcgctacgccgcggaggtgccctatgcgcgcaccttcgtgcagctctcagggggccgcttccgcaatgaccatgtcgcgcttcgctcgctggcccggcccggtggtggcatcgcgctcttctcgcagtccttcatccggctcggctggaaggccgcgggcgcgtacacctttccggatgcgcacctgtccgccatctatttgtcacatccggcagggctgccccgcatcttcatctccgagctgaagcaggaggagctgtccccgcgcgctcgcgagctgctcgcccggctgcccgaggaccccgcgcctcccgaggacgtggacgcactggccgcgtggttcggctcgccgccccctccagacgaggccgcgctgctggagctggagaaggagtcccagtatggcgcctggctgctcgccttcggccgcaaggtgaaccacttcaccggctcggtggacgacgtggaggcgtggcagaagcgcatgcgcgaggccggggtgccgatgaaggccgacatcgagggcgcgcccgggacgtcgctgcggcagacggccacgcaggccgcgccgctgcccgtgttgctcgagggcggtggctcgcgctcctggccctacgcctacttcgagattgcccagcgcacgccggacttcgacggcttcctgggcccccaggcccgggcgctcttcgacatgacgaagcgcggcgggtagctccgggtcatcctcgccggccaggggcaatcagcgcgttgaggacgtggtcgcgccactggccgtcgatgagcaggagctcccgcgcgatgccctccacctggaagcccaggcgcttcagcaccgcggcgctgcgcaggttctccggcaggtggttggcctggagccggtgcaggcccatgacgttgaaggcgtagtcacacagcgcgcgcagggcctccgtcatcaggccctggccttcgtagcggtggtccaagccgtagcccaggtccgcggactgcaacggaccgcggcggatgttcgtgagtgagatgttgccgatgatgggcgacaactggatggactgttttcgcggcagcaggaacacgcgcagcgacaggtcgagccggaagtcctcgcggtcctgcgccagccgcgtgcgccagtacgtcaccgagaagaagttggccggccgtgccggtgacacggtggagacgtgctcccggttcgcctcgtggtacgcgagcacccgccacgccgcatccggtgggagctgcaccagatgcaggcgttcggtgctcagcaggttgaaaactgcgtctgggcccatggcgggcattcaactccggcgtccgttggatttcagcgccgaggcgtcgtcgggggctcagcgccgctgccgccagtggcctcctcccctccacgcgggaggatgatttcaacgcgccggttgttggcgcggccctctggggtggagttgttggcgacggggcggtactcgcccaggccgcgcacctggatgcggtcgcgactcacgccctggctgatgaggaactcccgcacgtgctccgcccgccggtaggacagggcttcgttcatcgcgtccgagcccatcgaatccgtgtggccttcgatgaccatgggactgtcggacaccttgagcgcgtgggccacctccgtcagttgctcacgcgccgtagggagcaggtccaccgcgttcgacgcgaacagcacctgccctgacatcgtcagcaccaggcctcgttcctcctcgcggaccttcacgtcgcgcgccgtcgactccaactgtgtcagcgcctccgtggcgcgctgttccgcgtcgagccgcgcctgtcgctcgcgttccagctcccgctccacctggcgccgtgcctcctgctccgcttccagctccgccgagcgctggagcagttcgtggttctcctgggccagtcgccgggattcggactcggcccgcgcccggcgttgcgcttcttcctgaagccgcgtggtcttctccgccagccgccgcgactccgcttcctgctgctgggccagccgccgcagctgttccgcctcgtgctggcgccgctgggcatccatccgcatgcgctcggcttcctgttgctgcgtcacggcgtgctgccgggactgttgctgttgctggagggcttgcagccgctcacgctcggcctgggcgagctgctgccgggccgcatccagctccgcctgcgagcgctgccactgccgcgcctgcgcttgctggagcgtggcctgggcctccgcctgacgccgcgccgccaggtccgcggtgccgcgtgcccccgccgtctcggacttgcgcaacgccacgtaggacagcgagcgggtgcgaggagagtcctggctgcggtcgtactcccgctcggcttccagcagcgcatctcgcgccgccgcgacgtctcgaggacgctctcggccctgggggctggtggagacctcctggtaggccgcgcgcgcgttgaggagctcctggggcggtggtgcgtgtgcacaccccacggcggccagcgccgtgacgccagcgagggccttccatccacgcttcagcatgtcgctctctcctgtcgaggttggctgctcacggctggccgcggcgcagggactccgcctgggcggccaagcgtcgcgactcgcgctccagcgggacggcccgggccagcgcctgtgccagctcagcgtccgcctcggcctgcatgaagcgcagctccgcggcttcctgttcgccttccacccacagccgctccgcgtcggcaatctgctgccgggcgaactccaggtgtagggctgcttcggggactcgggcggcgccagcgccttccgccgagcgcagcgaggcttccgcctgcacacggtgctcgttcggcgcgggaagcacctgccgcccggcgcatcccaccatcgtcaggcccagcagcatcgccgccagcttcaggcgcatggtttcacctcctgccgctcgaggacgtggacacgcgtcatggcgcgcccagacgtagaggtgggccctcggagacaggccggcaatccgaccgtggcagggttggccgaagggcgggcgagcagccttgcaagcgccttccgggcgcaccggggcactggccggcgtgcgccgccgggggtagagagggcgacatgcgcctgcacctggtcgacggcacctacgagctctaccgcgcccatttctcgccccgtccgggccatgccgcgccggatggacaggacgtgaaggccacggtggggctgatgtcctcgctgctcgcgctgctgcacgacgcggacgaggcggtgacgcacgtggcggtggcgttcgacaaccccatccgctcgttccgcaacgcgctgttcgacggctacaagagcgacgagggcgtgcccccggagctgcacgcgcagttcgacctggcggaggaggccgtgcgcgcgctgggcgtcaccgcgtggtccatgaaggagcaggaggcggatgacgcgctggccaccgccgcggcgcgctgggcggacacggtggagcaggtgcggctgctcacgcccgacaaggacttgggccagtgcgtgcgtggcagccgtgtggtgcaggtggaccggcggcaggaaaaggtgctcgacgaggacgcagtgcgcgcgaagctgggcgtgccccccgcgagcgtgccggacctgctggcgctgatgggcgacgcggcggatggcatccccggactgccgggcttcggggagaagggcgcgtcggcattgctgagcgcgcatggccacctggaggacattcccgcggaggcgtccgagtggaaggtgcgtccccggggcgcggagaagctggcagcgacgctgcgcgagcaccgtgacgccgcgctgctctaccgccggctggccacgctggtgacggacgcgccgctgccgggcacgtcgtcactggaggacctggcgtggaagggcgtgccgcccgccgtgtacgaagcgttctgtgaccggctgggcctgacgacgctcaagcgccgtcccaagcgctgggcgccgtgagctcgtgcaggggcagcgccgtgggcgcatggcgtggcagccgcacg

SEQ ID NO: 1266 - DNA, 41768 bp, Myxococcus xanthus
  unsure (1)..(41768): unsure at all n locations
tcgggagagctacatccagttcctccagccgctgaaggggcggggcatgtcccaccgcagctggctctcgggactggtgcccaccgacgcgggctgcgcgaccgcgggcagtggctcggcccgcttcaccgccgtggctccggtcacggggggacagggtggcacgccagcgcaccctgggggtgctcgccttcatgcggagcgacacgtccgcgcccttcgacatcccggacctgtccctgccccagcagctgccggggcgcctggcgctgcccatcgacaacgcggacctgttccgcaaggcgcgcccgccggaggagcacacccggcccggggcggccaggctccacgtcctggtgcaggtcagccacctcatcgcggaggcggggttggacctgtccatggtgctgcaggtgctggtgcgcaaggtgtcgcaggcgctcggagacgcgtgcgtgctccaactgctctccgaggacacgacgcgcttggagctggtgacggtgcaccatcccaacgcggaggcccgcgcggtgctggacgcatccatgcggcgctgtccggggcgggtgggagaagggctgtcgggccgggtggcggcgacggggcagccgctcttcgtcccgcgccttcaggccgaggacctgcgcgatgagcgcgtgccggagggcatgcccttcctccggcactatgggccccacagcgtcatcgtcgtcccgctgggcgtgcgcggccgggtgctgggcaccctgggggtgatgcgcgaggcgcagggccgcgagtattcggtggaggagcgcgcgctactggagagcctggcggcgcgcgcggcgctggccattgaagacgcgcggcgatacggcgcggccacgcaggcggtgaaggcgcgggacgagctgctgtcggtggcggggcacgagctgaagtcgccgctgaacgcgctccaactccagattcacctgctggcgcgcatggcccgcgaggcgatggccgtggacgggctggcggagcgcgcggagcgggcggcgaaggcgggccagcggctggggctgctcatcgatgacctgctggatgtctcgcgcctcagctcggggcggctggggctgaagcgtgaagaggtggacctggcggcgctgacgcgcgagctggtgggccgcatgtccgaggagctggcgctggcgggcaacgaggtgcggctgctgctggacaggccggtgtcggggcactgggaccggctgcggctggagcaggtgctggtgaacctgctcaccaacgcggcgaagtacggcgcgggccggccggtgacggtggaggtggaggcggtgggcccggtggcgcggctgtccgtgcgcgacgagggcatcggcgtgtcgccggaggagcaggagcgcatcttcgagcagttcgagcgctccgcgtcggtgcagcacttcaagggcctgggcctgggcttgtggattaccaagcgcatcgtcgaggcccacggcggcagcatccgcctgacgagcgagccgggcaagggctccaccttcaccgtggagctgcccttgccggcttgagcgcctggacagctcgcactcgctgcgctctggttccgcggatgatgaagacgcgcgcactccaccgactggccttgctcgccgccgccgtgctggccgtggccgccccgggctgccggcacgcgcccccgctcgacccgggcctggacgcggatggcgacggcgtcctcaatggggaggatgcctgccccaccgtgcgcgggctcgcgcggctccagggctgccccgcgaaggacacggacggcgacggcgtggaggacgcgttggacaagtgtccgcgtcacgccgggcccgcgtcgcgggagggctgccccatccgcgactcggacgaggacggcgtggaggacgcgaaggacgcctgcccgcgggtgttcggcctgctggagcggcagggctgtcccgtcgacgacccggaccgcgacggggtggagggcgcggcggacaagtgcccggacgagcccggacccgcctcgcgcgaggggtgccccatccgtgacgcggacggggatggcgtaccggatgaagaggacgcctgccccgacgaggagggactgccctcgctgcgcggctgcccggagcgggacgtggacggcgacggcgtggcggaccaccgggacaattgcccgcgagagcggggcgcggtggacaaccagggttgcccggcggcgcgcaagcagcgcgtcgtcatccgcccggaccggctggagctgttggagcgcatcaccttcgcgcccggcaccgccgctctccagccgcgggtccagccggcgctcgacaacgtggcagacgtcctgctggtgcacccgcggctgggtgtcatcgccatcgagggccacacggacaaccgcggggacccggacgtgcagcgggaggtgacgctggcgcgcgcggaggcggtgcgggactacctggtggagcggggtgtcccgccagaccggctggaggcgtggggattcggcccggacaagcccgtcgagtcgaatgagactgcccagggacgcgaggccaaccgccgtctggacctccgggtggtggcgccgcgcggacggccgtaagtcccggactccccgtgggtggggggtgtgatgtacactcacccaccatgagtgcttccagccccctgttcggtgatttgctgctcaagctggggattgtctcgcccggtcaggtgcaggaggcgctcgccctccaggccctcaccgggcagcgcgtgggggaagccctcatctccctgggctacgtcacgcgagagcagattcaggacgcgctgggagaggcgctcgggctgcaccaggacaagagcccccttcagcccgcgctgggcgagctgctggtggggctcaagtacgtgacgctggcgcagctcgacgaggcgctcgcgcgccagcgccgcgacggccgcaagctgggcgaaatcctggtggagctgggccactgcacctacaagcaaatctacgaggcgctggggctgcagaaccgcatcgccgggcggcaggacctgccgcgcccctcctctgacggccgtcgccgcgtggtggtggtggacgacagcccgctggcctgcgccttcgtgcaggagggcctggtggcgctgggctacgaagtcctctgcttccaggacccgttcgaggccctggagagcatgggccgtctccagcccgtcatcgtcctcagcgatttggagatgcccggcctggacggcgtggagctgtgtcgccgcctgaaggaaggccccagccacgcggtgcccgccatcatcctcaccgccaacgacgtggaggccgagcgcgtgcgcggcctgcgcgctggcgcggatgactacgtcaacaagtccgcgtccatggacgaactggccgcgcgcatcgaaagcgtggtgcgccgcaccggcgaaacggagcgcatgcgcaagctgttcgcgcgttacacgtccgacgcggtggtggaggaaatcctcaagagcgcggacgcggtggtgctcaccggcgagaagcgcgaggtgacgttgctgttcgcggacatccgcaacttcaccggcctggcggagagcctgcctccagagcaggtggtgggggtgctcaaccaggtgctcgggcggatgtcggacgcggtgctcacctgcggcggcacgctggacaagttcctgggcgacgggctgatggccgtcttcggcgcgccggtggcccgtccggatgacgcgctgcgtgcgctccagtccgcgaagatgatgatggatgcgctgacggacctgcgcatcgaggcggaggcggagtgggcggcgggcgggcgtgagggccagccgctggtgctggagctgggcatcggcatcaactcgggtgtggtggtggcgggcaacattggcagcacggtgcgcgccgagtacacctgcatcggggacgcggtgaacgtggccgcgcggctgtgcgcgctggcgggcccgggggaaatcctggtgggggagcgcacccgcgagctggtggacgccaacgagacggccttcgaggacttgcctcccgtgcggctgaagggcaagcagcagcccgttccactgttccgcgccttgtaaggggtgaagtccacgcgcgcctcgcgaccggaaagcggctataggaaggggtcatgaacgcctcgtctgacgagccccctccgtcccgccgctcccccgtgttgttcgtggggctcgtcttcggactcgggttggtggtcgccgtcctggtgggcgcgctgagcggctccaaggccgtgcacgccgaccgcatccaccaggacctcgccctgctggaggaggccctgggccgctaccgcgcggacaagggcaccctgccggaagacgcggacgtggaggagctgctggtgcccgcgtacctgccctccgtgccgttggacccgtggggccggccgtaccgctacacgagcaacggcgaggaagtgttcctgtccaccttcggcaagagcggagaccggggtggctcgggcgaggagcaggaccacaccaaccacgacgggcacgccgtgcccaaggttgagcccgagcggacgtgacgtgcgggcgggcaggcgctggggcgtgcccaggccccgcgagcccgcgggggcggtgtgcgccgggccctggagcgagccagcgtagggcgggtgcccgcttcctggcgtcgccatggccactgtttccttcacggggaagggtcttcccgaacctggagggcagccatggccatcgtgtgcgtcaccaacctgtcccctgagtccctcgcggctgcccacgtggcggcggccgtggcggggcggctgcaagagtcgctgctgctcctgggcgtcgcggagggcgacgcattcctcgacgacggcaccggcgcgctggtcctcacccagcagcggttggaggcggaggccgcgcggctcgaaacgctcgcgagggtggtgcactaccggctgcaggcgggcacctccgcggacgaagtgctcagtgacgaggagtgccggcacgcgcgctggattgtggtggccgcgtccggctggcgcaccccggcgtggcggcgggccacggtgcccgaacgcctgtcccgttacggctgcgcgccggtgctggccgtgcgcagcgacaccgcgctgaccgactgggcgcggggccgcaggcggctgttggtgctggtgggcgtggaccccggctcctccaccacgggcgccgcagtgtccttcttgcgcgagctgcgccgggtggggccgtgtgacgtgctggccacctacgtgtgctcgcccatggacgaacgggaacggctgggcatccacagccccgtgcacgtggagctgctggagccggcgctgcagggcatggaggcgctggaccccatcgtggagcgcgtgctgcaacgcgaggtgcgcgagcaggtgggggacctggtgggcgagggccgcgtggaggtggtgctggagcccggcttcggccgtccggcggaccacctgatgcacgtggcgcacacgcgcggcgcggacctgatggtggtgggcacgcaccagcgcagcggggtgaagcggctgtggcatggctcggtgtccgcgggggtgctgcggcacgcggcgcagtccgtggtgtgtgtgccccccatggtgcaggcccggcgcgcggaccgcccgccgcgaagcgtgctggtgcccgtggacttctccgaggcctgcaccaaggccatctcccatgcgcgcacgctggtggggcccgggggccgggtacacctgctgcacgtccaccgccgcaagctggaggaccgcggcttcgcggaccactacggcgtgctgcccgagcccgccagggacagggaccaggtgctccagcggctgtgggagttggtgccgcgcgacgaaaccgcccagacggtgcgctggagcgtggagggtgtgacgggcgaggacgtgacgctggccatctgccaggccacggagcgcgaaggggtggacctggtgtgcgtggggacgtccctggagccctcgcgcctgcgggacgccctggagggcgaggtggcccatgagctggtgacgcgttgccgccggcccgtcatggtggtgccctccgcctgaggcgggtgtttcagacgggggatacctgtcatcacatgaaaggactgtcaggtggtggcggctccgacgtgcccggtagggcacgtctgcattagaatctagaaatcacgcatttccagacgcaggggggccgccggtgacaccgcagggttatcgtgaagtggagctcgtctgtaaccgttcctcgctgctcctccatggaggtacggaagaggagcggcgctgctgggcgcaggaagccgcgcgcaacttcaacgtggagctggtggaggtgcggcaggcggccgagctgccgcaagcgctccggcagcccaacggggtggtgttcatccctgacgtggcgaagctggggcgggacgcgcagttcgtcctgctgcagtgcctgcggacgcaagaggagcggccaaagctggtgctgggcgtctccggctcggcggacgcggcgctggcgcgcggcacgctgcgcgaggacctgcactaccgtctgcacaaggcccaggtggacttgcagaaggacgggctgcgggacgtgttgaagagccgctgggcgcagcaggccgaacagctcgcgctgaaggccgccgcggcccgcgccgccgaggaagcggcccgcgaagcggccattgcccggcgtccgggtacggtgacgcgcatcgctcccaagcagaagaaggtgagcggcggcgctcgagcgaaggccgtgtccaggaacgccgcccgctgaagccgcgcctcagtgccggtgcttctgcccgcgcttcgccctggtggcggggcgcggcgtcttcgcggtgccgcgcctggcggcggcggcctgtccgggcacggacttgcggcccacctgattgttcgctcctgccgcggaggccgtcttggtggacggtgatttgcggcgcgcgggggccttcgtgggcttgccactctcgatgacgccgcgggccgccttggccgtgcgccgcgtccccgttgccgccgacgtcttcacgcggccgcgggccggggtgccccgaatcttggactggaggttggccactccccgcgcagtcaccaccgcggtgcccaggaggacccgcgcgccgcgcgtgcctgcctggacgggcacctccttcaccctgtccaccagcccccgcttggaaatcgccatggcgcgcctcgtctccgtgactgtccttcgctgccgccaaaggtagtcacgggcacacgggcgtgaagccgtccccctccctctcccgcacgntggctcnggccattccaaggtgggcgggaatgtgtgaagcggggaaactgggctagagtccggcgcactgtcccaattccttctcggagcaagagcatgtcccaggaaaacaccggaaagccgaagcgcggcctgaagcgacccatcgaggtcgttcgcgcggagctgctcaaggatccggagacgaagaagatcgccgaggccgtgagcatgaagctcgaggactacgtggagctggtcctcaagtacgcccaggacaaggacaaggaggccgaggtcgccgtcatctccgacgaggagctgcgccgcaacggcttcaaccccctctcctccgaggaggccgccaacatcctcatcaagggcatgaagggcgagctgcccggctcccccccggacttcgaggcctccaagttcacccaggacaaggcctccaccgccggcaagccgtccctcacctcgcctcccgtgggcggcgccgcccccaccggtccgcaagatccagccgcccgccaggaactgatggatcagctcaagaagggcagcagcggcggtaaccgtccgtaatccctgggaccacgggcggagtccggtggggaaaattcgacgaaaaaggtgagaggaaacaattccccacacgcaccgagaatcctctcgagttttccttccggcacaaatctccgccttccaggcatctagaatccaaggggtacgatcatgggcgcactcaagtccgttacgaacgtcatcagcaaggtcgccagcacggtcagcaagattgccggtggcattgcgaacatcggcggcaaggccatggagttcctccagaagcccctgagctcgctggtggaccccatcgccaagttcatcggtgacaaggtcggcaagctgcccctggtcggcaagttcctgggccccacggcggagaacctggtgaagcagggcgccgcgtccttcctgggtgagggcacgctgggcagcctgggcttcctgtccaagatcgcccccaaggtgcaggacatcaccaacatcgcgcaggcggtcaagggcgcggcggacaaggtcggcgccttcgcggagaacccgctgggtctgcagaacttccagaacatcatcgcgcagaaccacgcccgcttcgtggagtgatgatccgcgcctctggcgcgaactggtagcaagccccagggccggtctcccgcgaagctgcggggccggcccttcggctttgcgggcgacgcggcccccgcgcggcggcgctcagtgccctgtctgggccaggcgccgggtgtcgcggatgaggcgctcggtggagtcgctgtccgcgctgtcgtagtagccgcgaatctgcccggcgtcgtccacgagcacgaagtgcgtcccgtggaagatggagagcaggtcgtcctcgggcgcgccgggctctcggcccatgctgaccttgaagccctggacgatggtctccttcaactgctcgtagtcgccggtgaggaagctccagcgggagaagtccgcgccgtggcgctcgccatactcggtgagccgctccggggtgtcgtacttcggatccacggagaacgacaccaactggagcccggcgccatgggacgcggtggcgtcctgcacgcccaccatcttccgcgtgaaggccgggcagatggtgggacagcgcgtgaagatgaagttggccacgaagggcttgccccggagctgtgtgctcccgaagggctggccgtcatgccgggtgaaggtgaagtccggcagcgcgcccagctggggcaggggctcaccgctctggccgcggatcagcatggcccccatggtggcggtgacgccaagcgcggccacggcgacacccgcccagaagcccgggcgctgcgtgagacgggcccgaggggccggaaggacggagtcagcggacatggccccggaggtaacggaacccttggagtcacacaagcgtggccgctggggtgcgacatcctggctacttgggggggatgatgtcacgagtctgtgacgacccatcccttgtgtcacaatttcgtgatttcagtgtttttgcataagtttatacataaataactgatcttgcggggaaacatcctctcagtcgttacgaaaatgtgggtacgtcgcctctctgttttcaggagtctgccccccgtgacgatctactccgttcgccgtggcgataccctcagcgcgctggcccagcgcttcaacacctcggtgtcgtcgctcgcgaagagcaacggcatctccaacccggatctcatctacgcggggcagcagctccgcatcccggacggcttcgacgcgcctcgtgcttcgggtggcggttcgtacaccgtgaagtcgggcgacacgctcagcggcatcgcgggtcggcacggcacgtcggtgggcgcgctggccaaggccaacaacatctccaacccggaccgcatctacgcgggccagcggctcacgattccgggcgcgggcggcgcggcgccttcctcgggtggcggttcgtacaccgtgaagccgggcgacacgctcagcggcatcgcgggccggtacggcacgtcggtgggcgcgctggcccaggccaacaacatctccaaccccaacctcatctacgcgggtcagcggctcacgattccgggtgggggcggtgcgtcgcccacccggccggcgccgaaccagccgccggtggggggcgtgggtggcccgaagccgccgaccggtggatccgccggcgtgacggtgcagcagctccgggcggtgatgcccaacctgtcccaggcgaaggcggagcagtacctgccccacctgaaccgggccatggcggaggcgaacatcaccacgcccatgcgcaaggcggccttcctggcgcagctcgcgcacgagagcggccagctccgctacatggaggagattgcctccggcgccgcctacgagggccgcagggatctgggcaacacccagccgggcgacggcgtccgctacaagggccgtggccccatccagttgacgggccgcgccaactaccgcgccgcgggccaggcgctgggcatcgacctggagggcaacccccagcgcgccaaggacccggacgtcgcgttccgcatcgccggctggtactggtcgtcgcgcaacctcaacacctacgcggacgcgggcaacttccgcgaggtcacccgccgcatcaacggtggctacaacggcatggcggaccgcgagatgtactaccgccgcgcgcagaacgtcttctgagcccgcgctcccaacgcgcggtgcggtgaagcggggaccgtggccagggaggccccggtccccgtcgcgtttcgggcgagccccatcccgccggggagatgccacgtccatccggggcgaccgccgaacgcgcgtggccccgggagaccccctggtgtgccggctgcattggacaggccgttcccacacggagcgcgtcccatgcctcgtatcgattcgtccggcagttcctcgttgtccaccatcgacacccccgcggaggccggagcggcgcccccgtctccatcgcgcgccgcggagccccgcgcgcaggcgtcccctcagcgtaacgaggtgcgcgccttcgatggatccgccgccaagacgccggagccctcgtctcatggacccacgcctgctggggcgggccccgcccggtccgcaggggagatggtcgtgctgggaggctggtcgcgcccggagggctcgaaggaggcgcccacggacgtgctcgaaggcatccgcgcgcgcctgacgcggagcctggagaactggaccgtcggtgccgacgacgtgcgggcggtgcacaccgcgctgggaagtctcccggcgggcacgtaccgggccgcgctggagcgcttgcagcaagacggcctgctgggcgcatacgtgaaggcgcaggacgcgggctcgcggctcgcgttcctggagcaggcggagtcgaagggcgcgctccatcggcgcagcggggagtcgggcccggtgggccccctgggctacccggcggtgccggacgtcttcgtcaatgaccggcggctgccgggggcgatgcgtgacgcggtgaatgcacacgccatcgacgtgggcgcgggcttctaccgggcgcacaccgaatacctcggccggtatgcccgcgcggtggatggggcccagagcctccaggaactgggtgcgctgggaccgccacgcgccgcgcacctgtccgaatccctcctgggcctcgagtggaaggacccgtcgcggcgggactacgaggcggcctggaaggcgggcatcggccagccgaagacgctcaacctgacggtgcaacacgtcagcgcccggcagcgggagctctctggggagcgcgccgggggcacggtgcagcttcacggcaaggtgggtgtcagcagcgagagcgcccagtggagcgcgaaggcggcgctcgacacccggggacacggggaactgaagggagacgtgggcgtctccgcgcgcgcgggccccgtgggcgtcgagctgtcacacgacagctccggcgagacggagaggaaggtcaaggtgaacctgggactcgtggagctcagtctggcatcggacggcgagcagcgggtcgcggtgggtgtcggctcgctgttccaggtgcacgcgacactcaacgcgaagaaagcggagctcgggggcggcgtgtcagcgaagctcaaggcggatgggagccaggccagcgcggaggcgggcttctccatgaagggcctgacggcggagcgggcccagcaatccttcggcccagggcatcggaacgtcttccagccgcccgccgagctggcatcccgcacggcctgggatgcgctgccggagtccacacgagcggcctatgcgaaggaggggtggaatcgggatgcgtggacccgggccttgccgcgctgaggatcaggaatccgcctcggggggcggcagggggcgaggccacaccaggtagcaggcgatgaaggggaggtaccagggcgcggccacccacagccacggcactttcgacgccatccgcgtcagcatgaagacgccgccgaaccagaacaggccctggatccccaggcccaggcttccgaggtactggagcgggcgcgtcttcgtccaggttccgaggatggccagtagcgcgggcgcgatgacgggcagtaggtagggcgtcagcaacgcacccacatcgtcgagcgtgcggacatccgggagggccatcaggatgagctgcaacgccaggcagaggagcgtggcggttgtcgccaggatgggcgagcggaggaggcgggacgtgggggccgccgtcgtcggcagcctctgctcactccgggcccgctccagggcgtccggggggacctccagcgcatacgggtagcccaactccagcagggcctccaccgccgcggtgcgcaccgtgatgccggcgctccccgtcaggacactggcatcccccggcagcgtcatcagggacagcaggtagtccgttcgctcgcgcaaggccttcgggtctccagcgggacgctgggcaatcgccgcgatgagcgcgtccacctccgaggggatgacgccgggcgaactcagggcgtcccgcagcgcggccagcgaagggggggcgggaagcggcgccagggattccacaagggaatcgctcgtcggctcggcggggcgggtatgcgtggaggtcatggccgcggagacgtgagtctaccaccgggctctgcggcgagtcccccgcgcgaccgtccggagggcgaggggccgggcccttcggagggacatgtcctcgaagcgtgcgcacccttcccctgggtgactctttcacgaggagcgaggcagcgcatggcgacggagcgagcgcagcggttcgtggatgcactggcgaagctggagaaggagggggacctggaggccctcgtctccctcttcagtgacgacgcacaggtgagcaacgtggcctcgccgcaggtcttctccggccaggagggcgcccggcggttctggcgtgaatacaagggcaccctccaacgcgtggagtccaccttccgcaacatgattgaggcgggctcccgcgtcgcgctcgaatgggagacgcagggcaccgcccacaacggcgcggcggtggcctatgaaggcgtgtccatcatcgagtgggatggcgaccggatccgccgcttctacgcgtactttgatccgcacgcgctcggcctggagctgacctccggcaacgcgccgcgctcggaagtccccgccaccacccccgcgtgaggcgtgaggccgccccgcctcggggcgtcaggttgtttcctgtgaagtgagccgccgggctcgccagcccggacgtgcccttcacccctggccggtgctcgacactgagccgtgaccttcagacacctcccgattcccaagtgcggacgctaccgtcagccgccgcgtccccggactgccgacgctgtccggacagggggccgcggaaaatgatgccggtccgccgatttttgggcggtaccgttcgacgcggtgcgttttccggaaagcccggacgcgatagcgtttgctccgtcctcggagaaggtgggttggtgatggtgtggcggaggacacgagctcggatgaccggtcctgacccggcagtttgctttgcgtctacacggaaaagcctgatgacccgctttgctgccttcttcgtcgtcctgtcgttgattgccgccccccacaccgcctgggcccagcagcgccagaccgagtccgcgaaaaagacccgggcggtgaagtcctcctcgaagacgaaggccacgaagacgaaggccgcgaagccggtcaaggccacgtcgaagcgcaagcccgcgaagaagggcaagaaggccacgccggccgtggattcgaggggcgtgaacgccccggagcttcaggcccagcccatgatgcaggtggagcccgccaagcccctgtctgcgacggacgacgcgcccaccgtccagaagaagtccggggaggccccggcggaagggggcgactcgctggacttcgacctgctggagcccgccgaagccgcggccgccgcgcaggtggacccggacctggagaggcgcattggccggcgccgcacgatgctcaagctgcaccagggcctgggcttcgcgatggccgccggtctggtcggcaccacggtggtgggccagctccagttcaacgactcgttccgcggcggcggtgatgaccgcaacctgctgggcctgcaccgggggctcgccatcggcacgtcggcgctgttcgccaccgtggggctgctgggggtgctggcgccggaacccttcgagaaggagttccagtgggacaccatcaccgtccacaagatgttcatggcgctcgccaccgtcggcatggtggcgcagatcgtcctcggcatcatggccacggaccgttttggccggctgtccgagacggacatggccaccgcgcaccagatctccggctacgtgacgttgggcgcggtgtcggccggcgtcttcacactgttcttctgaagcgcatgcctttcgtagtggttccctggaggttgacgtgattgctcgacgaatcgccctgatcgccaccctggtgctcgcgctgcccgcagtcgcgcagtcgcaggcccgcacgtatagcgtcaagaaggacgccagttcgctcacctacaagctcaagcacaagctgcatgaggtggtgggcaaggcgcagcccagcgacggcaaggcccgcctgctgccggacggaacgctccaggtggcggtgcgcgccaacgtgaaggacttcgattcgggcaacgccaaccgcgacgcgcacatgctggagacgacggacgcggccaggtttcccatcatcgacttcaagggcgtggccaccggcgtgaagccgcccaccagcttcccggcgaaggtgccggtgaaggtgaagggccagctgacgttccacggcgtgaagaagaccgtggagattccgatgacggtgctgttcaagtcggagaagcaggcggtggccgagggtagcttcgacatcagcctggatgcctacaacgtcaaccgcccgtcgctgttgatggtgaaggtggacgacgtcctggtgctggagcccaagctggtattcgaggtggagggtacgtgagttcgacgcgacgaggattcctcaagggcattctgggaacaggcgcggcgagcgcggcggcgacgacgctgccgggctgcgcgccggacatcaaccccgctccggtgacggacgtcacggccagcgagcaggggaccgtggacatcctggtgtcgcgctatccggatttggagcccgtgggcggcgcgttgacggtccgcgtttcgggtgagcaggtgccgctgctggtggtgcactccaaggacgacggcgcgccgaacgacttctccgtgctgtcgtcgttgtgcacccacgtggggtgcccgctgggcttcgacggcaaggacgtcatctgcccctgccacctgtcgcgcttcagcgccacggatggcgcggtgctccagcggccggccaccgtgccgctgcagacgttcgcggcggagtacaacccgaacacgggcgtgctgcgcatcaacctgcgcgcgggccaaagcgacttcccggccgcggtgaacgggcaggtggtgttcccgctcagccagtttccccagctgcgtgacgtgggcggctcggtgacgggggtgccgtccgggtacggcaagcgcatcttcgtgttccgcttgcaggacggcgcgctgtcggcggtggactccgtgtgcacccacgctttctgcgaggtgaactaccgggagcaggaggcggacctgttctgcgcctgccacgcatccatcttcacgcgcgacggcgcggtgacgcagggcccggccacccgccccctcaagaagttcacggtgtctgagacgggcgactccgtggtgctgaccggcgtggcgtgagccatgcgccgggcgcgggtgggcctgacacagggcccgcccgcacccgaagggagcgcggcatcgctcagccgagccggctccagaaggagcgcttggaggagatgcgctccagggcttgttgcagctcctcgtcgtggtcggcgcgcaaggcgatgtcgcccagggagatgatgcccacgatgccgtcgtcacgctccaccacggggatgcggcgcagttgacggcgtcccatcagcccgatgacgtcatggagcgtgtcgtccggcgtgacggcctccacgtcatccgtcatcacatcggacgcgcggagttgttccggcgagcggcccccggtgaaggcgcggaccaccaggtcccggtcggtgacgatgcccaccagccggtcccgctcgtccacgatggggacgacgccgcaggactcgtccttcatgattcgcgcgatgtcccgcagcggactctccgggcgcgctgtgcgcacgttgcgcgtcatcacctcgcgggccagcagggcctcgtgacgccagcggccattgcgggcgcggtcgtcccggcgggaggtgctcgtctcggagcggcccgcgacggcggtgtagattggggtgctcgctccgtcacgccgtgcgccggtggacgaaggcgcgcctgtcccagcccagcggtgggtgctcgcctcgtcgcggcccgggccgagggaggcgctccggtccatccggtagcgtgggcgcgcatctccatggcgctcttcgccatgggcgccgcgttcacggccgccaagcgtacgtcgcggtaggactccccctgtggcggttgggggcgggagggctcgccgccgtagccggagcggtcccagggtcggtagtcggcgcgttggcgagagagctcgacgtcctgttcgccggtgtcgtgccgagggccccggccagtggcgtagtggctgtcccggtcgtcccggccgtaggggccgctgtcctccgggggcgcgccgtacacgtcctcgccgggctcgtcgtccacctgggtgcgcggctgggccatgcgcatcgtcgccgcgcggtggtagcggccctggcggatggaggcctcctcgtcgcgggcggggttccagccggtgaggtcggactcggcgcgctcacgcgagcctggaggcgccacgtccgcctcgcggtgggtttcgtccctgccgttgtccatgcttctgtgggccatgacgctcctcgggcgatgtcgggttcaaactgcaacgctggtggtgaggccgcgagcctccaaggtgcgggcgtccaggcgagtgggtgcctgtccctccctggcgttcctcaccccgcggccagcgcgtcacccaggcgcaccaggccgctgaattcctccagctccgcgcccgcgtccggcgcggccaccgcgagcgtccccgagggaaggtgccgggtgaggcggtcgagcacgtcgcggtgggcctgggcccgcgcctgctccaccgaggccaggcgggacagcgccgccaccgcctgctccgcgtgacggtcgcctcccgtgtgctccagcagtgcctccggcgccgcgagcacgtcgtcatgggcccagctccggttcagcacgtagcccgcgaagggcaggccccgcgcggccagcgtctcgcggaaccaggtggcctcgcgcagggaggcgggttcgggggacgtcaccagcaggaaggccgcgtccggcgacgccaaccgctggtgcagccgctccgtgtgcagccgcatgccggagaagaggccgccgaaggcaccgatgaagccgcgcatctcctgggtgaagcccgcgccgaagatgcccgccaggacgcggtccaccaccgcctgcgcgccgtgccacagccgcccgccgcgcgcccgcttctccgggccgaacagcgacacgatgcgttcgtccaggaagcgcgccagccggccaggcgcgtccaggaagtccagcgcgtgccggctggggggcgtgtccagcaggatgagctcgtaacggccgtccgtgaggaaggcgtccagggcctcggcggcggcgtactcctgtacgcccgccaccagctccgacaggaagcggtagaggcggtggtcgacaatcgctcgcgccgcctcgggtgtgggcgccaactggtgcaccatgcgctcgaagatggcgcgtgggtccagcatccacacgtcgaggaggcccgtgccccaggggccgtcggcgaagaggcgctcggagggaatcgacgtgggttcgggaccgctctcttggagccccatggtctccgcgagcctgcgcgccgggtcgatggtgagcaccagcacccgccgtcccgcgcgcgcggcggccacgcccagggccgccgccgtcgtcgtcttgcccacgccgcccgcgccacacaggacgacgatgcgcttgtcacgcagcaaccggcgcaggtcgcccgcgctcacggcgtgcgcccctgtgacacgcgccggggcccaccgccatgcggtccgtggctcacggcagggcctcctgccagggcgcgtgctccggatgaggtgcgaagccctccgccagcgcctcgaccagcgcggggcccgtggcgtggagctccggcagggtgagcagcggcgcgcgcagcgcgcgtgacagccggacggaggcggcccgggcccgctccagccgctccagctcacgccacccctggtgcggtccgtgcgcggcgagcatccggtgcagggcggcgcgggactcgggcgtgaaggggtcctccggcatccggttgaggacggccgcggacagcggcagctccagccggcgcagctcggcggccacggtgagcgcctcgctgacgggcagcggctccggcaggctggcgaggaccatcgcggtgcgcgccgcatcctggaggaagtcgagcccctcccgcacgtcgcgtccgatgggccctccgggcatcagggacagcacgcgctggggcaaggcggccagcgccagcgcgtgtcccgtggcgggcaggtcgacgacggtcagcggatggacgaagcgtccatccggccgcgtgcgccggagcagggccagcaactggtacatcagccccatctcccggagcgcgggccctgcttccaggaagcggcgcagggcgcgggtgcgcagcgcggcgtcggccagccagcgcgcgggcagggcacgctccaggaagtgccggtgcccttccgctgcggagaggcgcacgaagtggagcccgggacgcacccgcgtcacctgaggccccgcctggcgcgccccaacgcgcgccgccaggggcgaaggcccgtcctcctccggcgccagctccgccagcagcacggtgcgtcccgcgcgcgcggcggccacggccagcgccgccgccagcgtcgtcttccccacgccgcccttgcccgatacgagcagcgcacgcctgtcccagagggcttcgagcaccggccaccgtcctgtcgcagcgccccaggccgcgcgctgttcccaacacggtgtggaaggcgaaacgccagggcaaccgaggccccggtgcggccgtcccaggcacgcggccgctcgcgcgcccgggtggcgctgggactacagcgcctcgatgaccttcttgattcgctcgaaggcccagtccagctcggcctgggtgacgatgagcggcggcgtgaggcggatgacggagtcgtgcgtctccttgcagagcacgccttccttcatcaacgcctcgcaggcgggccgcgcggagatgtccagcgccacgccaatcatcagcccccgtccgcgcacctccacgatgtggcggttcttcagcgtcttcagcatggccaggaacgacgtgcccatctcggcggagcgctccaccaggcgctcgtcgcgcagcacgtccagggcggtgcgcgccacggcgcagcccagtggattgccgccgtaggtgctgccgtgctcgccgggacggagcacgcccatgacctcgtcatccgccatgacggcggacaccgggtagaagccgcccgacagcgccttgcccaccacgatgacgtccggccgcacgtcctcgtgctggaaggcaaacgtcttcccggtgcgccccaggcccgtctggatttcatccaccatgaacagcacgcggtgctgcttgcagagctcggccacctgcttcaggtagccgtcgcgcggaatcagcacgccggcctccgcctggatgggctccatcaggatggcgcaggtgttgggggtgatggcgcgccgcaccgcctccacgtcgtcgtagggcaccacggtgaagccgggggtgaaggggccgaagccctgccggtagctccgcacggtggagaagctgatgaggctgatggtgcgcccgtggaagttgttcgcgaagacgatgacctccgccttgtcctcggggatgcccttgacggtgtagccccacttgcgcgccagcttgatggccgtctcgcacgcctccgcgccggagttcatcggcagcgcgcggctcaatccagacagctcgcgcagcgccttgtagaggtggggaagctggtcattgcggaaggcccgtgacgtcagcgtcaccttcgcggcctgctcgcgcagcgtctccaggatgcgcgggtgacagtgcccctggttcaccgccgagtacgcgctcaggcagtccaggtacttgcggccctccacgtcatgaacccagcagccctcgccccgttcgatgacgaggtccagcggatggtagttgtgcgctccataccgctcctccaggtcgatgaagtcgcgcgtggagagggcgggggcggcgtgctcggtgctcatggaactccctggggaatcgggtggcgcgaagcaggaccatcgatttcgatgaagtccttcgacgtgtccaccaccgcattgccccaggcggttgcttcgttgagcactgcacccgagcccatggctcgccgcgtcagtggacggaccagcgctccgcgatttcctcgcaggcgagcaccacgtcgctcagccgccggatgtgcgcccgcggcgcggtgaagaccgtccccgcgaagacgtccaccacctggatgaggcggtggtcacacgggcccagcgggcacaggtgctgctcggtgaagcgctggagcagcgtgccgatgtactgccctgagcgctcatccagcggctggtgcttggagaagtacagcttcatcaggcccacgcgcgcgttgccatgtctgtccatgcgctggagcacgacctccggccgcacgctgatggtgacgcccgccacctccagcacgggaggctccgcgcccaccgcgctgatgagcgtctcctccaaatccagccagggcaccaggtccgcgaagcgctcgagcgcctccgagcacagttgcagccgctgcgcctcgaactccgactggggcacgctgcacgcgaagcggcgctggtgctcacggaggatggacaggtccatgccccggcagaggaagtccgtaatagcatgcgacgcctccgggtagcgcagatactgctgctccggcgggtgcttctggtcgtggatgatgcgcttgcgacgcgcgggcgtggcgacgaggtactcgcccaacttgttcacggacacacgcgacagttcacggatttccgccatggaatcgctccccctgggtgctggcgaatgagcacacagtacagagggggggctgacatgcattggacggagtgagggctcactctctctggggttcgccgtaggggtaggcgctccagtaggtgtcgggcaatgggttggtgccggcgtcgctgcgcggaccatccccgtccccaatctcatccaggatggcgccgggcgtgcgctccgtcgggtcgatggtgcgcatgcgatgcgtgacttccggcgactcggcggcgtccgccaggtcgcgcttctcttcgctctcttctgtctccggagcgtgttgccgcggttcctccgtacggccgtagtaatcctcgggtggctggatgcccggctgttgctgcttgtcgcgctgagccatgatggatgccctccgccaccctacgttcgtaacggcacgggccagcggcaacgcgtcaacgggcatgcacgccaggagggcaggccggcggacgggatggacgtcccgggtcgggtgcgccaagactggcgggatggccgagcaatcccaacagacaccgtccgccgtggccgggccgttgctccatctggggtgtcagtcctgcggcgcgcgtctggtgctggagcccgcgctgcggaccacgcgctgtccctactgcgccgcgcccgccgtggtggagcgtcctccggtgcccggtgtgcccgagcctgtcttcgcgctgggcttcgcgctcacgcacatggcggcgaaggcgcatgtggcgcggtggttgcgttcgcgcagccgcttcacgcgctccggcatccgctccgccgcgccgggcgaggtgcgaggcgtgtacgtgcccgcgtacctctacagcgtgctggcgcaggcgcgctaccgcgcatccattggggagaactaccaggagacggagacgtacacgacgacggagaacgggaagcaggtgacgcgcacgcgcaccgtgacgcgcacggagtggcgttcgctggaaggcgagctgaccagctacgtggcggacgtgctcgtcaccgcgtccaaggggctggacaacgcggagctggaggcgctggagcccttcgacctgcgcggcctggctcgctacaccccggcgctcatctccggctgggtggcggaggagccctcgctcacgctggcgcagtgtcaggagctggcccggaaggaagcggtggagcgcgtgggcgggctgttgtcgcgcttcatgccgggggactcgcaccggggcctggagcatcagtcccggctggactgggaggcgctcgatgtgtgcctgttgcccgtctgggtgctggcggtgaagtacgcggaggatgcgccgccgctgcgggtgctcgtcaacgggcagacgggggccgtccatggcgaggcgcccatctcttcgtggaaggtgctgtccgccgtggtggcgctgctggcggtgctggccttgggctggctgctcacgggaggtgggcgatgagcgccgaatcggtgagggtggcgccctgccagcgctgtgactccgcgctggaggcggaggacctgcgttgccccatctgcgggctgacggcgccgcctccgccgcatgccgcggtggagcgcgcgcgggcccgcgtggtgcggtgtgatagctgcggcgcggcggtggagtactccgtggaggcgaaggcgccccggtgtggctactgcggctccgtcacccatgtggagacgacggcggacccggtggagcaggcgcagcactggctccccttcaccgtggacaccgaggctgcgcgcggcgcgctgatgggcttcctggggcggggcggcttcttccggccgtccgggctggcacaggaggcctcgctggagtcgctgcgtccggtgtggtggccggcgtggatgttcgacgcgggcgtggacgtgagctggacggcggactcgaacgcgggctcgcggcggtcggactgggcgccgcacgcgggccggacgcgcttcgatttcgagggcatcccggtgccggcctcgcgcgggttgaaggtgcgggagtgcgaggcgttggcgccccactaccagcgaggctccaggctggacacaccccatggaccggagggcgcgcacgtcgagcgcttcgaggccacgcgctcgggcgcccggcggagcgtgctggaagcggtggagcgcctggccatcgagcgcctccagcagggcgtcattccgggcagccgcttccggaacatccacgtcgccgtggcgctgttcagcctgcgcacccagcggctggccctgcccgtgtacgtgctggcttaccgataccgcgacaagccgtaccgggtgctggtgcacgggcaggatgtgcaggtggtgttgggcgaggcgcccatctccccgttgcgcgtggcggcggtcatcctggcgacgctgctggtgctggtggccgtgttgtacggcgtgggcgtgttgtgagcccgccgtgacgccacgcgcgtcacggtgtgtcgggctcctcgggcgtcgtggactcaggggccgtgtcagagggctccggtggggaaggcggctgggatgaggaggcctcggggcgtgcctcgtccggtgcctccgtggcggcgtgctgcacgtccgctgcgggttccaccgtctgggtgatgcgcgcctccagcgtcagctcggccacctgtgacaatcggactgcggaccccgcggcttcgcccaggggcgtctcggacgagggctctccggccagggccgcttcctccacggtcagcccttccggatgcagcccgccctcgagcagctccgcctggttgcgccggaccgtcgcctccacggcggcctgctccacctcctgcgcgatggcctgacggccccggtggcctccctgcgaatccagccacgcgcgcagcgcctccgccatctccgcgcccgtctggaaccgctccgaggggttctgccgcagcgcccgcagcaggatgcaccgcaggggctcggcgacacccgccgccaaccgctccacctgctccgggcccacctgggccatccgcgccgccacctccttcacgggcatccacgtcggcccttgcgcgtgaagctccagcggctccgactccagcacgggcgccaggtcatccaccatcaacgggtgccggcccgtcagcagctccagcagcaccagccccagcgagaacaggtccgaccgggcatccaccttccgtcgccgcagtgcctcgggcgaggcgtaggcgatgtcacctttcaccagctcctggctcgtcacctcgcgcccggagagcgacgaggccgccaccgtgaagtgggtcagcttcacctcgccatggacgcccacgcggatgttccgagggctcacgtcccggtggacgatgttcagcggccggctccactcatccgtgaggccgtgcgcgtggctcagtgcatccgccacctccgccgtcacgtgcgccgcgaactccgcggacaggggtcgccgccgcatggccgccaggttcagcaccgtgtccagcgaacgcccttccacgtactccatcaccacgtgaggcgcgccgcggtagagcttcagcagcatcaccttggcgatggcgggatggttgagccggaacgtgaggtccacctcctccaccagccgtcgccgctccacgaacgtggcggggttgcgcagccgcttcaccactaccggaccgctcaggccattgcggtagcggcgctgcgccagcatcagcagttcccccgtggagcgcatctccagcttgcggacgaactcgaacaccgtgccggccacggtgaacagcacgcgtggcctgtgtggacctccaggaagctcctctgtcgtcgtgtcaggcgtcatcatgggctcatggacctctgaggttgaatgaaagtgagtggatttcccggagggccaggcgcccaggcccctcccaatgaatggcgggccggctcagcgccacgagcgcagcgtggcccagagccgtttcagcgcgtcccgccaccgccgccacccggtgctcgcgcggacctctgtcaaagcccagggtgaggcgggctctgtgggcggcgcgaaggacgctggcgggcgcgctcgctccgggacacgcatccagtggcgcagctcgcgcgcttcctcgtccccgtcgaagaactccagcgcctcctcggtgacggcctcctcgggagcgagaggaggaaacaggtgctcatcccaggccgagtccgcgcccgccagcgccgcgtccagcgcgtcgaacagggccgctcccgaaggaggccgccccgccgcggagggcgacagcaagcgcgccacgatggcgtccaacgccttcgggacgcgcgggttgcggacagagggcaggggaaagccaccggactcgatgctggccagcagcccggcgggcggcagctgcgtcggatagggaaagctcccggtgagcacctcgtagagcaccagccccagcgagtagagatcatccgtgggcgcgaacgcgtaacgcgagcccgcgggccgaggctgcgcccagaagcgcagggcctccgggctgcgatagctgggggtgcccggcggcagggtgtcctcggtcagcacgggcgagcacgcatggtcccccgagccgaagtccaccagcaccggctgcccgtccgacgcgcgaatgatgatgttgttgcccttgatgtcgcggtggagcacgcccgcgcggtggatggcatccagcgtgagcgccaactgctggaacacctgcaccgcgcgccggggcgtgggctgcgcggccagggcccactcggacagggtggggccctccacgtaacccatgatgaggaccaggtagccatcgcgcgcatccggccaccgccggtagcccagcagctccacgacgttggggtgctccaggcgcatgaggacgtggacctccttccaggttcgcgcgtccgccgcgggcgagtcctcctccgagggccctggagcgcgaacttcagcgccacctgccggcgcgtctcggattcggccaggaagatggccccaaagcccccggtggccagcctccggacgatgcggaaggcccccacctcctccgactcctggagcatcagcgggtgcaagccctcttccggcatcacggatggactcctattggaccttggaggtccaattcagacgtggttccagcggctgtcattgtgagcggcgtcatgattcaaccttggaggtccatagcatgacgtttgccctttgaggtagtgtcctgacttgggaggtaggtttcggtggaggggatgcaccagggtggcggatggaaacttgcaggaccctgcgggcgtgcaaccctcggccgtcatgcgtgagcccgtcgaccacaagctggcagccgtgctgggaggtgctgcgcgtgacgcccgcctgcgtctgggcctcacccagggcgacgtcgccgaacgcatgggcatggccatggaggtctacagtcgcctggagcgcgggaagatgctgccccggacccagacgctgcgccgtctgtgcgacgtgctccaggtctccgcggacacgctgctgggcgtgggccgtcccgacggcgcgcccgtcatgccccgcaagacggtgaaggaagacccggtggagctgcgccgcatgacgcgcaagctgcgggagctcgaacccggtcagctccgcgcggtgtcccgggtggtgaacgccgtcgtcaccgtgctgcctcagccggcggctccggcgcccgccgccccggcgaagcccgccgcgcgtgcggcgcgcaagcgccgggcgacgggctagcgctgctcagcgcccgcctcgcggcactccctccacggcctgggagcgcttcatgacgccttttcccgcgccgcgttcacgttggacatctggcagggcaggcgcgccgtgaaggtggcgccctggcccagcgtgcttcgcacgtcgatggttccacccatggcctggacgttctgccgcgtgacgtacaaccccaagcccagtccgccgtagtgccgctcggagacggcgcgctcgaacttctcgaagatgcggcccaccgcctcggggggaataccaatgccttcgtcacggacgctgaaccaggcgtgctccgccgtcctgccgacctgtaggtggacggggtgacccacgccgtacttgagggcattggagaggaggttcgataccgcctgctccagccgcccccggtcccactggcccaccaccacctcgtccagcttcgcctggatgggcgtcccggtgcgctgggactcaccctcgaagcgcgcggccacctcttggaccagcgctcccaggtccaccggctccagctccaggtgcagatgaccgctgctgatgagcgtcacgtccagcagctcgcccaccagcgtcgacagccgcttcacctgccgctgcatgacctccaggtccgcgggcagccgctccagcagctccggtccgcgccgctcctgggtggcccgcgccagcgtctgcagcttcaagctgagcggcgtcagcggcgtcttgagctcgtggctggccacggtgaggaactcgtcgcgcagccggatggcctcatccatggcggccagcagccgctcgcgctcctgttcggcctgcttccgctcggagatgtcgatgacggagccgatgtagcccaggaactcgccgttcagcccgaagcgggggctggccgagtcgatggcccaccggtactcaccatccttgcgccgcagccggtaatcgagccggaaggggctgcgccgcgcgttggcgccgaggaacaccgcccctgaatgctcggagtcgtcgggatgcacggccttgagccagccgaagcccaggccttctgcctccgtctgtcccgtgaactcgtaccaggtccggctgagatagatgcagcggccggtgacgtccgtcacccacagcatcaccggcgcgtggtccgccatgttccggaagcgggcctcactctcctggcgtgccagttgggacgccttctgcgcggtgacctcccgcagggtgacgaagacccggtcgctccgctccctcgacggccgggtcagggtgagcatcacctcgatgtggcggccccccagggtctggagctcggtctccagctccaaccgtgtgccgccttcccagagcaggaggagctcggcggtgaaggccttcaacggctccgggacgaagacgcgggaccgggacagggacaaggtgcgaagcacctcatcccgggtgcgcgcttcgagcaggcgtaccgtggcctcgttcacatccacgaccttcacccgctccgcggcctccatcacgaacccgggatgcgccgcgagccaggcacgcaggtcctggacgccggaggcacgcaggctgtcgagcgcggccgaaacggcggtgaagtcctcttcccagagggagacatccgctccgttgaacagctcctggtagcgcgcgtctccggctgtctcagccccacccaaatgtgtctcctccgtaccccggctcgggtggattgagtcgacagcgcggatgcgtccaccgcgtcacaaggattctggagccgccaggagtcaacgaacaggcgtcttcctggcggctcacggtcgaacgccttcctggggggccgttacgtccgcccgtccgcccgtccgcccgctcgccttccgcgccggacccgccaaggtgcgcaggggcgctcccgttcgtcgtcttggctgttccgtgggcgccgctgcgtgtgggcgccttgaacaaccgttcaggccagggcgtggcaatccaacgcacccggcaaccttcgattggagacgcggcaccttctggtgaggatgcggggccggggtcgatgacacagatggagatgcggatgcgcaagctggcgttgctgttgttcgtggggttgtggctgggctgccgtgcggatgggactgactccacggaaggcacactgcccctgcatccccaggagacgtacacgtatcccgggtgcgccaacgaggactacaactgcccgcgcttgaagacggtgcactgcgcgctggagagcctgcgcacggagcgcgatagctgccagcaggacagtgactgcgtggccgtctccgtcaacggccggtgcacgggctatggggagtgccccccggcgatggtgaacaccgccagccgcgcggagttcgcgacgcgggccgccgaggaggtgctgcgctactgcaccgagtctcccatctgcgccagcaccggccagtgtgcctacccatccttcgtgccccgctgcaagcaggggcattgcgtggcggagccaggcgacgccggttcctaggcgcttcgaccccggctctcatggagcttggggggggggcggggcaggctgcattcctgctcaccgggtaatgacagacgcatgcgtgccgtccgtgcgggctccatgcgaggtgggtcgagggggagtcacttgtcacgcggacatgggctcacctagaaggccacgcatgcttcgcaagcctttgctctccttgctgctcagcgcgtctgtcctttccgccgcgtgctccgacgacgaacagaagccggctgtgctcatcatcgaccgggagacggtcgacttcggtgagctggaggtgggccaggtctcccccgagcatctcgtcaccgttcgcaatgcgtctccgtcggcggtggagtccgtgtccgtcaaggtggagggcagcgggttcaccatcgccgccaacacctgcgagcgcttcctcgatgcggcatggagtgcgaggtgcgggtgcggttctcgccccggctggcggggccgagcgaggcccgcctcaaggtggagggcgctcccgacgtggacagcgcgatcctcaagggcatgggcgtcggctatgtggaggtgcggagcctgcccggtgacggagcgcacgtggtggccgaggaggaaggctggttctgcggcgagccgtgcaaggtgcctgtccgcaaggcgcaggtgaccctccggaccgcgccggcggggattccgacctggggcggagactgtgtcgtggtggcgggcggcggctgctcgctcgtcatcgacgggacgaaggtcgtctccctggaggcgctcgattccctcctgcggtgggaggcgcggcggggcgctcatccgcggagcgtggcggtttcggccggtggtgacatcgccgtcctggaggccgggcagttgcagcggctcagcagcaccggggaggtgctttggtcggtctccctgagcgacggggtggcgatggccctggatggcgcgagcaatgcctacgtggtggactcctccgggcgggtgacccggtacgacccgagcgggcaggtgctgtggaccgcgttggtggctgtcgagaatcccagctggcccgagctcgcggtgagcgccagcgggcacgtctacgtgctgttgagcctgggcaaccatgaaattgcgcgtcaactcaagctcatcgccgtctcgccgcaggctgccgagcgctggagcctgctcttcaatgagggccagttcaactacacctggggcttggcggtgaatgcccagggtgaggtctatctggccggcagtgtgcacaaccgggacgcgacgtccgggcagtcggtgttcgtgaagtcctacttgcggaagtacagcgccgagggcgccatccggtgggagactcaggacatcgggagcctcttcgccgtcaaccccgagggcgcgacgagcaccctctcccccggggacggaaccaccgagggcttcacccagcggtggattggtgcgaacgggatgacgcagtggaacgcggcggtctcgaacgtgccgggcgtggtcaccctgcagaccttctcgccctccggcacgctgctcatcggcgggcacgaactcctcgcaggcggaacggagattggtcgaggctggttcgcggcgatgaacctcacgacccgcgcgctcggcccggtgacctatgtcgaggggagcacagggggcggaggcccggtccgtatcagcggcctcgcgctcaccccgggaggtcatgtcgtggtgaccggtggcttcagcgccacttgggaccaggacgggggcttcatccgggtgtacgacgggcgcgtgctcacgggcgtgccgtagcgccctctccgcgcggggaccacgtctccaccgctgcatcgccaggtggccggtaacggactgttccacgggacgggccaatccctgacgccggtgcgcccgcttccgggaacagccaccctggtagagtcccgccccagccatgacgacccttcgcaaggtgatgctcgttgacgatgaagatgacatccgcaccatcggcaatctcagcctcagccgtgtggggggatggcagacggtgctcgccgcgtctggcgcggaggccctggagaaggcccgcacggagaagcccgacctcatcttgctggacgtgatgatgccgggcatggacgggcccaccaccttcggccggctgcgcgccgaggagtccacggcgcacacgcccatcatcttcatgacggcgaaaatccagaaacaggaggtcgcccgctatctggagctgggcgcgctgggcgtcatcgggaagcccttcgacccgatgacgttgccccaggagattcgcgagttggtgccagggtgagtcaggggcttcgcctctcccgtcgctcgggcgtgttggcggcgggcgcgctgctgctcttgtgcggcctgttcgccatgggccgtccatgggccacctccgacaatgaccgctaccgcagtgcgctgcggcacctgcgcgtggccagcggcgacctggagatggacgtgctgcgcgaacgcatgggcctgcgcacgcttcacggctcggacccggaggacttcgccgcgctgagggcccgcgcggacgcgctgcgacagttcccctccttcctgtccgccatggaccggcgcacgatgaacgcggcgctggacctgttcgtcagcgcgctggaggagagcgccgcgctgctggagcgagcccgcgccgcggacgcgcggggtgagaaggaagcggcggacgcggccgtccaggccctgttggagggcaccgtcagcacgcgggcggagcgcctcatcaacacctacctggagctctacgagcgcacgcaggcgcgcaacgagcgctcgcgcatcatcttcttcatcgtctccctggcgctggtggcctacgtgctggtggtgatggtgcggctgtctagggccaccgccgacctggccacgctcaacacggatttggagcggcgggtggaggagcgcaccaaggccttgtccgccgccaacgacgggctgcgcgccagcgaggcacgcaaggccgcgattctggaggcctctccggacggcatcctgctgctggacggcggcggggacttgctggagctgaacccctcggcgcagaagaccttccaggtggtcgccgcggacgtggtgggccgcgacttcctctccgtggcgctcccggcggagctgccggacggtgcccgtcagaaggtgctggccgcggggcggaacaccgcgtcggggcaggccacgcggttggagtcgccgtgtctgcgcagggatggcagcaccttccccgcggagctgaccatcgtccgcgtgccgggagaaggtccgcctcgctacaccgtcttcgtgcgcgacatcaccgagcgcaaggcggtggagcggatgaagaacgagttcatctccaccgtcagccatgagctgcgcacgccgctcacctccattcgcggctccctgggcctgctggagggtggcatcgtgggcgatattccgccccaggcgctggacatggtgcgcatcgcccgcaccaacaccgaacgcctcatccgcctcatcaacgacatcctcgacctggagaagatggaggcgggcaagctggagctgaaggtctccacgccggaatgcgcggacctggtggagtccgccttcgcgagcgtccggggcatggcggacggcgcgggtgtctcgctccacgccgaggtgacgggcacgccgcaggtgaaggcggaccgggaccggctggtgcaggtactcaccaacctggtgtccaacgcggtgaagttctccccgcagggcgcgggagtgacggtgcgcgtgggggaagaggaggacgggcgggtgcgtttcagtgtggtggaccagggccccggcatctcccaggagcagcgtgcgcgcctcttcggccgcttccagcaactggacagctcggacacgcgctccaagggaggcacggggctggggctggccatctcgcaggccatcgtggagcagcacggcagccgtatcaccgtggaaagcgaggagggccggggctccaccttcaccttcacgctggagtcggcccggcccgcgtccgtcacgccgccgcccgtcatccccgaggacgtgtcccgccatgaggtgctggtgaccaccgcggacgcggagctggcgtcgctgctgggcgggctcctcgcgcacgaaggctaccgcgtggtgcgcgccaccagcctcatcgaggcggcgaagcatctggacacggccctgccggacgcgctggtggtggacatgcggcttccggaagggcacgcgctggactgggtgcggcgcctgcgcgaacagccgcgcacgcacgagttgcccgtgctggcgctgtccggccgctcggaggacgcggagggcgttccgcactgggtggattggatgcctcggccattggaagagtcacggctgctcaagtcgctgcgctacgccacacggcagccgggccaggcgcgcgtgctggtggtggatgacgacgccagcacccggcgcacgctgtgcgcgcagatggagcggctgggcgtgcaagtcttcgaggcggcggacggcgagagcgcggtggaactcgcgcgcgagacgacgccggacctcatcgtcctggacgtcggcctgccgcgcctggacggcttcgaggtcgtcgacatcctccgtcaaggcaagggccgcgccacgccgctcatcgtcttcacgggccgggatttgacgcgcatggatgagcggcagctcaccctgggcatcacccggcacttcaccaagtcgcgcgcgtcggaagaggagctggtctcctccgtgcgtgacctcctcaacggcctgctggcgagaaaggcacacccctcatgagcagcaggacactcctgttcctggaggacgacaaggatttgcagtccctggtgggcaccttcctgcgtgagaagggctaccgcgtggagcccgcgcgcagcgcggcggaggcgcaggccgtgctcgcgcgcgtgccggtggacgccgccatcgtggacggcctgctaccggggatgacgggcgcggacttcattcgcgagctgcgcaagacacagcccaagctgcccatcctcttcgcctcggccttctggaaggacttgaagagccatgagttgctcacgcggcaactgggcgtggtgcgcatcatccacaagccctacaagccggaggagctgctcgtctgggtgaaccagctcttccccgcgcccgccctgccgccaccgccaccgcccgaggcgttggaggaggcggaggaagtgaacgtggaagtggacgacctggccgccagcctcgcggcgctcaacgcggagtacggcgcccggctgaaggagaaggtggcggcgctggaggcgctgctcgttcgcgggcgcgggggtgacgcggcggcgctggaggaggcctacacggttgtccacaagttgcacggaaccgcgggcagctacggctttgcggaggtgagcatccgggcgggccaactggaggcggtgctcttgccggcccgggctggggcgcccgtggatgtggcggcgctggacgcgtccttccgcacgctggccgccgcggcctccgttccggtgaagcccgccgccgcgccgccgcagtcctccgagggcgtgctgctggtggtggacgaggacgcgaagctgctggccgaagcggagcgcatggggcgccaggtgggcgtgggcgtggtgacggcgcgcacggcggacgcggcgtgtgaggtggcgcggcggcagtgggtggatggcgtgctggtccacctggacctgggcgggccactgggcggcctggccgtggcgcatgcgctgcgcgcggaggagagcctgcccgtgctgccgctggccgtcacgggtgcccgggacgtgctggaggaacgggtggcggcggcgcacgcgggggcgtccctcttcctgccacggcccttcaccgcgcgggacttctccgccgcggccgagcgcatggtggcggcgcgccgcccggagcgcgcgcgggtgatggtggtggatgacgacccggatgccatcgccgcgctgacgcaggccctcgccagcgaccagattgaggtggtggggctgagcgacgcgcacgggctgatggaggcgctggcgcagcaccggccggacctgttgctgctggacgtgcagatgccggggcccagtggcttcgacctgtgccggatcctgcgctccacgccggagtggcaggagctgccggtgctgctgattaccgcgcacctggggctggagttccggctggcggccttccaggcgggggcggatgactacctctccaagccggtgctgcgcgaggagttgcgagcgcgcgtgcaggcccggttggagcgcacgcgtctgtctcgcgagcgggcggagcgggatgggctgacgggcctgctgctgcgccggcccttcctggacgggctccgcgcccggctggccgagtcgcggcgccagggaaagccgctggccttgtgcttcctggacgtggaccacttcaagcaggtgaatgaccgctacggtcacctggccggagaccgcgtgttgatgtggttgggccggctgttgggcgcgcgcttccgccgcgaggacgtgcgtggccgctggggtggcgaggagttcgtggtggggctcttgggagagagcgcgggcagcgcctcggaaatcctcgctcgcaccgcggcggagctgtcggacatgaccttcgacggcgacaccggcgagcccttccacgtcaccttcagcgcgggcatcgcggtgtcgccgggggacggcgacacggtggagtcgctgctgcggaccgcggacgcgcggctgctgcgcgcgaaggagaacggccgcaaccgcatcgaggcgtgagtcccagggctcacggctcgttgaagatgagcagcccgcgcgacgtgtccaccacatagatgcggccgtctcccggcacgcggatgccgatggcgccgtcggtcagcttgtctgtccggttccggtctgactcccggaaggtgttgtagtgcgcgatttcgcgaggctgcgagggattggacacgtccaggacgcgcacgccctcatggtagtacgcgacgtagagccgcgtgcccaccagcagcatgttgtggacggaggtgaggccccgcaggcggtattcaccaatcttcacgatgttcgccgggtcggtgacgtccagcacgcggatatgggagcccatcgtctcgccgccctcgaaggccacggtgcggccattgaaggtacccaccgcgttggcgtggctgaaggcatggggataggtgtagcggccgagcaactccggtgtctcgccgcccagccctgcgatgaggaagccatcgtcgaggtggttgatgtagaggcgcccctcatacgcgaaggcgtcatgcggatagcccacacttctgggatacgtgaagcgggtgaggagctgaggctccagcggttgggtgatgtcgaagatgagcgtctgcttgtgggatggcgacatggcatagagccggtttccatccacgaagagggtgtgcacgtcgactgggctgccaccgctggggtggttgcgcacgaaggcgggcaaccgcgggtcggccaggtcgaacacgagcaggccggagcgcgcgctgcctacgtagagcgcattgtctcgagcccacacggcattccagtagtcgctatggccgaagcggatgaccgtctgctggacggggatgtagggattgctcacgttgaagacggcgaggccgccgccgacgccgcgccggtcgatggccacgacataggcgtggccatgggtgacatacacgtccacaggcgtgtccaggcccacgggcatttcggacaggagctgaaggttggcggactcgggctcgccctctcgccacgtcatgcgctcggcgcggaagctaccgctctggcgcagtgtgctgcctcggcaccagagaacgcagccggtgaggctccgtggcccctgggcgtgacagccgatgaacgtgtagcggtcttggagcccggtttggctcgtgggctcggaggaaatgaagaaccgctcgccattcatggtggctgcatggggcttgcgtcccatgacggacatgggctggcccgatgcatcgaactggaaaccaccgttctccgggaggactcgtacggtgccgggctgcacctgggtctcgtaccggatttccgcgcggtagatggcgccctgccgctccaggcccgcgagcgagccgaagtcacagtctggcatcaccagtgtctccggcgcgttgcacgccgcctgggacgtctgcgcgggacaggactcgaaggccccggggtccacccattcccccagctccggaagcacctcccaggggccgttgtaggccggtggcgtgggccccggtggcgtggggtccgaggaggagcatgcggacaacgaaacggcgcaaacaatcgccagcagcgggcgcgcggcacgaacagacatgaggtgcagcttttggaggagaagaatgggcgcccgcatcgtttcgcgggcgcctgtgttcagcatagaagccatcgcgagcgccgcgaagtggcgccctctgctggctcacggctcgttgaagatgagcagcccgcgcgacgtatcgacgacgtagacgtacccatccccgggcacgcggatgccaatggcgccctcgaaggcgccgtccgcccggtgcgggtccgtctccctgaaggtgttgaagtgcgccacctgccggggctgggtggggttggccacgtccagcacgcgcacgccctcgtggtaccaggcgacgtacagccgctcgcccttgagaatcatgttgtggatggaggtggagtaccgcatgcggtgctcgccaatcttcacgatgttcgccgggtcggtgacgtccagtacgcgcagatgcgaactcggcgacgagccgcatcccgccggacgactcggcttcgccgcgccgctccgcccgctcggcctcgaaggtgcccatgctccgggtggaggaccggggcgtctccgtgcaacggacatagcagccggtgatgacgtcgggcctgggcgtctcacagcccgccaacgagacgacgcgctctccggtgtagggattcgactgtctgccggagaggaagaaggtgccgccggtcgtcttccgcgtggtgacgggaatgcccatgaccttgtcgggacccccatccgcgaagagctggaaggcggcggtgcccggcgtgacggacgtgccccatccgcgagccgcctttccgaccgcccgtcgcccacatagatgccgtgttgctccaccgcggcgagctggtccgcgttgcaggacgacatgtcgaagttcgccggatccgcgcaggcctcgaggctggggttctccacggtgaaccggcacgcggagaacgctccccggtcaatccagtcacccgggtcgtcccagcacggtgtagcccccatcccagggcgcctcgggccccgcgtccgttccggcgtcctcggaacccgcgtccgtgccggagtccgtgggctgctgccccgcgtcgggaatgggcggaggcgggtcgtcatcacagccagtggtggcggacagcagcaggatcaggacggacagcaggacccatcccgggcgaagcggggacgtcatggaggcacctcatggggaaatgcgaggcactgcggggatggctgtcccgcacctgcacgcaggcatacgcccgtcatggcgttcccgattcgagatgattgccagatgaacgccaaaggacgggcaatgcagcggttgcttgtttcggggcgggaaatggtcctggccttgcgggcgcgcggcgcctcggcgcacggcatgaattgtctttcattgcggacgcggcgggagttccaccttccgccaccgcacgcccggccggggtagggtgtgaggccacaggagggtcgcggtgggagggaaactgagtccgggcatctaccgggtccacaagccggtgggcgccacgagcttctcggtggtgcagcggttcatggaggaggcgaaggccgtgcagccgggcaagcggataccggtgtgccacggcgggacgttggaccccttcgcggaagggctgctgctggtgttggtggggcaggcgccgcgcctgttcgagctgctgcacgccgtgcccaaggtctacgaggccgaggtcgtctggggtacggagacggacacgggggacctgcacggccggcccgtcctccagggagacacggcggcgctgacgcccggggccctggacgcggcgctggcgtccttcgtgggctggcgggagcaggtgcctccggccaccagcgcgaagaaggtggggggcgagcctgcctaccggaaggcgcatcggggagaagccgtggagctaccgccctcgcgcgtgtacctgcacgccgcgcgctggctgtcccatgacctgccgcgcgccagccgcctgtggctgagctgccgtgggggctactacgtgcgctcgctggcccgcgacgtggggcgcgcgctgggctgcggggcgcacctgtccaccctgcggcgcacggcgattgggccgtgggaggacccggggctggggcagcgggtgtggctgcacggacgcgacctgttgccctgggcccgcgtgcggacgctcacggacgcggaggtgggcgagctgcgccgcgagcgccccgtcccagcgagcggcctccagccggcggattggacactgccccccggcttcccggacccggaggcccccattcggggcttccaccaggggtgcctcgccttcctgctacgggagcgcgacggcgcgctgtggagcgagctggagctgcgcggagggctgtaggcccgcgcgcgggacgccccgccgttgccaaggtgtcacgtgcctcgcccgagatgggcccccggtgacaagagtcaccacctgggggccgccccggtgatgacggttgtcaccggtgatgacagttgtcaccaccccgcccagccccgtgaaaagggcacccgaatccataacccactgaaaagacttgggacgctcaggtgcgcccaccgggaccggtgtgtggcacgccacgcgcaataggacaggacatcacgctccagcacggagcggggctcgaagcacggggggcctggccggggggccaggcgctggggggtgaacctcccgagcgaacgagtcagtcggacctggaggacttgaaggtgcgagcggaagccggttcgggggaaccggggtgcgaccggggggacgcagcgctcacgcccacgaagcagccgggaacgacgttgaagtgacctgatgggctcatggcgtggggggaaccccagccggggggctgggatgcgacgggggtcgcacccttccgcgccatgagtccgccaggacgagcacctggatgccgaaagggcccgagggcctcggaccgatgggggacggtccgaggccctctctttttgcgggttacggccgcgtcttcgtcttcttcagcgagtccttcgcctgctgagccacgtggtccgcggt

SEQ ID NO: 1267 - DNA, 41170 bp, Myxococcus xanthus
  unsure (1)..(41170): unsure at all n locations
ctcccagcgagagtccaccatcgaatccctgcaagggaacgtgcccgcgcgcgaccagcgcatttccgagctgagcggagaccttgaaggccaccagccagacgctggcccagacgcagcagacgctggcgcagacggagcagcagctcgccgacacgcagaacacgctcgccagcaccgaaggcgcgctggcggagacgcgtggcgagctggatgccaccagccagacgctccagcagacacagcagacgctggcccagacggaaggcgcgctggccgagacgcgcggcgagctggacgccaccagccagacgctggcgcaaacacagcagacgctggcccagacggagcagcagctcgccgacacacagaacacgctcgccagcaccgaaggcacgctggcggagacgcgtggcgaactggaggccacctcccagacgctccagcagacgcatgcggcgctggaggacacgcgcggcgcgctccaggaaaccagcgacacgctggcgcacaccacccgcgagcgcgaccagcgcatcgcggagctggcggacctgggcgccgcgaaggacgcgctggagcaggagctcaccgggcagattggtcatctccgcagcgagctgtccgagacgcagggcaactacgaggccgagcgggccgcgcacgagaagctggccgcggagtcgagcgcgcacatcggagacctcaccagtgagcgcgacggactccgctccgagctggaggccaccagtcagacgctggagcagacccacggccagctcgccgccacccgcgacgcgctggcgcgcgagcagcacgcgcaccaggagagccggaaggccgccgcgagcacccagaccacgctggaaggccagttggccgaggcgcgtgcccatggcgaggacctgggcgagcacctcaccctcaccaagcacgagctgggcacacgcgtcgccgagctgacgcagctcaccgccacgctggcgcagacggagaacacccgggcccacctcgaggagcggctgcacacgctcaccgaggagtcgcagcgccgcgaggagctcctccagaacgacctgacgcagaagggcaccgagctgtcggacacgctccgcaagctcacccacgtgacgcaggagaagatgcgtcaggcggaggtgctcaaccgcgaggtcgccacccgcaccgagcagctcaaggccatggaggccaagctccagacgcaggccaccgaggcccgccgtcaggccgagggcctggggcagcagattaccggtctcaacgagcagctcgaacagggccgcaaggcgctggcgggccgcgaggaccagctgcgcgccgcgggcgccgcccagcagaaactcaccgccgagcgggacggcctcgcgggccagctccagcaggccgaggcccggctccagcagcaggcccagcaggcgaaccaggaacgtgccgacgccaagcgcgcggcggacgaactggccgcgaagctggccaagaccgagcagcgcatcacccagttcgcgcaggacgcccagacgcaggccaccgaggccgacgccagggccaaggacctgcagggccagctgagcgcgcgggcgaagaagatccaggacctggaactggcggtggagaacgcgcagggcgccaagtcccgcgcggagaaggagctcaacgccaaggtggccgccgccgagagcaaggcccacgaggcctccacccgcctggccgccgcacagaaggagcgcaaggacctggaggcgcggcacgccaaggagcaggaagacctcgccgccaagcagaaggcggagctggagcgtcgcgacgccatcaaggcgcaggaggtcgcccgcctgcagcagtccgtgcaggagaagagcaaggccctcaaggtcgccgagctggagctggcccgctacaagagcaagtccgccaccacggccaccccggccaaggccgccgccaagcccgcggcggccgaggacgacgagctggccgtgaggacgcagctcaaccaggtcatcgcgcccgccgccgcggcccaggccccggccccggcgaagaagccggccgcaaagcctgcggcccaggccccagcgaagaaggcccctgccccggctcccgccccgccggcggcgctgagtgatgagtccgagcccaccgaccggaccctggtcatccagttgcccacggccaaggaagacgacgactggacggccctggtggacgagttggacaagtaacggcgccgggattccggcaccccgccggaatcccgacggcctcggcctcggaaccccgaggccacaatgaagcggccctgacatccgtgccctagccgggcaggtgtgtcagggccgtctcagttccaacgcaggaagcgtcgagcggttccatccgcgctcagagcgcggcgcgtgcctcgcggaccagctccttgaagtggagcgtggagacgacgtcccggagtgacaccacgcgggcccccgtctgggcctcctcctgggcacggggccaactgctgcggagtgtacgcaaggcgacataggtcatcaggagggggaagccgcccggaagcagaaccactgccaccatcatcaccatccgtaaccacgcccacaccatgaccgctcacctccctgaataccgattggaaaccctgagatgcacgaggtgtgcccacgttgcgcagaaaatttccctccagagttacgcgggtttgccaggcagcgaggcgaacgggccacggtgacgacaccggaaccctggcatttttgccgcagtcgccaggagggcgtcggttaagttcaccgggtgagcaccccttcgacggttgagagccacgcattcaccagcgtggaggacgcggaaaagcgcctggagcaggtgggctatctatcctcgccggagatcgccacggcggccttcctggcggaccggatggacaagcccatcctggtggaaggcccggccggcgtcggcaagacggagctggccaaggccctggcccaggcgctgggccgcgagttcatccggctccagtgctacgagggcctggacgaggcgaaggccctctacgagtgggagtacgccaagcaactgctctacacccagctcctcaaggacaagattggggacatggtgcagggcaccaccacgctggcgcaggcggcggaccgactggcctccagcgacgcggtgttcttctccgaacgcttcctgctgccccgcccggtgctgaaggcccagctctccgagcgccctgccctgctgctggtggacgaaatcgacaaggcggacccggagttcgaggccttcctgctggaggtgctctccgacaacgccgtcaccatccccgagctgggcaccttccgggcgaagcacatcccccgcgtgctgctcacctccaacgccgcgcgcgagctgtccgacgcgctcaagcgccgctgcctccacctgcacatcgacttcccggaccgcgagcgcgagctgcgcatcgtccgctcgcgactgccccaggtgccccaggtgctggcggagcaggtggtggaagcggtggccgccatccgctcgctcgacctgaagaaggcgccctccatcagcgagacgctcgactgggcccagagcctggcgctgctgaacgcggagcagctcaccgccgacgtggtggcctccacgctgaacctcgtcctcaagtacgaaggcgacatcgagaaggcgaaggccaacctctcgcagattgcccaggcctgacgggccctcgaagcacgtgctgctgaaggaacgcttccaaatcacccggccgctcgaggagatggagctccgcctcgtgcgcgcctcgctggccaacgcggccctggtcgacctgcgcgaggaagccatcctccgcaccgtcctgtcgctggcgcgcctctacaaggtgcggcacggcgaacgcgacgtgggcgtgggcgcgctgctcaccccgtttcgcgaggaggtggagcgccgcctgggccccgtcctccaagcccccttcccgcccacgcgggaccggctgatgccgcacgtgaaggatttgcgccagcacgccgccaaggcgcgcgacatggtggcgcagcggctgcgcgggcgcgttccccccgaggcattggaccgggaaatccggcacaaggaactggtgctggtcaccggtggcggcggcggaacggcctacgtctacctgggggtgatgagcctcctgggcgaatacggcctggagccgcgcctgctcgccgggacgtccatgggcgccatcctggccatcatgcgctcgcgcctgacgcgcttcgacgccacggacatgatcaacatcgtccgcgggctgtccttccggaagctcttccgcttcatctccacggagagccgctatggcctgcccgccgcgctgcggctgtttctgcgcgcggggctgggccgcttcttcagcgcgggaccggagaacagtggcatgcggctcaaggacttgccggtgccgacgctcatcgccgtgggcggcatccgccgcggcatgcttccccggccgctggagtattacgagcgcctgctaggcaccagtccgctgggcctgctcaaccccgtgggcgtggcacgccgcatccaggccgccatgggcgccatggccgagctcttcacccgccccgaaatcaccgcccgcctctacctgggtgcggacgacaccaccggcgacttcgacgcgctcgacgccgcgggcttctcctccgcgctgcccggcgtcatccactacgacgtgctgcgcgaggaccccggcatgcacacgttggtggaaggactcatgggccagcacggcgtcgcgaggctcatcgacggaggactggtggacaacctgccagcgaaggcggcgtggaaggcagtggcccgaggccgcatcggcacgcgcaacgcgttcatcctcgcgctcgacggcttcgccccgaagctgaccacgcccttctggctgcccctccagcggctcgccgcgatgacggtggcgccgaaccttccttatacgcaccacgtcaaacgctttccgcgaacactgtcaccgctagacgtcgtaccgtcggtggaactggcctcgaaggcattacaattcggcaggacggcactcgcggaggacctcccgttcctccgtcggatgctcgcccccctgccaccggtgctgtgactgtttcgggacgagaaacacgctttgacctcataggtttcactggctagaaggccctggctgtcccccctcaacatccaggcgaaggaacatcgaatgagctcgacctcgagtagtggagtgcgcgccgagcaaatctggctcgacggccgactgatgaaatgggacgagggccacgtgcatctgatgacgcacgcgcttcactacggcctgggtgtcttcgagggcatccgcgcatacaaaacgcatgacggacggctggccgtcttccggctgcgtgagcacgtccgccggctgctcgactcggcccacatcatcatgctgaagattccgtacaccgaggacgagctcttcgacgcgtgcgtgaatctgctccgcgcgcagaaggacctgttcgccaacggcgcgtacctgcggccggtggccttcatgggcgacggcgccatgggcctgggcgcggtgaaccccacccgcacggccgtgacggcctgggactggggcgcgtacctgggcgacaagggcatcaaggaaggtatccgcgccaaggtcagctcgtacacgcgcatgcacgtcaacgtgaacatggtgcgcgggaagattaccggccagtacgtcaactccatcctcgccaagcgcgaggcggtgctggcgggctacgacgaggccatcctcctggacatcagcggcttcgtggccgaggcctccggcgagaacatcttccaggtgaacaagaagggcatcatcaagacgcccccgctgtccggccccatcctggacggcatcacccgcgacacggtgctgcacatcctgcgcgacagcggccgcacggtggaggaggtcaccttcacccgcgacgcgctctacatcaccaacgagatcttcctctgcggcacggcggcggagatcacccccgtgcgcgaggtggacaaccgccaggtggctgacggcaagcccggccccatcacccggtacgtgcaggacatgtacttccgcatcgtgcgcggccaggagccgcgctacgcggattggctcacgtacatctgagccaccccgcttcgcccccctcttcggcatgggaggggggcgggcagccagggaagaggccacgtcccgcgcccgaccgcccatcgaatgggctagaacggggcttgatggctcctcccgctggctacgactacgacgacaatccgttcaagctcgagaacccatccatcctcgacatcgctccaccggagccgaagtcggtggaggacacggggctcaagatgggcatcctgtccgacatcgccctgaagtacctctattacgcgggcacgggcacgggcatgggcatcgcggacgagatgcgactgccgtggccaggtgtcatcgagcacgtggtggacttcctcgccacggagaagctggtggacctgcgcggcggcaagggctttggccgcgcgtccgtggagttcatcctgtcggagaagggccgcgagtacgcgcgcgacgccctcacccgcaccacctacgtgggccccgcgccggtaccgattgagcagtacaacgcgctcatcaccagccagacggaggagacgcccgtcgtcagccaggaggagttggtgatggcgctcagccacctcaccgtccccgcggagctgatggacaagctggggccggcggtgaactccggccgctcgctgttcctctacggctcccccggcaacggcaagacgagcctggccgaggccgtctcccacatgtttggcggcgaggtgttcgtcccccactgcctggagattgggaatcagatcatccaggtccacgaccggctcatccacacgccggtgtcgctggaggtcggccgggatgcctccggccgccggcagaccttcgaaatggacaaccggtggctcgtgtgccgtcggccctccgtcgtcgtgggcggcgagctgacgctggcgatgctggacctcatctattcggagagcacccgcttctacgaggccccgttccaggtgaaggccaacggcggcatgctcctcatcgacgacttcggccgccagaaggtccaccccacggacctgctcaaccggtggattgtccccctggagaaacgggtggacttcctcacccttcacaccggcaagaagttcgaaatccccttcgaccagctcctcgtcttctccaccaacctggaccccaaggaactggtggacgaggccttcctgcgccgcatcaagtacaagattgaggtcgggaaccccgacgaagaggcttaccgggaaatcttcagtcgcgtctgcgaggcagcgggaatcccgtacgtggaccaggccgtcacgtacctcatcgagcactactacaagccgcggagcatggagcttcgctcgtgccaccctcgggacctggtgagcctcatccgggacgcggcgcgctaccggcagatacctccagcgctctccaaggacctgctcgaccaggcgtgcgaggtgttcctcgtcaatctgtgatgatttcgttgttacaaccgcgcggaatttctagaatccacgcgccgttgtaccgctcggccgcatgcttcgagtaccgcccgcggcggacccgcagcgagaaggagccgcagtccgtgaaggaacgctaccaggacatcgacgagaagaacgaaacgctgcgtgggtacctcgacatctacaaggacaagccggacgcgcgcgagttcttggacaagatggagatgtcgtggatctaccacgacgccgcgctagagggagtcgtctacacgcatcaggaactgatggccgcgctgttccctcatcgaaccagcgcggaagcctccatgattccggtggtcctcgaaatccggaaccacaaggccgtctgtgacttcatccgtgaggaggcagcgggcgccaagaagcaggcgcaaatcacgctgaccaccatcaagcggatgcacgacctcttcctgggcaacacgccggaggcccagacggagcgcgcgcgcatggagcgccgcgagcgcacggagaaggagctggccaaggaacgcgacaggtccgggctgcgcaaggacatgccgctgcaccgcacgtacttccacgacatctcccagccggcgaagatccagccggagttggagaagctcgtggactacacggccagcgccgagttccgcgagttccaccccatcaagcaggcggccacggtccagcacaagttcgtgcagattttccccttcaccgagcacagcgggaaggtggggcgcatgtgcagcaacctcatcctgctgcgcaacggctacatgcccgccgtcatccattccatcgaccggcagcgctactacgagtccttccgaggacccgcggcgggcttccggacggtgctgatggacgcgatggagaactcgctcgacaacggcatgaagtacttccgggacctggggcgcaagttcaaggccctgaacagctagcccacgtcccgcggcggcccggcgagggagcgcgcaggctcacgctcctctcgcgcgtcgtgaaggatgcggggtccgtcgacaccattggtgtgttggcaacagaccccggatcctcgaatccctggacgggaggaagtaagaagaatacccatgtccgtgacacagtccctcaacagccgccgcggaaccggaagctcgggaggcgagctgacggagcccccgccaccgcggctggcccatatgccagcccgtgacaagttggagcggctcctgcgagtagcccagggccaccacaaggcgctcatcctcacccacgacaatccggacccggactcgctggcggcggcggtggccctggcgcacctgctcgagcgcaaggcgggcctgaaggcccacatcggctacggcggcatcatcggccgggcggagaacatcgccttcgtgaaggtgctgcgcctgcccgtctcacacgtgtcgaccatcgacttcgacgagtacgacctcttcgggctggtggacacgcagcccaaggtaggcaaccactccctgcccgcgcggctgcaagcgcacctggtggtggaccaccatccgctgcgccaggagagcctggaggcccctttcgcggacgtgggcggcgacttcggagccacgtccaccatgctggtggagtacctgcgcgcggcccggttggagccctccgcggaggtggccaccggcctgttctacggcatcaaggcggacacgcgcgacctgggccgggagacgacgcccacggacgtggacagctacctgtggctgttcccgcgcatggacaagatgctgctggcgcagattgagcaccccgagctgcccgcgcgctacttccagctgtaccacacggcctacgagcgggcgaaggtgtacgggacggccattgtcaccgacctggaggaggtctactccccggacatggtggcggaggtggccgagcggctgatgttcctcgaaggcatgaagtggtcgctggccttcgggacgtaccgcaaccagctcttcctcagcttgcgcgtgaaggaccggcggatgaacgcggggcgcctcatccgcgaaatctgcgaggactacggcggctcgtccggcggccacggcagcatggccggagcgcggctgccgctgtccgggaagctggcgcagcgcaaggcgctcaagcgcgagctggtggccaagttcctggaggcattcggcgtcgccaacgagcggccggtgtcgctgctgtacgcgcaggactcgtgacgtactgggactacaacgcggccgcgccgatacgagcggaggtcgcgacgctgctgtcgcgcgccttcgcgtcgagcggctacggcaatgcgtccagcgtgcaccaggagggccgcgcggcccgggcccggttggacgcggcacgggcgcaggtggcccgcgtgcttggctgcgagccgaaggaagtcagcttcaccggctccggcagcgaggcggacgcgctggcgctcgtgggcgcctggcacatgcggccccagcccgagcggcggcgggtggtgacttccgcggtggagcaccccgccctgctgggcgcggtggcgcagttggagcgggaaggcgcttacgtcgtgcgggtggcgcctggtccggacgggcgcgtgcgcgaagccgacatgctggaggccctgacgccagacgcggccttgtgctcgttgatgtgggccaacaacgagacgggcgtgctccagcccgcgcgggaggtggcgctcgcgtgccggcagcgcggcgtgctgttccacacggacgcggtgcaggccgcgggcaaggtgcccctgtccctgcgcgaggtggacgcggacctgttgtccctgtccgcgcacaagttcggcggccctccgggcgtgggcgtgctgatggtccgcaagagcgtggacgtccgcgcgctcacgccgggtcatcaagaaggcggccgtcgcggagggacgcagaacgtgccctacgcggaggcgctggcgctcgcgctcgcgttggccgatgcggagctgactgagacaacggcgcggctgaccacgctccgcgatgcgttcgagcgggaggtgacggcgcgactgcccggcgtgcacatcaacggcggcgcggccccgcgcgtgcccaacaccagcaacctgcgcttcgacggcgtggagggtgaggcgctgctcatcgccctggatctggagggcatctgcgtgtcctccggcgccgcctgcgcgtccggcacgctgacgccgtcgcatgtcctgcgggccatgggcctgtcgcccgcgcaggcccgaggcagccttcgcttcagcatgggccccggcacgacggaagcggacgtggcgcgcgtggtggacgcgctcgtccgacacgtgccgcatgtccgcgcgctggccggctaggacacggaacgtcggctcaggggcagccgaagatggaaggtcgccccgcccacagcacggacttcaccgacaacgagcagcgcatgggccacccaggtgagcacctcctcacgggccaggaagggccccctgcgcgtgtccgtggggggcgttcggctcggggagggtgggcacggccacgggcttggcgaggaagacgtccgccgcctcccttcccgcgggccgcgcggcgctcagcagcacgaagggaaccgatggcgtcgctaccaggactgctccggaagcgactgctcacgaacgtccgcatcgggctgcccatagccgggcatcccatcttcccgggcttcgtccgccttggaggtccgcggacgcgcgcgctcctcgggcttgggtgcggactgctccggcttcggctgcttgggctcgttggccatctggattcctccctccacgcgacaccgcgcgcggcgaaaggaaaggtcgtcatcgtcctggaaggtgggcaggaacaatggagcggacaacagggtgcccgctcccctactccgcgcgcgtgcccggcgtcggcggcgtcccgctgggcgacggcgcggcgggcacctcgtcactggcaccgaagagaccgcgcaccacggcggcaatggccagcggcgtgcccacgcgttcgtcgtagtggggcgtcagcgcctgggcgaactcctccgctgtcgggaagcggtcctcgggacgctccgcgaaggcccgggccaccacggcctccagcgcctccgggatgtcgggccgcagttcccgcaggggccggtactgccgggcgcggatggcgttgaacacggcatccggcgtcgtgccggtgaaggggcgctccagcgtcagcagctcgtagagcaccaccgtggcggcccacaggtctgcctccgggttcacctcaccgagcagcgattcgggggacaggtagtagggcttgcccagcacttcgccgccctggagcttgccgtccaccagcacgcgcgacacgccgaagtcgcccagcttgatttcgcccacgcgggagatgaagaggttggacggcgacacgtcgcagtggacgatgcccagccgctcgccctggggccccgtggcggagtgcgcgtacgcgagcgcctccaacagcaccttgcccaggtacaccgcgaagtcgagcggcagtggaatcccgcgcaccttgcagcgccggaggatctgccccaggtcgcggccgtccaccagctccatcacgatgaagtagatgccctccagcgcgccggcatccagcaccgtgacgatgttggggtggtggagctgcttggacagctgcgcctcgcgggcgaacagcgacacggactccggatcccgcgtcagcgcgggcaacaggcgcttgagcgccaccgtccagccctcacgcggtccggacaacacccgggcccggtacacctccgccatcccgcccttgcccagcacggagaggacttcgtagttgccgaagacccgcgtggtcttctgcggggaagtcggctggctcacggcgtggtgtttccagcccccgccgacgggcggacgggaccccgcttccgggtccgctgctgttgcatgagtgtttcgatgtcctcgcgcagcgcctgctccgccaccgcttccgccgcgcggcccgcgggcatccagccctgctcgaaggccttgcgcagcgactcgcgcgagcggttgcggttgccttcgcgctgatacgcgtaggccagccacaggtggacgtccgcacgccccaaccccctgcccgcctccagcgtcttcaccgcgcggctcacgtcattgagcatcagctggctggcccccaggcccaccaccgcggcggcgctgcgggggtccttcgacagggccagctcgaagtggcgctgcgccacgcccgcgttgcccgcggccaactggcgctgcccctcctccaagggtgacacctcgccctgccggcccagtcccgcggccacctgcgccgcggacgagttcgcgccgtccgccgtggccgaggcggccaccgccgcggtcgctgaagccgcgcgccccggcgccaccgcttccgcgtcccgggacaacggccgcaggagcaggagggagtcgttcttcaacaccggcgagcggcaaccgtccttcagccggaacagggccgtcatcaccccatcgtccgggttgaacacgaccagcgcgggctgattcacccgcggctcacagtggggccccaattgacagagcaacacctggcccaccaggacgttgtcctggaactcgccagagagcacctccgtatcgggttcgaatccgcagggtccgccagtcgcgacccccaccagctggtctccctgcatgcgcagggacaccacgccataggagtccccttgataggagctcgacaccgtgggcggtcccgcccacgcgaggccggaggcaacggaaagaaccgtcgcaagacccttgttcaatagcgagggcggcatatgtgggtggattcgggctctttccatcatagaggtcccgcgcctgccttgtaaacgcgcgaggatgccttgaccccgccgccccccgtccttatcatttccaaagactctggcgggaattcccaatagattcgaggatttggaagcactgtagctttgttcaagggctgtcccctgcggggcgcgtgatgctcggcagaaattcgaaccgatacgtccattccggggtccgtttcggtctccatgtgcaagccctccctcctcacgggggatgagggaagcctgcggaggcatgatttcggtccccacctggcttttgagggttcaatggacgccgggcacacggccatgctgcggggggctttttcttgggagcggcgtcggtgagcgagacggtggtggaagaggcggcggcgaggaagcagaccctgcgagaggagctcacggcgcgccggaaggcgatgacgccggacctcatcgatacgcggggtctcaaggttcagtctcggtttctggcggcgccctactatcagaaggcgcgcacggtggcgttgtacgcccccattcggggggaagtgccaacccgggatatcctgattgcggcgttgcaagacggcaagattgtctgctacccgctctcacatgttcacgggcggattctttcgttccgtgccatcaagtcggaaagcgagctggaaccgggacgtttgggggtgcgtgagcccaccaactccgcggacctcatcgcggtggaccagattgacctcttcgtggtgccgggcctgggcttcacccgggaaggcaagcggctggggcgcgggggcggttactacgacgccaccctccgcgcggccagtcagcgcagtcgtcgggtgggcctggccttcaatgaccaggtcgtccccgtgctgcccacgaccggggatgacgtcgacatggacctggtcgtaacggagtctgagtccctgcgcggcctgtaccgcgactgggacttcctcgatacgtgaaagtcctcttcatgggggacgtggtgggccgcccgggtcttcaggcggtccgcacgctccttccgagggtccgcgcgcagcacggcgtggacgtggtggtcgccaacgcggagaacagcgaccaaggctcgggcatcacttcagagacggcccactacctgctcgacagcggcgtccagctgctgacgagcggtaatcatttctactccaagaaggccatcctcccctgggtgaaggagcatccggacctgctcttgcgtccggccaactaccccaagggcacgccgggcaagggccacagcgtggtgaagctgccggatgggcgcgcgctgggcgtcatcaacctggaggggcgcgtcttcatgcgcaccgaggccagccccttcgaggtggtggaagggctggtggaggagctgcgccagcagacgccctgcatcctggtggacatgcactgcgaggcgtccagtgagaagaacgccatgggcgtccacctggatgggcgggtgtccgtggtggtggggacgcacacacacgtgcagacggcggatgagcgcatcctccccggtggcacggccttcatcaccgatgtcggcatgtgcgggccgctggactccgtcatcggcatgaagaaggagtcctcgctgacgcgcttcctgggcaagccggcgccgtatgaggtggcggagcggctcgtctacctgcaaggcgtggtggtggacatcgacgacgccaccggacagggccggagcatccaccgcgtgcgtgagcacctgccaggcacctgaaacccggtggaggaagtgcgtccacggctggcgcacttcgggtagcttgcggcgccatgaatccggacgcgctgcgcaaggcgacccccgaggagcagttcgaagaagtgacccgtggcacggtggacctccacgtgcccgaggacctgaagaagaagcttcagtactcgtatgacacgggcaagccgctggtcatcaaggcgggcttcgacccgagccggccggacctgcacctgggccactcgctgctgctcacgcgcatgcggcgcttccaggagttcggccacacggtggtgttcctcatcggtgacttcacggggttgattggcgacccgacgggccgcaacgccacgcgcccggcgctcacgcgcgacgaggtgaaggccaacgcggagacctacaagaagcaggtcttcaaggtgttggacgagtccaagacgcaggtgcgcttcaactccagctggctggactcactggggacggaagggatgatccgcctggcctcgcgctactccgtgcagcgcatgctggagcgcgacgacttcaagaagcgcttccgcggcgaagtctccatctccatccacgagttcctctacccgctcctgcagggctacgactcggtggtgctcaaggcggacgtggagctgggcgcgacggaccagctcttcaacctgctggtgggccgccagttgatgaaggaagagggcatggcgccccaggtcatcatgacgggccccatcctggagggcctcaacgcgaaggcggttgacggaaagattgtcggcgacaagatgtccaagagcctggacaactacgtgggcatcgacgagccggcggacaccatcttcggcaagttgatgagcatcaccgacgacctgatgtggcggtactacgagctgctctccgcgaagacgcgggcggagctggcggaaatgcgcgcccaggtggagtccggcgcgctgcaccccaaggcggtgaaggtcggcttcgcgcaggagatgacggcgcgcttccagggcgaggaggccgggaagaaggccgccgaggacttcgagaagcgcttcgcgaagaaggagctgtccacggacgagctgcccctggtggaggtgtccctgggcggcgcggagaagctgccggtgacgaagctgctgccggagtcgaagctggtcgcgtccgccaccgaggcgcgcaagctgatggcgcagggcggcgtgcgcgtcaacggcgagaaggtgcaggacgtcaaggcggagctgggcgccggcgagtacacagtgcaggtgggcaagctgaaggcagcccgcgtgaagctcggttgaatctccggccggtgacggccgtcgcaggcgcaggacatgcccccctgcccctcctctgaggggcacggcggggactgctgtagactcccgtgcgccatgcgtctttccctcccctgtctcgccctgttgctgggtgcctcgctgcccgccctcgcgggccgcggcgtcttcgtgtctgacgtcacggtggacgccctcgagcagcccgagtcccgcaaggtcgtcttcacggtggaggccgggaggccctaccccctgctgaagaagggcggccccaaccgcgcctggtgcaagctgagcggcgcgtccgccgaaggctgggtgttgtgtgaaggctcgccggagtccaccgcgcccgcccctccgagcgcggcggccctggtggccgcggaccgggcccactcggcgcgacaggtgacgatgcggggccccgcgggccgcgtggccgcgcgtgacgctgacaacgacggtgacgaggagctggccggctccgcgagctggaagccggccaccggctgctcgacgacgtgtgacagcgcgcccctgttcgcgaagccgccgcccttgtccgccatggaccgcgaggtgttggacttgtgccccgcgcgccccgacgtcagcgtgagtgaaggcgacgtgcggcgcttcctctcgcgccactacgacgacccgcgcctccagcgggccctgtccgtggcgggccggcccggcgcgcggcaggccaacatcgactggctcaccggcctctgggtcagcaccgggcctcgcaacgccttcacgcacgtcttctgcggcgacgactggcagcgaggccccattggcggcctgcacttcctgccgcgttatgcccagctcgaggcggagggccgcctctgctaccagggcccggtgcgcggtgccgcggccttgaagggtgacgcctacctcatccgcttcaagggcgtggcgccctggtcctgcggtgagaagcgcgtcggcggcttctcacgtgggccggacgcggtgggcctgatgtccattggcacgcgcgccttcgcccggtgctgcgcgcgcggcggggccaagaaggaaggcggcgtgtactcggcgccggacctgggcgggacgaactggcgcatctggtgcggcacgcgcaatggcacctacggcatcgccaccctgcatcccacggacgacaaggccacctgcggggaatgagcccgggctgaagggcccactccccgtggtggaccgcgctacttcgccgcgcccaccgtgagcaccgccccggccgagtacgcggtgaactccggcgcgtacatggactgcaccgtggcggggcccaccttgaactggccggccatgttggcgcgcagccggtacttgaaggtgtactcacccgcgggcagctgctcgaagaagaagttggtgccggagtcccgcgtctcctcgtaccagacgatgcccaagtcccagcggtggcgggactgcacgttctccggctccaagcccgcggcgcgcggatctctcaggtgcacgtactccgccgcgtgcttcgcacgcagggagagctgcacctccacttcgtctccggggagcaccacggcgccctcggccagcggcacgagcctggcgtccttcccctgtcgctcacgcaggaagtagcgccgcgacacctggaagaagtccccacggtcgctgtccggcagcttctccgtggagaagtgccacgtcgcggatgcgaaggcgaagcccggcgtcgtcttctccaccaccaccgagctcatcgtcgccgggttcaactccggcccgggcacgacgacctggttcttcttgcccgtgtactcgtccggggcgaaggacatgcgcaccacgcgcgggcccaccgtcacctgggcgtcctcgcgcacgcccagcgcgccttccgcctggaggtacttcaccagcgcgtacaccgactccgccgtggcgcgagtggacttccagtggttgagcttcttgttcagcagcagccactggaccaggccctcgcggcgcgcgtccttcggattgagctccgtcagcgtgcgcagcgcgaaggcgtgcgtctccgtggtgtcgttgtaccagagccagctgcggtcctcctgcgcccagtaggtgcccagctcgggactcgtcttcgccgagtccatgacgctctcccagacgcggttggcgtccgcgccgcgccccgcgcgcttcagcgtcagcgccaggtagcccttgaggtagggcgagtgcttcttccagtgcttgtagctgaacgcgagcatccacgcccgctccgcctcggtgagggcatcaccggtgtagctcgcgttcggatacgcggaggccgtgtagttgaggaacgtgaggaactcccagcctcgctcctccttcatcagcttcgtcgcgtactcctcgcggaagtgccgcgccaggtagccccaggcgccccgggtgatttccggcgggacttccacgccgaactccatcgcgcgggagaggccatgcacgatgtagagcgtcatgtacggcgacggaggcccccccgcccaccaggggaagccgccgctggacgtctgcgccttgcggagcttcgccagcgcggacgtgcgctcggcggcggcgaccttcgggtccaacaccttcaccagaccggcctccggcccggcgccgcccttcgccatctccagccagggcgtctcctccagcgccatcttccggttggggtccaccgcgtcccacgtctccaactgggtggggcgctcgctcagttgtttggccatccgcgccaccgacgggtactgcccgtacaggctggacaggatgcccgtcgacacgaagcggttgagcgtctgctccgtgcactcgtaggggtagtccaccaggtacggcagcgcctggagcgccgaatagaacaactgcgtgtccaccgtgacgaccagttgctcgttcacccgcgtcgggtccccgcccgcgcgcaggtcctcgaactgcatcgtcttggagtccttgcccttcagcgtcacgaagcgcgactgcgccaggtgcatccggcccggcaacaccggcagcgggcgcagctcaccatcactgtggttctccgagcgcgccaccacccggaaggcaacgggccccacccgcgtgggcgtggtgagcgggaagcgcaggcgcgtccccttccctgcttccacgcggaaggactgcgacgccttctggacgccgaagtccgacagcacgctcttctgcagctccaggtcctggatgtccaacgtgagcgtgccctgcatcgggcgcgacgccgcgttgttcaccatcacctccaacaccgcgcggtcgccctcgcgtaggaagcgcggcacgtaggggcgcaccatcagctccttcacgctccgggaggtgcgctgcagcgagccgcccttcaagtcacgcgtgatggcgtgcacccagacgctccacgccgtcaccgagtccggcacggtgaactccagcgtcgccgagccatccgccccggtgagcacctggggcgcccagaacgcggtctccgcgaagttggagcgcagcggctgcggcgcatccggagtcgctcccccgctgccaaagcgctcttccttgtccgcctgcatcttcgcctcagcccgggcaggcgcctcggcgagcggcgggggcggcggggcgcccggcgccggtgccatggtggcccttggcacggngccctcccgcatgccgcccatcccaccacgaaccatgtgtcgcatccgccgccggcctgggccgcccacctcgaagccctccccgaagagcaaggcgtcaggcgcaggcggtgaccagcccggcacctcgtcatatcgcgcgttcaccacccaccgggtgtcacccatgctcgccgacgactgcatgtccacggaggcgtgccgctggggatacagcgacgccacgctgggcggcgtctgcttcgcgaacaggtccagtgactggtcatacatgtacgagagcagctcggccgtgcccgcctccaccttcgcgcccttcggccccttcaccgtcacgcgccaggtctccttcgcgcccggtcgcagcgtgtcgcggaaggtggcgaactccagctgcagctccttgtcgtcccagggaacgaagatggacttcgagaagaacaggaactggtagtcacgcaccgtggacagcgccacggtgaagccgccgcgcagctccgccgtcaccggcacctccacgactccggaagactggcccgcggtgagcttgcgccgggagatgagccgctcgccctgatagatgtcgagcagcagcggctggcccttgaaccccgagacggccatcaaccgcgccacctcccccacccgcgccgtctcccgctcggccaccagcatcgcgggcaccgcgaggggcgtcgtcttcccggccaccaccagctcgcgccccacggtgtacgtctgaccgaaggcgtccgtcgtctcgtagtggagccggtacgcgcccgccttgagcgacggcagcttcagcacggccaggccctcggcgtcgtgctgcaccgagccggtcgcctgctgggccccatccgtccagccgcgaatggtggactccggcgaatacgcgccgaaccaccgaggacgcaggttgtctccaggcgtgggcgtgaacaccgcctcggggtccttgtactccggcaggccctggggctcgtccgcgggcagcaagggctgcgcgggctgattcagcgccaccagccgccacttgcccggccccggctgcggcgcgccatccagcgtggagcgcgtcagccggacctcggccacggcgccctcgcggaggaaccccgtgtccaggtccacgcgcgcctccacggcgacgaagcccagccggaaggccctgctggccgagcgcgtctcaccgccttcgtccgtcgcgtccgcctcgatgcggtagttccacgtcagccccggagtggccgcggaccgctcatccgcctcgggggtgaaaccgatggtgaagcctccgtccgcgcccagcggcgacgtgcccgtcgccaccacctcccgctgcgaggacccggacggcgggccccaccaccaccagggcagcaccggctcgcggaacgcacgccaccgcacggagccggacgtcaccggcatgccgaagtagtagcgggcctcgccctggaatgtcgcgggccggttgaggcgcagctgcgccttcgcgtccttcagcgtcacctcgaaggtgggccgcttgtactcctccacgcgaatcgccgcgcggccccccgcgctcacgattacggaccacgcccccagcatccggccggtgggaatcgtgaactcgcccgcggcggagccgaagtcgttggtgcggacctcccgggactccaccacctggtggttcgggtcgaacagcgtcacctggagcgggcggtccgccagcgtctgatagcgcgcctgctcgccccggccgctgaaggccaccgccttccacagcaccttctgctgggggcggtacaccgcgcgatcggtgaagacgagcgccgattggacgtccccgggctgatggcgcttgtagaacggcacctggcccgggtgcattatcgcgttccgtccgacttctgccaccaggacgtagctgcggtagccatcgcccgggaccgagtcgaaggtggccgcgccgtccgcgtccgagaggatgcgcgccacctccttgaagccctgcctgtagtcgacgcggatgaggcgcaggggcaccttcgacacgggctcgccggtgtcgccgtccaccaaccgcacctccagcaggtccccgttcgagggccgcgcgacgatgacccagggcgtcaccgtcaggtacaccgcgacgatgcggttgttcgtcgcgcggaagtcctcgtgggcggaggccatgatgacgtacgtcccccgggccgtgagcggcggcgtgacgaaggtgcggtgctcccggaagtcctccgtcttcggcagcggcacgctccaggtggccaccggacgctggcccttcaccagggccttcaacggcgcactgtccggcatgaggttgtagtcatccacctgggccagccgcttctccaggtccacggagtacgcacggaagtgcagcatggacacgttgcggtgggtgacctcgacggagcggcggcccggcccgtccgacgccagcgagcccatgctgaactcgggcgcctcgatggcggccatgagcacgcggcagcgctgcgcccccgtggactgggggtaggtggccgcgcacgccttcgccagcgagtgggcacgcacggcgtggtccgccactcgctccatctccacgagctgggcctgccccatggtcgaccacggcacgtcgcggaacgcgggcagcaaggcggccaggtgttgccggatgcgggtccggtcggccgtgtccgtgaagtgctggtgcagcaccgtgtagcgctgcagccgggcctccaacgccgactcgcgccgtcccgcggactggtgccacccctccaggtccccgagcaccgctgccaccttcaccagcggatggacgccggggtcggtcagcaccaccttgggcgtcccctccaggagcgcgcccaggtccagccggaacacctcattggcctgctcgggccgccagtgcgagctgtccgccagcagcgacacgcgcaggtacgacacggcatcccgcagcgtggagcgcagcccctgcggataggtgttgggcttcacgtactcggacagcgccttcaggggctcaccgccaagttgctgccgctgcttccacacttcctcataggcccgctgggcctcggtcagaatctcctcgtaggtccacgccttgaggtccaccggaccggaggacgccacggactcgcgctggcgcacctcccagccgtaggcctgcgcataggcgacgagcgcgttcgcgtagaagaggttcagcgtcgcgcgaggcaacgtgcccttgggccagggctgctcgcgcaggaagcgcaccgccgtctcgtagccatgcaagtcggtgcgcagttgcaccgtgcgcaccagcgcgcgcgtccactcggcctcgtcgcccttggacttcgcctgcgccagccgggcctcggcgccctgggcggcggcctccagcttctgctcttcgaccatcccttcgatggccttccacgaaggcggcgccttgccctgccccagcacgggcgaggtcagcagcagcagggcgaacagccagaagcgaacaaagggtgcgcgggtccagggggtccgatgcatgtcggcactctagacacagctggacacccgaacgttccacaatgaacgtcagttcgcctccggggcctctggcgcacggcggcgaagacccaccaggtagacctccatgctggcgccgcgggtggcttccggccggaccaccttcacctcttcgaagagggcgcggatctggttgcggaagtcctcgaagtcccggcccatgaagaccttggccacgaaggacgacccgggccgcccccgcgccgcggccaactccagcgccttgcccgccagccgcaggctgcgcgcctcgtcggtggccttgatgccgctcgtcttgggggccatgtcggagatgacggcgtcgaaggggccggcatggagctcggtcagcttcgcgtcgaagtcatccgcgagcacgtccagcaccgccgtctgcacgaagggctggctgaagggacggatggcgacgatgtccacgccgatgacgcggcccttcggccccacggcgtccgccaatatctggaggaaacctcctggcgccgcccccaggtcgagcacgacgtgccccttcttcaccatggggaagcgcttgatgagttcatcaaccttgaaggccgaacgtgcccgcaggccctcttgcttggccttctggaaatagtggtctttaggacggtagggcttgcccatgtcaggggggctccctagcatccgctactgtcttcgggaagccggagcagtcgcgggtgtcactccccgtgcaacggccagtccggaggacgtaggatgggcacgacccggagcgtgatgacggcgctgtgcatctccctgctgtcggctgggggcgccgcctactgctacacccgcgcggacgccctccaggtgcagggccagtggctgatggagcgcggcaccgcccaggcggaggactacgcggcccggttcgacggcgccgcggcggatgcccaactgaagacgttcgcggagcgccgggccatcctggagaaggcacacggatggcagcgcgggatgctgctgggcgtgctgatcgccgcgttggccaccgtctccgcgtacctcctgttcctcctcaagcggctgaacgaccagttgctcgatgccaccggcagcggggcacacgaaggcaccgaccgggagtccgcctccccggagcccgtccaggcgttgatgcccagtccgcagcgctgagcgctcgccgccgggcgcggcccgctggcacaatggcgtccccgtttcatggaggaggccatgcccggctgcgcgcactgtggacaccgactggacatcatcgcgaaccaggtgggccggcgtgacgagtgcccccactgcggcgaggacatccgttcgtgccgcaactgccgtcacttcgacctgggcgtggcgaaggagtgcaaggagcccttcgccgaggtgcccaaggacaaggacggcgccaacttctgtgagctgttccagattggcgaaggcggcatccatgagaaggagagccgggacgccctgctgaacgccgcggagtcgctgttccgcaagaagtgacgcagcccgccacccgaagcccccgaggtccgccggcgcctggcgccaacgaagcgccgaaccggggcgctatagtccgctgcctcccgagagaggggtgcggatgcggtggttgaagaatctgtacgtccaggtgctgctggccatcgcggtgggcgtcatcctcggatggctgcggccggacctgggggagtccatgaagccgctgggcgacggcttcatcaaactggtgaagatgatcatcgcaccggtcatcttcctcaccatcgtcgcgggcatcgcgaagatgggcgacctcaagcacgtgggccgcatcggcctcaaggcgctcatctacttcgaagtcctgacgacgctggcgctcgtcgtgggcatggtggtggtgaacaccctgaagcccggcgcggggatgaacatcgacccggcgcagatcgacacctccggcatcacccagtaccgcgcgtccgcgtcgcagcagggcaccatccccttcctcctggacatcatcccgcatgacttcctgtcggccttcaccgaggggaagttgctccaggtgctgctcgtcgccgtgctgacgggcgtggcgctcacccgcctggggcccatgggacagcgcgtgctcgacttgtcggatgacctggcgcaggtcttcttcggcatcgtcgggatgatcatgaagctggcgccgctgggcgccttcggcgccatggccttcaccgtgggtaagttcggtgtcgaatcgctcagctccctgggccggctgctcatcgccgtctacgtcacctgcgccctcttcgtgttcctggtgctggggctggtggcgcggctgtccggcttctcgctgtggaagctgctgcgctatatgcgcagcgagctgttgctcgtgctggggacgtcgtcatcggagtccgcgctgccccggctgctcaagcggctggagacgctgggctgcgaccggggcgccgtcgggctggtgctgcccaccgggtactccttcaacctggacgggacgtgcatctacctgacgatggcggccatcttcatcgcccaggcggtgaacgtggacctttcgctgggcgaggagctcaccttgctgggcgtgctgctgctgacgtcgaagggcgcggcgggcgtgacgggttcgggcttcatcacgctgatggccacgctggcggcgctcaacggcaaggtgcccgtggaaggcgtggccctgctgctgggcgtggaccgcttcatgtccgaggcccgggccatcaccaacgtcatcggcaacacggtggcgacgctggtggtgtccaagtgggagggcgtgcgtgacgacaccgtcatgcacgccgagctcgacagcgggcccaagcccctggaagggatgagcctgggccacggcgcctgagtgcgcggcgctagaagccgtagatcttcgagatgatctccttcatcacctcggaggtgccgccgccgatggtgatgaggcgcacgtcgcgccacatgcgggcgatggaggtctcctccacgtagcccatgccgccgtagaactgctggcagtcgtaggccacgcgctgggccaggtcccccgcgaacagcttcgccatggagacctccttcaccgggttctccttccggtcgaagaggtccaccgcgtggtacgtcaggcgcttggccgcttcgatggccgtcaggtgctccacgaacttgtggcgccacacctggaacttcatcagcggccggccgaaggcctcgcgctcgttgccgtagcggatggagtcctccaccatccgctccatgcccgcgaccgtggtgatggcgcccaccaggcgctcaccctggaagttggtcatgatgtggtagaagccttcgttctcctcgcccaggacgtagcgggccggaatccggcagtcctcgaagtagaggacggcggtgtccgaggacaggttgcccaccttgtccagcttcttggagacgccgaagcccttcacgtccgtggggaacgtcaccagggagatgccgccgtagccggcctcgcccgtgcgcaccgccagggtgatgaagtccgcccgcgtgccgttggtgatccacatcttcgagccgttgatgacgtagtcatccccgtcccggcgcgccgtcgtcttgatgctggccacgtccgagccgcaccccggctcgctcacgcccagcgcggcgatcttctcgcccttgagcgccggctccaggaactcgcgcttctgctcgtccgttccaatctcgttgatgatgggcgtggccatctggctctgcaccagcagcgccatgttcacgcccgcgttgaggctgcggctcagctcctccgcgaacaccgtcacgtaccagtagtccaacccgctaccgccgtacttcgggtcgtggttgatgcccaggaagcccaggtcccccgccttgcggaacagctccttggggaagatgcccgcccggtcccactcgaggccgtgtggggtcatctccttctccacgaagctgcgcaccgtgttgcggaaggcctcgtgttcctcggtgaatgggtggggcatggggtgtcctcggcgcgaaaggattgattcttgaatcaataacaggggcctctaggtgccacaagcaccgcctccccggcacaccgctcccctccttcaggccagcggacggatgcaccgcgtcgtgtcattttcacctgcccgctcggcggacggccgttagacgtgccggaggaaagatagtccgcactccggagtatccccttgacagacagttcagagactgtagtttccgggccgcagactttccatgtagaagccggctcgcaagtgtctccctggggccaggcgccccgtgaccggcaggagcaggacgaccgtgattcgacgcatgtggatggccgcggcagtggcagcggtggtgacgacgggctgtggcaaggccagcaacaagccggccctccccgagcagacgggtcccgcggcattgggcgtgcgcgccatcactccagccacggagttgagcgccgacgtcacccgcgtgacggggcagatccgctcgaagaacgaggcggtcctggggccccaggcgaccggcaccatctcgaggatgaacgtgcgggtgggcgacaaggtgaagaagggccaggtgctggcggcgctggacgcctccaacgtcgccatcagcgtggagcaggcgcgcgcggtgaagcaggccgcggacgcggcgctggagctggccacgtcctccctggagcgcacccggaaggtggcggagtccggtggcgtggccgccgcggggctggatcaggccgtgattggccagaagcaggccgccgcccaggccgcccaggccgccgccgggctgcggctggcggaggagatgctgcgtgaccactccatcatcgcccccttcgacggcgtcatcacggcccgcacgaagaacgtcggtgactcggtggcgatgacgccctccacgcccgtgttcagcatcgtcgacacgacggggctggaagttcgcgcgcaggtccccgagtccgtggtggacaaggtccgcgtgggcagcaagacgcagggcacggtgagccccagcggcgcgcgcttcgacgtgcaggtggccgtcgtgggcgcggtggtggacgcctccaaccgcacggtggaggtgctggcggacgtggtcggtgagccgtccccggcgctgcgtcccggcgccctggtggagctggacttctcgaccgtgaatcaggccgacgacgacaagggcctcttcctccccacccaggccgtcagcgcccggggccaggagggcttcgtgtgggtggtgcaggacggcacggtgcgcaagcgggatgtgcgcgtcgagcgagtgctgcctggttacgtccgcatcctccagggactgggcgccgacgagcgcgtgctcgccgactcctccctggacgtgaaggagggcacggccgtccgcgtagtgcagtgacgcctgccctcccctctcaagttcggagctcctgaatgctcaagacattcatcacccgccctgtgttcaccgcgatgctgatgctcgcggtggtcgtttttggcatcaatgcctacccacgcatcggcgtggaccagttccccgacgtcgagttccccgtcgtcaccgtcaccacggtgctgcccggcgcggacccggagtcgatggagaagaacgtcagtgacccgctggaggaggcgctcaacaccctcaacggcgtggagcagctgcgctccatcaacctggagagcgtgtcccagatcgtcgtccgcttcaccctggacaccaaggtggacgtggcgtcgcaggacgtgcgggaccgcgtccaggccacgctgagcaagctgccgacggaaatcgagacgccggtggtggagaagttcgacatcggcgcggcgcccatcatgacgctgtcgctgtccggcgcgctccctattgaagagatgacgcgcgtcgccgaggacgtcgtgaagcccgccctccagcgtcagccgggcgtgggcagcatcgacgtggtcggtggccgtgagcgcgaaatccagatcgtcgtggatccggagcggctgcgtggcttcgggctggccgtcagcgacgtgagccaggccgtgcaggcgcagaacctggacgtcccgggtggccgcaccatggacagcggccgtgagcgcgtggtgcgcctgacgtccgaggccaagagcgtggacgagctgcgcaacatcatcatcgccagccccaacggcgcgccggtgcgcgtgcgtgacgtggccgacgtggtggacggtccggaagaggcgcgctccagcgccaagagcggtgaccgcagcgccgtggcgctggtggtgcgcaagcagtccggctccaacacggtgcaggtggccgagtccatcaaggagtccctgggagaggtcaacagcctgctgcccgaaggcgtgcgcacggagatggtgacggacaactcgcggttcatccgctcgtccatcgccgcggtgcagttcgacctggtgctcggtggcttcctcgcggtgctcatcgtgctggtgttcctgcgcaacctgaactccacgctggtggccgccgtcgcgctgccggtgtccgtcgtcgggaccttcgccgtcatggcggccctgggcttcacgttcaacgtcgtcacgatgctggcgctgacgctgtccatcggtctgctcatcgacgacgccatcgtggtcatcgagaacatcgtccgtcacctggaagagggaaagacgcccatgcaggcggcgctcgagggcgccagccagattgcgctcgcggtgttcgccgtgacgctcgccatcgtcgccgtgttcatccccgtggccttcatggacggaacgatgggcatgttcttctaccagttcggcgtcacggtggccgtggcggtgctcatctcctacgccgtgtccatgacgctcacgcccatgctgtcggcgcgcatgctgagccaccatggcaaccccacgggcatctccgcggcggtggagaaggtgctggtcgccactgagacgggctaccgaaacatcctggccagcatcctgcggcaccgggccatcaccctggtgatcgccgtggtggtgctcttcctcaccctcttcatggccagcttcctgaagttcacgttcatcccggagcaggacaacggcaacatcaagctggcggtggagctccccatcggctccacgctgcaggagacgcaggcggagctggacgcgctggacgcgcaggtccgcgccctgcccggcatcgactccaccttcgccaccgccggtggcggcgtgcaggaggaagtgcacaagggagagctgctcatcaacctggtgccgctgaaggaccgcgccttcaaccagggcgagctgaagacgtacctgcgcggcgccatcacccctcgcagcggcgtcaccgtcacggtgcaggacatcgcggccgtgggcggcggcggtgcccgcacgcagcagattcagttcaacctccgcggtgacaactgggacgaggtcatcaaggccgccgaaaaggtgcaggccaccatgcgccagaatccgggcttggtggacgtggacatgacgttccgctccggcaagccgcagtacgacgtcaaggtggaccgcgagcgcgcggccagcctgggcgtcccggcggcctcgctgggtgccacgctgcgtgccttcctgggccgcgacaagttcggcgactaccgcgagggtggcgagacgtacgaaatcaaggtggccctgccgccgcagacgctggcctccgccgacgcgctgggcaagctgaccgtgcgcagcatgacgggccagttggtggagctgcgcaacttcgcgaccatcaccccggccgacggcccagtgcagatcgaccgcgagtcgcagaagcggcagatcaccctgctggcgaacctggcctcgggctacgcgctgagcgacggcatcaacttcctcaacgcgtacgcggagaaggagctgcccaagacggtcatctacgacttcgagggtaacgcgaaggagatgggcaaggccgtggcggccttcggctccgccctgctgctgggcatcatcctcatctacatgattctcgcggcgcagttcgagagcttcgtccaccccttcaccatcatgatgtcgctgcccttcgccctcatcggcgccattggcggtctgctcgtcaccggtcaggccatgtcgatgttcgccctcatcggcgtcatcatgctcatggggctggtggtgaagaacggcatcctcctggtggacttcacgctgcagttgcgtgaggaaggcaagacggcgacggaagccctgctccaggccgctcccgtgcgtctgcgtcccatcctgatgacgaccatcgcgatgatcgccggcatgattccggtggcggtcgccaagggtgacggcgcggagacgcgcgcgcccatggccatcaccatcatcggcggtctggtgacgtccacgttcctcaccctgggcgtggtgccggtggtgtactcgctgatggatcagctcaccgagaagttcaagcggcgcaagggtccggacgcgacctccggtacgccgcacgcggtgggtccgaagcacggcgctgaatcgccttccgtggccgctgcggcccgggtggagaccgcctgatgcggcggccggatgacaaaccggccgcgctcgcgaatcggcgcggcgacccgggtgcggagggccaggaccctcccgaggacggtggctccgaggagagccacggtctgatggaggaagacgtcgagacctccacgcccgagtcgcggcgcctccacgagttgctgattgagttcagccgctaccgctccctgaagaacccgctggcgggcatctgcgaggacctccagctcacgcccacgcagatgcatgcgctgtcgtggctgggcaacgacggtccggtgcaggtgggcgtcctggccctgcgggtgggcatcacccggaagaccatcaccggtgtggtggaccgcctggagagcatgggtctggtggagcggacccgggacgtggaggaccggcgcgccgtcgtcgtgcgcctcaccgagcagggcagcagcgtcttcgcccgcatcgaccggggcatggacgccagcctgcggcgcgtgctgagcctgatgagccccgaggaccgcgacgccgtgttcggcatcctggagcggatgctggcgcgcctgacggccgaggcggaatcggccagcggcgactcccaggcgagctgagctttaccctcacgcgcgccggcccatgcttcgggtcggcgcgcgtaggacgtcgcgggtgtcgctggcgcgcccgagcgaataagctccccccggctgcccaccgcatgacgatgaccgccatcctcctcgtgagcctcaccatgggactgggcgccgccgccccggctggcgcgcgtgcggaggtgacgtggcccgcggtggcgccgtccactgtccaactgcgggccccggggagtgcggcgcctccgtccgacgtgtcctcgctgctggcctcccggtgcaggcagtgggccgccacgcccgacaacgcctgggcgctggcccatggcctggcgctggacggccgggacttccgcacccgcgacggtcagcccgcggcggacgccatcatcgcgcgctacctgcgccggacaccgccgccgtcccactcgcccgccgccgcccagcggctcttcttcgacagccgaaccgccaacggcacgccggtggagccccaccccgcccttcagctcaagagcctgctgcacgcgggctacccggcgcgccaccgcttcaatgcgtcctggggccccgtcatggtgcaggcgctggtggagcagttgcagctcgatttccgcccctcgctcgtggcccatcccgagggtgcctgggcgctggacgcactgtccctggcgatggagcccggcaccacgttccgcaccagcgagggcacgacggtccacatcgacacggtgatgcgggacgcgctcgccacgctcgaagccgcccaggccgagctgtccgcggcgatgcgcgcggggcggacgcaggtccccaagcgaaagcaaggcatctacgcccacccgtgcggcgggcttcactacttccaggccgtggcgggctgggcccggcatgcctccgtgcgcaaggtgtggcgcaagcggctggacgcgcaggtggacgtgctgctgtaccggctggactcggaaggccggcagtacgaggcggcgctggccgacgcgccgttcgcgcaccggctgcccctgctggtgcagatgctgaagttccagggccacctgctggagacgctcggccgctaccgcgacgacacccggtggcggcccacgaaggcccagcagcagacggtagagcgggcgcgcacggccctggagcacaccgtgcgccggctggaagccggtggcgccttcgacgggtggccagcgctggccgaacggcagccgcagctcgcgttggacttgttgggcgacacctgccacgccgcgcgcggcgaggccctgtggcggacgcccgccgtcagtgccccagccgcgcaagctcctgcgcggtaaagcccgccgcttccagaatctcccgcgagtgctgccccagcgtgggcggcgcgcgcagcggcgtctcgcccatgcgcagtggcgtcagcaggtgcgtcaccttgcggcccagcaccgcgtcctccgcctccacgaagaggccccgggcctggagctgcgggtccttcagcacgtcgtccccttccgccacgggctcgatgcagaggtcggagcccgcgaagcgctcctgccagtacgccagagggtgctcggcgaacaggcgcgtcagctccgccttcacgcgcgcgccggactcacccggggcgtaggcgtcctccagcagctccggacgccccagccgctcacacacgcccgcgaagaacttgggctccagcgcgcccaccgcgagccaccggtcatccgccgtgcgatacaggccgtagcacgcgtagccaccgttgagcgcctccttgccccgctgaagggcgacgccttccgtccccatgtagaggcgcgacgccaggtgcatgtgcaggaaggccagcgcgccgtccgtcatggacacgtccacgaagcgcccctgccccgtgcgctcacgctcgtgcagcgccgccaggatgcccaccagcgcgaagaggctgccgccgccaatgtcccccatctgcacgccgggaaacgcgggcgcgccgccggcctctccgccgtagcccagcaggccggctcgggccgcgtagttcaagtcatgccccgccttcagccgatccggccccgtctgcccgtagccggagatggcgcagtagatgagccgggggttctccgcgcgcagcgcggactcgcccacgcccagcttgtccatgacgccgggccggaagctctccaccagcacgtcgtagtggcgcaccagccgcttcagcgcctcgcggccttcgggctgcttcaggttcagcgtcagggagcgcttgttccgattgaggccgtagaacaggccgctgacgtcatcccgcaggggcggcatctggcggatgtagtccccgccctccggctcctccaccttgtccacggtggcgcccaggtctgccagcaccagggtggcgtaggggccgggcagcaggcgcgacaagtccagcacgcgcaggcctgtgagcgggagcgacgacatgggcattcctcggagcgagcatcaggggtgtggaaacgactgcggcgcgcccctgtgaaggagacgcgccgcgtgcgacagaagccagcgggcggggtccgcccacaacgctccggtccgtcggaaattagagcagcttcgcgagcttcatcgcgaggcccatgtccatgggcttgaacttcagcttgccctgcatggccgccatctgcgcgttgagcttcttctcgcgaatcttcacgaagtcgtcgttgctcacggagatggtcatcttcgcgttgtcgaccgcaccttccgtcacccagccctcggacttggtggcgtccagcgtccacttcccgccgccctcacccgacacgtcaaagacgatgacggcgttgatttccttcgccagctccggcttcgccttgagggtctccggaatctggttctcgatgatgtccttcgcgctcacgacacactccttggcctgatcgttgatttgaaaatcaaagacaggggggaccgtaatggcgcccccctggcaggtcaagacacggatgcggcaactgtcacgcgatggtggacgcggcggcggggttcagcgagcggcgaaccatgtccaacaaatcgttgagttcgaacggcttggccagatgccccaccgcgccaatgtctgcggccttgctgcccacattgcggtccgcgctcaggacgatgagggggatgcgcgccacctcgggcggcttctgccgcatccgctgggcgaactcccaaccgtccatcaccggcatcatcaggtccaacaggatgaggttgggcggttcgggctccagccggtccaacgcctccttcccgttccgcgcccggcggatttcgaagccttcggcttccagaatctctgaaagggcctccaggatgtccgggtcgtcatcgacgaccaggaccaccggggctctcgcatgctgtgcattgtgcaaggtcagagcagtctcccgaggtgcgacgctgggattcttcaaccatcctcccacacggccgcgcaagaaaatgcgcccacgccgccagacatgggcccacgttgcaaaaccgacagtcactgcccaccctttccgtgacctgatggactgggggtgtggaacgtggcgagcgagggggagctgaaagcaggcgacatggcggcacccgggcttctgctcctgcctcgcggaggcagcccgcgcctgctcggacactcgctgctgcggcagctcgacctggaggcgctccccagccgcgtgggctccctgccggagctcatggcggtggcgggctttcagcggcgcgctgggagcggcagcctctgggagcgggatggccaggtgctgatggcgggcgaggaggcgctggaggacggcgcgctgctgctgtggacgtcgcccctggcgtgggacgaggccggtgtgcgccggcgcgtgcgctacctgtccatggcgtcgcatgacctgcgcggctcactggccaacgtgcgctcatacgcggccctgctgctcaacggccgcgtgcccctggagcccaaggtgcagcgtggcctggagaccatcctccgcaacgcggaccgctcgctggccttctcccaggatttcttcgacgccagccgggcggacctgggctccctgccctgcgagcaggagcgccaatccctgctgcccctgctggacgcggcggtggagcggcagcgcgccgcggcgtcggcggcccaggtggcgctcgtgttgggcctgaacccggagcaggcggtgcccgaggtcatcgtggacggggcccgcatccaacacgccgtggagtcattcatccagtaccagttggcccgcgcccaaccgggcgaggtcatccgattgggcatccgcgacttcgcaccccgggtgcgcgtggaggtccgccgggacggggcgcccctgacggatgaggacgccgccgccgtcttccagcgcgaggagcgcgccttccgggagaagcggctggaggaccccttgcgcgtctacctggcccggcaggaggtggaggcccacgggggcagcgtgggcgtcgagtcggaccgaggtggcagcaccctcttcctcaccctggcccaggcccccgtcgcggcgctcggttctccagcaaccatgcaggcttgaatcgcccgccggtcttgctggcggtcggcggcgcccatcggtatgctcttggcgtcttcgcgaaggagccgagtgatgggtttgaagggaatggaaatcctgctgatcatgggggtgctgctgctcctgttcggagcgtcgcgcctgccacagctgggctcttcgctgggaagtgcgatccgcaacttcaagcgcggctttggcggtgagggcgaggacgcggcggcccctggggacaagaagggctccgggacgctctccagcagcaccggcgtgcagaacgacgtcaccaagagccagacgcccagcggccacgtctgagccgccgccgggtggccgtgcctcccggcaggacgtgagcagtgccctgaaacgcgcaacgcccgagccgccccctggaacaaggggtgggccgggcgttcgcttttgccctgtgcgtggcgtggggcctcagtcgacgacggtggtgccttcgtacatccggtcgagctgcgccctgtacttctgggtgcagaccttccgcttcacactgagcttgggcgtcagctcctccgtctcctggctgaagtcgttctccagcacggtgaagcgcttgagcgtggcgtagggcggctgctgcgtgttgacctgatccaccgcggccttcaccgccgcctggacctccggacgacgggcattgtccgcgtaggtgcccacaggggcgccctggtccaggaggagtctgcgcgcgccctcctccgacacggtgatgagcaccaccaggtacggccgcttgtcgccgtacaccatggcctgactgatgatggcgtgcgtcttgagggcgttctcgagattctgcggcgccacgttcttcccgcccgcggtgacgatgaggtccttcttgcggtcggtgatgcgcaggtagttgtccgcgtccagctcgccgatgtcaccggtgtggaaccagttctccgcgtcgatggcctccgccgtggcctcggggttcttgtagtaccccttcatgacggccgggccgcggatgaggatttcgccgtcggaggcaatcatcacctccatgcccggcacgggcgcgcccacgctgccaatcttgatcttgtgctcgcgattgacggtggtgccggcgcacgtctccgtcaggccgtagccctccagcaccttgaggcccagcaggtcgaagaagtagccgatcttcggagacaggggcgcgccgccggagatgaacacgcgcatgttgccgcccagcttctcgctgatggccgcgtgcaccttggagaacaccagcttcttcgccaacgcgaagcccagggtggcgtactcgcgcccctggctgcgtgcctcgacgtactcgtcgaacagcttgaaggcccagcggaagagccggcccttgagccccggggccgccgagccgttggccaccacgttgttgtagaccttctcgaagacgcgcggcaccgacggcagcaccgagggacgcgtctccaccaggttggcgagcagcttgtccaccgactccgcgacgacgagccggtaacccatgctcagccaggcggccttcaccacctgcgcgaagacgtgcgccagcggaaggaacagcatcaccgagtcagagggcaccatcatccccaccgactgggcggccttcgcctcgaaggcccagttgcggtgcgtgaggatgacgcccttggggtcccccgtcgtgccggacgtgtagatgatggaggcggtgtcctccatggacacgcccgccacccgcgcctcgaagtcgtccggacgggcggcatgctcggtgcggccctgggcgatgacgtcggcgagtgacagctcggtgccaccggcaacggggccctcgaaggcgacgatgcggcggagcgccggacactccgccagcttctggcgcaggcgcgtgagccggcccgcctgccgggcgtccttctcgtcgttgtccacgaagacgagcgtcgtctcggagtggttgaggatgtaccggcactcatccggcgtgttggacgcatagatggggacggtgatggcctgcgcggcgctgatggccacatcgcagatgagccactgcagactggtgttcgcgaaaatcgccacccggtccccgggcttcaccccctgggcaaccaggcccgcggagagcgctttcacctcgtccaggaactgggcgaaggtgacgtcctgccagcggccgtctttcttgtggcttacgcccaccgtcgacgcgttcttcgcgcgctgaatgagcagttggaccagcgtcgcatcacccccccgcggtagcggaaagccgctacctgattctctgccctcatctgagctccttctcgatatcggcttcgactttcttggaccactcctgcacgcgccgcccttccgcggggtcgtacgcgatgctgccttgcttcaccttttgaatggcctcgcgcgccttcgcggccttgccgtccttgaggagtgtctccgccaggaagtagtaggcgcgcagcatctgcgggtgcttcgcgatggacttttcgtagaggctggcggacttcgccaggtcgcgcttgggccagggcagctcgtagtagtagcggcccttggccagcagcggcgcgccccggtcgtagcccgcgtcaatctggatggccttgtcgagccgctcgttgaacttgccctcgagcccctcgcccagcgccttcatgatgcccacggcctgggagtaggcgccgatgccggtggccgcgtagtagtggccctccacccgggcggggttgagcttcaccgccttctcaccccagtcccacgtctggcggcccagcaccttcttgagcttctcgttggccgccccgtccgcctgccactggaggatgcgcgccttgcgccagaccagctcgtaatcctccggcgcggcgtccagcgccatcttcaaggcaccctcgtaggccttctccccaccggactcgccgcgcttcgcgtacagcgcgtcaagctcggacaacagggaggcctcagccccccaggcaggcaggctcaggaggaggctcaaagcaaatgaaatcaagcgcataagcgccgggcttagcacgcacttttgcccggtagcaaaccatcggaggccaaacatccgccaaacgacaagaggcnggagcggtccnntctgacccggtgcgctccgccccgatgacgtgccttgccaggggggaagggccctggatggcctgttacgccgagtcggaggtccgctgcgacaccaggtgctcctcgttctccgtgaaccactgcgggtagaccttcaacaggaccttgcccatcacctccaccttaggcacgacctccggcgacacgccctactgcttgaacaggccctgcgcgcgcaccagctagac

SEQ ID NO: 1268 - DNA, 41927 bp, Myxococcus xanthus
gctctacagtaccgggggcccgcgggcgtcgccggcgcggccaccacgcccgagtggggcttcggcttcaaggccttccccttcgcgcaggcggtgccccaccggctgtccgtgcgcgtctatggcgccggtgtgatcgaggccacccggaacatgttccgcctctggcgcggcgagcacccgatgccccacatgcatgactggttcgtccagcgcctgcgcatggacttcgaccgggaagtgcccttccagatgggcggcgacgtcatcggcatgcggcgctcgctggagttcgacctggccgaggagagcgttcagctcgtcgactggcgccagctgtcgcgcatggtccggacctaggccgcgcgggcccggcggtcactccgtccgcgacttgacccgggtgtgttccggacactatgccgggacccgtgagctacacctatgagtacccgaggccggcgctgacggtggactgtgtcgtcttcggtctggatgacgaggacctgaaggtgctgctcatccgccgcggggtggagcccttcgccgggcggtgggcactgccggggggcttcgtgcggatggaggagtcgctcgacgacgccgcgcgccgggagttggatgaggaggcgggcatccggccgaaccacctggagcagctctacacgttcggcgccccggggagagatccacgcgggcgcgtcgtcacggtggcgtacttcgcgctggtgaagctcagtgaccatgtgccgcatgcggcgacggacgcgcgggacgcggcgtggttctccgtctgggatacgccgaagctggccttcgaccacgtggacgtgctcggcacggcgctgcagcggctcaagggcaaggtccgctatcaacccatcggcttcgagctgctgcctcccaagttcacgctgacgcagctccagcggttgtacgaggtcatcctggagcgggagctcgacaagcggaacttccgcaagaagatcctcgccatggacctgctcgaggagctggacgaggtggagcaggacgtctcccatcgggcagcgcgcctctaccggttcgaccacaagaagtacaagcagctggagaaggcgggcttcaacttcgagctctgacccgctgcgggttcgagggagcccccggcagctcgtgacattgacatcgtgtgatttggacactatgttggtgtcatcgagacacgaacatgggtgcgacccaggttcgtgagaggccgctgcccgtggggtgtccactggctgaagcgtgccgccgtatcgccgcctgtctcgccgcacgtgccctttcagggccacgggagagccatgtccgcgctgcccttcgacgtcgccgctgcctcggtgctgggccgggagcacgcccgagcgggtcgcaacaaccaggatgcgctgtgcatccgcgccagtgagcatggcctggtggccgtggtgacggatggctgtggcagccagccctgcagtgagctgggcgcacaactgggcgcgcgcaggttggcgcgggccgcgctggtgcggctcgcggacggtgagcgcgtggatgagcccaccttccttccaggccttcgtgaggatgtgttgtgcctgctcagtgagctccgggcggacctggggcgggaggtgatgggggacttcctcttcaccgtggtgggcgcggtggtgacgccctcgctgacgctcgtcttctccgcgggagacggcgtgtgggcactcaatggcgaggtgcatccgctcgggccatttccggggaacgcgccgccgtatctcgcctatgcgttgatgcacggagaggacgtcgcgctgaccacgcgggccctggtgcccacggaggacgtccacgcgctgctgctgggcaccgacggtgtggtggacctggagcggctggccaccacgcgcatgccggcggggaacgaactcgtcgggccgctgtcgcggctctggacggaggaccggtacttcgccaacccggatgccctgcgccgccggttggccttgctcaaccgagaagccgtgcgcgcggacttcgcgtcccagcaactggcgcgaactccgggcctgctgccggatgacaccacgctggtggtgctgcgccgccgcatggggagggcgtgaggccatggacgtctggctcgaaggcaagaaggtgcggttgaaccccgcgcgagcgctgggcaagggcggcgaggcggacgtgttcgacatgggggatggccgcgccctcaaggtgttcaagccacccgagcaccccgactacacgggcctgcccgcggagcaggccgcggcgcgtgtccggttggacgagcaccaacgcaagctgcgcgtcttcccggcaggactgcccggccgggtggtggcgccccaggccttggcgacggacaagaaggcgcacgaggtcctgggatacgccatgcgcaagctggacggcgtggagcccttgcggcgcttcggagagccgtcgttccgcagggcaggcgcggcgtccgggcgggtggtggacctgctgcgcgacctgcatcggacgctcgacgcggtgcatgcgtcgggcgtggtggtgggggacttcaacgacctcaacgtgctcgtggcggggacgtcggaggcgtacctcatcgacgcggacagcttccagttcggcgggttcctctgtccggtgttcacggagcgcttcctcgacccgctgcggctcgggagcacgggcacgcaagggttggtacccagccgccccgcttccatcgagagtgattggtatgcctatgccgtcgcggtgatgcagtcgctgctgtgcgtggggccgcacggaggcgtctacaagcccaggagcgcggctgctcggacgacgtccgcgggccgggtgctccaacgcatcaccgtgttccatccggaagtgcagtatccaaagcccgcgttgccgctggcgaccttgccggacgacgtgctgcaccacctgcaccgcgtcttcgtggaggaccttcgcggcgtctttccgtatccgctgctggaggggctgcgcttcaccccctgcgcatcgtgcggcgtggagcatgcgcgagcggcctgcccgacgtgtcagccccacgccaccgcgactgccacgccggtgacgtcggtccgaggccaggtgacggcgacgcggttgttctccacgcgaggcgtgctggtgcacgcgagcaacgaggcgggcatccttcgctggctctaccacgcggaaggcgcgtaccggcgcgaggacggacgcgtggtgctgcgcggggcgctggacccgtcgctgcgctgggccttgcaaggggacgtgacgctggtgggccggggcggtgaggtggcggtgctggcgcccggccggcccccggaccggatgggcgtggatgcgccggagggccagtccgctttcgccaccaacgcgcggcaccggtactgggccgtgggcggcgggctgtggcgggacggcgcatatgggccggagcgcgtgggcgcggtgctcgaaggacagacgcggctcttcgtggggccacgcttcgggttgggcttccatcgcgcgggcggtctgcgcggcgccttcgtcttcgatgcggagcgcctgggcttgaaggatggactgtcgctcccctggcccacgggaaagctcgtggacgtggactgtgtcttcgatgggccctccgcctggctgttcctggtggaggaagccggtgggcgcacgctgcatcactgcgtggtggtgggccacgacggggccgtgcgcgcgagcgcggtggcggaggccggtgacggctcgtggctgggcagcgcgccacgtggacggtgcgcggcgggcgacgcgctgttctgcgccaccgatacggggctcacccgtgtggagcttcggcagggccgcctggaggcggtgcgcgagttcccggatgccgagcccttcgtggacgcgggctgctcgctcttcctcgtgcggcaggggctggcggtggtggggcggcaggacatcaccgtgctgcgaatgaactgaagggacgtttctcaaccgcgtggagcgggtgcctccacgcctcacaggaggtaggacgatgaagacgcaagtgaaggcgcttccgcttccgaggttttacgacgcggcccatgccgggcagttcggatacagccctgacgcggggaagctccaggtggaggcccagcgctggcgcgcggcgaacgacgtctccatgtcggcgacggacgcgttcaacctgcacctgttgctcatcgacgtgcagaaggacttctgcttcccagagggctcgctctacgtggcgggacgcagcgggcgcggcgccgtggatgacagccgtcgcatcgcggagttcatctacagcaacctcggcgcgctgacgaacgtgacggcgacgctcgacacccacttcgcgtaccagattttcttcccgtctttctgggtggaccaggacgaccagccgctgacgccgtaccgcgaggtgacgcgcgagcagattgagcgtgggcaggcgcggcccaaccccgccatggcgaagtggctgtgcggtggcaactacccctggctgctcaagcaggtgaagtactactgcgaggaattggagcgggcgggcaagtacacgctgtacctgtggccgccgcactgcctgctgggcagcgacgggcacgcgctggcgggggtggtgcaggaggcgcggctgttccactccttcgcgcgtggcatgcagtcgtgggcggaggtgaaggggggcaatccgctgacggagaactactcggtgctgcgcccggaggtgttggggcggcatgacggccagccgctggcgcagcgcaatacccagttcctcaagacgctgctgaccgcggacgcggtggtgattgcagggcaggcggcgagccactgcgtgaagagctccatcgacgacctgctcggcgagattgtcgcgcaggacgcggcgctggctcgcaaggtgtacctgctgacggactgcatgtcgtcggtgacggtgccggacggcaaggggggcttcgcggcggacttcaccccgcaggcggaggcatcgctgaagcgcttcgcggacgcggggatgcacctggtgaagtccacggacccgctggcgagctggccggacctgcgcatcgcctgagcctcgcggcgcgaggcgtgacgacacacagcaatcgcttcgcctgtgctcgcgcgagcggggcaggcggagccctgccctcgggagagggagaaggagcacgggacatgagcagcaaggcgaatggcagtggcatccggaagctcttcgaggacgcccacgcggagggcgtgctgagcccggcgggattgcaggcgctgacggtggtggacctgggcgcgcagattcaggcggggctcggcgtctgcgtggaggacgtgcagtccagcgaggtggtgctggtgaccgtgatgccggatgactcggggagcatcgactactccgggcattcgaagacggtgtgtgacgggcacaacctggtgctggacgcgctgctggcgagcaaacagaaggacggcgtcctcttccacacgcgctacctcaacgggttcgtgctgaacccgtaccggccggtggaggacgtggtgcggatgcatggcaagaactaccgggcggaccatggcacgccgctgtacgaccagtcggtggtgctgctgggtacggtgctggcgaaggcgcaggagttcagcgccaacggcgtgccggtgcggacagtgacactgttgattacggatggctcggaccagcactcgacgtcggcgaaggcaaaggacgtggcggcgctggtgaatgacctgaagcgcgcggagaatcacatcgtcgcggcgatgggcatcaacgacgggagcacggacttccggcgcgtgttccgcgagatgggcatcgacgacaagtggattctcacgccagggcagagcgcacaggagattcgcgcggcgttccaggtgttcagccagtccgctgcgcgggtgagtcagggggccgcgagcttcagccgtacggcgctggggggcttcgggcagtgagggggctcacccagggggaggtgaccgtgctcctgggcgtctcacgcaagacaccggctccaggcccaggttgcgggtggcgatggcgcgtgatggaggtagcgttgcgcggccatgtccgacagcccgcgcgtcctcctcatcgctgaacgctttcctcccgacatcggcggcctggcccgcagtggcgcgcgcaccgcgggctcgctggtgaagctgggcgcccgggtggacgtgctggcctggacgcgcacggcggcgccaggcgcgctccagacggtggaggacgccggggacgtctcacccttcgcgcggggtgtgacgctccaccggctggggttgttcggcagcacggacctgtccatgcagcacacgctcgacgtgctcggctacctgcacgcgaagcaacgctatgacctggtgtgggggcactacctgtctccgcccgggttcctcgccgtcgccttcgccgagtccgtgggcattgcctccaccgtcagcgcccggggcaacgacgtggaccagctcatgttccccccgggcgacttcgcgcgcctgctgtggacgctgcaacgtgcccgcgtcctcaccgctgcctccgcggacctgggccggaagatgtgcatgctcctgggacgggacgaaaccgtggaggtcatcccaaacgccgtcgacaccggcatcttctcccccggtcccgcggacccggcgctccgggagcggttgggcatcgcgccagacgaagccgtgctcggcttctccggtgaacttcggcacaagaaggggctgccgttcctgctctccgccctcaccgaggtgcgccgcgtccggcccgcgtgcctgctcgtcatcggcgaggtgcggccgcgcgacgccgagcacctggtcgccttccgcgccgagcatcccgaggacgccgcgcgcatcctcatctccgggccgctggacacaccggaggccatcgccgcgcacctgcgcctgtgtgacgtctacctccagccgtcgctgtgggagggcatgcccaacgccttgctggaggccatggcctgtgcccggcccgtcatcgccagcgacgctggcggcatccccgaggcggtggacgccggacgcaacggcttcatcgtctccaaggccctgctcaatcacctggggcaggcgtgcctggatgtcctctccctgccgctcgaacagcgcgccgcgatgggcgccgccgcccgtcagcgcatcgaggagcgctttcaggcgcacgcggaggcagaggtgctccgtcgcgtgctggctcgcgccatcccgagccgctcttcgtaggcgctcaccagggcttcgcccgcgcggctccatgggaagtcgcgctccactcgcgcccgtgccttcgcgctcatcgcggggcccagggtggggtccgcccgcagggccttcactgcttcagcaatcgccttcgccgagcccggccgtatcagcatcacctcgtccggcgcggccagggtgctcaccacggggaggttgctggccaccacgggcgtcccggtggccatggcctccagcagcttcagcggacagcagccctgcacgcagttgcggtcgttgaagggcaggggcaccagcaccacgtcgcaggcatggtgcagcgccgccagctccgcctggggcaggggctccagcaactccactgtgccctccagcagcaggtcaccgcaccggtccatcagcgcccgtcgtgtgtgccggcgcagcgggcccaccagcgtcagcaccgtgggcatgtcccgccgcagcaaccggcaggcctcgatggcatggtgcacgccctgccaggacgtcatcgtcccgctgtacagcagtcgcacgggacgcccgagctccagagggcgcggcggcgcgtaccggaacacctccaggtcggcgccgttcggaatcacccgcacccgcgaggcgtccacgccccgtgtcgtcacgaggtactccgccgtcaccgtgctcggggtcaccaccaggtccgcgcgcgagagacagacgtcctcttgcgccaccagcttgcgcaagagttccgcgtcatccgccacgtccgggtagtgatacttcagctcgatggagggcaggccgttcacctcgaagacgagcgcgtccgtcagcgcttccttccggcaggcgacggggtagccctcgaagatggagcgcacgtgcacgacggaggctcgcggcctttcgcgccaccatgccgccaggtgcgagcggaacgacagggcctgggccatcaggtccttcccgcgtgattccagcgggtggtacgtcacgccctccaccagcgcgagcggcccggtgggcgcagtggggctgtcccggagcgcgaccaggtcgactcggccaaaggctgcgcccagtgactccacgaaggcccggatgtgcaccgctgcgcccttgggcgaagggaagcggtcgaacgaggcgtagacgattccggtgccggggtggggagacacactcgcgttgctatcgcggctcggccgggccggcaaacaggagggtttgacccctacggcacgggcccttacgcttcccctttctttcgttccgccgagggggcgcgactcaccgtggcattcaacatcgaccgcttccgcgaggaacgcgtctacagatgcaccggccccatccgggagttgcgggaagacctcgagcggctgcgcctcctggacatggatgtggagcagtcgcggcggaagtggcggaattcggcctgggtgtgtctggccgccaccgtcgccgtcttcatctatcggatgacgctggatgaggggctcgaggacgcgctcgcgtggcggctcaccctgtggccgggcctcgtgctgctcgcggggaccgtggggtgcttcgtcgtgtaccttcgcttccggcgcctggacctggagaaccggcggtacacgctggcctctcaggtcatccatcggctgcgccgtgacatcggccctgatgcgtcggtgaggctggagctcgacttcacgcccgtggacagcccggagaagctgctcggcaagcacaccacgcccagcggctgggaagcggagaacttcagcgacccgtggttctccctccagacgcggctgctggacggcacgcacctgcgcatcgccatggtgcagcggctcatgaagcggtcgcgcacccggcgcagcgccagcggcaagtacaagacgaagcaccggcaggacagctgggcgttgctccaggtccaattgcgagtgaaggcggcgcgtcatcaggacctggcactgctcgagccggaggcccgtcaggcgatgcgcctgccgggggacgtcgccgtggacaagctccagttgggcgaggaccggatgttcctgcgcaccctcgtggagaaggactgggatgccgggcccaatgtgcagggggacgcggtggatgcgccgaagacggtggtgatgatgctgctgagcctctaccaggtcctcaattactccagacaactgcgtcagcaggcgaaggcttcgtgatgatgggcatgggccggttccttctctgttgttccctggtcgcgctcacgggcgccgccgggtgctccaagcccggtgacgccgaggtgccgcgagccgttcgcgcgcaggaggccgccggcgcccccgtcgccgccgcggacgtaaagggcctcgagggcaagctcaagttcaaggacgacgccgaccgcgagcgcttctccctcaagccgaaggacgacggcgccaagctggtggatggcgaggagcgcgagctggcgcgttacaagtggaagggcgcgtcgctgaaggtctcgggcccggatgacgtggcgctgggatatgtcgtcggctccgcgggcggggcgctcaccgtgcgggacggtgagcagcggcaggtgctgttcacgctcgcgcggcaggggccgggctggcgcctcaacgacatgaagggcacgctcctgtactccgtgtggccggaggatgacggtgctcgcatccaggacggcgctggcgcggacgtggcccgcgtgaaggtgcgcgagggcaaggtctccctgcgtgatgcgcaggggcgcacgttgctcgccaccaagtcgctgttggcggcggaggccgccgcgtgtctcgctttcgaggcgctggagctgccgctgcgcatggcgctgctcttccacctccaggcgccgccgtcccaggagctggcccagccatgagtggattggtctgccaggagaacgtgggcttcctgttctcccatggctgcgggagccccgctgccatgacgtgcatgcagtgcgcgatgccgctgtgtgagcagcacgtgacgtccgtgggcgcggagatgctctgcgcgacgtgcgcgcggcaccatgaggactccacgggggaccggaacggcgaggacgaggaccacccgagctactactacgacaactacgggtactacggcgcctccgcctcgtcggggagcggcagggcccatgacgccaacgatttcaccgaggctgacggcgcgagcctccgccacgaggacgacgcctccttcgaggaggacatgggcggtagctgatggctggccgctggctcgtctatgcgttgggaggcggcatggggcacctgacccgtgcctccgcgttggctcgtgcggcctcgcgccgagggcacgccgtcgtcctgctcaccaacagcccgttcgcgagcgggctcccactggaggacgtgctgggcactggtgtcgaggtgttccggctcaaccccgcgctgggacgcgaggccgtgggcgaagtggtggagcagtgcctggcggacgtgcgcccggacctgttcgtcgtggacacctttccccgggggctcggaggcgagctggcgccgatgctgccttccgtgcgcgcgcgcaaggtgctgattcaccgcgacgtgaatcccacgtacgtgaagcagtacggcctggcgcgggcggtggacgcgttcgacctgctgctcgtcccaggtgaggccgcgcccttcgcgaaccatcctcgcgccgtgaggaccgcgccctggctgctcctgcgggccagcgagctgctgccccgtgacaaggcccgcgcgcggctgggcgtgcccgcggaggacccgcgcgccctggtggcggtgatgggctgtggcacccccgaggaagtgggggaggcggggcacatcgccgcccggctggacgcgatgctggggccagaggccgtggtccggtggctggtgccgcccggagcggcgatggatgtgcccgcgccgcgcgcgaagcagggcagccgggctggggcttccctggaggagggcctggccctgcgcatggccacgtggcccgcgctggcggtgctccccggcgtgcacgtgctcgtcggcgcgggagggtacaacaccgtgcaggaggcccgcgtcaccggaacgcccttcgtggcgctcgcgcggccccggctctacgacaggcaggccctgcggctgcgccccgaggagcgggcgggctctgtggaggcgctggtgacgcgtgccgccgggctcgctcgtgcccgaccggctcggagcctgaggccctacgtcaacgggacggacgacgcggtgacgctcatcgagcgcaccgtcctcagtgcttgaggtccttgtgccccggcgccgggtcgatgccgtgcgccatgatgaagtggtagagcgcctgcgggtcttccttgggcccgcccatgagctccaccaggaagtggccctgggcgcccgtgtccgggtcgggggcgatgttcacctccgtcacctcgcggccggggatgaccagctcgcccaccagcacctttcccttgaggacctgcacgatgtgctggcgctcctcttccaggagggcccagtggaagtcgtcgtggtcatacagcatggcgtccacggagccgcaccgcaggatgcagtgcgtgtgctcctggagccagcgccagaagccatcgaatttcaaggtgcgtaccggctgggagatgatgtccatggagacctctcgctcgtcggccagggcgcttgccggccacgtatcgcccctccctagcacggctggcgccatccggtgatgtcccctttcagggaacgggtcaggcgtgtccgcttgctgtccggtccgcgaatcccctgggcattggcggtgttgctcctctcagcaatgggggtggccctcgtgtctgggaaccccgtgaggagcgtgcgtgaaggtctcttcgggtctgccccgtgtttcagatggcccttgttcagcccggggcggctccatgagcctgcgctcctggctcgccgccaccatgggggtgctgacgttggtgacgttggcggccgccaccctgctcatcgtcctgacgagcgtgctcgaccgttcggccgcgaccctgggggtcgccttcgggggcatccgggtgtccgaggagctggaggtgggtctgctggcgcacgaccggatggtccgggaaggccccgtcaaggtgccccgtggcccgggcgggctgtcgcggatcgagctggaggccctcgctgtaccggcagatgggtgagctgcggcgcatcgcctcgacggcggcggagcgtcagcggctcgacgctgtccgcgaggacgtggacgtctacttctccgcccagtgggacccggtgcgtgcggagcaggaggcgggcccggcgctggacgccgcgttgagtggcttggaacaggtcagctccatcaacgtggagcgcgcgcgcgtggcccgctcggaagcggagcggtggaacgacatggcggactccgtgggcgtggtgctctgcggcttgctgctcttgggcgtgctcgtcgtgagcgtgctgctgcggcgcgtggcgctccagccgctgcgggacatcagccagtccatgcgccgcttcggcgcgggctgcaggcgcgcccgggccccggaggccgggcccaccgagctgcgggacatggctcgcacgttcaacgagatggccaacagcctggcccaccagcaggagcagcagctcgcgttcctcgcgggcgtggcgcacgagctgcgcaatccgctgtccgccctcaagttgtccacagccctgtcggaccgcagccgcgcccagctcacgcccgagcgcatggaccgcaccctgtccctggtagggcggcaggtggagcggctggaccgcatggtgggcgacctgctcgatgccacccgcatcgaagctggcaggttggagttgcgcccggaggtgcgggacgcgcgtgagctggcccgcgaggtggtggagctctaccgctccggcgacaccggccatggcctccgtctcagcctgccggacgtgtccgtgccggttcgcgcggacccggcccggctggagcaggtgctccacaacctcatcagcaacgcgctgaagtactcgccggcgggcagcaccgtggaggtgtccgtgcgccgcgaaaaggacacggctgtcctttgcgtgacggaccagggcatcggcatttccgaggaggagatgcgcctgctcttcgcgcccttccagcgcgccggcaacgcccgtcagcgcgccccgggcgtgggcctgggcctgtcggtggcccggcgcatcgtcgaggggcatgggggcagcatcgacgtgacgagccagcccggccacggctccgtcttctgcgtgcggctggccgtggccaccgaggccgttcggcatgccgaagaagacgcggggctgacgtccctcgaggacaccctgcactgagggggctgcccccaggttggcgcgaagcgtcgcatggcgcgcgtccgcgtgtagacggcggatgcgttcccgcaaggcccgacgtaccttcggggtccaaccttcaggagtcgcctgcccttatgaagaccccgcgccgcgccgcgccgctcgccgccctcctggccctgggagggctgggggcgtgtgcctcccgccagcaggcaccgaccgccgccgcgaagcccgaagccccgcgggccgccgagcctgtcgtccggtccacggaagggggcttctccgtcgcgattcccgggccggtgagcgaggagcgccgttcgcaggagacggatgtcggcgcggtgacactccacaccttcatcgccgtgcggccggaggtggataccgcctactacgtctcctacacggacttccccgcggccgcggtgtcccaggcggatccgcgtgacgtggtggcccgggccagccacggggcgctggaggcgctgggcgccaccgggctgtccgcgcggccgctggtgctgagtggcttcccgggctgggaggtggagggcgtgtccggcccgcgccacctgcgaggacgcttcttcctggtggggccccggctctaccagcagttgctgctacacccggagggcaagccgccccaggacgcggaccgcttcttcgagtccttccagttggacccccaggtggccgcgatgttgacgggagagcggcgctcctgaaggggacgcccgtcagtggcggtgttcgcccaccgtgctcagcagcacgtccatgtcgaagggcttcttgaggatggcgcggacaccgggcaggtgggcgcggccgctcgccgtgacgaggatgatgggcagctccgccaggcgctgctcctgctgaatccggccgacgaactcctcgccgtccatgacgggcatcatcaggtccaacaggatgaggcacggccgcaccgcgtggggtccggtcagcagctccagggcctcctggccgttggcggcctgggccacggcgtagccttcgaaggacaggatgtcctggacggcctctcggatgtcggcgtcgtcgtccacgacgagcacggtaggggacgcggcgctcacggcttcgcgctgctcttccccttgcgcagccttccgaagagctgggtcatggtgtcgtgacggcatgggagcgtgtgttccagggagctgaagcctcggcgcgtgagcttcaccgtaaccggcgcgtctgtcacgcactccagcgtcactgacagcggcgtggtgccttcggttcgaccattcacagagactgtcgcgcccgacggagcggagtcgaccatgagcaggctggcgccttccatgaacgcgcgctgctcacggacctctccctcgcggacctccgaaggtgggtcgaagctcggcgccagtgtcgtctcggggcgggcggcggccaccccctccggggtgacggggggctctccggattgccggagcgcggggagcacgaggaggctcgcggccaacaggcccgcggccgcgccgcagagccggaggacggcggccagcggactgggcggaggcggcggtggtggggcgggcacgtgccatctgcggggcgtctccgccacgtcgagtcggggctgggcccggggcgcctcgtgggggtcggcatcccgaggcgtctgcgcctggaggtgggccagctcctcggtgcgtcccatcagggactgggaccaggcatcgggctccgaggacgcatctgggagcgtgccgcggggatggggaggggtgttcacgtgggtcgcttccttgggaagagcgctcagccgccaacgacgcggaacacttcacgcagggacgtgtcgcccgcccgcgcgcgttcgacgcccgcggccagcaggggcaccatgccctcctggacggcaatctcctggatgcgggtgctgggcaccttggcgttgacggcgtcgcggatggcctgggagatgacgagcatctcgtagagcgcggtgcgccccaggtagccgctgccctcgcagtgctcgcaccccacggggccgaagaagttcccgcgcgcaatcccggccgcatccagccgcaccgcctcctcgggcgtcagcggctgcggcgcgcggcagtgcggacagaggccgcgcaccaggcgctgggagagggtggcggccgtcgcggaggcgaggaggaagggctccacgcccatgtcgatgaggcggttgaacgcgcccgcggcggagttggcgtggatggtgctgagcagcaggtggccgctgagccccgcctggatggcggtgcgcgccgtctccgagtcgcgaatctcgcccaccatgatgacgttggggtcctgccgcagcaccgcgcgcagggccgtgcgcgaagttgaagcccctgcgcggcgttgacctgcgtctgcgcgaagagcgggacgtcgaactcgatggggtcctcgatggtggcgatgcgcgtgagctcgccgcgcgactgctggatgtggcccagcgaggcatacagcgacgtcgtcttgccgctgccagtggcgcccgccaccaggatgaggccctgcggcagcgcgagcagttcctggtacttcgtgagcagcgcttcggggaagccgagcgccggaagctggggcagccgcacgccggtgcgggcgatgcgcagcgccaccgcggggccgtggttggtgggcaggatggagacgcggatgtccgcgggcccgtcctgcgtggtccaggggaagtgcccgtcctggggcttgtccaggtcgtacagcggcagcttcgcgagcaccttcacgcggttgatgaggcgcgagtggtgctcgcgtgggaaggagaggacctcctccagcacgccgtgcatgcggaaggcgatgcgcgtccccgcctccagagggtggatgtggatgtcgctggcgcccaggcggatggcgccatccatcaacaggttcttgaagccgatgatgtccgggtctggcttcgcggcgatgcggcgcagccgctgccccaggtccacgagcagcgtcctgacggcggtggccgtgtcgggggtgaggacctccagcggggagaggctggggcccgccggcggtggcttcgacggcgccgggcggtgccgcgcgcggcgggcgaccacgccggaggcgtagctcagcccgaaggccagggccacgctcccggcgagcagcggcgacatcgcggcttgaaggtagcgcccgccttcctggagcagcgtggcggcctccagtgaggagtgccggtaggcccacacgcccgcaccgccgagcaccgcgatgacggcgagggtccacagcaggctcgcgactcgattcatcagcggagtcatcaggcgccgcacgctaccactggggttggcgcaccctcaaaacgagctgtgaggatgatgtcggaccgcggaggtcaggacgggtgggaacgtcctgacccactggaaaccccgtgaagggctcagctctcggcttcttccgaggccttgtccgtctgctgctggccgcacgcgggagcggccttgtcggacgccttcttgtcgctcgcggaggcctgcgggtcgttcttcgcgcagtcaccgaggcacggagcgcccgcgagcccacaccgggagggctggccgttatccgtgcagaccctgttgcagggcacgttgcagccgcaggcctcgtagcattcctgcgcctgcgcgccaggggcaaaggtgagcgagaacaggaaggcggtgcccgcgaggaacttcgtcagcgtgttcatgattgctcctgtggaagacagccacgtcgcggctctccatgagccgcgaatccaggtgtaccgacacagggtgatgggagcgtgacaggcccgcgcgggcctcagcggtcctcgaacatggcctggatgacgcgccaggcgagctcgacctcgcggcccgagcgaagggacaggaagtcgcagatctccgccacggcgttggagcgctcgcgctcgaagccctggaagagcgtcttcaaggagacgtcgagccccttggagagcttgcccagggtgtccagggacggagaaaacgaaccgcgctcaatccggcggatggcgtccacggacaggtcgctgcgttccgcgagcgcttcctgcgtgagctcccgggccgtccgaagcttgcgcacgtggtcgccaaaccggcggtgcaaccgcgtccagttcgcgaccctgttgttccgtttctccataagagggagcggataatttggggtatctcggtcgcaagtgaagggaggatgttcggggcttgaccttgcatttgcgccgggctgtttctcccgcaacttccgttgactcacaggcatccactccaccgctgccaggaccgcggagtgtgggcgctggggctgctcctccagcagacggggagacgctggccgggaacatgcgcacgcaggggctttcgtctacgctgccgactacatgacgcattcggaagtcgggcggagcggccggcggacctggttcccggtcctgctcggtggcctgttgaccgcctgtgatatcgggtcctcgcctcgcgccgccacaccccctgcttccgcgccagaggcaccggtcgtgcgccccgctgaaccgccgcgaccgtcccccgcgccagaggttcgccggcggatgcctgttcgtcccgaacggaccgccgaggtccaggccctggccgagaagctgggcgcgcccggtgcgaaggtggaagacccctgcgtggcacccctggggaacggctgcgcgcgcacggcgctggcgcccttcttcgcgtcgctggatgcgttggccacgggcaccgccacccgccccgtcgtcatcgaggccttcggcaactcgctgattgccggggaccgcatcgtggacgtcctgcgcgacgacctggccacggcgttcggaagcgcgggccggggcgtgttgctcgtggaccgcatggcgccctacggcgggcgaggccgcaccagcgccagcagcagtgggtggcagccgcgcaccctgggcgagctgcgcgcgcctccgcacgccttcggtgtcaccggcgtgtatcacgtggccacgaacgccaaggcgcgcagccgtttcaagctggatggtgagccgcgcggaacgctgtggtggctggatgtgccaggcgctggcgcggtcagcctctccagtggcggcaaggtgctggcgcggaccgagcccacgggaagtggcttgtcgcgcgccacccacttcgagctgcccgaggacgcacagacgctggacgtggtggccgagggacagggcgcggtggtgcagggcgtggtgttgcagcatgcgcggcccggcatcgtcctggacacgctgggcgtgccttcgtcggacgcgagcctctatgcacgcatcgacggcgccacgctcacgtcccaactcgcggagcgttcgccccagttgctcgtcttcttcctggggggcaacgagtccaagcgcatcgaatggaagcgcctggacatggagaagctgcgcacggacctgcgggcgctgctccgccgcgcgcgggaggcggcgcccgggagcgcgtgcctgctggtggggcccatggacgcggtgaaggggcccggcgcgaaggctcaggcgctgacgcagcgttcctcgctggaggcggtcaacgccgccgagcgggaggtcgcgctcgccgaagggtgtgcattcttcgacttctacgccgccatgggcggaaagggggcgctcgcgcgcttccatgcgtccggctacatgcatgacgacctggtgcatccgcgcggcgcggggctggacgtgctggggcacctggtcaccgacgcgctgctgcgcgcctatgtggagacgccgccgtccgcgcggggtgtcgcggcggtgatgcccacgccctcgggggcgggagccgcgcccaccggggtgtccgagcccagcgcggaggccacgccatgagacttgcgttcgtacggtacggggccgcggtgctcctggggctcgcggggcccgtgtccctggcggcgcctcgggcctcgctggggatggtgtgtgagcccgccagcctcgacgccgagcagtcccctcgggccttctccgaggaagtgcgcggcgccctggacgcggtcgtccgcgccgagctgtcacaggggcccgtcgcggggctgtccgtgggcgtgacacgcggcgcggagcgctgggtgtgtgcctatggccttcgcgacgtgggccgcaagctgcccgcgacgccgcgcaccacgtaccgcatggcgtccgtcaccaagtccttcacggcggtggcggtgctgcagttggtggagcaggggaagctgaacctgtacgcggacatctccaccctggtgccgacctatccggccaagcagtggcccgtcacggtgagggacttgctgggccacgtgagcggcgtccccacctatgacggggtggcatccacccgcaacgtgaaggcggtgagcacggaggcggccatcgccgccttcgcgggcaagccgctcgccttcgagccgcgcacccgctacctgtacacgacgtggggctacaacctgctgggcgcggcggtggagacggcctccggccagtcctaccgcgactacctgcgcgagcacatcttcaagcccgcgggcatgccgaacgcggacctggacatcaccgccacgcgcgatgagcaccaggccaagggctaccgcatccagggggcggcgctgaagccgtcgcgcttcctcgacgtgtccagccgcttcgccggtggtggcacccgcgccacggtgggggacatgctgggcttcggccgcgccgtgctgtcgcacaccctggtgtcgcgcgagacgatgggccgcatgcagacgtccatgtccaccctcgacgggcgcctcaccgactacggcatgggcttcgcgacgtatccgctgcgcggccactacgtggtggcccacgcgggcggccagccggagacgaccacgctgctgatgatgctccccgccgaggacacggtgattgccctggcctccaacgtggagggcgaggcgcggcgcatgcgccggctgtccatccgtttgctggagcaggtgctggaagagggcaacacccgccgcgatgtctacgtggcggacccggtggatgcggtggtgcacgaagggctcagccgcgtcgccagctatgggctgtcttatcaccagtgggccacgcgaggcccgggcgtgctgccggaggagacggacctgcccggcgccttcgcccaggtgtccgcgatgctgaaccggaaggagattggccgggacacccgggcggcgctggagcgtgtccgaagcgggcatgacccgcgtctgcgcgccctcttcatccgcgtgggcgcgcacatggcccgcacgttggagaaggtccacggcggggctcggctgaaggactacaccgtcgaaggaccgctggcgttcttcgaggattacctggccgcttgtgacgcgaagcaggttccagaggcggagcgcatcagcgagtcgctgcgcgcggacgtgctccgtctggccgcgagctggaagcgcgcgcagttgcccgagctccagcgcctgcgcctggacgaggagaagaacccggaggcgcgctgggccgcgctgcgcaagtccgtcaccgcgtcgccggggttccatccggattactcagacgagttgctgcgcatcgcggagggcttcgcctggcgcaagcagcccgctgcgcggcggcgctggttggagcgggcggtggagctgcagccccggggcctggatgcgcgctgggccctggccgaggcgttgctcgcggcgaacccggaggaggccgtgctgccgcatctgcgcgaggccgtggccacgccgcagggcacattggcgctcgcgcctcggaacttcctgaagcgcctcatcaacgcggagtccaccgcggtggcggcgggcctgctgcgcgcgggcgtggcgttgcatccggatgcgcccgaattgtgggatgcgttggcgaagcgggagcagtccctgggccggaaggcggcggccaccgcggccctgcgtgaggcgaagcgggcgcgtgaggcgcccaggccggaagccgcgccggtgccctccgtccccgaggtgccgggcgccagcggccccgttccggatgaccacgggctggtgcccgcggggaagtgagcgtcaccgccggagcccgtgactccggcggaggcggctcagttctccggccgtcgcttcagcttgccggacacggtgcaggtcgtcgcgatgggcttgtccttgtagatggccggcttgaagcgccactgcttgatggtttcgcggctcttcgcgtccaggtccactccgggcttgagcatctggcagtcggtggccgtcccgtcgagatggaaggtgcatctgagctgataggtggtctccttgatgcgggtgagctgcgagggggcgaactggaggtcctctcccttgattcgctcggggcgcatcggcgggtggccgcaggggatgggcatgctgcggtccatgttcttctcgaaggcctccaggttgcgctggagttcggcttcgaataccgccttgtcctgcgtcgcgggctcggcggccaggacgggcgcggacagcaggaggagggagacaagcccgggcatgtgcatggtctctcctttaagcgtgagtggggtggggcgaaagcgtgatgccgacaccctgacttcccagcgggcacccgtgcgaggatgagggcacgtatgcgcatcccgtgtccccgttgtcaggccttcgccgtcccaggcgcgcagagctgcgcgtggtgcggcgcgtctcttctgcaggaggccacgccaggctccgcggaccccgtgtgtgccgtccacccggagctgctcagtctgcatgcgtgtggccggtgcggcagcttcgcgtgcgcgcagtgcctgcggaaggggccctgggacgagcccctgtgcgccgcgtgtcatgaccgcgtgcccgcggatgccctgccgtgggaccggcgcgatgagctggggacgctgcgggcgtactggcagacgtgtgtggcggtgatgctgcgtccctcggccaccttcgagcgcgcgcggccggagggttcggtgggcagctccctgggcttcgtggcgctgtccaacctggccgcctccttcaccacggcgctcttctacctggccctcctcttcgccatcccgcgtgagatgatggatggcgacaacgtctcccagagctggttccggctggccggagtcggggtgttcggggtgatgatggtgctggcgcctgtcatcggcatgctcgtcgcgctcatcaactccgcgctggaccacgtcgtgttccggatggatggcaccggtcagcccttcgtagtcaccctgcgcgccaatgccctgtcgttgtcgccctacatgatggggctgattcccttctgtggcatgtatggcgcgcccttctgggccctggggctgcgcatctacgcgtaccggagcctgcaccgcacgggctggagcaccgcggcggtggctgccctggcggtgccgctgctctcctgtggtctgttcttcgctgcctacgcggtgattgcggtcgtgggcgccagcatcggcgggtagttcgccgcgcgggtgctacggctccgtcaccgtgctggcgggcgccgccgcggtgacggtccgctgctggggccagaagcgcgtgccgtggacgttctccaacgcggcgatgcgcttcttcgtcttcgcgtcgtagacgcgggcggcctgctcggcggagaccagcagcaggcgtccgcgcatccgcagcgccacggtcgacgtgggcgcgagcgccagttgctcaggctccaccagtcggtcgttcacctcccagcgcagcgggagcatgagcgtgggcagctcgcccgtggcttcccaggagtagagcgggccctggtgcgtctccatggagacccacatgccgtaggccgtgtggccccggtccttcaccaccgcgtccagccgggccgcgtcttcgttgccttcctccaactccgactcggagagccggtccgcatcctggctgaaggtggaggacgtcagccggctggccgtggccagggcttccgtgcccagggcaccgtccatctcatacagcgtggccaccgtctccaggtgcttccactggccggcctcgtggcggtacgcgtgtgccaggcccgggctgccttccgcctccgggaggaggaagcgcttgccgtcgaagaggaagtactcactgccgctctccatcttccgtggcaggtcctccaactgcgacaccagcgcgacgacgtggcccgcttcgtcgaaacccagcgtgtcggtgtggccgagctcgggcagcagcagccgggtgctctggccggactcgaagtccacctgccaggcgcgcggaggcagctcgccgttgccccggtccatcaccaggccctgccggccacgcggcccccaggccagcttgagccgctcgcacaccgcgtccacggtggcgagcggcttgcgtgtgcccgacgactcatggcgaatccaggtacatcccgagggcgacgccgcttcgaggaaggacagggtgtagccaggcgcgggctcggtgggtgccggaggcggagtggcggagggctcgggggcggggtcctcggacttcttgcaggcgctgcccagaagcagcgtcgagccaaggatgacggcggggccgagatggcgactcatgttgcgctccagcggaaagcggccctccaccatggcagatggttgggcctcagaggaagccaccccaggagtacccgaaaggcgtaccggggtcatctggacctcgtcgcttgcctccatggtgggttcgcgcttcacgtccggaagcccacgttgcattcggggagcgccttgcgcagggcttcgacttcttcgggtggaagtgaggtctggtagaggtccaggctcttgaggctgctcatccgggacagccatggcggcagggtcgtcatgggcgtggccttgaggcccagggacctcaagcgcgtgagctggcccaccgcctccgggagcgtgcggacgccggtgttgtccaggttgagggattccagtccctccaactgcccgagctcgggaggaagcgtctccagcttcgggttccaggcgaggtcgagttgtttcagcttcgtgagccggctcagcgcgccggacacctgcgtcagttgtgcgtgcttcagtgtcaggcgctccagctcggagaactcgccgatcagctccgggacgacgccgagcttccgccccaggaggaagatgtccttcgtgtctcgggggaaggtgcccaggaaggagcgagctcaggtcaggcgcatgttcgaaagtcatgtgcatgggttccaggtccgccgggtgctggcccgcggcgttctgtcccaaggtgttccgcagactcgcttccaggtcctgccacgcggtctcaatggggacgggcggcgccttgtctggcttcttcgctttcgccgaggaagctcgtggtggagcggtcttcttggtcgacatggcgttgcctaccgcctcggaaaaatgccggcaagtgactccgcgccgtgcgtatctccgaggctcacgtcgccgcggaccacagctccacttcgtgctcgcgagcccgcagcagcgcctgtcccagcgccacgggatagggcggcttggcgggggacaaggcgcgaatctcgggcggaagccttgagagttcgcttcgcgcgaattcgcggatggcctctagtgtcggtgatgcctcgggcaaccgctgtcccccacgcatcaccggttggagcaagggccttccgggcgcggtgtcctgcctgcacgtgagcacgtcgccgcgcgccacgccgtccacctcccgccggtagatttgcttcgcgcccgggagcagcagcttccccgatgacagcttcactcggggtcgccctgcgtacgccaccagcttgtaggccatgtccaccgcgggtgcgtccgacgaaactcccatggccgtgcccacgccgaagctgtcgatgggcgccccgcgcgccaccagtttcgccactgcgtcttcgtccagtccgccgctcgcgtacacgcgcacctgctccaggccggcttcatcgagcatctcccgcgcggcctttgacaacgcgagcaaatcgcccgagtccaggcggatggagcgcacctggaagtcctcgcccagctcccgcgccagtcggatgacgtgctgcacgccgcgcagcgtgtcgtaggtgtccaccagcagcgtggcgtttggatggacgcgcacgaaggcgcggaacgcctccagttcgtcgtcgtgtgactgcacgtagctgtgcgccatggttccggcgagcggaatcccatacgtcttccccgccagcacgttggaggtggagtccacgcccgctacgtacgccgcgcgcgccaccttcagcccggcgtccgtgccgtggtagcgccgcaagccgaagtccatgacgtggcgtccggcggcggccgtcaccacgcgcgcggccttcgaggccacggtcgtctggaagtgcacctggttgaggaggtacgtctccaccagttgcgcctctggcaggggcgcgcggacctccagcagcggctcctcggcgaacaccggcgttccctccgcgacggcgtccacgtcaccgctgaatcggaagcgttcgagccacccgagcagccggtccgagaagcggcctcgagatgccagccagtccagcgcctccgtgccgaagcgcagcttctccaggtacctcagcgcatcgtcgagccccgccgccagcaggtagttccgccggggcgggagcttgcgcgcgaagaggctgaacacggcctcgtcccacattccctcctcgagataggcctccgtcatcgtcagttggtagaggtctgtcagcagcgcggtctcttccggccaggtcatgtcggggctccgctcgaaggggcactggcgcctgaaactcaagctaggccctggcctcgacgcgcgctcccgcaagtccgctgcccggcgagcaggcgcccgccgctcgtgcagcttttgcagcacgccccctggctgcgcatcttttgcgcgactgtcgaggtccgacggcctggggggctgcatggagcaggccttgcattgacgctggtggcacgcggcgaggatgactcgccgggcaggggagcgggcatgcgggtggctgtcttcgacacacaccgatacgaccgggacgcgctggaggccgccaacgcacgtttcggacatgcgctcacctacttcgagccgcgcctgacgctccagacggcgccactggcggagggcttccccgccgtgtgttccttcgtcaacgacaaggtggacgcggccacgctggaggtgctgcacgcgggtggggtgcggctcgtggcggcgcgctccgcgggctacaaccacgtggacctcgaagcggcgcggcggctggacatgcgtgtcacgcgcgtgccggagtactcaccccatgcggtggccgagcacgcggtggcgttggtgctgtccctcaaccgtcacatcccgcgtgccttctctcgcgtgcgtgattggaacttctcgctcgacgggctggtggggttcgacctcgccggcaagacggtgggcgtggtgggcacgggccgcatcggccgcgtggcggcgcgcatcttcaagggcttcggttgcaatgtgctctgctgcgacgtggcgccggacgcggccttcgagcgcgagctgggcgtgcgctatgccccgctcgacacgctcttcgccgagtcggacatcctctcgctgcatgtcccgctgacgccgggaacgcggcacctggtggacgcggcggcgctggcgcggatgaagcggggcgtggtgctcgtcaacaccggccgaggcgcgctcatcgacagcaaggcgctggtcgccgcgctcaagtccggccacatcggcggcgccggactggatgtgtatgaagaagaggagggcgtcttcttccaggacctctccgggcaggtgctccaggatgacgtgctggcgcggctgctcacctttccgaacgtgctcgtcacgtcgcatcaggccttcctcacccatgaggcgctcgccaacatcgccgagacgactctggcgagccttcaggcctttgagcgtggcgagcccctggtgaacgaggtgcgcgccgagcaggtgctccgcgcgcgttgatttccactccacgcccattcgaacctggagctgccatgtccattgtctgtgccaccaacttctccgacgccgcgcggcgggcctccacgctggccgcggagctggctcgcaaggccggtacgtccttgtggctggttcatgtcctcaaccccgactccgtgcgcgccttcggcaaagccctgttggggtccgccgaggcggtgctgagcgacgagacgaagcgcctggaacagctgggggtgaaggtggagcccgtgctcctcaccggcgagccggcggtgatgctggaggggttctgccgggagcagggggcctcgctggtggtggcctcgcgagccgcggacgaatcgcccttcgggggcgaaggtggcacggtggaccggatggcgcagtcgctgacggtgcccctgctcgtcatgcgtgaccccgcaccgctggaggcgtgggtccggggcgagcggtccctgaaggtgttcctcggcgtggaccgctccctgcccttcgaggcggcgcgcgactgggtgctgacgttgagcaagggtggccgggtggacgtggtgggcggacgtgtctactggcccgaggaggaagcccgccgcctggggctgcggcaggccttggccttcggtgatgccctgcccgagctgcagcacgtgctggagcgggagtgcgcggagttgctggccccgctggcccagggcggaacgcccgtgcgcgctcgcgtggagatgggcgtggggcgcatcgccgaccacctggtggacctggccgagcaggagcacgcggacctgctggtggtgggcacgcaccaccgccgcgcgctggggcggctgtggagcgtgtcgcgtcatgcgctgcggctggcgcggatgtccgtggtgtgcgtgcccgcgcaggcgatggcggtgggcacggacacgccgttgccggagtaccgcgaggtgatggtggccacggacttctcggagacgggcaaccgcgcggtggcacatgccttcgcgttgacggctccgggcggcacggtgcacctggtgcacgccacggaatcgaagccgtcactcgaggaggaggcccagatgcgcgagcaactctcggcgctcgtccccaagagcgcgaacgaccggagcgtgcggctgaacatcatccccggcagcaaggacgtggtggccacgctggcgcagacggccgagcggctcggtgtgagcgccatcgtcatgggcacacatgggcggtcgggctggaagcgcgccgtgttgggctcggtgacgcagtccctgctgctgcgcacggaccggcccgtgctggtggtgcggcccccggcgacgtgatgacgcgcgtggacgcttccttcgatcaggaagcgtccacatccacgtaggcgcgcttcgccaggacggacacgatgcggccctccggcatcacgtaggcggagagcttgccgccgtacacgcagccggagtcgagccccaccgcatgcgggtgccgctggatgccccgcatggcgtcatggccgaagatgaccagctccggcccctgccacaggctggcccagggcgcgcccgcgtccacgcgcttcgacggcgtcccatccggcaggatgctgcgcaggttgagcagctcgtcttccttctgcgcctccagcggcacgcctggcaccagcccgccgtgcacggcgaccacgttcagctcggggaagaagcggtacagcggctgggactccagccacgcccagtcctcgggcgtcagggtatccagcacctgctggtgctcaggcttcagcttcttgccgcgcggcccccggccggcgtgccagcgcagcacgtgggcgtcatggttgcctcgcaccgccaggaagccctgctcacgcgcacggcgcaccacaccggcggagtccgggcccttcgccaccaggtcccccaccagcaccacgcggtcgtccggctgccaggcgcactgcgtcagaagcgcgtccagttcctccgcgcacccgtgcacgtctccaatgaagagcgttcgcatccgccctccctttaatgcgctttgcatctatccggaaaccctctgtcggatgtcaggcattcagggggctcgcgcggcgggaatgtgtgtgggcctgggcaggcgtgcccgccaggcatccacttcctccagcgcctcctgtcctgacgtccccagcgtcaccaatgactcacgggcttcctccgccaactgaagcgcgcgaggccggtcgcgcttcgcgttccagagcgcttgcgccaggaagaatcgcgcgcgtgcctgctcgctgggtgcctgcggcgaccgggctccgctggccaccacccgctccaggagttcggcggcctgaagaggccggtccagcgcgagcagtgcgcggcccaggtccatcagcgtccccgtccggtagccgtaggcatcatcctcgcgcgcatcgaggatggcgcgggcgcgctcgaggtagggcagggcttcggtgtagcgctggtccatcatcaagagttttcccgtggccctcagcgtctgggccacgtagggatgttgggcgcccagccgctgctccaacggcgcgagcatggtgtggaagcgggtcagggcctcttcggagcggccgacgcgcgccatcagcgtggccaggttgcccagggtgatgagcgctcccgcgccgtccgcgccttcgaccttgagcgcgatgtccagcgcgcgctcctggagccgcagcgcctcatcggagcggttcatccgctggagggccgcggccaggggattgatggcggaggcgacgtccgggtgctcggggccgagcgcgcgctcgaagacctccagcgcgccgcgggccagggcttccacctgttcgacgtcagacctgcgccagtgcgcataggccagctccaactgggcacgtgccacgtccggatggctgggccccagggccgcgcggcgcgtgctcagcgcctgttcgaagagccgcatcgcctcgtcggcgcgcagctgcgccatgcgcgtggcgcccagctcgagccggacgtcggtgacctccaggctgtcgggcccataggtggcttccaagcgcgagagggcggactcctgctgctcggcagcctccgtgtagcgcccctgcgcgaagaggagcgcgccgacccgggcctggagctgcgcgcgcagcacgccgtcaccgcccagtcgttcaatggcggcctccgcgcgctcacgccaccggtgtcccagggcgtgctggtccagcacatagccggaggcatgcaccagccgcgtccaggcgcgcgcggccgccacgtcgttgcgcccggcctccgcgttccacacggcgtcgaagtaggtggtctccgcgtcgcgcggctggcctgtctcctcccgcagttgtcccatcagcagcagggcgtccgcgccgccgtggcggtcatccgcgtccttcgccgccttcaccacgggctccagcagcgccaccgcctccgtgtacttgcccgcggccttcagggctcgcacccgcaccagcgtccgtgcccgttcaagagaggcgccgtccgtgggttggggctcacgcgccgccagtgccgccaggtccgagcacttgcccagcggcggcagggcctccgcggcgcgcgcggccagctccacggtgcccgcgtccgcccgggtgaagagctgcgtgagggcggccacttccgccagccgcccatccaggcagtgcatgcgccgcgcgagcacctgctcggattgctcaccccgtacgcgcgtggcctcgcaagcggaggttcgcatcgacgcccactccgcggtgtacgcatccagcgagcgccgcacgcggagccatgcggcgggcgcgaagggcttgcccgtcgcgaggaaggcgaactcgatggtctattgcgcttccggcccccactccgagaacatggcctcgtcggcgcgctggcatgcccgtgcccggctggagagcaaagcgtgggtgaggcccaccgccatcagcagcagcgccgtgccgcccaccgcgggcagccagcgcttccagcgcgaggccgggtcgtgctgaagcgccaccagcagggcattcaggtccgtgtaccggtccatggcgctggcggacagcccccgcagcagcacgcgccgcagccacggcgggacgtgcgtgccccggggcgcgggccgcaccttgccggcgcggacctcggtcagcagttcgtgtggggtggtggcggcgaaggggcgctcgccgtagagggcttcgaagagcgtgacgcagaaggcgaactggtcgcttcgggcatccgcgggcgcgtgggcctccatctgttcgggagccatgtacgcgggcgtgcctcccgccaggggtgacacgtcgtccaatggattggcgttgcgcgcgagcccgaagtcggtgacgcgcacgcggccatcctggcccaccagcaggttctccggcttgaagtccccgtggaccacgcccgccgcgtgcgccgccgcgagtccccggcccgcgtccaggaacagcgccagcacctgtcgccacgtccgaggcgcgtccttcagccaggggcgcagcgtccgcgcgtccaccagctccatggtgaggaacacctgcggcccgaaggtgcccacgtcgtagacgggcaccacgtgcggatgggagacgcgtgccatggcctgcgcttcgtgcagcaggtgcgcgcggccctgctccgcctccaggcccagggccgcgacgcgcagcagcttgagtgccacgcgccggtccagctccgggtcgtaggcgctgtagacgacgcccatgcctccggaggccagccgctccaacaccaggtagcggcccaccgcggtgcctcgctccaacgagggaccttttcccgagggcggccgggagttcgtcagcggggtggtggccccgggcgggtcgtcgtcgggggcttgtgcccgcagggcctcggccaccatgcggcggcaggcggagcaggtgtccaggtgcgcatccacctccgtcgcgcgcgcgggaggcaggtcccccatcagcagcgccacgaacgtgttttcatccaggcaggccatgggacgcgcgcgtcagtcgttcatccgcgagcgcagcaggcggctgaggctcacgtcgagctgactggagatgaggcgcagtacgctgtcgagctgggaggacgtgaggcgcaggcgctcggtgagccgttgccgcgtctgctggagcagggtctcctgcgcccccagcacccagcgcgccgtggtggagcggtgcacgccgtacagcgctgcgagctggtcgatgctcaggccgtccaggtacttgaggcgcagcacgttgcgctggcgcggctccagcgcgaggagcgcggtggagaagcagtcgctgaactcggcgcggtacgtgcgtttgaggtaggccagctcggggtcgtcctcgggagacaccagcatcgacaggtcgccgtcgtccgtggattccgccggtccgccgcgctgccgctgccagtccagggcgagccacagcgccgccgcgcgcacccagccactcagcgggcctcgtgcccggataggccgccagccgggccggtgtctccgcgctgcccacgagcatgcgctgacgcaagagttggcgtacctcgtccaggccggagggcggcagcttcagccggaccaccgcgagattcacctccgggaggtagcgcgcctcgaacgcggagagcgccgtgggcagcccgtccgccgccgcgcgagcgaggtagacgtccggcaggctcagggtctccaccgccaccgccgtgtcgtcaccggggagcagccgggcgaggtgactgacgaagcggcggccttccaggtccaccccgggccagggcgcgcgcgccatgtccagggcccgggccagccgtgcttggagtggggccagcgactccggcgaagacgcctccgcgccaccgcgtgccgcgacgaaggcctgggccagggataagtccatgggggacacgcgcgagtcgatggcaccgcctccggaaaaccgctccgggcggttcaaccgtcgggggcgacaatgcttccccagcggcccttccagcaaggaggcgacatggacccggggcgttgccaccgctgtccgcctgctccgcgcgcgggcgggtgtggcgtatgggccgcgcctggcgcatggcccgcgcattgctggtatggctgcgagcgtggtggaggtgaacgtggagtcaatcggcagtggcccaggagacgcagtccattcctcgtggctggagttgagtgcgtccgccctgcggcacaacgtcgcggtgttccgggccctggaggggcagggggcgccgcgagcactgggggtggtgctcaagggcaacgcgtatgggcacgggctcgcgcaggtgttgcccgtggtccacggcgaggtggacctcctctatgtcattgccccgcaggacgcgctgaaggtgcgggagtacgagcgggcacagggactggggccaaggcaggtgctcgtcctgggcgcggtggcgccggatgaggcggtggtgttggcgcgcgagggcgtggacgcggtggtggcggaccgtggctgggcggacgcggcggcggtgttgcgcgcggcgaagctggagcgtcccctgcgggtccacgtccacctcgacaccggtctggggcgcgagggcttcacgctggaggggctgcccacggagtctcgtttcctctcggagtcccgcgacgtgctggaggtggtgggcgtgctcagccacttcgccaacacggaggatgtgacggagcagggctacgcgttggcgcaggtggacgccttcgagaaggggctggcgttcctctccgagcaactggcgccggcccggccgctgcaaaggcacatcgccgcgagcgccgcgacgctggtgttgccccgcgcccgctatgaggcgctgcgcgtggggatttcgctctatgggctgtggccgtcgccggagacgcggctgtcggcgcggctggtgctgggtgaggttccggtgctcaagccggtgctgtcgtggcggtgccgcagccaggtggtgaagtggctgtccgcgggcagctacgtgggctacggctgcacgtaccggtgtccggagcccacgcgtatcgcggtgctgccggtggggtactacgacggctacccgcgcctcgtgtcgggcaaggcgcacgtgttggtgaatggccgccggtgtccggtgctggggcgggtgatgatgaatcacctcatcgtggacgtgacacgcgccacatccgacgagcgtcccgtgacggccaccctgatgggccgcgatggcgaggagtccgtgcccgccgagtcactggccggctgggcccagacgattcactacgaactcgtcacccggctgggggcgcacctgaagcggacggtggtggcgtagtcccggcgggcagggcggcctccggtggcggctgcaccttccagcggcggtgcagccacatccactggtccgggtacttgcggatgcagcgctccagcgcggccgtcacgcgcgcggtgtgctccgtaatcgggtcggcgcactcacccggcgcgggcgggaggatggggccttccacttccatgcggaagcgggcaccgcctcggccgttgcgtacgcccatcaccacgaacaccggggcgtccgtgcgcgccgccgccaccgccatggccggcgtggtggaggccagcttgccgaagaagggcacgaaggccgcccccttcgccggcagcgcctggtccagcagcatgaagggggactcgccgcgattcaccgcgtcgatgatttcctggatggcgcctcgcggatagatgaggccggcgccgattctcacgcggttctccgcgatgcgcgtgttgagcgcgcccttcagcggacgcaccagtgcatcgagcgggacgccatggcggatgagcatctcccccagcaactcccagttgccgaagtgcgccgtcaccagcagcgcgcccttgcccgtggccacgcgcgccttcagcgcctgccaggccgcatcgccttccacgccctgctcggcccagtccagcggcagccggtcgccggagggcagcgactccagcaccacgcgcgacatgttgatgtaggcgccgcgcgcaatctcccggcgctccgcgtcacttttctccggcatcgccatggccaggttttccaacgccacgcgacgacggatacccagcctgtatgcgaggttgcccacgaagcgagcgagcgcgtcacgcgactctggagacagccacgtcaagaacgcccagacaaagcgcgtgaggaatcccaccacccgtccaggtggtgtgccgacgatgcggcgcaggtgctcggacgggagcttctgcgtcacggcgggtgagtcagggggcggggatgcaggcgcaatctgggacacgtgacgcactccacctcgaagtggagatgacggcaaggccacacctgcttgttgcgcgctaccttgcttgcccggcatgggacacactgcgcgccatgcccaacctgctccgtccagcggcactggccgctgtcgccctcctcagtgcgtgcggtgcccggcagaaccctcccgccaccgctgaaccccctttggcccaggcgtcacgacaggccgtctccgccacgccgccgtcaccgaagctgcgcctgcccacggaggtgcgccccaccggctacaaggtggcgctcacgctggacccgaaggtgtcctcgttcaagggcgcgatggacatcacgctcgacgtgacgaagcccacgtccgtggtgtggctgcacgccaagagcctcaacgtgacgggggccgtgttcatccagaacggttcggccttcatcgggacgcccgtgaagggcgaggaggacttcctcggcttctctgtggcgaagccgctggccgccggccgggcgaggctggtcatcaactatgaaggcgtcgcgtcggagaaggagacggacggcgccttccgcgtcaatgaaggcggggactggtacatctacacccagttcgagccggtggacgcgcgccgtgtgttcccctccttcgatgaacccggcttcaaggtgccgtggcagctcaccttccacgtgcccgcgggcgtcgtggccgtcaccaacacgccgcaggagtcggaggaggtgcgcccggacggtggccgcacctaccgcttcgcgcgcacgcagccgctgcccagctatctcatcgccttcggcgtggggcccttcgacttcctccccgccgcggacgcgggccagaagaaggtgaagacgcgcatcatcaccccgcgcggccgcacggcggagggcgcctacgccgcgcaggtgacgccggaaatcctcgccgcgctggaggactacttcggcatcccgtacccgtacgagaagctggacgtgctggcggtgccgctgctgcgcggcgccatggagcacccgggcctggtgacgttcaactcgcgcctcatcctcgcgaagccggaggaagactcgctgggccgccagcgtgccttctccgacacgcaggtgcacgagctggcgcaccagtggttcggcaacctggtcaccatgcagtggtgggatgacctgtggctcaacgaggccttcgcctcgtggatgaccccgcgcatcgtcgaatcgtggcgtcccgcctgggacgcgcccgtcgagcgcgtgcacgaccgcgcccgggccctggacgcggacagtctcctgtcggcgcgccgcatccgccagcccatcgagagcgccaacgacatccacaacgcctttgacggcatcacctatggcaagggctccgcggtgctcagcatgacggaggagtggctgggccgggatgtcttccagcgcggcatccagcgctacttccgcaagcacgcgggcggcaacgccaccgcgaacgacttcctggacgccgtgtccgctgagtccggcaaggacgtgacgggcatgttggggagcttcctggaccagagcggggcgccgctcgtcaccgcgtcgctggcatgcggcgcggacggcgcgaaggtggtgctcacgcagcagcgttacctgcggctgggggccgcgtcgccgggtccgcagacgtggaaggtgccggtgtgcgtggagtacgcggcgggcggcaaggaggcccggacctgcacgctgctggagggcgagcgcgccgaggtggccctgagcgaggcgaagacgtgcccggactgggtgttccccaacgcggagggcgcgggctacttccgggtccagctcgatggggacgcagcggcgaagctggcgaagtccgggatgaagcggctgtcgcgcaccgagcgggtgacgttcctgacggacgtgcgcgcgctggccctggctgggacgattcccgccgccgaggccctggccctgacgagccgcctggcgaatgagccggaccgcgtcgtcaccctggcctcgctggacctgctggagctggtcagctcgcggctgcttccggacgagaagctgaaggaccgggctcgcttcctgcgtgagacctatggcccccgggcgcggcagctcggcttcgccccgcgcaagggcgagagcgaggacacgcgcctgctccggccccggctggtgcggctggcgggacgggacggcagggatccgaagctgctcgcggaagcgcgtgccctcgcgaacaagtggctgaaggacaatcgcgcggtggcgccggagatggtggacgtggtgctcgccctcgccgccaccgagaacgacgcggccttccgggagcagctcgtcgtggcggtgcgctcggagaaggagcggcgcacgcgccagcacctcatcggcgcgctgagcagcttcacggacccggtgctggtgaagcagaacctggccctggtgttcgagaagggcttggacccgcgtgagacgatgtggatggcgttcgcggcctcgcagggactgcgcacccaggacgtggccttcgacttcgtgaaggagaactacgaccgcctggtgggggactcgcccgaggcgctgctgtcactcgatgccgcggggcgcatggcctacatcggcagcaacttctgcgatgcgggcaagcgtcagcaggtggaggagttcttctccgagcgcaccgcgaaggcgccgggggggccccgggtactggcgcaggtgctggagatcgtggaccagtgcatcgcgctgaagaagacgcaggcggccagcgtcgagtccttccttgcgaagggcaccccgtcgcgtccgccgcaggcacccgcgtcgcggtagtcgcgcggacggccgggcccggcatccctcatgagatgtccgggcccggatgttccgccaggccctacttccggccgcgggacatgaaggacatgaaggcttcctgcgcctcggtggactggaggcgctggatgaactcaccgccctcgcgggccagcgtctcgcgaatctgggcgcgcaggggctcgcgaatcagccgcttcgtcacgcgcaccgcctccgccgggcgggaggccagtgtggcggcgcgctcggtggccacctgctggaggctggcgtccggcaccaccttgttgatgaggcccgcgcgcagcgccgtggccgcgtcgaagggctcgccgaagagcagcagctcgctggccagcgcgaagcccgccgtcctggggatgagcaggctgctggcgccctccgcgcacagccccaactggacgaagggcatgtggaagcgcgcgcgctcgctggccaccacgtagtcacagtgcagcagcatcgtcgtgccgatgcccaccgccgggccgtccaccgccgccagaatcggcttgtccgcgtccaccagcgctcgcaggaagcggaacacggcgctgtcctcgcccgcgggcgggtgctccatgaagtcgccaatgtcgttgccggcggtgaagacgttgcccgcgccggtgagcagcaccgcgcgcacgtcgacgttgccctccgcgtccttcagcgcgcgggtggccgcctcgtacatggcatgcgtgaaggcgttcttcttctcgggccggttgaaggtgagggtgaggacccccgagtcgagcttcgtcagcagcgtgtcggacatggtgccggggagcctaaccgactccgtgcgttggggcgggagaatggcaccccgcgccctggctcgcgatgctgccgaggcgtccaggccccctcggtcgggcagggcctgggcgcgggaagtgtccgctggtcgtcagggccgcagggcccgggccaccaggggcgcgagcgtcaccacctggtgctggaacggcagccccaggacaggctccacgctgtcggtgctcaccagccgggtgagcggcaaggtgcgcaggcgctccacggcggggcccaccagcagggcgtgggtcgtcgccaccgtgaagtcctccgtgcagcccgcgtcgcgcagggtgcccgcggcggcggccagggtgccaccggtggacaccatgtcatccaccagaatcgggcggcgtccccgcacctcgcccatcagcccgctggcgtggacctcgtctccgctcagccgcaccttgtgaatcaccgcccacggccggttcagcagccgcgccagggcctccgcgcgcttcaccgcgcccaggtccggcgccaccaccacggaggtgtcggtgacgtgctcgcggagcgcttccgccagcaacggcagcgaggtgaggtgctccagcggcgcgccgaagcagccttccagcgcggggctgtgcaggtccaccaccagcacgcgcgcgaagcggccctgtgacagcaggtctgccaccagccggccgcccaggggctcccctggcctggcgcgccggtcctgccgcgcgtagcccaggtagggcaccacggcttccaggcgggcggcccccatgcgccagcacgcgtccgccatcagcagcaactccagcaggtgctcacccgcggggggcgtcgtggactgcaccaggatgacggtgcggcctcgcacctgctcgggcacctcgacgtgcatttccccatcggggaaacgctcgaagtggcagtcagcgggcgctacgcccagggcttgcccgagcgcgcgtcccaggtgggggctcgccgtgccaacaaggaggacagggtccatgggccgcaccctagcgcgcctgccggtcggacggtgcgtccccggcggtccccccgcgagcctccctccgggacggccctcgcatggccctccgccgccagtcgcgcgccccgtgacttccttgtgggaaggaggaaggacgcaatgcgctttcgggaccgagcagatgcgggccgccggctggcggcgcggctgttgccctaccggggtggcgaggtgcgtgtgctgggcctggcgcgaggcgggctccgggtggcgtacgaggtggcccacgcattggaggcgccactggacgtctgggtctcccgccgcattgacgtgccgggccggatgacggtgctgggcgcggtgtcggaagggggcggcatctacctggaccaggacgcgctgcggggcctgggcctgccggaggtggaggcccggagcctggcgcgggcggaggcttcggaagtggacaatcaggtccagcggctgcggggcacctcggagcccgcgatggggggcttcacggtgctgctggtggatgacgggctggtgtcgggcgccacggccatggccgcgctccaggtgctgcggcggcaacacccggctcggctggtgctgggcgtccccgtggggaccccgcatgggctggcccgggtgcggccggaagcggacgcggtgcattgcgtggaggtgctgcccgcgatgcgtgacgtgtcggaggcctacgacgactaccggccgttgccggacgtggagctgcggcagttgctcgtgcgcgcccgggagcccgtgcagccgcgcgaggtcctcgagtccacggacctgggcggcttctttagagcg

SEQ ID NO: 1269 - DNA, 49225 bp, Myxococcus xanthus
gctcctcctcccggtgtggttcgccatcggctcgaagtacgtgctcaccttccaggggcgccacgtcttcaatccgtccatgttcggcgtggccatgtcgctgctcttcacgcgcgagctcatcaccgccgcgcccgcctaccagtgggccaacggagaggtggccctctccgccttcatcctcatggcggcgctggtgctcttcttcttccgggtggggcgcgggtggctggtggtcagcttcctcttcttctacgcgctccagacggcgctgcgcgcctatgtgctccggcaccacctgcctccggaggtcctcttcctcggtacgctgggtgcaccgtcgttcttcatcttcgtcttctacatgctcaccgacccgaccacgtctccgggcacgcggcgcgggcagatactgctggcgctggcggtgacgctggtggacctggtgctgcacttcaaggagagcgtctacacgttcttctatgcggccctcacgtgcgccacggtccgcttcctcttcgtccacgcgcgagccgcctggcagcgcgggttgcgcgagtcgctgagcacactggtgtcctccggctggctgaagcgcgcggtggtggtgggcgggctgggaggtctcatggtgggtggctacaccctggccgccacgcccggagtccggacctcgccgctggacttccgcatggagcgcgtggaggcgcgggccgcggggctcgactccaccatgggcaacacgctcgaggagttggacccacggctggggcatgtcgcgaagtggctggtggcggtgggggattccgtcgccgtgggggactacgacggggatggccggccggacctgttcctcacgcacccgctggcgcggcccgaggaccacgcgatcctctatcgcaacctcggcgacctccgcttcgaacgggtgcctgttcccgcgctggagcgcttcgccacccgctacaaggaagagggcctgccgggcggcggcaccttcgtggactgggatggtgacggcgacctggacctcgcggtggcggtggccttcgggcccgtccggctgctgcgcaacacgttgcgagagacgggcaccgcgggcttcgaggacgtgacggaggccgcgggcgtgacggaccacgcggtgagcctgggcctgaccttcctggactatgaccgggatgggcacctggacctcttcgtgctcaacgtgatgaccacgcacctgccgggctacgagccgccggtgccgctcaacctcttccggctgcccgagcccgagcacgcagaggaccgccgcatgttccgcttcatgcacgacggctggcacaacgcggccaacggtgggctcaacgcgctctaccggggccggggagacggcaccttcgagaaggtggacatcgccgcgatgggcatgccggagacgcactggtcgctggcggtgagcacggtggacttcaaccgcgacgggtggacggacctgtacgtggccaacgacttcgggccggacgacgtctatctcaacgagggcggcaagcacttccgccgcgtggcgggtcggctcttcggcgagattggaaaggacacgtacaagggcatgaatgcctccgtggcggacttcgaccgcaacggctggttggacctgtacgtctccaacgttcaccactcgctccaggcggagggcagcctgctgtggatggtgggccccgggaaggacgccttcacgccggagttccgggacgaggccaccttccgcggcgcgctcaacgagcggcgcttcggttggggcgcggcggcgggagacctggacaacgacggttggccggacctggtgcaggccaatggcatggtggatgaccgcctggacgcggcgcggtggcgcatccccgacggccagcgcaaggactactggtacgtgaatcacaagctgatgcagtccggcccggaggtccacacgtacgcggacaagtggggcgacatccggggccgcaccatctacccgaacgaggcgcgtcgcgcgtacctcaacctgggcgacgcgaagcccggacacttcgtggacctggcgcgcgagctcgggttggacgacccggacaactcgcgaggcgtgctgctctcggacatggatggggatggcgacctggacgcgctcatcaccaatcagcacgggcccgtgtcgctgtatcgcaacacgctgcgctcagaggggcgccaggatgcgcacttcgtgggcctcacgttggtgggccacggtgggcgcacgcaccggagcgcggtgggcacccgggttgttgtctcctacgaggaggcggggaagcgcgtggagcaggtgcaggaagtcgggttgatgggcggcttctccgcggcggcggacgcgcggctgcatttcgggctgggccggtacacggggctcgtgacggcgcgggtgcactggtacgggggcgacgtgcaggaggtgtcgctgtcgtcggaccgcacgcatgagcttcggcagcctcctgacgcggaggtgttgcaggggcgtgccgggccatgatgtcgccgctcaagggttcgacggtgcggcgtgatgcgctcacggaggcgcagcgtggacagatgctggcgctaatgcagctctgctacacgggcgtgtcgccggagcgcttcgccgaggacttggaggccaagcaatacgtcatcctcctccacacgcggcgaggcggggagttggtgggcttcagcacgctgcgcgtcgccgaggaactcgcgggcgggcagcgggtggaggtggtgtattcgggcgacacggtcatccaccccgactggtggggccacaaggtgttgcaggtgtgcttcgggcgcttcgtgttgtcgcgcaagctccgccatcccctgcgtccagtgcactggctgctgttgagcgccggcttcaagacgtacctgctcgcggtgaactacttccccaggacgatgccccggcgggactggacgccgcctcccggacgcgccgacttccttcacgcgctggccgcccgctggttcggcgcgcagtacgacgcgtcgcggggcacgctccgtttccagggcgcgcactatcgtgtgcgggacggcgtcgcgcccatcgaccgcgcggcggcgttgcaccccgacatcgccttcttcgccgagcgcaatccgcgccatggcgagggcgaggagctggtgtgcctggtggagattcgctggtgggacctcttcctggcgctggggcggagcgtgtccggacagcttcgcggctgggcccggcgagggctgcggaacgccggtgtccgcgtggggacatgaggccgtcgtgagtgcttcctccctgccgctgagcggcctgcgggccgtgctcgctccctccgcgctgcgcttctaccgggccttgcgccatccggaggccgcgcaggcggtgtgtctgcagcgggtgcttcgttcggccgtgggcagcgtgcaggcggagcgcattcctggcttccaccgcatcagcgacgcccgtgacttccaggccgccgtgccgtgggtgaccccggacgcgctgactccggacgtggagcgcatcgccgcgggcgaggcccgggtgctcacgcgtgagccggtgctgcgcttcgaactctctggaggctcctcgggcgccagcaagcgggtgcccatgacacgcggcctcctggccgagttccagcgcgccctggcccccatgctcttcgagttgctccaccgccggcccgcgttgcgcgagggcgccagctactggtccatctccccactggcgcgaaagcaggtccgcacggcgggcggcattcccgtgggcagcgcggaggacagcgcctacttctcgcgcgtgctgcgccccttgctgtcccgcatcttcgcggtgcccggtgaggtgggggcattgccggatgtggagtcctgccgctacgtgacgctctggcatctcgtcgcccgcgaggacctgtctctcatcagcgtgtggaaccccagctttctcacgctcctcatggacgcgctggagcggcacggggagcgactggccgatgacctgatgcgagggcactgccggccacctgcgtccggcgcagcgtacgatgaagccgcgacgcaagcggtgctggaccggatgcgcttctccccgcgcccggagcgggcttcgctgctgcgtgaggtgctgcgaggtggctggagcgcccgcgcgctgtggcctcgattgtcgcttctcagcatgtggacggacgcacaggccgcccacgcgcttcccgccgcatgccgccgctttccgggcgtggaggtgcagggcaaggggctgctggccacggagggcgtcgtcaccgtgcccctcttcgatgcgcccgcccccgtgctcgcggtgcgcagccacttcttcgagttcatcgacagcgagcagcccacctcgcgacctcgcctcgcacacgagctggagcagggccgcacgtacacggtgctgttgtccacctcgggtggcctgctgcgctaccgcctgggcgacctggtccgcgtggagggcttccaacacgcgacgccctgtcttcgcttcgtcggccgagcggacgccatttgtgacctggtgggcgagaagctcgccggcacgcgcgtgggggccgtgctggatgccgtgcttccagacttctttggcggcgcgcgccccggcttctccatgctggcgcccgagtggactcccgcgccgtcctacgtcttgttcctggagacggacgcccccgcttcacggctcgcagccgccgcggaggccgtggagcacgccctctgcgagggacaccactaccgctacgcgcgagccctgggacaactcggtccggtgcgtgccgtgcgcgtggcggacggggctcgccgctacgaggcccgctgcgtcgcgctgggccagcgcgcgggcgacatcaagcccgtggacctgcaccgcctgacgggctggtcggaccatttctccggagccgccacatgagaccgccactgcgtctgcattcgcgcgacacctcgcccgcccccaacgtggacctggaagccgaagccgacctcacgcgctgtggcgcgctgaaggacttctggtacgtcgcgtgtctctccaccgagctgaagccaggcgagcccctggcgcggaccctcttcggcacgggggtggtcctcttccgtgacgtacagggacagcccaccgctctccgggaccggtgtctgcaccgcaacgcgcggctgtcccggggcgcggtcttcaatggccgcatcggctgcccgtatcacggctgggtctacgacgcgtcgggcgccgtggtggaggtgccctcgttggggccttcgcagcgaagcgagttgctcgacgccgacgcctgcgcgcgggagggactggcgaccgcgccctgcgcgctgggacgcctgacgcgctttcccaccctggagcaggacggccttgtcttcgtctacatgggcggtgccgagcccgcgcggtccgcgccgttccgcgtgccgtactgggaccaggaggggtggaccgtctacttcatggtgacgcgcttcccgaacggggtgacgaacctcgtcgagaacttcatggacgtcccgcacacgctcttcgtgcatccgggctggttccgcaggcccgccagcaagcgagtgccggccacggtgcggcgcacggcgggcagcgtgttggtgacgtacaagcaggcacaggacaccgtcacgggcctgggccggctcttcaatccgcgcggactgccgctgctccacacggacaagttctacgtccccaatgtcacgcgcgttgactacctctggggcgagcacggcttcgtcatcaactcgcagtgcacgcccatcgggcccacggacagcctcgtctacacggccatcagctatcggttaccggtggatgtccccggtgcgctggtgggacgcgccatgatgccgctggtgcggtggtacacgcggcaggtcatccagcaggacgtggtcatcatggacatccagcgcgaggccctgctggacggcccgggtggaggcgtctactccggcacggaggcggacctgcaccacgccgacatcgaggcgtatcgccgctggctgcgggagggcggccagggctcggggcccgaggacgccgagcgcgacatggccttctggatttgagtccgccgcgctactgcggacggtagggcaactccacgatgaaggtggcgccctggcccaactcgctctccacgcggagggtgccgccgtgcgccaccacgacctggcgggccgcgtagagccccaggcccagtcctccaaaggcgctcgagggaacggcgcgttcgaagcggtggaagatgcgctcctggtgctcgggggcaatgccgatgccgtggtctctcacgatgatgcgcgcgtggtccggtgcgccgtccacccgcacctcgatgggacggcccctgccgtacttgaaggcattgaccaggaggttgcccaccacctgctgaatccgcagcgggtcccatacgccttcgatagggacctccgccatcaactggaggggacagtccgcctcggccgccggagtcatggcgcgggtaaccgtgtcccggacgagccgcgacaggtcgagcggctccatcatcaagggcacctggccctcgccaatgcgggagacgtcgagcaacccgtcgatgtgcgtggcgagccgctcggtatggcggatggccttgtccagccgctccagcaggcgtccgccaccatccttccgcgccgccgcggaggggagtgattggagttggagctggagcgcggtcaggggcgtcttcagctcgtgaccggccagggccaggaattcatcccggcgatggagggcctcgcggagggcctgctccgcctgctgccgctgcttgacttccacctccagtgcctgggcgcgctgctggaggagactgacctctcgcagccgtccttccgtatccgcgagccgtgtgtagcgctcggtgggaatgacgtgtgcgtgcgccttgcagacatcgaggaagggccgcgcgtgcgccgcctggccgaagtggccgatggcgtaggtgcacaggagggacagggggtacagcacgctgaggtcattccacagtgcctccagctccaccgccacgtccggcatcccatccaggcagaggacatccaccatctcgccgtaggcgcgtaccttggcgccggggcgcgaggccgcgaggctgtgctcaatcacggtgccgatgacttcgcggaagcgctcccagtccgggcgtccccccaccatgaagcgcgccagtgtctcacgggcatcgagcagggtgagctgcccgctcgcgatggccgccgcggtgtccacgcccgcggccaccagccgcgcgatgagctgctgccggtggctcgcctgggcgatgatgatgagcgggtctcctcgttcgagcccgcccgtgatgtaggcctcgacgatgtcgatgacgattgcctcgtcctcatagaactggaccgtgtgggcatgctccaggggatacccgacgggtgtttcgctggcgggctgccggtggctgctcccgagagctgcggcgtcggatggaggcatcgtcctcaccatgtgcgtgggcgcctcattattctgtcggggcctttcgacgcggaacgacccccgggggcattggagcgcacggaagccgtcactggtgggctggcgcgcttgactcgggttcaccgcacggccgcgggacgcgcccccctgccacggccgcgcgtccctgagtgtcacttacggatagagcgacttgaagtagctgatggagttgttccacgagggcgtcaggtgccccatcctgtttggaaaggcgttgcccgcgcagcccgtggcgtcgcagtagtactggttgtactggcccaccacgaccggccccgagacgggcgcgtcatacgagtagatgggcgagccgctctggcccgggctgccgtcgcagccgatttcgatttcctggtgccagccgtccgcgtccgggctgtaggcgttgctcgtcttgcactgctgggtgtcgccgtacagcgtgcgggccgtgcagctcgcgggggccgccacgtggccgcagccggggtagccgcgcatgaaactggaccacgtcttgagcgtgtccgtggacgcgttccagtgccccatccagcccgggtggccgttcgggaagtcgtcctcgagcaccatgatggcgacgtcgtagcggttgcaactggcgacgctgttgcacgagccgttgatgtagccctccggcacccagtaccagatggcgtcctggacaccccacggcgcggtggcgccgtcgcggcgggcggtgaaggtgttgaagatggggttccacccgctgtacgcgctgacgacgcagtgcgcggcggtgacgacgacgcggcggcccacgagcgcacccgaacagccagcgctcaggtggccgatggtccgatagggccacgagttcgtggcatagccatccgtgaggcccatgcggatgcgcgtgtccaccccgttgctccacgtctggcctgagaccgtgccggaggtcagcgcctcatcgccgttcacgggctccaaccgcgcggcgtcgtccagcgtgccgcgtgaggcgccgttgagtccgcgccgcgccagctcctccgccacgcgctccaggttggccgtgtccgtgcgcaggcggtaggccttgttgttcttcacgtcgatgccaatgaaggcgcgctccgttgtcggccggaccggtgcctccgccgcggcgcgcgtgcttcccgcgggctggcgcgccgaggcttcgcggaacaacgcctccgcgttcacgtccttcagcatgcggacatcgcccagggcctccaggtgtgggagctcggcgcccgcggcctcgcccagccacgcttccgggacgacctggacgggtggcgcttcctgggcgcgtgaaccgtcaccaccacacgccgcggccatgaggccgagcgcacagaacatggacctgcgaatgccacgaagcatgagtttcccctgcgcgatttgtgaaaacaggtgagccgcgagcgagaacgggcgtggggggattccttctcttttcgtggcggatgcgccgcgctagcgtcccagtcccatggcggacacacggcagcgcagtgcacctccgagtttttcccagaacgaggccgcggacatcatccgcgaggccacggctcgcgcgatggcgggcaaggacgaggagcgcgcgctcacccgggaggacctgctcgccatggcccgggagatgggcgtgagcgaagccgccgtggagagcgtcatctccgcgcgcacgggacgcgacaaggcgcagcgccgcatgcgcagggcctacatgggccttgcgtcacacgcgacgagctacaccatcgtcatgggagggctcaccctcatcgacctgttttcggggccgggctggtgggtgcagtaccccgccatcggctggggcatgggactggcgttccatgccatgggcacgctgctcgcggctttcaatcacgcggacaggcagcggtgagcatgcgggcgcgctagccgatgcgccgcagccccggcaggtcttccggccgcagcgcccagcggggcaccggcggcagggacgccaacgtacccgtctgcgtcgccgggaagccctcgatgtgcgcaccatccgcgaaggcgctgccctgcttcaccaggctgcccgcgcccacgaagctgccgcgtcccagccgcgttccgtcacagaggatggcgcccggctccaccacggtgttcgcgcccacgtggctgccatgcaccgtgcagcccggaccgatgatggcgccgtcctccagcgtcagcgtgtggtccgacagccggtgcagcacggtgttggccagcacctgtacgcccgcgccgatgcggactgggccattgccatccccgaggattttgaccccggggccaatgatgcagcccgggccgatgatgacgtcccctgttacctctgctgaggagaagagggtggcggtggggtgcaccagtgggtgcttgtcgcgaaacgtatagagctgtcccatgggagcgtcctctgcgcgatctctcgcggagaaagcggtgagtggctggcccggcaggtcgaggcttccgccgcggcgcttccggagccgttccaggtcatccgcggtggttcgacggagaatgcggccggggcggcccacgacgacggagtcgtccggcaccacggtgcccgctggaatgagcgttccttccgccagcaggcagcgcgtgccgatgcgcgcgccgggcatgaggatggaggcacctcccacatcgcagagcgcgccgacctccgcgccgagtacgatgctgcggtggtccaggaaggtgcgctctcccaccgtgacaggctgctgcggcagtccgatgatgacaccgttctccagcacggccgagccggcgcccaaccgcacggcgccttcgtgcgagcgcaccaccgcgccttgcgcgatgttggctcccggacccaggtggagagttcccagcacccgagcgctgctggagaggctgaagtgcgcggcccccccgacaggcaccgcgggcgcactttcgtgcggcaggctgatgaccattgacgcggcaccctacacccacgcgctcgacggcccgacggcccgacggcgcaggtaggttgtccagcgtccgacgctctcagggccaggccttgccctgggggcggttgcccgctcgccgcgcagggggcctggaggggagaggcgtcaggtgtcatgggggatggcgtccctggacctctttccgccttcctgacagaagggcgcaaacggaggcaggcatgtctgagtcatccccggtcgggttcgaacccgttccggcggaagcacggggtccgcccgaagaggggcctcaggggttctgggcttcggtgaaggaagccattcacggaaccgagagggacctcacccggcttccggttcgcagcgccatcttcctgctcgccgtgccgatggtgctggagatgatgatggagtccgtcttcgccgtcgtcgacgtcttcttcgtcggccggttgggggcggacgcggtggcggcggtgggactgacggagtcgctgctcaccatcatctatgcggcgtccgcggggctgagcatcggcgccacggcgctggtgtcccgccgcatcggtgaaggcgacccggagcgggccgcgcgcacggcggtgcaggcggtggggctgggcgtcgtgttgtccattccggtgtcggtggcgggcgtctacttcgcgcggccgttgatgacgctgatgggcggctcgccgtgggtactggagcacggcatccgctacacgcaggtgatgctgggcggcatgggcagcgtcctgctgctgttcctcatcaacgccatcttccgcggcgcgggggacgcggccatcgccatgcgcgtgctgtggctggccaacgccatcaacatcgtgctggcgccgctcctcatcttcggcgtggggcccttcccggagctgggcgtcatgggcgccgcggtggccaccaccttcgggcgctcctgcggcgtggcgtaccagctctaccggttggcgcgtggctccggccggctgcggctgcggcgcgagcacctgcgcctggagccggggacgatgctggccatgctgcggatgtcaggcgcgggcacggcccaggcgttggtgggcacgacgagctgggtggtgctggcccgcatcgtggccacgttcggcagcgcggcggtggcgggctacaccatcgcgttgcgaatcgtgctgttcgcgctgctgccctcgtgggggctgagcaacgcggcggccaccatggtgggacagagcctgggcgcgggaaagccggagcggggcgagcacgcggtgtggacggcggggcgcatcaacgccgtcttcctgggctcgctggggctgctgttcgtcctcgcggccaatcccgtggtgggcatcttcacgaacgacgccgcggtcatgaaggaagcggtgctcgccctgcgcatcctgagcgccagcttcctgttctatgctttcggcatggtgttgacgcaggccttcaacggagcaggggacaccaccacgcccaccgtgctcaacatctgttgcttctggctgttggagctgcccctggcgtgggtgctctccggccccctgggcttggggccgccgggggcattcctgtccatctcggtggccttctcggtgatggcgctggtggccgtcgtcctgttccggcgtgggacctggaagcaccgggtggtctgaatgggagggcggaacgtcatggcccatgtatggcgtttcgccaggaccccggggctgcttccggtggtcctgctcctcgtcctggggctggcttcatgccaccccgtggaggtgcccggggatgaggtggcctgcgcggggctgcggtgcaccgcgggcacctgcttctccaacgcggggcagcccatgtgccgctgcggaccgtgggagcgagccgcggggctgacgtgctcggtcgccgccttcacgcagccggatgaccatgggggctcgcctgacagcgcgacggtgctgacgctccccatgtcgcccctggagggccgtatcgacgagggccggcgggaggagatgctggacagggacttgttctccgtcaccgtgcaggcgagcggcctgtatcgcttctcgtgcacgcggctgctgctggtggagtgccgggttcggttgctggatgtggctgggaacgcccacgacatgccctccgctgtcgagggggcgagggtgtcgtggttccccacgctctccgagggcacctggtacttcgaggtctccagcagggactcgtacgggcgctacacgtacgagctggcgtcgctgggcgtggacgaccatggcgatacgttggaggatgccaccgtcctggaggccggctctggcacgtcgttccccgtgcggctctcctcgccctttgacgcggatgtgttcaccttccgctcgcgggtggggcatggctaccgcttcatctgtgagcaggctcccaacccgttccttcaattgacgctgcagtccgcgaccggcttgctgatggatgcggtgcagggcacgtcaggggagccgctcacggtgagcctgcaggcgacgtccgagcgagactggctcctgatgctggctgccgaccatggcaccttcccggtggatgccgcctgccgcttcgaggacctggggcccgatgagcatggcgacacactggagaccgcaacgcccgtgacgccgggtgtcccggtggcggtcacccttcagtcgcgtgatgacgtggatgtcttctccttcacgggggagcccgggcatgtctacacggtgcggacggaaggggccgggcggtggtccgcccaggtggtggacgaagatggcgcgaacgtggcgctcacgacgaccgaccagttgcgggtccgtctgaaccgctggggcacctactcccttcgcctccagggaggggctccctgggagcactccttcgtgctgacgctggtggacgcgggaacggatgaccacggtgactctccagagacggcgacattcatctccccgggaatcaccatcacgggccgcttcgactcacctcaggacacggatgccatcgccttccacacccaggcacgtgccatctaccttgcgtcctatgcgccgttcgccgacctgtccctgaacccgcgaggcgccgtgggaatcctggggttggggagcggccgccatctcttcagcgcgagggacgcccggcaggtcaccttgatgttccagcccctgaatggcgtggagggtttctccctgacgctggaggaggtggccttcgatgaccatccggactccagcgaggatgcgcaggtcctggcgctgccggcttcgatgtccggcgtggtccagtcggccgtcgacacggacgtgttctccgtctggctggaggaggggcgcgcataccggctgggcctggacgccggcacgcttcgcgcgacgctcatcgcgcctggcggtctcctggcgaatctgcgggacggacggttcgtggcgagccggagcggtctccatacgctgtttctcgccggtgcttccggcctggagcaggtcccctggcgcttcacgctccaagcggagtgagtgcgtcagggcaggcagatttcgaagccggtccgcccggcggggaaggtctcccggggacgtgaggcgggcgtcacggcgtagaggtggaagtcgaggcgccgctggaggaagcccttcagcgcgggcgccagcgggtccagttcgtcctggtacagcgtgaagaagtggaagccctggccgtgaaagtccgcgtacacccgctccacgagcgcgcggaggacggccgggtcttctccgcgcacgctggtgttgcagagatagaagtagcggaagtcgctgcccggcgcgggcaggcgcggcgcgcggagcgcggtggccagcgtgtcccagccccaccgcacccagcgcatgcctccacggtaggcatggacgcggtagcgcttcacggcttccgggttccaggcggtggtgcagcccaccagcgcgccggtcgcgtcgaaggccagataggtgtcttcgattcgcagcccgggccagtgggcgaggcggtgctccaactcgcccgtgtcgaagcggtagccgaaaggacgcgcacggtggtcggcatccagcaacgccgagacagcggggacgtccgcgggtgtggcgcgccgcacggtcacagcgcttcgccggggacggcggcggagcaggaactggatggacacggcggagaagcgacggagcagggtgtagtgcggctggctcacgcgcccgggccgccgccgcacgagcgcgtggagcgcgggggcattggaggccatgacggccgtgaggaaggtgtccacgcccaggcgctgggcgctctcctcgatcatgggcccgtagaagcgcgcgaggccgcggttccggcgcgcggagaaacgggtgcgcaggtctcccaggtagcccacccggcacggacggccctccagccagccatcgcgcacgtgcacggcgcccatgccgtccagccggccgtgctcgccgtggacccagacctccgtctctccacgctgcatggtgtagaggccgaagtagtcgggcgctcgctgtgcggagaggaccaggtctccctgcatgggcaccgtgccgaacaggtcgagcagcgcggtgttgtcgtcacgggtggcgcgtcgaaagttgctcatgcggcggtgacggagtctaccctggccgccgccttttgccgtgagtccctcggctttggcgcgacggtgcttcggggccgtgtccgaaacaccatgtcgctgtgtgtcaggaagtctgctgttgcgtcgcggaagcacgcggcgtgtggattggctgcctcgtgtctgagtctggagttaggctggaggctccccgaaaggagtcacgcgatgaagaagaatggaattgcgatgctgatggcgctgggtgtgggactggcggcgggtttcggaatggcgttcatgccgtccacggccgaggccaacgctcctgagttcacgcagtccgtctgtgagcgcaactcggactgtgaccacttctgtggcgagggattcgggcactgcatccggggcatgtactgcgcgtgcatgtaatggcgagcaggtcctgaagacatcgccaggaagccgccggctccctggcgatgccggacacctcgtccatcaccgcgtgtccaagggccgccgggtcagcagcgcgagcagggcctgccccaccaccaccagcgcgatgaaggcacatgccagcaccgcggcggcggcggggtccgcgtagctctggagttcgaacagcagcgtcccgagcacctcggttcccgcgggtacgagcaggacggacatcgtgatttccgtcgcgcatgcgaggaacgccaggacgaaggctgcggtgagcgccggccgcagcaagggcaggggcgcatccacgaacgcgcgccaggggccggcaccactgacccgcgcggcctcggtgagcgaggcgtccaattgcgcgagcgcctcgtcgctgttgcgcgcgcccagcgcgaggtacttcgccacgtaggcgatgagcagcagccacggcgtgtgtgccagcgcgagcacgaaggcgacgcggtccagcaggatgaagcgcaagtcccgggagaacgcgagcagcagcgccagggccagcaccgtccccggcaccgcgtagggccataccgccagcgcctccacgcccgtgcccaggcggcgcagcccgcgtcgaagcaccgccgccgcgagtcccagcccacacaccaggacacccgcgcccgccgccagcaggacactgcgccccgtggcgtgcaacgtgcgcggctccagcagcacacccgcccagtgcgtcagcgtcaacgtctcccaggtcagcgccgcgccgaagctgcgctggagcgacgtgaggaggatggcccccagcgggaggagcaccagcaccgcggccgtcatgctcaccgcgcccaggacgagcccgcgtgcgcgccccagcgggaagggacgggacgacaggcccttgcccgcgctgaggcggacgcggccggcacggcccagcgcccaggtcaccagcatcgccatgggggcgagcagcagcagcgacgtcgccagttgcgcggcgcgcgccaggccctcgtcaccgcccatcagcaccagttcatagatgcgcgtggtgagcacccgcgtgggcggtgaggccgacacgcccagcaggtacggcacgccgaaggacgaggccgccatgaggaacaccatcaccgcgcccgacagcagggagggcagcgccagcggcagcgtcgtcgtcagcagcgcccgaagcgtcgaagctccgcagacgcgcgcggcttcctccaccgccgggtccacgcgccgcagggccgccgcacccgccagcagcaccagcgggaggcccgacacgccctccacgaaggcgatgcccgcggggccgtagatgtcgaaggtgtcatcgccgagcagccggttgaggtaccccgcgcgggggctcgcgagcgacagccagcccatgccccagatgaacgcgggcacggcggagggcagggtgaacagcaccgtgaaggccccgcgcaggggcaggtcggtgcgttgcagcaccagcgccagcggcgctcccaggacgaaggccagcaccgccgcgcccgtggcgatgagcagcgtgttccccagcgctccaccttcggcgagcagccagtccaagccgcccgtcccggagtggcccaggcctcgccagagcagcgcggccaccgggagcacggagaagcagagcaccggcaccaaccacaggccgagccccagccactgggatttgggcgccgccgcgctcattgggagaaggcctggcggaagcgctccttcacggcgccgccctgtgtgagcccgcgttcgagcaactcgggcgtccatgggcgcgcgcgctccagcaactccgagacaccggcctctccccgagggcccgcgagcctggggtccaccgcgtgcatgtctcccttctccacgatgatgcgctggccttcgggcgacagcagcacgtccaccaccgccttcgccgcgacggggttgggcgtcgtcgcgaagagggccgcggggccggggatgacgacggcgccatcggtgggccacaccacctggatgggactgccgcgggcctgggccgcgagcgcgttctccaggagcaacacgcccgcatccgcctcgccgctctccaccttctggagcaccgccgcgttgcctcccgcgacgatggcgcctcgctggcgcagcccggggaagaaggacgcgccgtacttcgcgtcgcagaacacggcccaggtgaaggcggtgcccgacgtcagtggatctccaatcgccacgcgtcccgtccacggaccttccgcgagcgccgcgaaggaggtgggcggcggtggcccgccctgccggtgcaccaggaccatggtggacaggcgcagggccgcgtagcgcgcgtccaggtccaccagggcgcggggcacccggagcacgttgggcgaggcgtagcggagcagggcgccttcacgggccagccgctcgtagaggaacgggtccgacgtggccagcaggtccgcgcggatggccccggcggcgcgctccgcctccagccggctggccaccttctcactgcccgcctgataccaatgcacccggacgtccgggagccgcgccttcagcagcggctccagcgcgtccaggacgtgccggtacatggacgtgtagacccagacgtctccggagggcgtgccctcgcgcgccagcgtgggcccggccgagggcgcggcggactcgatgcggcaggcggcgagcaggacgagcgcggtggcgacccccgcggcccggagcagcatgggcagggacatgtccccgcgattatgcggcacgcgcgcgccctgtcacgcggcgcggccgtcacgcatcggaaacgagaagcccctccgcgcaccgggcacggaggggccgctcgtctgaccgaggacctacttgcaggagcgtgggtccatggcgtcaatccagtcggagatgagtcgtgagccctggtcgtggcgaagcacgcggcccagctccggcatcatcttccccgactcctcggtgtgcatgcggtaccagaggatggacaccgaatggctgccggggacgatgtcgaactcaccgcccacgccaccgcccgcggagcccggccgcttgcacacgcccaacgtgaactcctccgtgttgtccacgttgaggaacagccggctggtggtgcccgccgtccccttggggttgtggcaatgcgcgcagttgatgtccaggtaggtgcgcgcgcgctgctccagcgtgccgtcctccgcgttgaacgcgttcggcgcgcggggaacctggttgaccggaggcagccccgtcagccggcccaggttggccaggtgctgaagctggttgatgggcccgtcgccatagtcatggtcctggttgaggtagcgggccttcacgccaatgggcagcagcacctggttctcctgtgcgtcctggagatggtggcacttcaggcactggttcttgctgggcaccaggtagtccagcgtccgctccacgccgtcctcgccaatgaagcgcacgccgcggacgacgcggccgccgttggccagcgtggcctccgtctgggcttcgttccagaagtagggaaaggcctcccagcccccgggcctgtgcaccagcacgcgcgtttcgatggcgcgcacgttctcttccgggacgcggaggtccgcggggaaggagaacgtcttggtgatgatggtgcccaccggcaggtccagcacgtcgttggccgagtacccggcctgcgcgtccggcgggatgtacagcgtgcgcgacttcaccgagtagtcggagaagagcggcgtggtcagctcataggggatgttcccctccaccggctggagcccacccgtcgcgggtgtcccggtgaagaggccgaagcccgacagggtgttgggcggaaacgcaggcccggcgtctggcgtccccgcgtcctcgttcgtccccgcgtcctctggggtgccggcgtcctcgcccgcgtcacccgtgcccgcgtccggggtgccgctgtcctcgggcgggagcccggagtcgaccgtggagccgcctccgccgtccggggtcggctccacgccgccctcgtcacccgagcacgaggccagcgccgcggtcaccagcatcgcggcgaggcccagtcctgggatgaacggcctgtacatgcgtccgttcttcacgatgtctcagcggatggtcagggccggggtgaagcccgagcagttgtagggctcggcgccctgggcatagcggcgcgtctctccccaggcggcggccgcgttttcgggggtggggcccgccgagaggtggccaccgacggcctgcaggtcgaagtccaccaccgaggcctgcgctccctctggcagcgtgttgcgggtgaagcagatgttgatggggttggccaggctctcatcgcgaggcgccgggtcgacgccgtcccacagcacgtgctccacgcccgtcacgccgtgggccgcggcgccgtactggtagacggcgcccaccagcgcgcccagcggacggcgctccgggtccggcgtgccgttgtccaccattcggccgctgccaccggtgaaggtgttgtcgtggatggagatgtcctggctggggtagttgaagaagccggccgcccactggacggggtcgggctcgatggccagaccgctgaggatggcgatgtccaccgtgttgttgttgccccacgtgttgcgctccatctccacccggcgcgacgccaggatgaaggtgccggtgccggccgggacctgggacacggtgctgctgctggcctccacggaggcgaagttggggcggttgttcccggtgatggtgttgtgggcgacgtagatgtccgtgccccggatggggttgcccggcaggtcgaacacgaccaggcccgtggtgttgtcctcggcgacgttgttcgtgacgtgggcgtacttcgtgttctcgatttcgatgcccgccacgttcttcttcgccacgttccgccggacgatggtgtgctgcgtctgaccgacgtagatacccgcgtcggcggcgttgtacgcctcagagtcctcgacgaggacgtacgtcgatttcacggggtagatgccgtacttgccgttgctctgctggttctcctgggcccactcggtgcggatgcgctggatgttcacgttggtggaggactcgatgcgcaggccatccttcttcgcgttccagacggccaggtcgctcaccgtgaagagcttgctcaccacgtcgaagccgttggtgttcgccgcagcgtgcgtgaagtccagcacggtgctggactcgccgccggtggcctcgccctgggtgcccttgcccgcgcccttgacggtgatgccgttggcgcggatggtgatggcgttgtcgaactggaaggtgcccgcgcccaggttgatggtggtgcaatcgtccagcgcgttcaccgcgtcctggaggtcctgctcctggcccgggttgaacgtcagctcggtctgctccttgccttcgcaggagaattcctgcggccaggccatggggccgccggcgtccggggtgcccgcgtcactgcctgcatcactgcccgcgtcgctgcctgcgtccgcgggcatgccagagtccggctggcccgcatctggacggtcatcgccgtcatccgaacatgcgggaaggacaatcaggcccacgagggcaagaagcacggcacggggcgcgcgcgacagcggcagaggatgcatcaggtatctcctgtggaagtgctgcgcctgctggcttctgagcacgatgctccagggcgcggaccggaatgcgaatcctccccgtgaagatgaacaacctcaagggtgagacatcgaaaaacagccacccttccgtgacgcgatgcgttctgcaacacgattgataaattgctccaacccttcatgagaggtcgacgcggtgctgccttacttccccttcgagcaggatgtcttttcaatgtcgctgggcgtgcgtgcgctgaggcccgaagagacactcattgaagtagacgcgccgcgctatgcggacgaagtggcattgaaggcggcgctgctgacggcggggcacgccgagcgcttccagggagggcccggaacagaggaactccaatgggagacgttgacggtgctgctgcctgccatggcgcgtcaatcgccggagcacttctcgctggaggtggatggcacgcgctggtgctggcacaaccgcctgctgggaacgcggacggacttcacgccgggggacgcggcgagcctgccgctggcgccgctggactggtttggccggcaggttcaggaggacctgctgctgctggccggcacgcatgagggtttcccgctagtggcgggccagttgtgtttcccttccgggtggtgcttgggggacaagctgggccggtcgctgctggccgtccacgagccggtgccccagttcaacgcgaagctggggccctccacgctgaagttgatggagggcctgaagcccgggcgccccgtcacgcgctgcaactgggccatcagcgtcacggagcggctggacctggagccgcgcacgctgccggagtggcggcacttgttcgacggcatcaccccggacaatgcgggcgagcgctgcttcctccgcctggagcgtcagacgctcacccggctgccccgcacgcgcgccatcctcttcaccatccacacctacgtggccccggtggcctcggaagtggaagcgcccggtcggcggcagcggctggcccgcgtgctgcgcaccgtgcccgccgacaccgcggcctacaagcgcatcacgcccgtgctggcgccgctgctgggctacctggaggcgggcgaggctgacgccgggtggaacgggtaatgaaaaaccccacctcctggaaaggacacgaggtcgccctgggggcgggcggggtgtcgctcaggaacggggacgcttccggggtgccgtcgaaccggaagtcaggccatttctgtagtaagtcgcccctcagaactgactgcggcgatgtctcactgccgctccaaaaagcaaggaagggcaacgacatgcagaagacgtggctggtcgcgggaatgctggtgctggcgggctgccagcagcagggcaagacggattcgacgccggcggcgacggcgacggcgcccggcgcgagcgcgaatccgcagacggaggaccagaagacgctgtacgcgctcggcctgtccattggccgcagcgtgagcgtgttcgacatgactcccgaggagctggagtacgtcaaggcgggcatcaccgcgcaggtgaagggcgacaagcccgcggtggagctggagacgtacggcccgaagctgcaggagctggcgcgcgcgcgcagcacccgcaaggcggaggctgagaaggagaaggcgaaggcgttcctggagacggcctcgaaggaagagggcgcccagaagacggagtccggcctcatctacaaggagctgaccgccggtacgggcgcgtcgccccaggcgtcggacatcgtgaaggtgcactaccgtggcacgctgccggacggcaccgagttcgacagctcgcacaagcgtggcgagcccacgcagttcccgctccagggcgtcatcaagtgctggaccgagggcgtgcagaagatgaaagtgggcggcaaggccaagctcgtgtgcccgtccgacatcgcctacggtgaccgcggcgcgccgccgaacatcccgggtggcgccgccctggtgttcgaggtggagctgctggagatcgtcaagccgccggagatgccggccatgggcggcacgccgccggcgggcaagccctccgcggccgagaagaagtagtcaccgtcttcacgcaggacgcccagggggctggcggggattcttccctcccagccctcttcgcgttcacgggcaccggagtggcggaggggcgctgcctcggggtagtccacctgtctccagcgtctccgcatcggggacgggccaacacccacggaggtcgacacatcatgcgccagggcctgctgttgatgatgggagcgctgctgctgagcgcctgcgtccagggccgttcccgggaagtgctccgcgagccgtccgccacgggcgctgtctccgaatcggagttcaaggcgctgcacacgctgcgcgaggacgcgccgccagcgcccaagggccaggaggtggaggtggccggcacgaaggcctacctgagcctgccccagggcgcccaggggccgctgcccgccgtcatcgtcatccatgagtggtgggggctcaatgaccacatccgccactggacggaccggctggccgcggagggctacgccgcgctggcggtggacctgtatggcggcaaggtggccacctcgcgggatgaggcgctggcgctgctgaaggccgtggacccggcgcgcgcgcaggagacgctgacggccgcgcacaccttccttcagcaggacgcgcgggtgcaggcgccgcgcacgggcaccatcggctggtgcttcgggggcggctggtcactgcacgcggccatggccatgccggagctggacgctgcggtcctctactacggcaacccggtgacggaggcgcgggagctcgccgccatccgcgcgccggtgctgggcatcttcggcacgaaggacccgtccatccccctggagacggtgcaggccttccggcaggccttggatgatgcgggtgtgcggcactacatcctggagttcgaagcggagcacgccttcgccaacccgtcgagtgagcgctacgacgcgcaggccgccgcgggtgcctggcagcaggtggcggccttcctggaccagcacctgcgtcagtaggggcgctggcccacgtagttgcccggcggcgcgtagttgcacacccagagcgtccacttggggaactgggaaccgaagggcgagtccttcgtgcactcctggacggcgcagcccagggcccgcgtgttgcgccacaccacctgggtgtagtggccgcagaccttgccgctcgcgcaggtgttggcggcgtggtcgtagtgggcggcctcgtccacccagccctgcaccacgccctgggcgcccatggcgctggacgatgccgcggtgaggttctcccccaggttgccgcgattcgggttgtgcgagaactggcacttcgcggcgtaggccttcgccgtgcgcgtcgcctgctcgtcccacgtcaggtcctccaacgcgggggaggccgcgggcgacacgttcctccgcgcggcgttgtgcgcggccagcatgtcgcggtcgaactgcgtcatgaccagcggctcggtgtcgctgtcttcctctccaggtgtgtcggagccacagccggtgaggagcagggggatgagcaggccaagcggtcgaagatggcggggcgtggggcggagcatggggggattatccgccgccaggcggagggccgtcacctcccgccgcgtgagtgtccgtcacccgggacacaccggccccgtggggcgcgctcagtagggccgttgacccacccagttgcccggcggcgcgtagttgcacacccagagctgccaggtaggaaacttcgcgccgaacggtgagttcttgttgcacatcaccgtggcgcaccccacggccgccgtcttgcgccacaccacctgcgtgtagtgcccgcacaccttgcccttctggcaggtgttgcgccggtagtcgtagtccgcggcttcgtccgcccagctcttcaccacctgggacgtcgtccacgcgccgggcgtggcggcggcgaggttctctccgaagtcgccccggtccgggttgtgctcgaacttgcaggccttcgcccaggacgcggccttgcgctcggcctgggtggaccaggccagcggcggcagcgcgggcttgggtgcgggctgggcccgggagcgcgccaggttgtgcgcggccaccatgtcccgggagaagtcattcgcatcggggagggccgcgcgtggctccttcggcttcgcggacgcggcgggctgccgggtggccacggcctgccgggaggtggcgttctgtcgccgcccctgttgggtgcctccgctcccgcagccgagcagcggcggcagcaggagcaaggcggaccagcggtaggcgcgggagaaggaaggcatgagggggatgatgcgccaggacgcccgctcatgcatgtgaagcgtgcgcggcggggcattgcgtgcggtgggccgcccgctcgcacgctccgccgcgcacgggaatgccggcgctacacaaggcccggcagcgggcccgtcccgtcgtcaccgaaggtggtgacgttgggcacgcccatggcctgcatcaggtagatgtacaggttggccagcgggtcctgctggtagacgatgtgccggcccggcgtgagcgcgccgccgcccttgcccgccaggatgatgggcaggttgacgtggttgtgagagtccccgtcgccgatttcgctggagaagtagaccatcgagttgtcgagcatcgacaggccgttggcctcgatgaccgacttcatgcgctccagcaggtactggaggagcgtcacctcccacttgtcgatggtggcgagcgcgttgtagttggactgcgacttctggtggtgtgagtacgtgtggtgtgcgccgctgagccccaggaaggggtagaccttgttggcacgcgcgttggccagcatgaaggtggccacccgggtgaggtcacactggaaggcgaggatgatgaggtccatcatcgccttggtcttcgccgtcgggtcctcggacacgatgggcgcggctcccgaagcgcaggccatggatgggacggacacgtcctccacctgcttctccaactcccgcacgctggtgaagtactcatccagcttctgcaggtccgaggtgcccaactggcccttcagcgcggtggcgtcatcgcgcacgacgtcgatgatgctcttgccgtacgcgcgccgcttctcgatttgtgcctgcgtctctccggggatgccgcccgcgaagagccggttgaacgcggcctgcgcgttggtctccttggccaccggtgttcgaggccccgaccacgcgatgttgttggcatacgggcacgcgtagccggagtcgcagttgccgatgccgcggcccgcgtcgatgcccagctccatggagccatagcgggtggcccgcgtcgccgtcatgtggttggcgatgacctggtccatggagatgcccacgcggaggttggtgccctccgtcttgtacaccttggcgcaggacaggaacgcgccggtggcggcggcatggtgcccgtcaccatccgggaaggcgggctggttcgccaggccggtgacgaccagcaggtcgttcttcaccgccgccaggggttccagcgtgggcgtcagctcccacgcggggccctctatcttgggtgtccacttctgcatgtggatgccgttgggcgtgtagaagacggccagtctgcggggcacggtgcccggcgcgccatgcgcgttgcggggaatcatctgctccaacaggggcagcgccatcagcgcccccgttccccgcaagacggtccgtcgcgagagtctgaatttcttgctcatggcgtctgctcctcctccgcgccacgctgcgtgaagtggctgctcgagacgatgctgaggatgtagtcgacgagtcgcccaccgcgggcctcggccttgtcggcgacatccttcaccgcgcagtggtcggcctcgtccaggccacggcccgtggcataggtgagcatgtgctcggtgatgcagttggtcagcttcgggtcctccttcaggtaggtctgcatgtcgcgcaccccgttgaggatggcgccgtcgggcaggtcacccgtggcgtccacgggcgcgccgctcacctcctggaggcgccagcggccaatggggtcgaagttctccatcgccagccccagcgggtccatcagccggtggcagccctggcacgccggcgcgctgcgatggagcgccatgcgctccttcatcgtcatgtccggcgtgatgggcggcggcaggttctccacgtccggtggcggtggcggcggcgccgagcacagcaactgctccaacacccagacgccgcgctgcaccggtgaggtgcggtccgggttggacgtgacgatgagcagcgagcccttgccgaagatgccgctgcgctccgggtggcccgtgagctccacgcgtttgtgcgtggggctgccgggcaatggcaggccgtagtgggcggccagttggtcgttcacataggtgaacggcgcgtcgatgaggtccttcagcttgtggtcgccggagatgaactccgcgaagaagagctccgtctccgtgcgcatggcggcgcgcagctcctcgttgaacgcgccatagagcgtgccgtccggcacggcggtacccagcgcgcgggtgaagagccactggccggcgaagttctccaccagcgcgcgtgccttcgggtccgcgagcatgcgccgcacctgggcctccatctccgcggggtcgctcagcttccccgcttcggcggcggcgaacagcgcgtcgtccggcatgctgctccacaggaagtaggagagcctgctggccagctcgaagttgtcgagcgtgtacggttcggtgcttcctggcggcgcgttcttctccacccggaagaggaaatgcggtgagacgagcaccgagcgcagggccagcttcacgcccaccacgggcgggtccgcgtgctggctcgacaggttgacaaaggtcatcagcttgtcgacctcttcctgctgcaccggccggcgccaggcgcggcgggcgaagtcggagaggatttcgtgcgcgcacggcgcagggttgagcgggtccagcgcgcaggcgttgaaggcgccgcgcgtccaggcgtcattcaccagccgctccgccgcggcggagtacttctccatcaacagcggcgacagcgagagcacgtcggcgatgttgtcgaagccgtagccgtggtcgtcgatagggaagtcattggccggctgggtggtgtctcccagcaggtcccgcacggtggcgttgtattccgcgcggttgaggcggtggagcgtgacgcgccccggtttctggggtgcgttctcgcactcgcctgcgaccgggggctgccccggtggaacaggttctcctggtatctcctcgtcgggtttgacccgggccattgggccgtcatcggtgcagctggtcaccagcagggcgagacttgcgcccgcaaggaagagccagccccctcttcgtcgatgcatgggtgtcacgtcggctacccccctccacactgccccatccgaagccgggacagcagaagccgtagcaatgtgcactccacccaggcacgtggccttttggacctctccgttgtttcagggggcaggatggcgttggctacccggaagcgcgctgggaagagattggcgcgaatgggtagcgaggttcccggcgagggaacctcggacgaacgcagcctgcggcgtgcaagctgcgttcgcgtggatgccgcgggctccttactttgcgtcgaggtacgcgcggtacgcgtcgaagccgtactcgcgcccgaggaagtccttcaccagctccgcggcgggcttggagccgccgggctccagcacggtgcggcggtacttcatcgccgtctcccggtcgaggaagcccttcttctggaactcggtctccaggtccttcgcgatgacggaggaccagagatacgtgtagtacgccgccgagtagccatccaggtgcccgaaggccacctcgaagtgcgtgccgtcgcggtgctcatgcttgaaggggctgagccgggtctgcagggcaaccagggcctcggtcgtgtcgaagcccggcgctcgcgagtagtagtccaggctcaccgcggacaggaacaactgccgccgcgcccacaggccctggccgaactccttcgacgcgcggagcttctccaccatctccgcggggatgggctggttcgtctcgtggtgcttcgcgaactccttcagcacctccgggttgcccgcccactgctggagcagcatggacggcgtctccacgaagtcccactccacgcgggtgcccgcgatgcccgcccacttcaggtgcccgccgaagatggcgtgcagcaggtggccgaactcgtggaagaaggtctccacctcgtcgtgcgtcatcagctcgccggggcgcgcgaagttgcacaccagcgaggcctccgggtagcgcttgccggcctggcccgcgacgagatcgaactgcgccgcgtgcttgtacttgtcgtcacgtggatgcatgtccaggtagatgcggcccagcagcgtgtcgccgtcgaacacgtcgtaggtctccacctcctgctgccacacccgggcgtccttcaccggcttgtaggtgatgccccagatgcgcgaggtgatgtccatcacccccgccttcacccggccgtactcgaagtagggccggaccgcctgcgagtcgaagctgaagcgctccgcgcgcagccggtcctcgtagaagtcctggtcccagggctccagcaccttggctcccttgacgtccttctgcttgcgggccaggagctgcgcgtactcctgcttcgcgcgggcctcggtggccatgcccagccggtcgatgaagtccgcggccacctgctgcgtgcgcgtcatcttgtcctcggtcgcgtaggccgcccagttccggtagcccagcagcgtggccagctcgttccggcgggacaccatgcgctgcaggacgtccgcgttggcggggtggccgcgctggcggaacacgcgccacatctgctcgcgggcctgggcatcccgcgagtacgtcatgaaggggacgatgtccgggtagtccgtggtgatgcgcaccttgccgtccggcccgggcggatgggcgcgcacgtagtcgtcgggcaggccctccagcgcggacggagacagcgcctccgtgcgcgtgtcctggcggatgttgcgactgaactcctgaccgatgcggaccagctcctcctggagcgccttcacccgagcgcgggtggcgtcatcccggtccacgcccgcgcggcggaactcccgccgcaccttctccatccacttcctcgtggcggcgtcctcgccggacaagtccagcgcggccagcacgtcatagacgccccggtccatgcggatgtcgttgctgagcgtctccagggcctgctcggcggcctcggcggcctcgcgcatggcggcgtccgggtgcgcatggcgggcgacgctggcgcgggctcccgcatcgtcgagcgctgccgtggcctcgtcgtagatctccagcacctcgcgcgtgacgtagggggggcggagggccttgagctgggcgattcccgctcgggcggcggccatggcctcctcaccggcacgcgtgaattcggccggtgggcaggtgacgaggcgggcggcgtcggggacttggctctctgacacaatctgctcctggacgtgatgacggcgaatatacggccgcaaaggtaatgcgccggacgccggggagcagcagggattggcggcggaaatgcgagaggccgcccggcgcatgcacgcccggcggcctccgtgggaaacccggtgcttccagcccggctacggctgctctaccgggctctgggagttctgtggctgacggatggcccgggtgacgaagtccgcgctgttgttgttcgagtcccagccgttgccgaaggacgcatcagcactgccatccgccatggtggcaggggtcgaggtgctcagggccttccgctccaggcttccgcccaccgcggggtgagagggcgcggcggtgccttcgggcgagttcccggtgccccacgcaaccttgtctaccgccacgtcattgacggcggtcgtcagcccaggaccgatacgaacatggccaccagccgtcgtggacgacgagacgtcgaacgaatagcccagatcccgcgccacggggccgctgtagttgccgccccccagcaggaagtacccgtgggcgcggatgacagtcccggaggggatggtgacggtgccggagtacgaaggccctgtcgcagacctgtactgcaccagccagccgccgatgttcacgtcggcgttcgtcgggttgtagagttcgatgaactcatcggtcgccgcggcaccgcctccgttgccgccactcacctcgctgatgacgacgtgattggccacggctggcggcggaaccaccgtcaccgtgccgtaattgcccgtgcttccctccgcgacgacgccgtcctggtcgcagtacacccacgcctgggccgccgcgggcccctgggtgaaacggtagcggaagccgtagatgtagttgcccggcgccgcgatgttcagcggagccacccgctcatcgtcgttgcccggcgtggcgaagcccgcgttcggctccgccgtcacccacgtccacgaggcaggtgacgaggcatcggttccgtagcccagctccgccacgaggtgcgggaagccgtcgttgccgttctggttccgagtgctcacctggggctcatagaactggctgtagacagactccgcgcggcccgcccggatgggggtagcgaaggacttcggatactgaatggcgcagtggtccaccgggccggtgatctccacaccgcaggacgcgttggcgccgcccggcgtgccccgtccaccgccaggaagcacttcctccgagtcacaccagtaccaggcgtgctggctggcccgcgtgcccaccaccacggacgacaggttcatcgagcgccccgtcgtctgcgggaaggaggccgagtacgccacgtcatccaccacggtggcgcccatctcgacgaagaggtgccccgagtggccaagctcgaagagcgtgctcccgtagccgtactgcgccaccacgccgccgttggtggcctcatccgtgttgctcgcgaggacgaaggtgccccggcccgggacgacgagcggccggtccccggtcgtcagcacgctgaagtccgtctcaccgcccgcgccattgtcgaagcggatgcgcaggttcgcgatgtcccgcggtccgtcgacggtgctggtcagctcgatgtactcggtggtgttcgcgtccgggcggtgcatcacctcgctgatgaccaactcacccgccacgggcgcaggcgccgtgtcacacgcccccgcgacacagacgccgtcctgccccgggcagacctccggggtggccgtgtactggcactccgccaggcccgccgtcaccacgcacgcttccgcgtacgccacacgctgcacaccgtcctcgtcacactccggcgcgcgcggcgcgcagacgatatcgccgcaggggcccggcaccgagatggagacgaacgccacggtgctgccgttgttcgagccgtcgaagacgcggagcgcgaagtaccaggtggccgcctgggacggcggcagcgcgtgaatcacttcctccgcctgtcccggcgcccgtggcgccgccgtgggcacctcgctggcgagcgcgaagctctgcgggtccatgggccccgcgctgtagcgcagctcgtagcgcgcggcgttgcccacgacgccgttgtctcccgtggccagccacgtcaggcgaaccgtcgtgttgtccaccaggctggcgttcagaacgggctcggcgggcgcgacgtcgtcggtgatggtgaccatcgtgtcgacggacggcagcgacgggttctccgtggtcgcggagaggacgaagctgcccgcctggtccaccgtgaggtcgctgaagacggccacgcccgcctccggcgccaccgtcaaggtgccgcccagcgtcaccccgaccgcccccaccaactggagcgtcacggacggcgccgtgacgttcgagacgttgccgaacgcatcctgcaaggccacccgcgtctcggacagcggctccaggacggtgcccggctccggaggcgcgacgaacgcgagctgcacgggcgcgcccgcctccacggtgaagtcagacgtaccggacaccggggcatcgccgtccgtgaacgtcaccgactgcgctcccgccgtctcgaaggtgatggtgaaggtgtgcgctccctggtccgccgcagtgtacacgtgcgccgacaggggcgcagcctccgggtccgtggacgcgggcgccaccgttccctggtacgccgtcagcacgttgccgaagcggtcacgcgcggagacggtgaaggattgaggctcgcccgcgacgatggacttcgtcggccccgctaccgacaacgccgcgaggagcccgggctgcaccgtcacagaggcattcccagtcaacgtcgccgtcgtggtgtccgtgacgacgagctgccccgtgcccactgtggcgaactccacattgaagaggcgctgaccggcgtccaactcggtgaaggtgtagtccgaaggcacggtggcctgggcgtcccctggaatctcgaagtggacggtgccccggtagcccgaggcgaggttgccgtggacatcccgcaccgacacggtggcccccacgggctcgcccgcgcgggtcgtcgatgagtccaactgcaccgtcaactgcacagcgggaccagacaggacctgggtgttcagcgccgcctccagccccgtgttgccctcctcccgcaccgtcaccgagcgcgcgccggaggtcaccagcgtcaccgagaacgtgcgctgccccgcgtcctgcccgggaacgaaggtgtagttcgcgggcagcgtcgcctcagggtcactcgattcgaactgcaccgtgcccgtgtagcccgtgacgatgttgccgaaaccgtcgcgcgcgatgacggtgaggctctgcgcctcgccggcctccacttcggcgggaagcgcgctcagcaccaactcagcggccgcaccggtgctcacctccacatcgagcgtgtcggtcagctccggccgtgccgtgtccaccacggcgacgctctgaggcccagaggtcagcagcctcacgccgctgaaggtccgctggcccgcatccgccacggtgaacgtgtagtcgcccggcagctccgcctcggcgtcagtggacgagaaacgcaccgcgccggtgtagcccgtggccacgttgtcgaaggcgtcatgggccgtcaccacgacgctgcccccggcgcccgcggccaccggcgagaccaggcccgcgagcgacaaccggacggcgtcgcccggcgcgatggtgaacgcgtcgctgggcaccggatccaaccccgtggccgacgcgacgaagcggtgcgttcccgcctgctccaccaccacgcccgagaaagtcgccacgcccgcgaccgccgccacctgcaagggtgtgaagtcgggctcgtcctccagcgtgagcgtcaccggcgacgtggccgtcgtgacgacctctccatcctcatccaacagcgagacgcggagctccggttgcgtatcgcccgcgtccccatccacgggctgctgggagaagacgagccgcgtgacgccctgcacctgcgtctgcaccatcaagctggaggagcggaccgcgttgtcctggttgtccgccacgcgcagcgccacgtagtagttcgtgccgggctgaaggcccgtgagaacggcggactcctgcgtgccagcctccgcgggctcgcccaggccgcccaccggcgtcgcctggttgaagtccgcatccgtctcaatcgggttcagcgagtaacgcagggcatgcgacgcggcccgcccctggtcgccgtcatcacccaccgccgtccaggacaccgtaacgctgtcgtgcgtggccgcggtcgcggcgaggacagggatggcggggaacacgttatcgatgatgtcgatgtccgtgctcgtggcgggcgtcagtccatccgcagtggcctgaagctggaagcggccctccgtgtccacgtgcacgctggagaacgacgccagcccctccatgggcgccacctcggtgacaccacgcagtggcgcgccacccgccggcacgagggacagcgtcaccgaaggtgcacccacgggcgtccggttgccatgcgcatcctggagcaccacctccacggcggtcagcgcggcgcgaacggacgcatgcgagggcacgcgcgcgaaagccaatgccgaggtccggtccgccgagacgcgcacgtcctggcgccccgccaggcccgcttgcgcggcgtcctgcacgtcgacacgctgggtgcccgcccgccgcagggtgatgcccgtgaaacggaagcggcccgcgttcacctccgtgaaggtgtgcccgcccggcagcgtggccgtggcgtccgaggactgcacgctcagcgtgccgcgatagccactggcgacgttgccgaacgcgtcacgcaccgtcacctccgcatcatgcgtggagcccgcgatggcggtctgcggcagccccgtcacctcgacagtggcggcggcggccggcgtcacgtcgaacgaagggctgaccgcgccctcgacgccggtggcctcggccttgagttgatagcccaggcccgcgcgcatcagcaccacttcctggaagcgggcgacgccgtccacggcctgagcccggagcgtgcctcccagggaagccccacccgggccagcggccagcgacagcgtcacctcccccgtgacggacgaaaccgggcggccgtcagcgtcccggaactcgacgtccagcccgccaatgggtgcaccggctcgggccgacagcgaggccgccgcgaaggccagcctcgtggcccgcagcgcggtgaagccgacgacgggacgcgagcccagcaccaccgcgcctccctcggcatccaccgaggccgtcacccgcttcgagccgcctcgcgtggacaccacggacgcggtggccacgccctgggcattcgtccggtccgcgggctgcgtcacggtgttcccgtcgccggagacctccacccgcaccgtgcggccctccatgggagcgccgtccttctgccgcaccgtcacggtgatggtgacccggtccacgccgtccgccagcacctgctccacccggtccacctgcaccgtggagagcgccgcgtcgggcagagacttcgctagcggcgggagcggcgacgtggcgctgtcaccacaccccaccagcacaacgccgaggcacagcacgcccaaccctagcaaccgggtgagcgcgagaggacaacgggacatgagaggctccgggaacgaacggaccccgcacggaagagagcactcgcgaggtcccagtgccttctaccagacaagtcccttcaccacgtagacctccaccagagctttgcatcccgggtggaacccacggggctatcatgacccatgccccgttgagtgcgtccccgttacatgccgagcgcggccatgagcgcgccgccgcccagcagggactggccaccgtcgcagaccatgatggagccggtgatgtaggacgagccttccgacgccaggaagagcgcgagctgggcgatgtcctgcttcttcccgaaacgctggagcggcagggcctgggcgagcttgtcgcggccctcgtcgctgggggcgagccggcgcatgccttccgtgtcgtcgatggggccgggggtaatcgcgttgacgcgcacaccggagccaccccattcaatggccagcacgcgggtgagcatgtccacgccggccttggcggcacagacgtgggcctgcatggccatggggagatacgcctggggcgcggagatgttgatgagggacgcgcccggcttgcgcaggtgctcgaaggcggcgcggctgatgttgaaggtgcccagcacgtcgatgtccatgacggtcttgaagccgttggaggacatgcccagcgcgggcgcggggaagttgccggcggcgccacacacgacgacgtccagctcaccgtaggcctcgcgcaccgtctggagggccttctccaccgcggcatagtcccggacgtcggcggccacgcccatggcggtgccgtgcgcctgaagccccttcaccgcggcctcgagcttctccacgttgcggccgttgatggccaccttggcgcccgccttcacgaaggactcggcgatgcctaggttgatgccactgctgccgccagaaatgaacgccaccttgcccgcgagcagcccgtcccggaacacgccatcagccatttggacccgtctcctgtggaagcaaccgggcagggacttgaacaaacctgccgcactgcgtccatgacgttcgccggacggacagcggaacccggggccgtgtgttagaggtcgcgccatgacccgccgccgccccgaaatcctcgcccccgctggggacctcgactcgatgaaggccgcgctcgccagtggcgcggacgccatctatttcggattggacgaagggttcaacgcacgcgcacgcgcggagaacttctcgctcgccaccctgccggagacgctggcgctcgtgcaccgcgccggcgcccgcgcctatctgacgctgaacaccctggtcttcgagcccgagctcccggtggtggagaacatccttcgccgcatcgccgaagccggcgtggacgcgctcatcgtccaggaccccgcgattgcgctggtggcccgcgcggtgtgtccgcagatggaggtccatgcctccacgcagatgaccatttcgagcgcggaaggcgcgcgcttcgcgaagggcctgggcgccacgcgcgtggtggtgccgcgcgagctgtccgtggcggagattcgccggctggcgtcggagacggacgtggagctggaggtcttcatccacggcgcgctctgcatgtcgtggagcggtcagtgcctcaccagtgaggcgtggggtggacgctccgccaaccggggacagtgcgcgcagtcgtgccggcttccgtacgacctggtggtggatggccagacgcgggagctgggcgacgtgcagtacctgctcagccccaaggacctcgcgggcgtcatggcagtgccgcagctcgtggagattggcgtccactcgctgaagattgaaggccggcagaaggggccgcagtacgtcgccacggcggtgcagggctatcggcgctgggtggacggtgtgtccgcggggacgccggacacgggggcgctgcgcaaggacctggcggacatgacgctgtcgtacagccggggcttctcgcacggcttttttcggggctcggaccaccaaacgttggtggaggggcctttcccgaagcaccggggcgcgtacctgggccgcgtggagtccgtgcacggtcgtgacgtgcgcgtggtggacgacacggagggccgtccctggacgggagggctgggccaggacgacgagaaggcgcgcccggatgcgcccgtgggcaaggtgtcctctccgctggagacggcgacaccggtgccggccgaggtatcgccccgccccggcatgggcgtggtgttcgacgacgggcatcccgaggacaagcacgagcccggcggtccgctgttccgagtagagcgcaagggccgtggctgggtgctgggcttcggcaatcccggtccggacatgggccgggtgaagccgggccagcgcgtctggatgacgagcgacccggccctggcgaagcgcacggaggagctgctggggcgcggcgagcccgaaggccgcgtgcctctggagttgaccgtgacaggcgccgccggttcgccgctgacggtgctgggccgggcgcgcggtggacacgtctattcggtgtccagcgaggtggcgctggccgaggcgcgcggtggtggcatcgacgaagcgctgctgcgggacaagctggcggcgctgggcggaacgcctttcacgctgacggggctggatacgtccgggctcgcggcggggctccatttgccggtgtcggagatgaaggcgctgcggcgccggctggtggcggagctgtcggaagccgtggcgcgcggtccggtgcggaccgtgaacgaaggctccacgctggagtccctgcgcgcgtcgctgcgtgagcgtgtgcagccgacgccccgcgccgtggaggacgtgcgcttgctgccgctgtgccgcacggacgagcagctcgaagcggtgattgccgcggggctgcccgaggtcgagctggactggatggagctggtgggcctgcagcgcgcggtggagcgtgcgcgcgcggcggggctgcgcgtgacgattgccacggtgcgcgtgcagaagccgggcgaggaaggctacgacgcgcgcatcgcgaagctgaagccggacgcggtgctggtgcggcactggggcgcgatgatgcacttcctggagcgcccgcccgcgcatggggagacgcgccctgccctgcacgcggacttctcgctcaacgtcaccaactccgtgacagcactgcacttgctggggctcgggctggacacgctgacgttcgcgcatgacctggacgcggtgcagttgggggccatgctggagcacctgccggcggagcgcttcacggtgacggtgcatcaccacatctccacgttccacaccgagcactgtgtgtattcccacacgctgtcccacgggcgtgactaccggagctgtggtcgtccgtgtgagaagcaccgcgtgtccctgagggaccacaagggtctggagcacccggtggtggtggacgtggggtgccggaacacggtgttcaacgcgcaggcgcagagcgcggcgtcgctcgtgccgtcgctgctcgcgaggggcgtgcggcgcttccgggtggagttcgtgcgcgagtcccgcgaggaggcttcgcgcgtgctctccgcgtaccaggagctgctggccggtcgcatctcccctgcggaggccgtgcgccgcgcggcggtgcatgaacaattcggcgtgacgaagggcacgatgaaggtgctcaaccccaccttcaccgtgcagcgctgacgctgaagcccaccgcgttcagcgggagcccgtgggcacggcgcgacgtgaaaagcgcaggacggcgcggaacacgtcttccgtgtcgtccgcgtccatgccctgctccgcggcccactgacgccgggtctccagcaggctcgcctcgcgctccgcgtctggcagcggaagtccgtgctcggccttcaggtgtgcggcctgctggatgagctgggcgcgacgattcaggagttgaaccagctcacggtccaacgcatccacgcactcccgaacttccgtcagcccgggcggcgcggcgacaggctccggcgcgcccgagcgccccgaatcacagcccaggtggagctgcgtgagggcctccagcagccgcacgcgtgcgtcccgcgcgtagggattctccgactgcacgacgccgaagagatggggcacctccagccgtgcgtactcctccaggcgagccacgggctggaagctgggcggcgcgaagggcaggtcctttccggcctccgccttgagcaacccgtgggccaggaagaaggtgagcacatgcgtgcgcaccatcagcgcgtcgtgcgcatccggcgacagctccgtcacttcacagccgatgcgttcgaacaggacccgggccttgcgcacggcctctgggtgcagttcgttcgggcacaccaccgtgcggcgaggcaggtcgcccctcgccagactggccgggccgaacagcggatgcgtgcccacccagggaatgtcccgccccaacacggaggccagcacctgcacagggcgcaccttgacgcttccgacgtcgagcaccgtctgcgcgggcgacaggcgcgggcgaagctcctccaggaccgagcgcattccagacacgggcatggagagcaccaccagccccgcgccctcgacactctccgcgagcgtcggtgccctcagtgcgtcgggcacgtcatcctggcgcggctcgaacacccgatgcgggatgcccgccaccagcaggaggccagacagggcacggccaaagcggccgtaccccagcagcgcgatgctttccgtcatgtcgccggactccaaatcccaggtgttcctggaattctcgcatcgccagcgcaagcggaggaagcccctcggcccgggggctcagcgcccctgaaagtgaggggggcggcgttccacgaatgcggaaaaggcttcggccaggtcatgggactgaaggaacgcggagttccataccgccacataacgcaggccatccgcgatggatttgtccgcgcagtactccatgacctgcttggcgccctggacgacgagcggggcattctcggcgatgcgcttcgcggtcgctcgggcctcctccagcagggcctccggcgtggggaacacctcgttcaccagccccatgcgcagggcgcgcgccgcgtccacgtcaccaccggtataggccagctcgcgcgtgtggccctcgccgatgatgcgaggcaggcgctggagcgcgcccaggtcggcgacgatgcccaccttcacctcgcgcagggagaacttcgcgtcctgggagcagtaccggaagtcacacgcggcgatgagatccataccgccaccgatgcaccagccgtgcacggcggcgatgacgggcttgcggcagcgggccatgccctcggtggcctgctgcatgtcgccaatcagcgacagcagcttcaagcgctccagggccaggttgctttcgccggtgagcagcggccccagggactccatcatccccatgaggtccaggccgaaggtgaagtgcttgccttcgccgcgaaccagcacgacgcggacggagtcatccgcatccagcgcgcggatggcctcgggcatctcccgccagaagtcgggccccatggcgttgcccttgccagggccggtgagcaccagctcggcgacgccttcattcttctcgatgcgcagcgacttgtaggtcccgtccattcagctcagccctcccggacttcgagttcctcgaacgtcacgccatccagctcgaggtcattcacggcttcgacgaagcgctcactgacgatgacggttgcccagccctgccggtgacgaaagacgtcccggtctcccggcaaagaagctgcgtcgaggacgacggtgcgaggccaggcctgtttgctggcgccgcatgccgggcatggtggttcgcgctctttcggcaggcaggcttgatgcagcagcccatgcaactccagttgtagttggagcagttcgggcggagcctttccacggaaacgcacctcgaccgacgccccttgaagccctcgcacgcccgcggcgttcaatcgctcgaaagcggcccgctgaacaaacaacgtgggtgcgtcctgcatgaagagcgggccgaaacggccagcgcccttcccttcacacggtccgaattgggcccctggctccagcaatgcccacggcggagccattggcgcaatcaacgccctcaagcgcgagaactcctcgcgagagaccggccaggggtcggacagcttcttcaactcgtcgcgaggaaggctggacaggtccacgcacgggtatgcgagccagggagcccctccgcccgcgcggcacacgggacagggatgcacgccaggaagacaccacttgttcaccgcgtccaaggagcccgtgtagcccgacgccgtgtctggatgaactcggtagaacttcaaggttcctcacggagcacggatggacggcgctgcttgatagggcgcgaccggcgcattgtatggcacgacgggccccgtcagctcgaagcggaagatcaactccaccgccttgcggtgcagttcctctgacgtcatcgaacgcccctgctggctgtcccgaaaatcccgccacgcctggttccacataccaccccgacccttgccgctatggagttggcggtggatgtgctcggggatgaggatggtgaacttgtggatgtcgacgccgtgcgacctgaaccacctcgcaagctctggctgttgaggaaacaggtggtgatgcaccaacttgccgggacctctcggcagcgcgggaagaaagccctcccggtaacggaagtggaacgtcatccgtggccgtgaaccggagcgaatcccaaggttccgccagtggcgaaacgagggaactccacgtgtcggtgggcgaaacgctccagccagcaccggcctgaatgcggcctgcgcctcttcctcctgcgcgacgtcctcgcaatcgaacagcccacacgtcccgctttcgcaagcgaggaccacgcaggcaccctcatccgagcgcgcgcactccagggaagaaggaggttcgcttagcgaagcgagcccaggcgccgtcgacgcacaacccaccaacagcaggctcacgagcccagacagcagaagccatccacgacactcaagccccatgggccagccactgtactggcgctggcccatcagccgtcatggaatccggcttttagaaatcagccccggctcagccgaactccaccacccgcatgccgaacaggcggtccaccgcgagcagcaggtcgtcattcacctgcaccttgatggacgtgttgccgatgagcgcctcgccctcgcccttgaagagcacgctcaccgccacgggcgttgcgccggcgtacttcttcgccaactcatgcagcttcgccacccgctcttccgtgagcaggtccgccggcacgcgcagctccagccgcttggtgcgcttctcacgcaccgccttgaggctctggatgtcgtcgacgatgagctccggcgtcggcgtgtcctcgtcacgctggctgatctgcaccgtgcccgacaccaggatggggtcgtccgacttgagcaggtgctcccagttctcgaagcccggcttggggccctgcttcgcccacttgccgtcccggcccatcacgttgcgcgtgccgtccttgcccgggaagcacaccaactcgatggagccggacaagtcctcaatcgtcacccacgccatgcgcttgcccgtcttcgtgggccgctcgcgcagcacggtgacgatgcccgccaccgtgagcttgtcgtccttgcgcgcgcgctgcaccgccgtaatcggccgcgcgtagcgcttcagctccttgtcgtactgatgcagcggatggccggacacgtagaagccaatggcctccttctccagcgacagccgctccttctccgaccagtcctccacctcgacgtagtcgtccttcagtccgccgccccccccatccgaggacggacccgccagcatgccgaacagcgagctctggccagccgccttgtccttctggctggccgagccgcggttcatcgccttctcgatggtgtcgaaaatctgccggcgcgagcgcttctcgaagtcgaaggaccccgccttcaccagcgcttccatcaccttccggttcaccttgcggctgtccacgcgctcgcagaagtcgaacaggctcttgaaggagccatccttgcgcgcctccaggatggactcgatggcgccctcgcccacgcccttgatggcgcccaggccgaagcgaatcttcccgctcaccgcgccgaattccatgtcggactgattcacatccggcggcagcacctcgaggcccgactcgcgcgcctcgccgatgtgcttcaccaccttgtccgtgttgtccttctcgctggagagaagggccgccatgaactcgcaggggtagtgtgccttcagccaggccgtgtggatggtgaccaggccgtaggccgccgagtggctcttgttgaagccgtactcggcgaacttctccatcaggtcgaagatttcaccggcgaccttgaggtcgacgttgttcttcgcgcagccctcgaggaagccggcccgttcggcctgcatgacctcggccttcttcttgcccatggcgcggcgaagcaggtccgcgcggcccagggtgtagccacccaggacctgcgaaatctgcatcacctgctcctggtacacgatgacgccgtaggtgtccttgagcaccggctccagcgcggggtgcgggtacgacaccttctcccggccgtgcttgcggttgatgaagacgtccaccatgccggagtccagcggacccgggcggtagagcgcgccggcggcgatgacgtcttcgaagcagttcggcttgagcttcacgaccatttccgtgaagccgctggactccatctggaagatgccggccgtgtcgcccttggccatcaactcccaggtcttctcgtcgttgagcggaatctcgtgccgcgggatgtccttgccgtggttgcgcttcaccaggtccagcgcgtgctgaatcacggtgagcgtcttcagaccgaggaagtcgaacttcaccaggccggccgcttccacctcgtccttggcgaactgggtgatcagcgtcttttcacccggcggctggtagacgggcacgaactcccacagcggcttgtcggcgatcaccacgcctgcggcgtgcatgccgggctggcgatgcaggccctccagcgcgagcgcgatttcgagcacgtccctggtggtgacgggcttgccctctacctcgccgatgttggagggcgtctccatcatctccttgaggcgaggctccatctcgatggcctccctcaaggtgatgttgagcacctcgggaaccagcttcgcgatgcggtcaccttcgctgaacggcagcgcgaacacgcggcacacgtcgcgcagcacgctcttcgccttgagcgagccgaaggtgatgatctgccccacgttcatctcgccgtacttccggccgacgtactggatgacctcgtcccggcggtcctggcagaagtcgatatcgaagtcgggcatcgacacgcgttccgggttcaggaagcgctcgaacaggaggttgtacgggatggggtccacgtcggtgatgcgcagcgcgtaggccaccaggctgccggcgccggagccacggcccgggcccaccgggatgttcatcttcttcgcccagttgatgaagtcctggacgatgaggaagtagccgcagaaccccatcttctggatgacgccaatctccagcgccagccgcgcctggtactgctcgcggtcgatgggatacgtgacggtggccgccagttcggtgaagcgctcgcgcagaccctcatacgccagctccgccatgtagctgtccggcgtgtggctgtcgggcaccttgaaggtgggcagcatcggcttgcccagcttgagctccaggttgcactgctcggcgatgcgctgggtgttgtggaccgcctcggggatgtccttgaagaactccagcatctccgtggggctggtgacgtagagcttgtccgtggagtgcttcatgcgcttgccgtccgccagcgtcttgccactggcgatgcacatgagcagttcgtgggcgcgcgcgtcctcgcgcttgatgtagtgcgcgtccgcggtggcacacagcgggatgtccaggtcgcgcgagagctgcttgaggttctcgttcgccttgtcctgctccggcatcccgttggactgcacctccaggaagaagtgccccgggtcgaagatgtccttgtactcctgcgcggcgcggcgggcgtggtccatgtcgccgcggaaacacgcgctggtgacttcaccacccaggcacgcggtgagcgcgaacaggcccttgctgtgctcggcgagcaccttcttgtcgatgcgcgggtggtagtagaacccgtgcatgtacgcggtggaggagaggtagcgcaggttggcgtaaccctcctcgttcttcgccaccaggatgaggtggtgggagaccttctcggagcggtcctcacgccccttgggtccggcgacgtacgcctccatgcccagaatcggcttgatgccggcgtccttcgccttcttgtagaagtcgatggcgccgaacatgttgccgtggtccgtcacggcaacgctgctcatccccttctccttcaccgtcttgatgaggtccttcatccggatcgccccatcgaggagcgagtagagggtgtgcaggtggaggtgggtaaaggacatatgcgcgttccgctcctggaggccggggtgccgccgaacactagggccgtgctcccctgctcgccagtccagtgttgcccctggcggagaagcgcgggggaagccggaaaatcggcctcttgcggcgttccgccatgagcggaagccctggacggaacgctaacggcccgcccttcccaccgcccgtctccgtggaaatcacgatgcgtccaaccctcaggcgccgggacgtggcccctggccggtgagcggacgggcggcttcatacttcttcacgcctcgtacaagtcccagcaacggcgggccggcacattgcccaccgtcgccgcgaggggtggcgacttcacgtggagccgtccgcgctccacccaggagaaggccatgatgaagaggttcgccgtcgtcggttccgcgatgctcgccgtcgcgctgctcagcggcttcgcgctgcggggaggcccccgctggggcaaggacccagaacgcgtgaagcaactggtgacgtggaagctcgacgacaagctggacacgctggacgccacggagtcccagcgccagtccatccacgccgtgaaggaccgactgttctccgacggggtgcagctcatgcaggagcaccgcgcggtgcgcgaggaggccttccaacagctcgcgtcggacacgccagaccggcagaagctccacgccctggtggacgcgcgcatcgaggccatgcgcgccttcgctcaccaggcgacagacgccgccctggaggtccacggcacgctgacgccgcagcagcgcaaggcgctggccgaacagttccgcgagcacgtaggcccgtagtccgcgcgcacgccaccgtggcgtcaggacaggtggggtgtgtgcttgcgggaaagggtgggcggggcggcggagcacggctagtttaggtgcgtgaattacaccgactacgcaaagcggatccgcgcccacgcccaggtcgcggacgtctccgaatacggccgcgtgacggagggggaccaggactaccccctcttccggctcgtcgtcccgggagagcgttggctggtcatcacctccggtttccacggggaggaacccgccggtcccctcaccctggccgagcacttcccggcggtggcggcgtacgcggtggagcgcggcgtggggctgcgcgtctacccctgcatcaacccgtccggcttcgaggcgggtacgcggtacaaccgcagcggcgagaagcccaacaacgacttcctccgctacgaagtcgcccccggggagtgggtgggcgaattgaacgtcgcgcgccccatcctccgctgggcgctgtatgacgaaggccccaaggagacgcgcgcgatacgcagcgagctggcgcgctatgccgctccggccgccgcgctcgacatccaccaggacgactacctgggcggggcgtcgacgtatgcgtacaccttcggagacaaggcggcctaccgcccgctggtggaggccagcgcgaagcacgtcgcggtggtgcgcagccagaaggtggacgaccacagcttcaccgacgcggacggcctcat

SEQ ID NO: 1270 - DNA, 51354 bp, Myxococcus xanthus
  unsure (1)..(51354): unsure at all n locations
tgctcctaaggccgtagttgcccagcgacacgtcgtcgtgcaggcgctgccggggaaccttcaggacccggccgaacaccgtcttcaagtggtcgctcacggcgtcctgacccgcgcggcccgtcatcgccggcgtacgcgcggcgggcaccgcgtcgctcacgccgcgctcctgcccgacatgctcgcgcaagcgtgccggctctcccaccagcaccagcacctgtggctgccccgtctcccaggcgcgatagaacgcctgcagtccctccttggcgcgcagtgatgccagcccggagcgctgctccgccagatccctgagctcggggcccacgctcatcccaccgtcactccagagcggccagttgatggacagcgtccggcccgaccgctgccccgccgccaccagcccagcgcggtagtgcgcgtacgcatcgaggtacgcattggccgtggcgtaatccgcctgccccacgccgcccagcgcccccgcgatggaggagaacgagatgaacaactccagcggcaggtccttgctcgcctcgtcaaggttcgacacgccgagcaccttcggctccatcacctcgctcagttcggcgtcgctcttgtggcgaatgaagccatcccgaaggatgcccgcggcgtggatgatgccggtcagcgcgccgtgcttctcacggatgccagcaatcaaccgccggacttcgtccaactggctgacgtcggcgcgcaggtattcgaccgtgacgccggaacgacggagcgtcgccaaccggggctccatctgacgaggagacgaacggccacagagaatcagcgtcgcacctggcgcacgggctgcaatctcctgggcgaaaatcatccccagcccccccagtccgcccgtcacgagatacacgccgccccggcgccagacggactcgctgtgcggagtgctcgacgctcgctgtgccacttcctgccaccgcggctctcgccagcctccgcgtgtgtaccggagcggagcctgtccacccggcgtcgcgggcgaacagcaacgacgccagcgaagcgccctccggctcatgcacctcgatgagccgagtcttcaaccggggctcctcggcgtgcgcggtcttcaacaggccgtcgagcgcggtgagcaactgctgctcccccttggctgggatgaccagatggcagaggacgtccccctgcggcccggacttcaagacgcgcttgaacgtggagagcagccggcccgcgtactcctggacgcggtctcccatccggtcatgagaggactccaaccggatgagttcggcatccccagcgtgaggccgcagcgccgcctccagtgccctgcccgtctcgcacaggaacacgatgtggcggccgggcttcgcgggactcgtgccatccactcgcggagaagacacggtccacgcgggcgtcatgagcaggacttcccggccgtgctcagccgactcacgggacgcctccggtgcccgcgtgacaaagcccttgagctcgacacacagcgtgccctgcgcatcgtagatggcgatgtcgacgcaaggcatggccgagtccggtccattcgcggctggccgcgtgatgtgcgcccaggcctccgagggacacggccgatacacgtccaggcgctccagaccgaacggcagggccgctggcgcgtcgtccttgccgcgcgccagaccgaccacggcttgcaacgccgaatccaggatgcccggaggcagtgcgtaggacgccgccgcacgggcgttggatgccggcagggacaggtccgccaccacctgctcccggcctacgtgaatccgccgcagtgcttggaacgaaggaccatgctccaggcccgcggcgcggaaacggcggtagcacgcctcgccatccaggctgtcgacgccacactcacgcagcagcgtgttccgttcgacacgcgaccgctccgccgcaccgggcatgtcggcggtcttcagtcgcgccgttccctggcagaacagcacggccatcccgctgtcgtactcaggcgaactgtagatccggaacgccaggtcaccgtcgggctgcggcttgagcccgatgtggatgtcggtggcacccgtctcgaccaccagggctctcggccagacgacgttcgccaactgcacgcgcttcgtccgctcacccgcaccgagcaacgccaccaccgccgcccgcgccatctccaactgggcggcagccggcatcaccctgcggccagcgacacgatgctcggccaggaacggctcatctccggtgaacgtggacgtgaaccgcagctcggacagtgtcgatgtattccgctggacgagcggatgaccagcgtccgtgatggcatgcgccatgggcgccgcggcctcggatgcatgctcaggcagccagcaccgctccttggcgaacggataggtcggcgcgctgattctgcgagggccctgtccgccgtggagcgcggcccagtccacgcgtgcgccccggacccaggcggccgcgatcttcgcgtagctgtgactctgtctccagacacccacgaggacgttgaggtcgtcggtggacggagcctgaccgctggccggaccagccccgagcgcggtgcccacgaaaacgtccttccccggcgaaccgtggaggaaaccctccagcgagcgactcagctccgaagcgctaccggccaccacggccagccgatgctccattgccgcgcgcccgacttgcagtgtgaacgccaggtgggccagcgcgcctgcatccagcgtttgcacgaatcggcgaagctcggccgcggagctggccagttgctccgccgtcttcgccgagagcacgaacaccgacgccggccccaccgcgctcacggtcggcggcctggacgccgcgggatactcttcgagcaccaggtgcgcgttcgttccactgaagccaaacgagctgatggcggcccgccggagcgcatggccgttcggtttccagggcttgtgctcggtgttgacgtagaacggtgaccgctggaagtcgaagtgctggttcggctcggagtagttcagggacggaacgagcgagccatgctgcatcgcgaggagcaccttgtggatgctcgccacccccgccgccgcggaggtatgcccgatgctgctcttgaccgagccgatggcgcagaactgagtccggtccgtgcgctccttgaagacggacgacaaggcctccagctcaatcgggtcgccgagccgggtaccggtgccgtgcatctccacgtagccaatcgtggccgggtcgacctcgaaccgccggtagacctcgcgctccaactccatctgactggccgcgctgggcgcggtgatgccgttcgtcttgccgtcctggttcgtgcccgaaccgatgatgacgcccaggatggcgtcccggtcacgctcggcatcctcaagcctcttgaggacgatggcgcccacgccctcgccggggatgaagccgtccgcgccattgtcgaagggccggcatgcgccccccgtcgacagcatgcccgcgtcgcacatggccagatatgactcgggcgccaggtacagcgtgacgccgcccaccagggccatgtcgatttcatggctggtcagcgcctgacaggccaggtgcgtggccaccagcgacgacgaacacgccgtgtcgatggcgatggccgggcccttcaggttgaggtggtacgccagccgtgccgccgcgatggcgtagctgttgcccgtggtgttgatggcctgggccccactccgctgcaacagcgtggcgtactcactgcccatgatgcccaggtagacgccacaccggcggccatccagggcctcaccggcgtaccccgcgtcctcgaacgcccggtagccttcctgccagaacagccggtgctgtgggtccgtcacttcggcttcggccggcgacatgcggaagaagagcgggtcaaaagactcgatgtccgagagcgcgcccatccggtggcaatagttccggtcctgccggaactgcttcgcggtggcctcgtcccatcgggtgtacggcagctcggagattccgctgaccccgtcccggaggttgtcccagtactgccgaaggttctccgctccagggtagcgccccgacatgccgatgacggcgattcgcacggtgcccgccggtgcgacctccttcttcacgatcgctggcgcctgcaccgcttgcacgctgggaggcgggctcgaaacgacgggcgcgacgcgtaccgtcttcgcctccacctgtggcggcggcgcgggaggcggtgcggtcggccccagctgccgggcgaggtagtccgcgaacagtgagaggttcgggtggtcgtagaccttggtcaccgggagtgacaggccgtattgcttgttgatggcgtggatccactccaccccgacaatcgaatccagcccgagttcgacgaaggtggactccgcgttgacctgcgcgcggtcgatgtagagcgcctgggcgaggctcgtcgccagttcctcgcgcagtttgctcgacgcagctgcgctcggtggcgggggtgcagcaggaggagcggtgggcgtcggacgctccggctcgggtgcctcgaccacggtattgcgcttcggagttgcagcgtccatcaactcggcctccaggtcgctagggtctcgcagcacgatgggtgccctcctgttcgcggtggcgcgtgtcaccacgcgaccggcacggaggggttgcgcgggtgtctgcgtgtccaagacccaatgtctttctctgctgaacggatacgtaggcaggcggatgcgctgggcgcggccacccgcatggagttcgtgccagcgaaccttcccgccgcgaacccacgactccaacacgggcgcaatctctccccgtgagatccgctcggtgagcccactcgccggctcctcaacaacggcagtgccgccacggcttccggcagtgccacggtagaggcccgactcgagctcggttccctcgacgaacgccgtcaactggcgttcgagcgtggccagggagtcgacggtgaacgccagccgctccttcatctcgtcccggcccacctgcaacgtgtaggcgatgcgcgccagttccccgtcctgataccggccatgccggagggcgtcgcgcaactgctgggcctggaccttcaggcgctcggccgtcttcgccgagagcacgatgatggccggcgtaccgggcatcacctgcgtgctcgcggtctcctgtcgccgcgccacgtactcttcgagcaccacgtgcgcattgacgccaccgaagccgaacgagctcacgcctgcgcgccgaggcagttccactcctcgccggtccgtgaggcgcggccagggcgccgtctcccgaacgacgtagaacggcgtgtcgtccagccggatgtgcgggttcaaggtctcgcagcccaggctcttcaccagcgtggcgtgcttcatctgaagcagcaccttgatgacgccggcgatgccggccgccagctcgaggtggccgatgttggtcttcaccgacccgatgccacagcgaggctgcgcactggcggcgtccccgtcggccttcacgagcgtctggtacgcgctcgtcaacgccgtgacctccacggggtctcccagcgcggtgcccgtgccgtgagcctcgatgaagcccaccgtgctcatggggactccggccttccggtaggccgccatgaggacgtccgcctgcgacgcgggattgggagacgtcagcgagttcgcatggccgccgtgattctcggcgctccccaggatgaggccatgaatcgcgtccccgtccgcctccgctcggctgagcgtcttgaggaccacgaagccggccccttcgccccggccgtagccgtccgcccggtcggagaaggtcttgcagcggccatcccggctcaacatgccggccttgctgaagcagatgtgcccgtccggcgtgacgatcgtgttgacgccacccacgatggccaggtcacacgtgccgtccgccagtgacgtcatcgcgcggtgcagggccaccaacgagctggagcaggccgtctccaccggctcgctcggcccgtgaaggtcgagcagatagctgagccggttgggccccatcgacggcaccaggcccgcggacgtgtagccctcgatggggatgccggcttccttgatgaggtcgccgtagccgaaatggcccgtcccgacgtagatggccgtgttcgaacccgcgaggcttgacggcgcataacccgcgtcctcaatggccttccacgcgtacatcatcagcagccgctgctgcgggtcgatgagccgggcctcgcgaggagagatgccgaagaacgccgggtcgaactcgtcgatgccgtcgatgaagccgccccacttcacgtccgtcttgttcggttcgcggatggggtcaccgtcataggcccgccaatcccatcgcgagttcggcacctcccggatgcagtccttcccggcgacgaggttcccccagaacgcatcgaggtcatccgcactggggaagcgccccgccatgccaatcacggcgatgggctctctcgcgcgcggctgcgcgggcgcgacccgttcctcgctccttgcaggctcgaccggcatgggggccgacggcggcgaagcaggctcgaacgcagcggcctccgcgcccagttggtccagcaatcgtgggccgtggctctcacacaggtaccccgcaagcgcattcgcggtggtgaactcgaagaagatgaccggcgacaagcccagcgaaagctgtcgattgaggaggttggcaaactccgtgaaggtgatggagtcgaagccgtagtcactgagcttggtgtcggcgtccagctcctcgcgcggcaccttgagcagctctgacacgccctccagcaacaccgcctcgacgcgcgcttgcaggtctcctgcgttcggggtctcaggggctcgctcgcgacgcgacacgggctcctggcccaccaacttccgaatcgactcgacccgccccaccgtgaccaggacccgcgacgcgctcccggtcagcacccggtagagcgccgtcatggcggtccccgtcggcatgggcaccatccccgtgcccagcgtcatggcctcttccgtcgccgcgtccatgcgcatgccgccgtcgcgccagaacggccagttgagggcccggctcacgccgctccggtcgccagcggccacctgcgtctggcggtgcgccatgtacgcgtccatgaacgcgttggccgccgcgtagtccgcctgcccagcgttccccagggcgcctgcaattgaagagaacgccacgaagaaatcgagggacaggcctcgcgttgcctcgtcgagcaccaccaatccgctgaccttgggcgcgaacacccggaccaactccgcctcggacttccgggcgagcaggttgtcctcgatgacgccggccgtgtggatgacgccgtggaccgttccgaactcccggcggacttccgcgaccacctccgccatccgagccatgtcggcaacgtccacgacgaagtaccgcacccgcgcaccggacgcctcccactcacgaaacgcggcgagcagcggttccttcgcgtccgagcgccccaccaggaccagcgtcggccgctcacaccgccggacaatctcctgggccatcagccgagccacaccgccaccaccacccgtgatgacgtagacgcccccggcccgccagggtaccgctccgaccgtgtccgcctcgcacgccaccgggagacgggcgcgctcatgccaacgcgtgacgaaccgcgaggcgccttcatagtcgacctcacgctccccgggcgtccgggcgttctccagcaaagccttcgccagctgctccgccgacaccggaccgtcgaaaccaatgctctggcagctcagccgcgtattctcgagcgccgccgacttcagcatgccgccgaggcccgcgacgaccttgtccgctcccgcgtaggccagctggaccagcagcttgcccttcgtcccggccaacgtctcgcgcaggcgttcaagcgtctggcgggcgaagtcgaggtaacgcaggtccagccgctcctgacgggattgcagctcgcggcaagagaccgacgtggagccacggccgtcccgaaccgcgcgctcgacgtccgaagccgtcagccccgacatgccgcaggtgagcaccaggtgatggtcgaaggacggcgctgggctttccggtgctggctcgcgcacacgctccggggaccaaagcagcgtcgcctgctcgtccgcgggcggctgcgccgttgcgctatcgatgggccgcgcgttgaagccttcgagcaccacacacggctcgcctgcctcgctggtgatgcgtatcgcacacacgatggggccattcgctccgcctcgcggttcacgctcgaccaccacccaggcctggtccgggcagggacggagaatccgcagggtgtccagggagaacggaagcgccgttctcagcgcgccctgtcccatcgccaggcccagcgtggcctggagggccccatcgagcaggctgggcggcagcgtgtaggcagcgcggtctgcgaggctcgtcccgcgcagcgacaccttcgcgaccacccggttctctcccaccgccagttcatcaatcacccggtgcgcgggcccgtaatcgatgccaatggactggaagacgtcgtacagcgcctcgccgttcaccaccttccgggtgcagcccgccagcgcgcctggaatgtccacgcgctccgcaatcacgccacccgggccacggcgcgcgcgcccctgggcgtgcagcatcgtctctccggacctgccggtgctggtgatccggaaggacaggctctcgtcggccacaagcgacagtcggacggtcagcgacgcattctccgccgagtagacgaagggacgcagccacacgacctgctccagacggatggccgtcgagccgcgttccgccggttccaatgagcgcagcaccgcctcgtgcgccagttcgaggtagccgaccccaggcagcaccttctggccccggaccacgtggtccgcgaggaagggctcgtccccgctgaagtgcgtgacgaagcacggaccggccagcgtcgactggttctcgtgcaacagcgggtgcaggcgcgccggagccacggccgatacggcggttggcgtggccggtagcgcgtagcgctgcttcgcgaacggatacaggggcaagctgagacgtcgcctgcgcttcccctcgtgcagactccgccagtcgacgtggccgcccttcacccaccgcgcgcccagctcagagagcgcgcctgtcctcatggcttcgccgccatcctgcgaggccagaccctcggggttcttccggatgttcgccgtgagcaactcgggcgtggaccgcccctgcgcgaagtcgctcagccgctccctcagttcgcggatggaaccaacctggcaggccagccggcagtccatcgcctcgcgtcccacctggagcgtgtagcagagatcctgcagtgacagcgcgggcgcctgcgccaggaaggcgtcgaacgacgcggcatacgtgcgcagctgctcctccgtccgggcggacaggacaaagagcgcggccccgtctacgagcgcctgagggtcttgcgtcatggcttccgccggggcttcctcgatgatgaggtgggcgttgctgccccccgcgccaaaggaggagatgcaggcaatgcgggggatggactgtccctgcgcgtcgcagggcagccagtcctcgcaggtttgctgaacgacgaacggcgtcttgccgaagtcgatatggggattcagcgtgctcgagtgcagggacggcacgtacttgcggtgctgtccctggagcaggatcttggacagccccgcgatgccagcggcggcctccaggtgcccgatgttcgtcttcaccgagccgatgcggcagtacgcgaggtctggcgtctgcgcggcgaaggcctccgtcagcccccgaatctcgatggggtctcccaggtccgtgcctgtgccgtgcgcctcgacgtaggtgatatgccgggcaggcaccttcgctcgcgccagggcccgagtgatgacctccgcctgggcccgtgggttcggcaccgtgaacccgttggtcttcccaccgtggttgatttccgagccccggatgacgccgtagatgtggtcgccatcccgcagcgcgcgtcccagaggcttgagcagcacggcgcccacgccctccccgggcacgaatccattggcccccgcgccgaacgccttcgacctcccttccgtcgacagcatctgcagcttggagaggtccgcgaagtggtaggggtgggtataggtattgaccccgcccgcgatggccagcgtgcagtcacctgattggagctgctggcacgccaggtggatggccaccagcgacgacgaacaggccgtgtcgatggcgaggctgggccccttcaagttcagggcgtaggagacgcggttggggatggtgaagaaggtgtggtgctgctcggccacgcccaccttcgacgcgccgacgaacacgcccacccgctccgatgccagcgccgtcggcgtatagcccgcgtcctccacgacgtgccaggcacactggagaaacagccgggactccgggtgaatgatctccacttcgcgcggagagattcggaagaacagcggatcgaagtcgtagaggcctccaaggaacccgccccacttgccgtagctcttgccactcgcgatggctgcgtccttgtcggcgtcgaagaagacatccagcggccagcggtcggatggcagctcgctgacgcagtccgccccgcgcgccaggtttgaccagaatgccgtcaggtcgtgtgcctcgggatagcgcccgctcaggccgatgatggcaatcggctcgtcggtgttccgcggagcggtggcccccgcgtgaggcaggaggtccgaagccggtgacggtggtgccgcatcccgcgccagctggtcactcacgtgctggatgagctgcgcgggcgtcgagtactcgaagaaggccgcaggctcgaccaccaagccatgcccctggcgaagcgcggcggccagcttgatgaccaggatggagtcgaagcccagctcgctgaactccgcctccaggtcgagctgctccgggggcacgcgcaagaagggactgagcgtcgtgcgaatcatcgactcggcccgcgctcggaaccgggtgtcatcccccggcctggatgcagggtgttccgcgatgggcatcgtgccctcccggggctgccgcggcgccgcatccacccagagccgttgcatcttgaatgcatagacgggcaggcgcacgcgctggggcttcgcctccagtggccattgccaatcgaccacggcgccccggcaccacgcgaccgcagtctcctgagcctcccgctgacttgcctggagactggggtgcgcagctgcgtcccgctgccccttgctcttctcagcgctcccttcgaagacgccttccgagcgctcgcccgcgacgtaccgatcgagctgatgctgcaaccgcgtccggtcctcggccaggaaggccacgcggtgcttcatcgcgtcccgtccgagttgcagcgtcaacgccacggcgtccaggtccaactccggctccgccctgagcgtggccgccagccgcgcgaccctgtcgacccgctgctccacgctgctcgccgacaccggaacgacatgccactgacgcgagggcggcccgcccgcggacggccgcgattccagctggggcacgtattcctccacgaggaggtgcgcgttgttcccgccggcgccgaacgaatgcaggcccgccagccgcggctttccattgcgccgccagggctccgtccgggtcgcgagccgcgcgggctgacggtcaagctccagatacgagttggcggattcgaagccggcgatgccgtagaccttgtcgcggcggaagctgtggatgaccttgaacagcgcgccgagcgccgacgccgactccatgtggccggtcagcggcttgaggctgctcacccggcagtggcccggcaccacgtcgacgccctgcgccgtggcaagccgcttcagcgcgtcattgatggcctcccactccgcgatgtcggcgacggggttggccatgccctgcgcctcgatgtactcgacgtcccgcacgtcgatgcccgccgagcgataacaagactgaatcagctcgctgtggctctgacggctcggcgcggcaatcgatacgcccgagcgaccgttgtagttgaccgcgctgcccctcagcaccgcgtggatggggtgcccctcacgctcggcctgctccaagggcatgagcagcacggaggccacgccctccgcgcgttggtgcccgctggcgtccttgccaaacgactgcacgcggacgctcgggctcaactgctgcaattgggagagcttgatgaacccatcgggccgcaggatgacgttcgcggcggcgacgatggcacggtcaatctcccccgaccggatcgccagcaccgcgcggtggatggccacagcagcgctcgagcacatcgtgttcaccagctcgctcggcccgctcaggtcgaagaagtacgacagccggttggccaccatgctggccgcctggtcgaagccagacgcggtatcgacgccttgctcgcgcaggtgcagcaggtactcattctcctccgcgcctacgaagacgcccgtgcggctgcccttgagcttctccggggcctgccccgcgtcttcgaggcagtggtagaccgccatgagcagcaggcgctgccgggggtccagggtctccgcttcggccgggaggatgttgaaaaaccccgggtcgaacgacgcgacgtcgggaatgaagccgccccacttgctccggctcttgtccgggaagagaggccggtagtcgaaccggttgggagggatttcctccaggagcgtctgctcggcgtcgagcgcatcccagaaggcctggagcgactggcagcccggaaagaaacccgccgcgcccacgatggccacggcctgagcgtccttacccccgcgtgtctgcgaacgaggcgcgggcgcgtcatgctcaggcacgggaaccacggagggcagcggcggtgccacatccaactgcgttcccaggtactcggagaggctacggaccgagggatgctcgatgaactcgcggggggagacatcgctcccgagccgccgcttcaagcagaccgagagctggaccgccgagatggagtcgaggccatagcgctggaaggcccggtcgtcgtccagtgtgtcgactggcaactggaggacctcgcagaccgcgtcacgaatcgctgccttcaccccggagctgtccactgctggcgccgcttctggcgtctccaccgtgcgccgttgggtcgtcacgggcgactccgcgagcatcgggttgccctcggcccaggacgtctccggatggaggtaggccagcaacacccagctcctcgcccccaggcgcatcgacttctcgaacagggcacggccctcatcgttggtgaagctccgcatcccgagcgagcccagggcctggtcgagccgtgccttgtcctcgggtgaaaggcgggcgcccgcgccggtctcgttccaatccacccaggtgatggtccggtagcacgtccgcttccggccttggtgttgataggccgtgaagtggtccaggaacgcgttggccatcgcgtagtcgctcaggccccgcgcgagcctcggtatcacgcccgtcagcgacgagaacgagacgaagaagtcgaggtccgcgccttcgaggacgtcgctcaggcactcgatgccccgaaccttgggagcgagcacccgttcgatgtccacggcctttttgtcgacgaaggctggcgtcttgatgtcggagtaagcccccgcgctgtgaatcacgcctcggatggggcctcgctcgcgctggattctggtgaacagcgcagcgagcgcggtccggtcgtccagcgggccaatgtggatgtccagtgagtccactcggcgttcaagcgccgcgagcttctccagcctgagcgtgtcctgcggggaacgacctcccgcatctggcccgcgcctcgacggcaacggcgtcgcacccatcaataccagccgacgcgcacctcgggagaccagatgctccgcgatctccagcccgatgccgcgagtgcctcccgtcaccacatagacgcctgtttcgtgcaggtcgaacggctggcgctccaggccatccgcgtcagtgcgttccacccgccttttttcgagcagcggtgcgaagcgaaggccgcgccggtagcacacctcggactgttctcttggagccgccaactccctgcccagcagttccacgagcgcctcagcaccgacgtcgaggtcgatgctcttcgcgaccacgtgggggtactccgcgctgagcatcttcatgaggcccacgagcttggcccccgccagactcggctgggcgcactcgaatggctgcaggccccgcgtgacatgcaggatggacagcgcggagaactcgcgaatcagtcgctggaggaaggtgaccctgcccagcttgtcgtcatccacgctcctgggctgcgcgtagaggtcagacacatcgatcaccacatcgacgtgtcccacttcgcgcagaagctcggacgccagtgcctgccccgcttctggagagaagagcgctccggcaatgacgacgcgcacctccgcgggtgccagagcctgccgcaattcactgacgaactgcgccgtctcggggttgaccaggacgaccacccggctcccggcttgccagcgcgaaccggtcgaaccctcagccgtcgacacggagacaggctggcgccgccataccttctccagcaggtagacgggttccatggcttgaaccacgggaacctgccccaccgactgggtgctcatcgcgccccactggagcaaccgcctccgctcacccgtgtaacgcaccaggctccgcgctggccggccttcgtcgacaatccactcacgcaggaagcgctgcaagctggggagtgaatgagcgtcatcctccatgaacacgcagcgccacgagtcctggggccgcgccatggtcgacagcgcggcatcgaggccaccaacgtcgccctccagcgtcgcagccgtgccaccgcccaggcagtacacggtgacacccgcgccccgcgatacccatcgctcgaattcaggcagcgcggcgcgcagccaccctgccgtgtcccccaccgctcccgggagcaaccagaacacggtcgcccgagcttcgtggcccacgtcgatgcgcggtccctcaaccgctgcaccacgaacgaagcggtgcatgtggatctgaagcgctgatgacaccccgccggacgcgctcacctgctccagcagcgccacgaatcgccgggcatcggactcttcgtcgtagacgacccagacagtgccgccgagcttggagagcagccgctcccgccagggcagcgtctcgggcactggcgcgtcgatccactccaccttcgtctccagcacggacggcgacacggttcgcacgccctgccccttgagtgccagccagtaagtcctccgctcgaacgggtacgtcggaaggctcacccggcgcggcgccggtgcctcgccaccgtagagcccgccccagtcgatttcccggccctggacccacgccgccagcagctcacggcccctgctttcgtccaacggctgcgcgagcgtttgcgaggccgcgctccgggcacggccgaaggcacaggcgtcgtcgtccacctcgcccagcaggacatctgcgcccgcatccccgcggaggaaggcctccagcttctctcgtgcttcgtcggccgaccgagccgtgaaagccaggcgcgcgttcatcgcttcgcgcccgacctgaagcgtgtaccccagagcgcgcaggtgctcggcatcgacgtgccgcgcctggaacaggtagccgcacaaacggcggcccacctcgcgcagccggtcgggattcttcgccgagagcgggaacaggaccggcgtgcccggacgcatgggagtcttctccgggcccatctcgaactcctccaccaggacgtgtgcattcgccccaccggcgccaaacgacgacaccccggcaaggcgcggccgctccgagagcacgccgtcaacctcgactcgaggccgtgcccagtcctcgaagccgcgctgcaccacgaagggcgtctcaccaaaggcgatgttcgcgttgagcgactccgcatggaggctgggcaccagtcgcttgtggcggagctggaggatgaccttggtcagacccgcgatgcccgcggcggcctccaggtggccgatgttcgacttgagtgagccgatgcggcagtacgcgcgggcatccgtgtcgcggcgaaacgcctgcgtgagtcccgcgacttcaatcgggtccccaagctcggtccccgtcccgtgcgcttccaggtagctcacatcgcgcgcggagaggcccgccttatccagtgcactgcgaatcagcgccgcctgcgcctgcgggtcgggaacggtgtagccgttcgtcttcccaccgtggttcacactggttgaccggatgacggcgtagatggagtcgccgtcggcgatggccttcgacagcggcttgagaagcaccgctccaacaccctcgccgggaacgaagccgttcccccctgccccgaagctgcggcaccggccgtccgtcgacagcatctgctgcccggacaggctgacgtagctcgacgggtggacgtagagattcactccacccgcgatggccatgacgcaggcgcctcgttgcagcgcctcgcaagccatgtggacggctgtcagcgaggccgagcacatggtgtccacgggcatgctcggccccttcaggtcgagcagatacgagacgcggttggcaacagacgcaaacgacgtatagggccggaccgaggcatctcgtccttccagctccgcgccgtagagttcgtagcccgtcttcgtgattcccgcgaaaacgcccaccgcgctgccaaagcgctgggccaggctgtcccgggtgtaccccgcgtcctccaggacctcccagcagctctgcaggaacaagcgctcctgcgggtccatgctcgtcgcctcacgcggcgagatgttgaagaacagcgggtcgaagtcagcgaagccgccgaggaagccgccccacttgctgtagctcatcccccgcgcggcggcgtgcttcttgtccgggtagaagaacccgtccaacgaccagcgctctggcggaatctcggtgatgcagtcgtcaccgcggctcaggcgctcccagaactccgtcaggttctccgccccgggataacggccgctcatgccaatgacggcgatgggctcgtcggcgcgaggcgcccggtgcgtcgcatccgcacgtggcggcctggcctcctggatgacggaagacgaattctctccaggtgccgccacccacttcgcgctctcttccgcgcggtgctcggccagatacccgctgacttccgcgagcgtccggtattcgaagaacagcgtcttcgagagggcgttgtacggcccttcgagggcttggttcatctgcgtgatgatgatggagtcgatgccatagcgctccatcggctggcgggcatcgatgcggcgctcttcgtatcgcgtgacctcgctgaagagcgccttcagcttcgtctcgaccttctcggtgatggacaccacggcgtccaacgccacctgatgcggaggcggtgcgggcgaaacactcacggagagttcacgaaacctctgggcctcccccgtccacaccgcgacaccaggggagcccagttccagcgcccggtagaacgcccccagtcccgcttcgtctcccagcgcggccatcccggtccgctgcatcaagacctcacggctccgtgagtcgagctgcatcccgccgttctcccagagcggccaacggatggacaccgtccggccctgccgctgtccggcgttcacgagcgccgctcgggactccgcgaatccgtccatgaagccattggccgccgcgtagtccgactgaccggcgtttccaaacgcggccagggacgagaacgtgacgaagaaatccaggggcagctcgcgggtggcgtggtccaggttgacgagccccaccaccttgggcgcgagcaccgcctgcatttccgccaccggcttgttgagcaggtagttgtcacggcggatgcccgccgcatggatgacaccgtcgatgcgcccgtgttcgcgcagcaccgtagcgacaaaggcgttcacgtcgttcggttgggtgacatccacgggaaggtgccgcacgcgcagcccgttcccaccgtccaccgcctccgccgaggatgcgcgggcaaccagaatgacggtggcccgcgtcgcgcgcttcccgatttcggcgacgaacagccgggccagggcgccggttcctcctgaaatcacatagacgccgtcttcgcgccagaagcgggatgcgtcccccttggcgacacgtgcctcgcgccactcacagcgagaaagctggcccgcgtggtaccgcgaatcggtgacgtcaccggcgcgcgcggacttcaccagaacgtccaccagcgccgatgcggagacgcttccctggacgcggatgagctgcccccggaccaacggattctcctgcgacaccgaacgcagcaggctccccaggccactcagtgccagcgcatcccgctcctctggcaccagcacctgcaatgtcacaggagcggtcagacgctccgacagcagcgccttgacgcgttcgaagaccgccgaggcatgcgccatgaaccgcgcgtccagccgcgcacttgggctggacgtcctgaccacttcgatgcgcctgtccgcgagcgtgctcgccagcgcggaggcaccttcagcccccagcgcatcaagaggctcgcacaacaccaccaggtgccggagcgccaacgaggcatttgacgcgccctcagaccacggctgccaggtcggaacgaagagcgggacacccgcgtcaggatgcgtcttggaggaattcgccacggagtgcgcgggcgacaacccgtagcgctccttcgcgaactgatacgtgggcaggctgacacgggcgggcttcacgtcaccgtgcagcgaatcccagtcaatcgagtcgcccgtcgcccacgcctccgcaactgcccgagcatcggcatccacgctgggtgacgtatcgaccaccgttcccacgtgggcaccgcccaccgtcgcgatgcctcgccgcagtccctccaccaattcgtcgcgcgtcgacgcagtcaccaccatccgctcaggcatcgcgacccggccgacctgcaacgtgtaggtgatgtccgcgagcgccacctccgcggacgccgggtcctccaggaagtcgagcagcgcgcggaggttgtccttcaacgcctccagggtgcgcgccgagaatggagccaccgcacggactgcgttcgaccgctggctcctctcccgtgggcgggagtcgcgcgggtagtgttcgagaatggcgtgggtattcgtcccgccaaggccgaacgcactcacggccgcccgcctcggtcccggcagggacggccacggcgccaaacggtcggcgatgacgaacggcgaatccgtcagctcgagcttcggattcacctgggtcacatggagcgtcggaggaacttcgccctgccgcaggctcagcgccgtcttgatgagcccagccagtccagccactgtgtccagatggcccaggttcgacttcaccgagcccagccggcagtacccgcgccggtcggtgaaggtccggaaggcttcgctcagcgcggagacctcgacagggtcacccagcaaggttccggtgccatgggcctcgacgtagccaatcgatgcagggtcgatgccggtccggtcgaacagacgccggatgacctccgcctgcccggtggcgctcggggcgtagaagcccaccttgtcctggccgtcgttgttgatccccaccttccgcacgaggcagtagattgggtcgccatcgcgcaccgccgctgcggcgtccttcaccaccagcacggcgacaccttcaccggcaatcatgccgtccgccgcggcgtcgaaggccttgacccgccccgcgctggagaagttgagcccccgctggtgcagataacccaggttcgccgaagggaagaccgtggcggcccccaccagcgccgtctggcagtctcccgctgcgatggcctgctgagccacgtacagcgcggacagggatgacgagcagttggtgtggacgaacaggctcggccccttcaagccgagcttgtaggaaaccatcgtcgggatggagcctgcctgggccagcacccacagcacgtattcgtcggcggtgcggaggaccggctgcccgtccgcaggaaattgcggcgagccctggtgatagaagctgttgctggccgtcatgaagacgccgcacggtcccaggcgctcaggcgtcgtcgccgcgtcttccactgccttccaggcgtgcatcagcaacagtcggaactgcgggtccatgaaggacgcgtcccgcgccgtcagaccgaagaactgcgggtcgaagcactccttgtcttcgatggacgaccggaccgcgacgtaacgggaatcgcggaggacctcctcgggcacgcccagctcgcgcagttcctcatggcggtacgccaccacgctgtccctgccctctcgcaggttcttccagaagcgccaggggtccgcggctccgggcaactgacaggagatgccgatgacggccaggctgccctcgtagtcacgctccgacgcggtgtcctcgcgagccggctcggtggccccagtacgggcttgcgccgtcgcgccctccatgtggcgcgccatgtcgcgaatattgacgtacttgaacaggtcggtgacggcgagccgcgtgtcgaagcgccggttcatctcctccaccagcacggcggccagcacggagtccccccccacttcgaagaagcgatcctcgacacccacctcgttgacctggagcacgttcttccacagctcgacgagggtggcctcaacaggcgaacgggcatggaccgcggatgtcttccgccgggtgaccaccggcctggccatcagctggccccggtccaccttgccattgcccgacagcggaatcgcatccaccgcgaagacgtgcgcggggaccatgtagtcggggaggaacttccgcaggtgtgcacggatggcttcctcatcgaagctcgttcccgcgggctgacagtaggcgacgagctgcgaggtgccgttcagctccttggccaccacggcacagttcttcacgctgggatgcccggccaactgcgcttcaatctcccccatctcgatgcggaagccgcgcaccttcacctggtggtcgagccgccccaggtactcaacctcaccgtcagcgcgccagcgcgccaggtcccccgtccggtagagcgtcgtgcccggcgtgaacggattggaaacgaagcgctcggcggtcagcgccggccggttgaggtaaccgcaggccacgcccgcgcccgcaatccacagctcgcccggcacaccgatgggcaccggctgcatccggtcgtccagcacgtagacctgcgtgttgtcgatcggctttccaatggtgaccggacgcgaggccgagaccttcgccatcgtcgaccagatggtcgtctcggtgggcccgaacatgttccacacgtcgctcgcggtgcgaacgaagtgggccttgagcgactccggcagcgcttctccaccgcagaggattcgaacccgctcggcgttctcccagccagactggaacaacagtgtccaggtcgcgggcgtcgcctgcatcaacgtgggccgatgggtgcgcagcgcccgcttcaacgcctgcgcatcccgaaccgtctccgccgacgcgatgatgacctgcgcccccgcacacagcggaagcaggagctcgagcgccgcgatgtcgaagcagtacgtcgtgaccgccaacagcgaatccgtgcgcttcaggcccagcgtcctgcgcatgcacaggaggaagttgaccaccccgcgatggggaatcatcacgcccttgggccggcccgtgctcccggacgtgtagatgacgtaggcaagtccgttcggtgaggttcccgccggcgcggacgtggctccagccttgacgtcctccagcacgcacaccttgcaggaggctccggcaatggcggcgaccttgtcccgcgaggcctgacgggccagcacgaccaccacgccactgtcctccagcatgtaccgcagccggtcctcggggtgcaccgggtccaggggtacgtaggccgcgccagcggacagcacacccagcatcgccgccaccagctccgcggaccggtccaggtagatgcccacgagcgccccaggcttgacgccgaggctcttcaggtgcgccgcaatctcgcggctccgcgtatccagcgcctgatagctgagcgagtgcccctcgtagctcacagccatggcgtctggggtctcccgggcctgccgctggaagagctcgtgaacgcccaggtcctcgaggaacggcgtggccgtggcattccagtcgcggagaagcgtgcggcgctcttcgtcgtcgagccacgacagtgcgctcagcggagactccaccccatccgcgacctggtccgcggcgcgcaacaactgacgcgccatccgttcgaccgtgtccgcctcgtacagccgcgcgtcgtacttgaaatgcagcgtgaggcccttggcgccctccaccacttcaagctccagcgggtaggcgccttcctgatggacgcagtcgagcggctcaagctccggcaacccgcccgacctgggctccggccttggcggagcgctcgtcagttgcaggctctggaaggtgaacatcgtctggaagccaggcgcctcctcgggcccattcgacagccggaggtccttcaccactcgcgggaagggatagtgggcatgctccaggccatcgatgaccgagtcgtggaggtggcgcagcagcgagccgaacgagtgctgccccaggccccgcgcgcgcacggccatcacgttgacgaagtacccaatcgccgtcgccagttccgcccggggccgccccatggtggggatgccgaccaccacgtcgtcctggcgcgtgtgccgatgaagcaaggcgtagtagagcccgagcaggacggtcggcaggctcacttgctgtgcccgagcgaactcgcgcagtcgcaatgcttgctcggtgggcaccctctgcgagtgcgttgctccctccgcgtccagccccgtggcggagcgaggccggtccgttggaagattcaacggcggaggaacgggcgtggccaacacgtgccgccagtagtcgaggtggcgccgtccctcatcgcctccaatggcgagctgctcccactccacggcggcgcggtaaggagcgacgatcggaacctcgagcagccccgccttcgcctcggtcccggcgtaacgctcccggagggcgtcgagcaagggcgccacggatgccccatcgagcaccaggtggtggaagcacagcagcaggacatgctcgtgctccgaccgcgagtacaggtgcagccgagcgagcggtccacaggcgagatcgaatggcaccttcgcggaggcgcgcagggtcgccaccagtgctgaatcggagaccgatggaacctcgtggacctcggcggagacctgcccactggggacgatgaccggctccgtgccttcgacgcgaatcgcgccagcgagcagcggataccgttcgagcagtccttcccaggcccgggtcagcctcgccgggtcgaccttgccgcgcaggcggtaggcgagcggcacgttgtaggccggcgattcgggacgggcccgctgcatcgcccagaggcctttctggccttcgctgagcggcaaccggatgctcgccgcccgcagcgcggcaagccgccgccgtgcctcgaccttggacagcctgccttccgcgaaggcggccagaacctcacgcgttgtcatgagcgtcgttctccagccgggccgcgacgtcctcgatggacagaagcccttccttgagcatgtccagggcgtcctgctcaggcaccgccacgggcaccgtgtcttccactctcggctcgcgcccgcgcaccaacgtcgcgacatgggatgcaatcgccgcgatggtcgaccggtcaaccaggtcacggagccgcacgtcgacgcccagggttcgtgccagcacctgcgccagccgcatcatcgtgatggagtccgcccccaggtctctcgcgttgacgtggtcgcccagctgcgcccgaggcacgctcagcgccaaggagagctgctcgcgaatcgcctccgagatggcctccacgccgcggcccttcggcgacagcgggacctcatgggcactcgcctgcgaatcggcgcagccagacgcgagccaataccgctccctggcaaagggatacgtcggcagcgggatgcgtttgacgtccgctccctcatgcagccgcgcccacgggacgtggccccccagcacccagtactcagcgagccgctccagcccctgctcagcgagcagtgactccaccagtgacgctcccgcggcctccgacaggaacttccccagtcgagtcgagccatccacctcgcccacatggatgggggtaccggcccacgacgtccgctccggcgaggccaggtacgtgctcagtgcggcggccaactcgttccggtcgcgagcgaccacggccaaccggcagttgaaggcgtgacgtccggtctgcagggtgtaggcgaggtctgccatgacgatgtcgctgttggacgccaggaaggacgagagccgccgcgccacctcctgcaatcggtccgctgtccgggccgagaacacgaacaaccgcggcccctcgcggccccccgccagccgcgtgtccgcagcgaacgactccaagaggacgtgcgcattcaccccgccgaacccgaagctgttgacgccggcgcgacgcggggacggctcagcgcctgccggcgtccgccacggctggctgtccgacgacaccttcaagggcgagtccgccactgagatgtcctcgtgccactgcgtgaaacccggcaggcccgggagcactgcatggcggagtgccatgagcgctttgatcaacgccgccatgcccgagaccagctctccatgaccgatgcagggcttcaggctgctcaaatggcagacgtgaggctcgccgtcgcgcgcacgctcatccacctcgcgaaacgcagccttgatggcttccacttccgcgccatccgctagaggcgatccgacgccgtgcgcctccacgtaggagacagtccgcgcgctcacgcccgcggcgcggtacgcggagacaatcgcgtccttcatgcccagagggttgaccgccgtcagcgaaagtccccggccgccatgcgcaacgccactgccacgcaccaggccgtagatgatgtctccgtcagccaccgcccgcgacagaggcttgaggacgagcgtccctaccccttcactgcgaacgaagccgcgagcctcgggctggaaggggcggcatgaaccgtcgacgctcaggtactccatggcctcgaagccggtgaaggtcgtcggcgacaggagcaggttgatggcgctcaccacggcctgctcgcactcaccggaacgaatcgcctggcatgcccggtggaccgccgtcagcgccgacgaacaggcggtgtcgcagtactcgctgggccccttgaagttgaagacgtgggagatgcggttgggagcaatggacgccgtgacggcggtcgtgcccaacggatggctcacgggaatggagacgacgcgcgggtactcccctggcgcggcggccacgaagacacccgtggaggtccgggcgaactgctccgggatgaggcccccgttctccaaggccgaccagacagaggccagcagcaggcgctgctgggggtccatcagctcggcctcttgcggcgagatggagaagaatcgtgggtcgaactcgtcgaccccctcgatgaagcctccccaccgaggccgcgtcacatccgagccgtctcctgccagtgccaggagcgcctcctgccgcgacgcgggtacctcggagaggcagcgcttgccctcgacgatgttgcgccagaacgcatcgacatcctcggcgcctgggaagcgcgcatggatgcccacgaccgcgatgggctcggtgcgctcgtgaggggccgcacgggtgcgtgactccggcgcagcgacttgagcgtgagcaggcgacgcacgcttcgacaattcctgggcgacgaagtcccggagttgcgatggcgtcgtgtactggaagaagcgcgcgggctgcacccggatgccgtgccgccgatggagggccagacccaactccacgatggccagggaggtcacgcccagggccgacagctccgcctccatgtccagcgcatgcgcgggctggcccaggtagcttcccacgacgtccctgaccgtctgctccgccttcgcccgagcgtcagcatcgaccgcctgggccggaacaaccgcctccttccgaggctgctccgacaggcgatactggatggcgacatggcgcatgccaccgcggacgacctcgcgcagtgccgtgaaccccacctggttgggcatggggatgaggccttgcgaagaggcgagcaactccgagagttcgcgggagagacgcatgccgccatcgcgccactgaggccagctcagcgagatcacggacaggggctcgcccaggcgattcgtgaaccgcggcgccccttccgccccgaagccgtccgccagcccgttcaggaagccattcgcggcggcgtagtcactgtgctggtactcccccctgctcgcctgggacgagaacagcgcgacgaaccggcacgggagacggtgacactgttcgagcaggttgagcgcgcccaggcacttgggtgccagcgtgcggcgaagctcgcggtccgtcttcgccagcgcgggccctggctcgacatgccccactgtgaagaagagtccttccagccgtgcttcccgcgcccactcccccaccgcctgctcgacgtcgcgagggtccgtcacatcgagcttgcaccagcgcagccgggacgatgcctgcgggcctgcactgagcggccgtccagagcggctggcgatgatgacgtcggcatcacactgctcgaccaaccagtgcgccagcgcgagtcccagcgcgccaccacccacgacaccgtaggtcttccggccctgggccagtagctcctgccgggaagcaggcacgggccagggaacgcgaaccgcggcacggacgaaccgcttccgaccacgataggtcacggcggaatcgccccggccctgccgccgctcccgctcaacgacttcctcgacccagtgccgcccaccgacatcgtcgagccgcaccacctgcccctcaacgttgcggtgctccaactgcagcgactggagaaagctccagaggccttcacagaccgcggcaggactcccgcggtcacaccagatttcgacccggcaaggcgcccggggtcccgagtgctccagcgcacgcagccgctgaaggacggcgtccatggcactcagcatgacctccgccggattcaagccctcgacgggaagcgtttcgctccctgggatgtcgaggtcacgaccgagccgcagggagatgcggtgaaccggagccagggcgccattcgcagtggcatccacttcgcgttcacgccacacatactgctcggcctcaatgcgtccggcctctttcgcggcctgggggctggggcggaagcaaactccctggagggtcgcgagggcttcgccgtcatcagtaagcagcaccgtgtcgaacgagggtgccgactccgatccggcaggaacgaaccggctatggacgaccatcacgcgaggaagcgcgcggtggaccgtgacgcggctcagtgagaagggaacgattgctggcgcggaagcgacctctggcatgcgctcatcacgccgccggcgcgcgagctgcaacaggacgcaggtctgcagcgcggagtccagcaacgacggatgcaggacagcgtcgttcccagcgtcggcgccagccggcaacaccactgtcgcgacgacctctccctctcagaaccggcagtgctgaatgcccggcaagccaggtcagtactccagccatgcctgtatcagccactggtacgcgacatccccgtccaggcgctcagggcatctcccctccagttggggcaactgtcggggctcctcctcaggatgggatgaggacgccagctgaccacgaacatggcctgtctcactgccgacggttccgtggtttggggacacgacctggaagntaacctgccccgtccnngcttcggagaacacgacgcgcacgtccccgcgcgcgtcttcgcggagcggatgctgccagacgacgtccgtgagttcagaaggatgggtgaagtcgcacgccaccgccgccgcgcgagccagctccaggtatgcagcacctggaagtatcggtgtcgtcgcgacctggtggtcccggaacaagaactcgccaccgtcgaacgacacacgcacctggtgccgatcgccgttcacgcgcttcagctggaacaggacgcccgtggacgcatggaccggtgccgcggtatcgcggccttcaacccagcagcgccggagcgcgaagggatagccggggagacgcatccgctcgaacgcgtctgctccgcccgaacggctccaccgcaccgccccgccctgcacccatcgttgcgccgcgctgcgcggttcggtgtcgccttccccattcggacggtcctctaccccgggctccgcgacaccttccaaggccgtggaggagcgtcggccttcttcatatgcctggagttgagcctggaggtccgcgaccgactcagccacgaaggccactcggaatcggagggcatcgcgtccctgctggagagtccgagccacggcgtgcaccgagcccgaaggctgcgcatccagcgcctgtcgcaggctccgggccatcccggggagcaggtccggcgctcccgccgacagcggcaccacctgcggtccatggccatctggtggtcgcgcgtcacgccgaggcagatactcctcgatgagcaggtgggcgttgacgcctccggacccgtacgaatgcacaccagccaatcgaggctgacccttccgtcgccacgcggaactctcacgcgccaggcggcagggctgcacatcctggtcaaggaaccgattcggctgatcgaacccgatgattccgtgaaccgtgtcggtctccaggctgcggatgaccttgaacaacgcccccagcgcagatgccgagtgcatgtgccccatcatcggcttgagcgtgctgatgcgacattgccccgcctccaacgagacaccctgccgctgcgcgagttcccgcagcgccctgttgcaggcatcccactcggcgatgtccgccacgggggtgcccatcccctgcgcctcgatgtactccacggcgcgcgcgtcaacgcccgccgtctggtagcactcctggatcagcgccgcatggctggccgcgctgggagacgcgatggacgtgccgccccgcccgttgaaagcgaccgcgctgttccggatgacggcgtagatggcgtcgccatcccgttcggcgcggtcaagcggcttgagcaggacgctggccacgccttccgcgcgcagatagccggaggcacgctcaccaaaggaccagacctccttgcctcgactcaactgtcccagccgggacagcgacacgaagagctccggacgcaaaagcaggttcgccgcaccgaccaacgcctgctcgacctcgccgttgcgcagcgccaccacggcgcggtggagagccaccgccgcgccggagcacatcgtgttgatgacctcgctcgggcctcggagatcgaagaagtacgacaggcggctggcgaccatgctcggggaatggccgaaggggtccgccatctccactccagccgactggagatgcgccaggtactcgttgtcctcgacggcgacgaagacgccggtgcggctctcccgcagcgtctccggggcgtaccccgcgttctcgaaggtgttgtacgccgacatcagcagcaggcgctgccgggggtccatgcgagcggcctcgccgtgcgagacgccgaagaactccgggtcgaagtcctcgatgcgcgggatcaagccaccccatcggctgtggctcttgctcgggtcgctgccatccgggtcaaagtgggcgtcgatgtcgaaccgcgcgcgaggaatctcttgaagcagcggctggtcgcggtccaaggcccgccagaacgcctcgacggacatgcagccaggcaggtagccagacaaccccacgatggccacgggctgcacccccgtcgcgggctccacgcggaccgcgggaggcgcctgccgccgatgtgcctccactgccgcgagcaactgtcgacgtttcacgtccatggctcagcagtaatccgccacgagtttttccaggtacggcagcgactccatgaccagcgggtagtcgacgccgaagtccacgaggcacgcgatgtcgttcacgcccgcggcgatggtcttctccaccatccgccgcgcgtcgccgacgtcaccgaacaaggccccggtggagaagtagcgctcataggcgtactccaggattttgttcttctccgcttcgccaatctccttcaggctcaccttccccgccgagcccagccccgcggcgagatgggcatccaaggagcttcggatgtactccttgaatggcgcctccaccgcccggcggaccaacgccatgtcgcgatggaccagcgtgtggagcatcaaggagacgatgccggtctccgggtcatggcccgcttccttccgagcctggcggtagagggcgatccggtcacgaaggacgtccaggtcacagccatacagcatggtgaagacgttgaagccgagccgccccgcttgcgcgaaggcatccgcgttctgggtgatgagcaaccagacattcagttccttctgcaccggccggggatagacggtgatggggatgtccacaccgcccggccctggaaagggcaccgtctccccgcgccagagccgccgcacgatgtcgatgcgctccgcgcagatggcccgccgtttctcgtaggcgtcgggggcatagatgaagtccggcttggcccaaccggagccgaagcccaggtccacgcgtccaccggacaggttgtcgttcatggcccaccactcgacgacctcggccggatggtgcagcggcaggctgatgcccgccgtccggaaccggatgcgcttcgtctgggcaatcaggtacgaggccatcaccgccgagttcgcgtagatggagccgaactcactgaaatgccgctcggggatgtagacggcggtgaagcccttcgcgtccccgaacaaggtgacgtcgcgcatgaagcggtacttctccgcgctggagatgtccttgcgcacgtccgagaagaacaagaagctgaagctcacctgcgagcgccgctggctgggaggccgaacgcccaggagctcttcgagcgacatcgtcatgattgcctctggggagattgagcggccaggtggcgaatcagcgcccgggccgtggagaactccaggaaccaccgaggcaggatgggcatcgccagcttcttctccagccgcgtggccaactgggtcgcggagatggagtccatcccgaagctctggaacgtctggtcgtccgagtagtcaccgcgcagcttcagcacttccgtgagcgcatcccggaccgcgcgttcgagcgcttcgccaccggtcgccaggcgacgaggagcccgctccacgggcgcggagaacatcagcccgtgcgctcgctcaaccaacgctgtcggcacctgctccaggtcgtagtccgccaggaacgccgccacggccgcaggcgcgggagcgccacccgcttcgaaacgccgcagcccctcttccagcccggcccacggggatgaggcgctcggttgtgtgtcgttgcttcgcgccaggccgaagacacgtcgagccagctccaacgagggagtcctgaccagcgccaccaccggctcggagagctgaaggctctggtcaatggcctccagcgcctgcgacggctcaatcaggccccagcccatggccgcgaaccgttcatcgcgccgctccggcatgtagctgtccaccgtccaaggcccccaacactgggagaccgtccggccagagcgctccccacgcttcacctgctcgttccgatggcgcgcgaaggcgttctgataggccgtcgcgtagccatagtcggacgagcctcggatgccgaaggcggccacggacgagaacagcaggaagagttccagcggttcgttcgcggagacttcgtcgagcagcaccgttccccgggccttggctgcgaccacccgttcgaaggacgcccagcgcttggagtagatggggctgtcctcgaccagccgagccaggtggaggatgccgtggaagacgcccacccgcgccttggcctccgcccacgcgcctcgcaaggcggccgggtcggtgatgtcgaccgggaggtactcgaccttcgccccaagggagcgaagcgtctccagctgcgcctcccggaccgggtccagggagcttcgggagaagaacaccagcgtgggctggtaccggcgggccatctgtctgcagacctgctcgcccaccggccccaggcctcccgtcaccaggtacgtgcctccctgccgcagcttcgggaagtccgtccgtgcctgctcgggtggcacctccacgaacgtcgccagggcccgctgcgcctgtgcatagcggacctcgcacggcgtggcgcagacgtggctgccaacgatttctggcgacgcttccgggtcggagagccattcctgcaacagcgcctgacgaggagacagtgccgctccgtccgcgctgaagcccaccaccttccagacatgggccgcgttctccagcatggcggaccggatgaaccctccaagcgcctcggcgtcgatggccgactgcgacgggctcacttcatggaggtgatagaggcggacagcacgctcccccgccgcgcgcatcagcgtctggctgattcgaaacacggtctgcgccgcgcgcagggcgccctgtccctccggcttcgaggcccccagcgagaacaccacgtcgggaagcaccgggaacggattgccgtcgagcgcatcaccgaagtcgcgggcgtccacggaatggactcttggagcacggtctcccagccccgcacacgccgctgacagcaggaccttgaaggacgccaggtcgtccgcctcctggtagacgatggcgatttccttgcccgcgtagcgcgccagacggacgcgccagtcgatgccatcctccagcgccgtgggcacccacttctgggccacgcacagccaggaaccggcacccgcctgcggttcgcggacaggcgccttcaccacggcgggaattccgtcagcagcctccttcgggtgcaaccagtacgagtcacgctcgaaggggtacgccggcagccgcagccgacgcgtcaggagcgcactgaacatcggctgccagtcgaactcggagcccagcaggtagaggtctgcgagcgcgcagaggtcgtcatggaacccagccccctcgcgcgcggctctcagcaacacgtcgtgtgggaagacctgctgcaagcgctggaggaagcgctgcttgcgcagactgtcgaacttggtcgctcccacggtggaggcccggcgccgctcggccaaggacagttgctcacacaggtccccatggctcgacaccacgtaggcggagcgatgtccccagtgcgcgcgccccatggccagactggcgctgacgtcgcccaggtcttccaggggattcgcctggagccaggtgagcaggtccgcctcacgccgctccagcgcccgttcggtccgagccgacaacaggacgagataccgccccccagcccccacgccattgctgacgggccttgtcgccacgtgctcccgcaccaggacgtgcgcgttcgtgccacccgacccgaagctgctcacgcccgccacgcgacgggcctgtccctccgacagctcccagggatgctcctcgtggctcacgtagaacggggtgcccgtgaagccaatccgcgggttcatctgttcgaagtggaggttcgcgggaatccgcttgtggcccaggcacagcagcgccttgagcaggcccgccgcgcccgctgccgcttcgaggtgcccgatgttcgtcttcaccgagcccaccgcacaccgcccggtggaacgcgtccccttcgcccgagacatgcggtcgaaagcggtgaccagccccttggtctccaccgggtcgccgagcgaagtgcccgtgccgtgcgcttcgatgtagccgacttcctcgggcgccacgttcgcagcctggagcgccttgcacaccaactccgcctgcttctgcgggttgggcgccgtgagccccgcggtccgtccaccatggttgacggccgagcccatcacgacgccgtagaccggatccttgtccgccagggccttcttcagcggcttgagaaggaagaccaccgccccttccccacggacgtaaccgttggcgctcgcatcgaacgtcttgcaccgcccgtcctcggacagcatgcctgcgcgctggtagcagaccgtgttgctcggctcgcagatgaggctgacggcgccgaccagggcctgaccgcactcaccgctccgcagtgctcgcagcgcctggtcgagtgccaccagcgagctggagcacgcagtgtccacctgcacgctgggaccgctgaagtcgaagaagtaggagatgcggttggggatgacggacgtggacgtggccaccgcgtattgcggagcgatgtcccgcccgtacttgtcctggagcgtcttatagtcggagccactcgcgccgacgaagacgccggtgtcgcttcccgccagacgcaagggatcgtgccccgcgtcctcgatgcactgccagctgagttcgagcagcagccgctgctgcgggtccatcaactcggcttccgccggggagatgttgaagaaggccgcgtcgaaccggtccacgtcactggcatgcgcgacatggcccgaggcggccgcatgtcccaggccggaccagcgccagcggatgtcctcgagcgtcccgacgagggactgacgagcaatcagcgtgtcccacagttgctgcggcgtctggacaccgccgggcaggcggcaggccacgcccacgatggcaatctcctggtcactcacctcgcccgagggagccggcacgggcgcgggacgcaagggcgcggacacgggctgcgccaccaccggctgattccggccggcgaggaacgcgccaatccggtccagggtgttgtgctcgaagaagaaggtctcctccagcttcagctcgaagcgccggccgatgtgctcggcgagctccatcagccccaccgagtcgacgcccagttccatcagcggaaggtccagccggaccgccgccgcgtcgcactcgacaatccgtgcgaccacctgacgcaggtagtactcggtctccgtggacgccacgccacgggccgtcaccgctggagcaggactcgcgctctcggcgtcttcgaccggggcatcccggcgaacacggttgtgcacgtcatagcgcaccatcacgccatggccgtggttgtccgcatcgcgaacccggtagcccacgaccaattcgcccagctctgcgccgtgaatctggtggaagcggagcacggggtccacggacaagccgtgctcatcgcgcacggcgacgtactgttcgagggacaggtgcgcgtggcggccatacgccttgcagcgagtcacccccaccaccgatgccacgtcattcgacagtgcgcagtactgcagcatgaactcgagcagccggtctcccagccgcgaatgctgcgcgctcggcgagacgttgacgcccaggagctggaccactggccccgtgtccgtgtggagcgtgtcgaccgtctcagccgtggagccctggagcacgccgtcatcacggatgcgctgggagtagatggccccgacgacctgtccctccagctccagcaccagttggccctgagggtacttctcgacgcgggctttcagcacggcgtccggcgcgcgcagctccgcgtcccagcactcgcgctccagccgctccagtgccggcaggtctccgagtcgcgcccaccggatgcgataggatcgcttctcgaactgcgtgagcgtcatccgggtgaacgacagcgtccgcgggaaacggcggatgacgtcatccctggcgaacagccccgcctgcgcggccgcgagcaggaagtggttcgcctccaccagcatctgatgcgagaagcggtggtaggcgtcgaagtggaggctctcgctctgactgaggttgccgcgaaccaccggcgccggcaggcagtgaacctccaggatgaccaggggatgccggtgcaggatggcggcccagcgctcgaggtgctccaccaggctgtggaacacctccgccggaaccacctcctggcccgccttgcccacgaacaccgaatcgaacggaatccgggcgtggagccccgccctgtccgcgggaggctggtagggacggtcgtggtcgagaaacgagcggatgtgcagcgtattctcaggctcggctagcccgcgcgcccgcaggtcctcgatgagacggtccggccgcgccacgtccgcgcgcaaggcaacgtgctccaacccggccagcgtccgcccagcggcttcgagcgccttctcgttgaagtccgcggcgatgagcgtgagcggaaaccggtcgagcgcccttccccgccgcgtgtgccgaagcaccgtttcatacacccgcttcaggagcgtgccgtcaccgcaccccatgtccgcgatgtagcgcggctgtgccgacaggttctcggcatcgaagacggtgatgatgagcttctccagctccgcgaagtacttccggtgctggtggccgctcccaatcacgttgagggttcggtccaggtgcagttcgtggcccgcttcgtcccgcccgaagacctggtcgcagtcaccgaagagcagctgcggcatgctggccagcatcggccggtacgagccgacgatggcgaagagcaatgcccgctcgaagatgaaggcgcccttgggcgtgagctccgcgtcgacggcgtcctcacgcgtccacttctgcgcggagaagaacccggccagctcgtgttggacggcctcggggacgcacgtgtcccttccatcccccccggaccacaggtcggacagacgcctcgcctccttgaggcccccacgctgctccagcgcgagcatcagcggcgtgatgatggcgccgtcgagcagctcgcgcaccagcgtgtcatcggtatcccacgacgcccgagagcgctcgaaccacggcgccagggacaggccgtcctccccgcgcaggtaccggtccatgggcagcgcgaagagcgactgcgcctcgcgggggaaggaccgatgcgcggccgccgccgccgtcaccgcgtacacgtcatccgcgtcgcggcgaacccagccgagcgattcgaacatcctcatcgcgacgcgcagatgtccccggttggcacgcaatgcctccgccaaccggtcgaagtccttcggtccctgccgcaggagttcgaacaggccagcgtcgttgcaggccaggaccacgggcgtgaccacataaccgtgtgcgtggttgttgatcaggttcaacataggggcgcgcctcagaggaacagctgctcgatgcgcctcctcacgtcgtcgtgatggaaggtgatgccgtgcatctccagctcacgctcgatgacgtccggaagctctcggcggatgtcgcgaaccaggtgccgcttgagcgtcacgagcgacagccgaggtttcgcggccaggtccctcgcaatctcgtaggcgtggggcaagacttccttgcgcggcaacaccggaaaaggcacgccccgcttctccaggtcggcgccgcggtagttcctggcgttgagcaggagctcatgcccgagcgagtaccccagccgcttcggcacgatgtacgtggcgcccatccccggcgtgaagccgtagcgcatgaagttcgtcgtgtagacgctctcccggctcaggaccacgaagtccgcgaacagccccatcgcgaacccgccgcctacgccatgtccctgcatggcggaaatcaccgggatgtcgcactccagcgcgaggctgtagaagttggtgacgttgaaggagccgatgccgtcgcagatggacagcaggccggccttggtcccgccgagcgcgaagtaggtgtcgtagccggtgagcaccaccgcgcggtagcgctcgtttccattcaccttgccgaacacggtgatgagctcgcgcacgagctgctcgctgaacatgttcttgttctcgcgatccaccagggtgatctgcgccaccccctcctccacctcatggagcgtgaccaccggcgccattggcgttccttccgtcatgattcccatgggagtcggcctgtctccacgtagcgatggatggcttccagcgtggcgcggtcggagaacatcgcctcattggcggagatggcccggggcatggccgcgagcagctggccgcccagctcggaggcgtacttcttgtactgggtcaccgctggcttcgacaggcaccgcagcctgcgcaagtggagccgcaacagcttctcgctatcggcgtccaccgcgtccgccaacccccagctcagcgcctgggccgcgtcgatgggccgcgtcatcagcgtcaggtagtgcgcccgctggatgccgattcgccgggcgaggaacggcatcacgcaggcggggaacagcccgaacagcagctcggagagactgaactggacctccgcctttgccagcacgatgtcgcacgcggcgacgaagcccaggccgcccgcgttggccttgccctgcacatgggcgaccgtcacgtaggggcctgtcgccagttgcagccacagccggtacagctgctccgcgttgccttgctcccggcggccgtcgtcgacccggtcgtggatggctcgaaaatccgcgcccatgcagaacacgtgtggcaggccttcgagcaccaccgtggtggcgtgctcctcacataacgtgagcacctgctggcactcgtcaatcagcgtgcggctgatggtgttgtccgcatccggccggtggagctggagaaaacaggtctgcgcctcgaagcggacccggagcgtctggtagtcgcggtgcggaggggaagcggcttgcatgggcgtgtcagctctccgtggcgctccggcgcacggcgacagcggtgttgatgccgccgaagccgtaggcgagcaccagcgcgttctggagggactgggcctccgcggtggcccccacccagcggaacgatgaatcaatcgggtccaccaggttcaaggacgggtgcagccggccctgctccaactggaccagcgtggcgatgagccccacggcacccgccgaggacaggccatgcccggtgatggacttcgtggtgttgacccgggcgtgcgtcaggccgcacgccttcaaggcccccagctcgatggcatccccctgacgcgaaccgctgccgtgaggattcacgtagtccacccgctccggcgcgaggtccgcgtgccgcagcgcagccccaatcacctgcgactccccttcgatggacgacaacgggccgcggctcgcgtccaactgcatggcccagcccgacaggatgccgcgaggagtcaccccgcgtcgccgagcgtgctccgcagactcaaccaccacggcgccgcacgcctctccaaagatgaagccatcactctcccggtcgaagggccggcaggcacgctccggctcccgcgcgaaccggtcggtgcccatcgcgcccatggcccgcaggccctggcattcccagtaggagacgtccatcagcgcccccacggcgatgcaaacgtccacccttcttgagagcaccgcctccgcggcctggatgaccgccagcaggccactggccgatgcgcctcccaccgtgaaggacatcccgtggatgtcaaagtgctgcgtgccagaggcccacgaggtcggtgtccatgaaggtcgacccgtaggccgcccgcagaaagggcacccgctcgcgataggcgtcttgcatcagcaccaggtcgcgctgctgcacgttggtgccccccaccaccaatccaatccggtgtccggggacggcctggaggcgcaccgcgttccaggcctcgtggacggtcaccagtgcggcctgccccgaaaacgtggccgagcgccacagttgtggggtgacgccttcgggcacggccagcgaggcgatttccgcccccaggtgggccgtcgtctgcccgttggcctgatgctgacggcccggccgctccatcacccggaaccgtgccgcgccctccagcagcgccgaggtgaaggacgcggccccctggccaatggcggaggtgaccccgaaccccgagacaaccagctcctgcacaggtgaggtggacattcagtggtctcagcagccggacggcccaccggccgaggatttcaacgacgctccggagggctcaggcattcgcccacttcgcgggcgcggcggtggccggtgcgggggcgccccgcttgttcgcggtgatgaggcgggtcagcacgcggccggggcccagctcctcgaagtcctccacgccctgttccaggaggtagcggacggtggccgtccactgcaccgggctgcgcagttgcagagccagcccctgcaccacgttgtcatgagcgtaaggtcggcccgtgacgttggagatgaccacgcaccggagcggcgcgtactggaactgagacaggaagcgctcgaactcgctggcggccggctgcatgtagcgcgagtgaaacggcgctcgcacgttgagcggaacgtaccgcgcgccacggtccacgaaacactgccgtgcccgctcgatgtcctgcgccggtccggagaccacaatctggtcgggcgagttgatgttggcgatatccagactggtcagctgacggtctcgaaggacctgttccacggccacggcatcacagcccaccaccgcggccatggtccctccggacgcgccgctcatgagttcgccccgccgcttcaccagccgcagtcccgtctcgaagtcgaaggcccccgcgaccagcagcgcgttgtactcgcccaggctgtggcccgcgacgaaggccggctgctccgctccttcacgcagccgcttcaggtagctgagcgcgttcaccacgtacaacgccggctgggtgaactgcgtctgcgccagctccttgcctgggtcctccaaacagagacgcttgatggaataccccaggatggcgtcggcgatgtccgtcaggtccgggaactcgtcgaagagcgcggcccccatgccgcgctcctgcgagccctgccccgggaagagcgcggccttgcgggcattcaccggcgcgctcgccgctcctcgggtgtgcagcgcccagggcgagctcggcggcggcggcacctgcgcaggcgccctgggtgcgggcgcctccgtcatcgcgcagctccgcgtcaccccatcgagctcccggtcgatgcgggagaaggggctgagcaacgggaagagccgtgacgtggagtcccgcgcgaggatgcgcttgatgatggtcgcgaaggacgcggcggggccgacgtcgatgaagtcgcagccgccctgcccctccagttgcaggacggtgtcgtacagctggatgggcgcgcggaccacgttccagaagtggtcgctgcgcaggtcgtgcacccggttcgcggtggtgcacgagtacatggggattcgcggccacgtcagcgaatccgcgcggacgcggcttcggtactcctccctcagcgggtccaggtgcgaggaatgaaaggggtagcgcaccggcaaccggtggaacgccaccgagcgttgggagagttcctgctgaatccgtcccaggcccgcctcatccgccgcaaggacgaagttcgacgggtagttgatggctgcaacctcgccatcccgcgcgacggacgtgaagccccggcaggcttccagttcgtgaagcaccgcgagcatgccgccccgcggcgccgtacgggcaaagagctgggcctgcgccgccaccagggccacggccgcgtccactgagattgcgcccgcaatcgccgccgccgccacctcgcccatgctggcgcccacgacagcgtccggctggataccccggtcgatgagcagccgcgccagcgcatgctcaatcatgaagatggcgggaaaggacaccaggacatcgtcgagcggatccaaccgcgcggcgcgcgcgtcatagattcgctcgagaatcgagtgccccagccgctgcttgaattgctcgtccagctccagcagctgccgcttgaaccccgtctgggtgtcaaacagctccttggccatgaagtacgactgggtgccctggccggaaaaaagaaacaccttccgccgtgcctgtttcgacactgaatcgaccatgatgttcaccgcgctggagatggtggggccaagcggttcagctcggcagccgcgactcgacgatgatgggcacgccctgagacggcgccagcgtgttgctccggcgcaccaccttcgcgtggtagccgggcctggtatcgaagcgcatgcggcgcaccgtctccgagacgaagatcttcatctcgtagtaggcgaagctcgtcccgatgcacttccggatgccccctccgaaggggaagtagtggaacggattcacccgctcctccaggaaacgctctggccgaaagaccttcgggtctccccacaggtccgcgcgatggtgcgtgccgtagatgttgggcgacagcaccacgttcgccgggtacgtcgttccgccaatggtctgtggctccttgagcacgcgagccaccaggctgaagacgggcgtgatgcgcatcgtctccttgaccacggcatccaggaacttcagctcgttgatcttcgccagcggcagcacgccgtccaccgtgtgggccgcgatctcctcacgcagcttgcccatcgcatccgggtgacggcagaggtggtagacgcaccacgcggcgatggtcgcgctcgtctcgtggcccgccatcagcagcgtcatcagctcgtcgcgcagctcctggggcgtcatcacggagccgtcgtcgtagtgcgactgcatcatcagcgagagcacgtcctgccgcccgctgatgtcctggctccggcggtcctgaatctcctggtagatgatgtcgtcaatcgccttcagcgacgcgaacacgtccagggagggaaacgccttgcccacggcccgcgcgaagccctcggcggcgggcttgccctccccgttcgggaacaggaacagggccagcttgagcacctggtgcacgtggtgccggaactgggcaatggtccgggcgtcctccaggccgaaaatcacccggagaatcacctccagcatgatctgctgcgtctcttcatggaccgcgaacggcttcccgacgggccaccggtcaagcgccgcattgacgatgtcccggatgaccgagccatacgcatgcatccgttcacccacgaaggtgggcatgatgagcttgcgatcacgccggtgccgcttcccgtccaacaccagcagcgagttctcacccaccaccggcttcaacccgttgttcgccttccctccgaggaagaggtccgggtcacccttgaagatgacctcgatcaaggcgggatcgctggtctggatgaacggcggcgtccccggaatcttgagggtgaaggtgtcaccgtaccgggcggcgcagcggtccaggaactccgtgggccgcaggaacaacatcatcaactgcgcgatgccgggcattgccggaccgcgaggcagtgcctgggcgccgacgggcgcgacaggcggtggttttgacaaggcgtggtccggctcaactggctctgaggtccccatgaactccagtccttggcccggcggccgaccgcacacccatggcggggcctatccgggagacaactgctgacgcggctcgcggaacgactccaggatcatcagggcggcccctacgactaccgctgtgtccgcgatgttgaaggagggccaatagaagcggtcccccacgtgccatgacacgaaatccaccacgtagcgcaggcgcacccggtccacgtagttgcccaacgcgccgccaatcatcgtcgccagcgaccagcgctggagcttcatcgtcggcggcgtgtagaagtagtagccaatcagcaacacgatgcagatggcgcccacgacgtagaagaaaggcatgcgccactcttcgccgaagctggagaacagaccgaacgcacccgctcggttctccacgtagtggaagtgccaccagctatcgaagaccgcgacgggccttttcgccccgtcgcgcgccatctgtttggtgacttgatcggccgcgaaccatgcgccgccaacggcaaggagatagcccaggcgggcaggccagttcgtcaaggaaggagtgttcattcgtcggaattggaggtggcgtatgagctacacccactcgtactgacgatgatagtccacgacccttcgcaaggcgagcatgcgcgggcggctcgccgtccgcgtcaccagcgggaggtagcgctccacgtccacgtcccggttcttcgttggaaccagacagcgaaggttctctttcagcaattcgacatattggtcgaacgtgagctggcggcgcccccggaggtggccaccgatgtccaacccagctagcgcggacacggactccgggccgatgacgccgctgaagaactccgacgagcaacccgacccataggagaacattcccacccgagcggaccgctcgggcttgatggtgtcgatgatgctgcacaggctcaggtacacggagccggagcacaggttcccgaccagactcgggtactgcagtgacggcttcacgcgccggccgaagtccgcttcgatttcgtccacgtcgcacggggtgagctcgcgcatcatcttgcggtgcccggccttcaccagtccggcgaacggcgtgtgcatcgccaggtagtcgaacgtcgacacgaagtcgacaccgtccacccggcggccatacgcggcgaagctgtgcttgaggcagtccaggtacgtgaagagcgaccggtccacgtcgccgatatcaatctccggcgagggccgcgcggtgtcgaagacgtcgtagctgtagttgccgaacgctcccaggtccatcttcatcacgcgcggctcgtcgcccagcagcacggcgacgccgccggtgcccatcgccggctcggagtacagaccgctctcgtccaccagcgtcacgtccgtggcaatcaccagggccttggcccccggtgacacgcccgacgcgatgtagcccagcgctagctggagcgctccggtggcggcgtaacacgcctgcttcacctccaggaaccggcagtggcggctcagccccaggtgctcgtgcgcatacgaggagatggacttgctgaagtccacgccggactcgctcgaggtgaccaggagctcgatgcgctcccgggcctcgggcgacatcgcgtccaggatgggccgcgccgcattgaccgcgttggtgacggggtcctcgaacggcagcgcgacgccgcgctcctgcatcatcaggttggagaatcgctcggggtccagccgccggccccggaacaagtccaacaccggaatggaggcggcgccgccgtaggcgttgatggcctcgatgccgactccgccgggaacccgctcagccacccgcgacctcaccggccaggaacgccaccagcgcgtcgatgttgcggatgtcggcgaacttcgccagtggcgtcttctgcagccgcaggctgtccaggatggacgtgagaatctcgacccggtccacggagtccgcgcccagctcgcggaggttcaagtggcccgcaatctcgttggagcgcacgcggggcaggacgcgcacgatggactggtgcacgactccgcggatttgttcgtctgtcatcggctcacccacggcggcctccttccgaagcggcgtcgaagcgcaccttgaccgtcgccacggcgatgtcccggccctgcgcgccctcgcgcatcttcacgttgaacagctcttccccgccgcccacccgctcccagtgctgcacgtcgatgtcgaaggtggtgtccagcgccgcgttgccgaggaagcacagttgctggtccagcaccacgcgcgacaggaaggcctgctcgctgcgtccctggtgcctcgccagctgccagatggcccagtccaccatcgagaaatacgacgcgaagtagatgagccccaccccattgacgtcccggatgacgtccaccgcgtagcgcagcgggaagcggtccacggtcagccggtactccgcggagtccacatcgtgaaaggtgccccgcgcccgcgcgtccccataggcccgccgcggcgagtattcgtccggcaagagcggcaggtgtgcgtactggaaccccacgggcgaggacttgatcaggctctcgttcgacttgccgtccgagcgcgtgatccaccggttgaaggtctccgcgtagatgcggcctggctggggctgctcgtacagctcttcatggccgaaggcatccgcctccggagcgccgccctccgccgtcttgcagatgcggtgcaccgtcaggacggattcgctgccgaagttgtacgccttcgacgtgacgtccagcgtgtcgccgaagcgcagcgcgccgggatgcagcgcgggcgtgccccggatgcggaagtaatagaaggccaggtaggtgggcgcgcctgaggcgttggtcgcggtcagcacgtccgtgccacacaggcggctgacggtgtcccatgcccagtcgccaatctgcccggcgaacaaggacgtctggccgcacatgctgggggtgattcgcagccggcggctcaccgcgctgtcacgggccgtcagggggacggccgtcgctacgctggacatggctttgctcgaagccccgaggctaggaaatccattggtagtcgcgatggaagtcacgaatcgccgacaagaagagcaagggcctgccccacccgcccggccggatgctgccgacgacaccgaaatccagctcggcgttccgggtcccgaagcgcaccaggccgttccccttcagcagcgcgtcgtaatccggcatggagagctgctgccggcgccccagcgcttctcccagccccagggcgcgctgccgctgctgcccttcctccgtcaccacgccgctgaagaactccgagctgcaccccgagccatacgagaagcagccaatccgcttcgcggtggcgaagtcgccgtggtcgatggtcccgaggagcgagagcgccatcgtcgcgcccatgatgttccccacgcgctggcagtaggtcagcccgggggccactcgccgctggaagtccgcttcgatgtccccgcggttcttgccggagaacttgcgcatcatcgtgcggtgggcgcccttcaccatgccgccaaacggcgtgtggaaggcgaggtagccgaagctctccgcgtagttcgccgcggggacgcggcgggtgtactcccggaaggcgttctcacagcagtccaggtacgagaggagcgacaggtccgcgtctcccgcttcgctgtccgccaccgggcggcaggtatccatcacctcgtagccgtagtagccgttcgcccccacgtcgacgcggaacacccggggcgtgtcgctcaccagcatggccaccgcgcccgcacccgagctcggctccgcgaaggaccagtcctccgtggaggcatctcccccttcggcgatggagaagcgcgacaggtcggaggccaccaccagggccttggcccccggcgacacgccggacaggatgaagttgacggccatctgcagcccggcgaccccggagtagcaggcgctcttgagctcgatgagccggcagttgcggctcagccccaggtgctggtgcaggtaggtgctcatggccttgccgaagtcgaacgaggactccgtgcaagccaccagcagctcgatgctgtcccgttccgccgcggtcaactggtccaggatgggccgggcggcattcacgccgtaggtgacagggtcctcataggggagcgggacggtcttctcctccatgagcaggttcgcgaagcgggaggtgtccaggccacggtgggtcgccagctgcaacacatccaacctggcgatgccacagtaggcattcatggcttcaatcccgaccggccccatggcttcgcctcacagcctcgcgtgaaggacgtccaccagcccgccaatggtcttcgcgtcaatcagctcgacccgggggatgttgagcgccagcttctccagcgtgaggttgacgatttcggcgcggtcgagcgagttcgcgcccagtccgaccaggtcatcctccggctcgaacggatgtgattcgagttcgggtaccacctcccgaacactgctggtgacgatgtcgaaaataattctcttgtccatggaacgactcacggtccctgaagccttgctgcgggtcggggtgatgaaggaatggaaggggatgtccgcggaatcagtcggtgatcggttccagttgctcggcgctcacctccacggacaccgagcgctgtagcagccccacggagacaatgaaccggagttggctcttgctcgtcaccagacttccttccagacctgtcaggggcccttcgatgatgcgcacgcgctgccccacccgcagatagtcacagggattggaagagacacccgaatccgcgacccggcggatggcctccaattcctgtgcgggcacggcttccggccccgcgtcacctccgagcagccggatgaccccgggcgcccggacgatgcggtacggattgagcggctggtaacgacagaaaaggtacccggggaagagcggaagcttcgccttcacacccgaggacttgggaggcgtgtacgtcggcaggaagaactcgtagccgtgtttccccaactgagcggcagccactttctcgtgattgacgcggacgagcaatgcaacccaatcgttctcagcacaccgcggcccaggcattgcaacttccccccagcctgctatttctcagaatctggcaataactggcacaccaaccgaattctggtcgggctgccgccacaaccnccgccgcatccttgcgttcaaaccgctgacagccccgtctcaaattccggctgcctgggtccgcgaggatggcgttctggaggccctaaggctcggcaacgacaccgttttcattgttttgcatacgcttccatgaggcagcgtgtcaagcaaaccgccctgaaggataaacaccgttgaagctggaaacaccccaagcgtgacgagagcgtgactgccttcaacggcgtggttacggcccgaggattgctaaacctgcactcgagagccattgaatcactctggagtgaacggaagccggcgcattcccagaacccagacggttgtgtccgaggctccgacaagacttgaaacacacagccccgctcgatgccgggtgcaacctcctggacgccttcccgcatcgggagagatctgaagacaggactgccgtgggacgttggaagacgtgcccgccgccccgtcctgcgggcgacctgcaccgctttggatcgcccgcaccaggcgagcgcgatccattctggagcaccggtggacgagcccgaggcccgcgctcctgattccgggcatttgggaatggcacaccccgtgctctgaggctccgggcatgagggcgtcccaggcggaggccccccattcaaggagacttacgatggaagtccggtttcatggcgttcgggggagcatcgcggtgtcgggctcgcgcattggtggcaacacggcctgcgtggaggtgaccagccagggccaccgcctcatcctggatgcggggacgggcatccgcgcactgggcgaaatcatgatgcgcgagggcgcgccccaggaggccacgctcttcttctcgcatctgcattgggaccacgtgcagggcttccccttcttcacgccggcctggctgcccacgtccgagctgacgctctacggtccgggcgcgaatggggcccaggcgctccagtccgagttggccgcgcagatgcagccgcctcattttccggtgccgctgagcaccatgcgctcgcggatggacttccgctcggcgttgcatgcccgacccgtggaggtgggccccttccgcgtcacgcccatcgacgtgccgcacccgcaggggtgcctggcgtaccgcctggaggcggatggccactcgttcgtctacgccacggacgtggaggtgcgggtgcaggagctcgcgccggaggtgggccgcctcttcgagggcgcggacgtcctgtgcctggatgcgcagtacacgccggacgaatacgagggccgcaagggcgtggcgaagaagggctggggccactccaccatgatggatgccgcgggcgtggccgggctggtgggggcgcgccggctgtgcctgttccaccatgacccggcgcacggatacgacatgctcgaggacatggcggagcaggcccgcgccctcttccccgtgtgcgagcccgcacgcgaaggccagcggctggtgctgggccgcgctgcctgagagggggcagtcccatgccctctggatgctatggtgcggtctcctccttcgatctgacggcgttgcccgtcatgtcccaagcctcatgggacgtgtcctacttcctgctacccttcgcaggactcgccgactgacacgtggaccctaacgccttcctacagactctgatggaccgcatgcccatgactctgaaggcgtaccgttgcacgc

SEQ ID NO: 1271 - DNA, 50725 bp, Myxococcus xanthus
tgccctaaagcctccaccacgttgtatcccgccagcgagagcagccggttgacgaggtatcggttggcgtcgtcgtcgttgacgttgaggacggtggctggatggggctcacccacggcggcttgcctcctgcggcaacgcttgggagcccaggccggccttggacagtgcgtcccggatgcgggtgatggccacctcgcggctcagcgtgtgcttggcgaggatggcggccgtctccttcgccagccgcgagcgctcggcctccttcagctcgtgcgaggtgtggaggatgacggggacgtcacgcgtgcgcgggtccgccttcagctcgtccagcacgtcgaaggcggtgatgtccggcagcacgaagtccaggaagatgaggtgcggggacttctcccgcgccaactggacgccttccttgccgccagccgcctccagcaggacgtagggcatgtccttgaggagctgcgtgagcaggtagcggtgcacatcatcgtcgtcgatgatgaggatgcgctccaccggaccggtgcgggccatggcctgcagcttgcgttgcagccgcacctcgtccaccggcttgagccagaactcgtcggcgcccagcgcgcgggccttctgctcgcggtccgtcaccgtcaccaccaggatggggatgtcgcgggtggcctcgttgttcttcatgtccgccaggaagccccagctcgtctcgccctccagcatgacgtccagcaccatggcggcggggcgcacgcgctccagcacgcgccgggcctcatccgtgctgcgcaccggcagcacctggaagccggagcgcgccaggtacttctcgtagaggaagagcgtctgccggtcgtcctccagcaccagcaccggggcccggctggggtccaggtgctcgctgcgctccgtcaggccggtcatctccgtgacctccatgtggacgcgcgggagggtgacggtgaacgtggcgccctgtcccagcgcgctcttcacggtgagcgtgccgcccaggagctccgtcagccggcgcgccagcggcaggcccaggccggtgcccttcgccttgcgttgcaggtggctctccacctgcgagaactcctcgaagatgcgctcgtggtgctccggcgcgatgccaatgcccgtgtccagcgcggcgtggaggctgcgcacgccgcggttggattcctccagctcgttgttgaggcgggccagttcgtccgcgcggcgcttgagctcgcgctgctggcgctccgtctcgcggtggagcgcggacatctcgctcagggtggtgctcacccgctcgagcgcgccgccgtagtcctccggcaccaggctgcccaccagcagcacgcctccgtcatggggccgggcgcggaaggcgaacgtcgtgggcacctggtcccggcagaggatgagctcccagccttccaccttctcgtcgtgcgcctggaccagcagccggtccaccttctcctcggtgccctgggccgccagtccgcgcagcgtctgtccgggattggcggcgaggacgttccgggcacgggcgtccacccaggtgagggtgtcgcccgcgtcgcaggccagggcgacctcgcggctgaggtcgtcgaagaactgaggctcggcggaggcgggaagcctcatgaacgagtctcctcccaggacacccccgcttcggagaggagcgtccgtgcttcggggtgacgtgagcccagcacggacttcaacatgcccagcacactgggaaatgccaggaggccaaatccgcgcctcggccagaagccggcgtaccagcgcacatggtcgccgagcaggtcgggcttcccggcggcgagcgcgtcggccacgtaggacagttgcaactggagctcttcctccaggcggggctggtcctcggggatgatgtagagcgtgaggcgcgccgtggcggcgcgcgcgagctcgggcgcctcctcttccagcaggcgggctggaccctcctggtagcgaagggcctgtcgcgcggcgcccacgtagtcgtggggttcgctgccggggccccagccttccgcttccagcgcggcggccagcgcggcgaagtgccggtccagatggcgcgagcacatgccgcgcgacaccagcagggtgcgcagccagcgggcgtagccttccaggacagaggggaggtgctcgtccagggactgcaccaggtagcggacgtggaagcgcgcgtcctcgtcaccgaagcgctgcgcgcgctccagcccgtaacgggcggcccagaaggggtcctgatagagcgcctcctgagaggcggtggccagccggtccgcccgcgcttccacgctcttgctcacgctctccatggtgctttcagactcccagggcccggcaggcggacgcgacgaactgccgcgcgtccttgccgaagaagttcacgcccagctcctcctccagtccgggtgcccagttgaaggccaggccgcccacggcgatggggacatccgggagtgtcttgcgcacgtgcgccacggcttcacggagcgcgggcaggtggtacgtcatcgtcacggaaagggcgaccaggtccggacgaagctcgttcgtcatgcgggccaggtgctccggtggaacgttggcgcccaggaagcgcacgtcgaagccggccatctccaggaagtcgctggacatgcgcgcgcccacttcatgcagctcgccctggacgcaggagacgaggacgaccttgccgttgaacggatccctgggcaggtgccggtacaggtgcgcgagcgcgagctgggagacggcggtcgccaggtgctcctgcgccacggagatgacgttctcctgccacagccggccgatttcatactgggcgggctggatgacctccaggtgcagcgtctggagggggatgtcccggagcagtccctcgtccacgagcagccgcaacgcctcacgccggttcccggcgagctgcgctgcgagatacgcgttcagcaggcccgtcagggcggagtcatgggaggtgagcacgggcgccgtgggggaagggcgagggggcaacgtaccggggttgcgtttctcagttacagtgaactggccccgatttcatcgccaacctgacagtgcccggcccttctttcacgcgctcgcgtgcctgcttgcttgtagcttttaccgagtcggaggggcggcattgtacctgggtacaaggacgctgcgctgattcccgaaaagtccccaggaaactcgggactgaaaagtccgagtgacagttctccgaggccgcggtgtttccctgtccgcggcaaccgagggaggcgagcgagcggtgtcaatcgatgtggaggcctactaccggcgctatggcccccaggtgctccggcgctgccgcttcctcttgcgtgacgaggagaaggccgtggacgccatgcacgacgtgttcgtgcagttgcttcgttaccagggcgcgctgaaggacgcggcgccgtcgagcctgttgcaccggattgccaccacggtgtgcctcaacaggctgcgcggcgcgaagcggcgtccggaggaccgggaggacgaactggtgctgcagattgcctccgccgacgacaccgagtcccgcaccgccgcgcgcggcctgttggaccgcctcttcggccgggtgcccgcgtccagtcaggacatcgcggtgctgcacctggtggatgggatgacgctggaggagacggcccgcgaagtggggctgtccgtgtccggcgtgcgcaagcgcctgcgggcgctgacggcagtgctgcaagagctggagctggaggccgcatgacatccgcccaccaccgcaccccggattggttgctggaacgaatcgccctgggcgagctgccgcccgcggagctggccgccgcccgcgcccggctggccgaggaacccgacggtctcacccggctcgcggcgctggagtccgacacgcgcgccacgctggagacgctgccgcccgcccgggtggcccgcgaagtggatgcgcgcgcggcccggcaggacgcgccccgcccggccttccgcctgtcgcccgcgtggggtctggtaccggcgctcgccgcggtggcgctggtcatggtggccctgccttcctcggaaaccgggctcggcacggccccaggggacacccgggaggtcacgcgcatcaaggggctggcgccgcagctcgtcatccaccggcagtccgccgcccggccggagcggctcgccgacggggccgccgccgccgcgggtgacgtggtgcaggtggcgtacatcgcctcgggccgctcgcatggcgtcatcgtctccctggatgggaacggcgccgtcaccctccacgcgccggaggagggctcccagtccatggccctggtgccgtcgggaacgcaggtgttgccgcgcgcctacgaactggacgatgccccggggttcgagcgcttcgtcttcgtttcgtccgatgcgcccttcgacgtggcggtggtgctggccgccgcggaggcactggctggaaatcccgacgcctcctcggcacctctgtcattgcccgggaacttgacgcaggcctccctcacgctggaaaagcatgagtgatgaaatcctttgcgctcctcgcattcgggctgtgggcggggacagccaccgctgagtcccggtacgcaccccgcctttcgctgatgagcgagcagggggccttcgcccagcagtcgggggacgatgtctcggagtcctcctcgcgagggctgcgccggggctccacccacatggagttctggttgagcgacatccaggtcgccaacatgggggtgaagctgggcggcggaggcgtctacttcacgctgatggcgggcctggagccgggccgcgacgcgcgcttcagcttcgcggcgggcgtgggcgggcacatgacgctgtcccagcggctctgggtggacctggacgtgacgggcggcgccgtccagccggtgcgcaacccgctggagggtgatggtggcaatgtgctggggcaggcccgcttgatgctgggcttccagctcatgccccgcctggccgtgttcgccgggcccacctacaacgcgtggttctcctggggcgagtcggacttcgactccatcacccggctgtccttccgggagacccatccggagccggatcaacgcctccagcactggcccggcatccaggtgggcctccacatctgaggcccgcccggaagggtggtttcagttttcgaccttgctggcgcgcaggacggtggccgcgcccgcggggcccgcgttgggccgcgtctccaaggtgccctgaatcttgagcccggtgccgtccagcgtctttcggatcaacgcatccgtctgctcgtccgagcccttcgtcaccgccgacagctccagctcgtgcacggggatgggctccgcgtccggcttgtccaccgggaaggcgttgtaggtggggcaaggcggggcgaagcagcgcacgccgctgtccttgacgatgtagacggcgctctcacccggcttgggctgggagtcatggctgggcggtgaggtcatggtgggcgttccgttctcgctggagggggggccattctcgctcgccggtggtgaggacgtcgcggcgggcggcttgctacatccggagacgaagcctaggacaagggcggcgagcaccagcgaacggctgttcatgacgggctccaggggaggaaagaggcgccagtgtgctccggctcgctgccaggggccagtctgtctcgcgaattggtgactggcggtcagttgcaggtggacattgctgttccccgtcgctcagggttcgttgacggactggagtgcaggggctacatccggcctcgtagatcggccttcgcggccgagacccgtaaggacgccctccgatggaattccgcatcgccgccgacgagctgaagaaggccctctaccgcgcccagggcatcgtggagcgcaagacgacgatgcccatcctggcgaacgtgctcgtcaccgcgaacaagggcggcatcaccgtcaccgccttcgacctggacatcggcgtcgtgtccgagcacccggccgaggtcatcaagacgggcgccgtcacgctgagcgccaagtacgtcttcgacatcgtccagaacctcccggacgcgcaggtcacgctgaagaagctggccaacaactacgtggacatctccagcggctcggcccacttcaaaatcgtgggcatggcggccgaggagtaccccaagctgccgaaggaagagaacgcgcccctggtgcaggtggggggcaacacgctgctggagatgatcaagaagacgcagttcgccatctccagcgacgagacgcgctacatcctcaacggcgtcttcttcgagccccagtccaccggcaaggtccgcatggtggcgaccgacggccaccggctggcgctggtggagcgtgagctgccgggcgacttcaagctcaagagcggcgtcatcatcccccgcaagggcctgatggagctcaagcgcctgctggacgaggcgccggacgcggagtgccacctgggcttcgcggagaactcggcgctgttcaagaagccgggcctcaccatggtgatgcgcctcatcgacggccagttcccggagtaccagcgcgtcatccccaaggaaggggagaagatcgtcctggtgcccaaggtgcgcctgctggagagcctcaagcgcatcgccctgctgtcggcggacaagagcaacgcggtccgcatcggcctggaggagaaccagctcatcatcaccgcgagcaacccggacctgggcgaggccaaggacgtgctggagctggcctaccgcggcaacggcatcaccatcggcttcaacgcgcgctacctgatggatgtgctcgccgtgacggagacggacgaggtctccttcgagctgggtgacgagcacagcccgggcgtgctccacgcccccggcgaccggagcttcaccgccgtcgtcatgcccatgcgcgtgtgagtcgggtgggccccctcgagagggcccgcaccgttcactcgtgacgcgataggccccctgggggcctgacacccggccggtgccttcctatggtgagggcatggccacgcacccggacaacctgcgcgcccggctggaggaccgcgcggacctcctggaggccacgcgtcttcgctatcgcgccctgcgcggcatgctggcgtccttcttctggaagcagcgggtgcgctcgcagttcgagctgctgctggaggtggcgcgcacgcagccagaggtggacgccaccctggccgcgctgaagcgccgcgccgccgcggaagggtggcctgcgaacgccgcgcccatgaagctgatgcgggaggtggagcgcctgcgggaggacgtgcggcgcgtggccttcaagcggctgcccgcggagggccggcccgcgacgctgggcgaggcgctgctgaagttggaagagacggtgctggaggcggggccgctcctggggcggcacatctgggcacgggcggtggagctgttgccgcgcaacctgccggagctgcgcgccgcgtgcgccgccgcggaggtgttcgagcacgtcttcaagcggcccgcgccggaaggggtgctgcccttcacggtggaggaggcggaggcgcttcagcgggccttgccgctggcggagacggcgctggcggcgctgtggcagcggctggagcacttcgatacgcgggggcaggtgaagggcttcctgcaggcccgcgtctctcgcgcgccgcagcgggtgcctcgcagcgggccggagctgctgctgcacgtggccttctggcgaggcgtggcttgggcgcggctgcgcgcttcgttgggggagcggctggccccggtggtgcccgcggatgccgaggtgccggcgctgttggtgtggctggcggcgcgcgaggggcgtttcgagcggggcgcggagcctcggatgggcgggccggggctgttcgcgcccgaggcgcctggcccgcagccgcggacggacggggctgtagggctgcgcggtgtgggcgtggaggtggccggggaggtgcggcttccggcctgcgaggcttttggcgaagggcgcgccgggctctttgaactggccgcgcagttggcggcgctgtctcgagagcgtcccgtgggcacgtgggatgaggagaccgcgtgggctcggctgtggaacgcggcgcagcgggctcgaggcgagcagggcgaggacgtggagcggctgcgggacgcgctgcggctgttcatcctccttcgcggccagggacagacacccgcgcgcctgttctctcccgagcgggcgcgggttcccacggtggaaatcggggccgacgcgggggcggccgtgaaggaccttcccgcgctggtgcatgcggcccgcgcggcggcgtggcgcgggcgctaggccgcggcgcgggtgccagcggtggaggccggcatgggccgtgttgggcttgctttcaggggtgtctgtggccgcgcggcggcgtggcggagacgctcacacgggcgacagcgtggcctgcccggcctgatgctcgctgacgggcagcagccgcgaggccaggcccgcgaggagcgcgtcctctgtcagggccacggccacgtccggaacgcccagcttcttcgtggcggtgcgccgcagcgaatagaaggcccagctcgatgccagcgccgccagggcgcccagggccgccgccgcgagccgcccgccgcgttggcgctcggtcgtcaccgaggccgcggccagggcacccgacaacatccggcccgtcaacggcacggcggcgacacgcgggggcgccatcggcagcttgtccgcgacaagctcacccacggcgagcaggcccagcacgcgcggtgtccacggatgcgccagggttctggcgagccggtcctcgctgtcgggctgtgtcttcgtcagccagcggctcgccagcgccggcgcgctcatgctccgcattcccgccagcacgcccagtcccagggccctcaacccgtgtcctcgattcatggcttctatctcctcctccaactgcgtttctcgtcgccctggcgcccgctgcgcgaagaactgcaccggggccgttcccagcgcatggccggagtgcgccagccggccgtggctcgtgagctggccgacgaactccgggtgcttcaacgccagctcgcgcacccgcacgtgcgtcagccggtgccacgcgcgctgatagcgcggagccaccatcgcgaagcccagccggctccacccattagggaactggccgggacgccaggccgcctcgatgtggaagcgcacctcaccgctctcgtgctccttcttgagcaggaaccactcgcgcccggcctcgatgtgtccatggagcgtctcgaagctgaagccgaagacgctgtacacctcatcgtgctcctcgcgcgtgtctcccactcgcacgccgcacaggtagcgcagttgctgccccagcgcgcgcagctccagcagcaccgtgcgaccctgcatcggctcctcggcggagaagtgccaggcgacgatgcgcgggtcggagaagtcgaaggtctccagcacctgctgggcgcgctcgaagagtccgcccgggacagggcgccctggcgactcgcggccgagcacgctctccgagcggacctggctccacccgccctgcagcgtcatctccccggagacctccgggaagttgcgcgccagcgtgcgagcccgcgccagccggggaaccatttcctcttccgtccagccggagaaccagcgccactcaatcattgtcttccgtctccccgcgccaggaaggtgggcccgtggacggtgtcgccgccgggcggttcgtcctccaactcggtggtgtccgcgtggatgacgccatgcaccccgtcaccggccgtcagcgcggcgcgcaggacgaactcggtccaggtgttggtctgcatggcgtctccggcggtgacgaagccgaggtagtggaacgtcgagccggagcgcgcccggctgcggatgtggaagatgacatcgccgcgcgcgttccggtaagcgccgaaggtgatgcggcccgcctccgggtgcccgtggagcgtgccgagcgtgaagctctgggcgtcctggtggatgacgcgcacggcgaaggtgcccgcgccctgaatcttcaccgtcagctcgtcgtccagtgccagcggttggcccccgcgttccgggtgactgcgctcgaagacgcagagttcggacggggcgaactcggcgaagcgcacggccacccagcgcatgagttcctcgggggagacccggcagtcgcggatgactgcccagtagtcgcgctggagcagggggcctgccccttcttcagggagctgaagcccgcctggctggttggcgtctgtgtgcatggactcgttcgccatctcgccctttgcctccatcggtcacaccatgatggggacctcttcgctgggctgcatggcgcggcccggcggaagagcgctgcatgcggcgggcctgtctgcccgccctgggagggcgcatggagacggacgtcaacccggcgagccgggcgtcggagcatgagtacctggacgtgcccccggtggtgcgggcggagcacgccgaggcgtcactgacgcgcttgattgaacagcagacggcgaaggtgccctcgcacgtgttcctggtggcgagcctcgcctcgatgggcgcttccttcgtcttggaggtgacgggccgctcgcacctcagccgcttcattggtcagtgggtgtcgcccctgctggtgatgggcgtctacaacaagctggtgaagattttcggaccgcggtgaggctgtgcgctcatgcggcccatcgcgtcgtggtgaagaacaacgcgttccgtgcctcgtatggtggagggggcacggaaggtgagaagccgagggcctcgtggcgtaacgtgccgttccaaacaggatagggtccgcttgagatgcgcatccatcctggcttgggtctttcactgcttgttgcgttttggttgggttgctccaccaccgcaaagactcccattcagcgaggcgcgcgcgcggcgacggaggcgtgctccggttcgcatgaggaccgttgcgtcagcctcctttgcgagggggacgcatgtggcttctaccgctgcgaggacctgctcggtgaagtggagttggcgcgctttcctcccgcgcgtccgcctgtggccgcggcagcgccgggcagtggacctcggagaaattggggaggtgggcagcagcttccgcgcggggctgtcatggtcttccccaactggaatggtggttcctcgcgggtcattcctccgtcgcaccgtctaacgcccggtcgctgggaaaagcaccacatcttcccgcaggcagaagacctggctcgatggttcgaagggcagggcgtgaaaatccacagctacaccatgcccattcctcgcgacgtgcaccggcggattcatgggccccttggcaatggtggtgcgtggaacaaagcatggcgtgagttccggaaccggaacgcgagcgcagaggagattttcaagcatgcgggggagttgatccatcgcttcgagctcatcggtggtccgattcagccctattattcccgccctggcgccgtagggactcatgacccgattcttctggctgcgtgaagacgaagcggcaacggccgccttcagtggaagcttcaacgccgcgcacaagtggtgtctgcccggcgtgaagtgctccgcctgtggcacgacctggagttcctgggggaaccactatcccctcgtggacctgtcgcagctgccggagcgtgccgcgttcgagaaggcccggccggagccgttcacggagttctcccgtcttcgggaactggtacgctccttggctcctccggatgcggagctgccgcctggtgcggccttcgggccattggttggcactgcgtccggcgaattcggtccattcacatggcaggggacttcgctattgctcgtacgccgcgatgcgatggagcgcctgcaagccgaaggtgtacgcggtctgctgggcggacaaacggaactgcgattccgcaagaaggagtcaccggagttgttggacctccaactggagccacgcggcctgctgcatccggattgcatcccatccgacgcatcgccgccgtgtccaacctgtgggcggcacgcctttgctcgacccgatgcccccatcctcgccgcagcttcgctcccggcggacgtggacgcgttccggctcgtgaacttcgcgacgatgatcatcgggaccgaccggttcgtggatgcgatgaggcgcctcgggctggagggaatcgcctgccaggaacttcctacccgctgacctcgacgacacccagcggcaacccctgtccgttcaccagggcctcgaagcggtgcggcccggcgtagtgcttgcgtgtggagagctgcgcgaaggagacgcgcttgctcaccgtctccgcttgtcccgggccaagcagcagctcgcgcaccttgaacaccttgggccgcgcctcgccgttcgccttctggaaatgcaccgcgaggtccaccaccagcgtctgctgctgcttcgagcggttggtcacctcgaagtggacctccaccgtgctgcccagtgccgcgcggcggggcaactgcgtcacgcgggcctcgatgcctgacggcggccgcgcgcccaccaccgccagcgccgcgggctctccgcgcttgatggacgagcgcagcgcatggcgcaccagccactcccgctccggcgtggcgttcttcatccacgccgtcgcaacctgcaccagcagggcagggtggtccttgccgatgtcattcaggttgttggccaccgagcggcgcacataaagcgccgggtcgtccttcagccgctccagcagcgcgagcaccggtgtggggtccttctggaactcgcgcagccgtgaggcccacggcaggcgcgtgcgcgtgccctctgacacgagccgccggacatgctcgctcgggtcctctgtccactcgcgcaggcgggccagcgtcttcgcggtgtgccgctccaggtagggccggatggagaactccgcggtgaatcgctgggtgagcacgtgctgggcgcgcatggacggctcgaagtgctccaggccatgctccgccacgaaaatcgtgtgcggcagatagaagaaggaagccatggcccctccctccgtggcctccgtccgggggccgagcgagcgcagcagcacctccaccgcctctgggtagtcttggggcagcgcacggtgcagcgcaccagcgatatgacgcgcccggtccatcaactcatggccatccaggcccttctcggcctctcggatgaacgcggcgcgagggaaggtcggcgccgcggcgtggagtgacgcgccgaggcgttcgacaagccgcgcgtcgaagaaggtcttgaggtggtccgccatggggcgcgcaatctggcatgggctcgccagagcaccagcaccatgtgcgtgccagggggccgcggtgggcaggcggctggacaacggtggactgggcagcccggggtggctctgctaggccctggccccgtggcgacgcgaacgggtcagcactggagtcaggacacgcgcagcaggcccgcggtgacggagccccgctccttgcgcgaacagctcgccgaggtgccggattcgctcgcgctgctcgaagggctgttcacccattcaccggtgccctacgccgtcttcacctcggacggccactgtctgctcaccaaccccgccttcctggcgatgttcggcgcggcgccgccacccgagtacagcctcttcaaggacgaactgctcgcgcagttgggctacgcgaagttgctccagcgggtcgtgtcgggcgagcgcgtccagacgccggtgttctggtacgacgtgaaggagttggcgcacgtccgcgcgcccgccgaggcgcggcgcatcgccatctcctgcaccggcttccccctggttgcctccagcggcggcgtcacgcacctcgccgtggcctacaaggacatgacggcggagctggcggcccgtgaggcggcgcaggtggagcggcgcaacctgctccaggtcttcacgcaggcgccggtggccctcagcgtgctgcgcggctacgagctgcgctacgagttcgccaacccgctgctccagaagctcatgggcggacgcgagctgaacgggcgcacccaggaggaggccattccggatttgtcgccggagctgctgagcctccaccggggcgtgctggagacgggcgagcgcgccatcgcgcgggagtaccccatcaccatcgactacgagggcgccggccgcgtcgagacccggttctggaacatcatcttcgagcccctgcgcgacgagcgcggcctcgtggacggcctggtgacgttggccttcgacgtcaccgagcaggtgttcgcgcgccaggccgtggagagccagcagaagtggctggaggccgtgctcgacctgatgcccatgccggtggtgatggcggacccggccagtggcgacctcaacttctccaacgccgcggcggaccggctctacggcctgcacatccccaaggacgtgcccaccaccgcgtatggcgagcacttccacgtcacggacctggagggccgccggctgagcgtggatgacctcccctccaaccgcgcggcccggggcgagcggctggacgggctggaggtccactggcacacgcccgcgggccggtacgccctcagcatctcgtcggagacgctgcccgccatgcatggccatccgtccgtggtggtgattcccttcctggacatcacccgcctgaagacggtggagcagcacctccaggaggccgtgcgtgcccgtgacgagttcctgtccgtggccagccacgagctgaagacgccgctgacgtcactggggctgcggctccagtccttcgtgcgcgccatccacgcggacccggagtccgcgttggcccagcgtcacgggcgcgaggtggaggccatgcgccggcaggtgacgcgtctggccgagctcgtggacgggctgctcgacgtgtcgcgcatcagcaccggccggttgaagctccagttcgagccggtggacctgccctcgctcgtgagcgaggtggccgcgcgtttcgagctggaggccgcgcgcgccggctgcgagctgcacgtcacgcaggcggaagggttcgaaggggtgtgggaccggctgcggctggagcaggtggtctccaacctgctgtccaacgcgctcaagtacggcgcgggcgcacccgtgcacatcgacgtggcgccggggggcatgggcgcccggctgcgggtgaaggaccggggcattggcatcgacccggaagcccacgcgcgcatcttccagaagttcgagcgcgccgtgtccgagcggaactacggcggcatgggcctggggctctacgtgacgcgcacgctggtggaggccctgggcggcaccatccaggtggacagccagcccggcgagggcgccaccttcgtggtggagctgccgctccagcccgcgagataggtcccccgccggggagcggagaggttatacggagggggccgtgcgcctcctcgcgcttcacgtccacgacttccggaacctcccccaggtccagctcacgcccagcgcccacgccaccatcgcggtggggcagaacgggcagggcaagacgaacctgctggaggccctctacttcctggccacgctcaagccgctgcgcgcggggcgtctgtcggagctggtgcgctggggttcgcagggcgcgcgggtgacggggcgcttcctgctcaagggcgccgagcgtgaaatcgccgtggaggtgggcggcggcacgcggcaggccttcgtggatgggaagaaggcctccagcctggaggactacttcggcggcgtgtccgtggtggccttcacgccggatgacctggaggtggtgaagggcggtccggactcacgacgcggcttcctggaccgggcggtgttcaaccgcttccccgccttcctgcgcgagagccgcgagtacgcgcgggccttgaagaaccgcaaccgcctgctgcgcgaagggcacaccgtggacgcggtgtatctggaggcctacgacgagacgctggcgaaagctggcgcgcgcatctattcgcggcggcgcgcgttgatggcggagctggcgcccagggcgcaggcgaccttcgcctccattggccgcacggtggacccagccgtgtacaactaccgccccgcgcatctggagggcgacttcgccgccgcggacgaaacggcgctggcggccatgctgcgggagagcctctccgcgcgcctgcggcgggacatggagcggggcttcacctcggtggggccgcactcggacgacgtctcggtgacgctggggggccgcagcgcgcgggcctacgcgagccagggacagcagcgggcgctggtgctcggctggaagatcgccgaaatcgaaaacctggaggccgcgatgggcttcctgccgctgctgctgctggacgacgtgtcgagcgagctggacccagagcgcaacgcctacctcatgggctacctggcccagagcggcgcgcaggtggtgctcaccaccacggacggctcgctggtgcggggcgcggcggcggacgacacgctctggctcgacgtgcacggcgggcaggtggcggtgcgcgcggacgccgagccgcctcccgccaactgaagtcacggcgtcacgcgccgacggtgccagggccagtggacgtggaagcgccgctccgcgtggtgcggcacgtcgcccggcgccacgttcttgaagaaggggaaacggtactccgcccagagcacgccatacgccacggcgaagaggaaggtggccagtggcagccaccacgacgtgcccacggcgagcgcgatgacggtgagcagcagcagcacgacgcccacgcccagcgacacatcgcgcagccgcttggactcgctgaaggccaaccccatggacaccaccgacaggagcagcacggagacagccagccagtagctgtgtcgtgtgtacaggttggcgattcccagcaggaagaggccgaggccgaatatcgcgagtccgccgtccatgggagtcctccttgtccgtgtgtcgagcgtggggcactgctgtccgagccggacggcttgcgtgcgtcgggacaaagttggggccgcgcggcgtggccggggactgcccgcggatggacgctcgcacagactggttggtgccatggcggacggccggcgcacctcgggtggcgggaatgtgacgtgccaggatggattcagaggtgtggcagtggacgtttggcccccaccgcacgacatggaattccttgcaggtgcgcgacttgtgacgcatgacttggtcgcagggccggaagagagccacgaagaacggtgccatgccgcggatgacgttgctgtgcctgctggtggtcatgcccctggcgggctgtcacaggacgacgttcgaggattccgtcctcaccaagcccgccgtgcgctaccgcattggcaagctccccgcgtattgggagcaggtgcggctggaggacaacgacctcgccttcgccgaggagggcaccggtcgcgcgctctccgtcaacgccacgtgccagggacatgatgacccgtcgctccaggtgctcacccggcacctgttggcgggcttcacggaccggcaggaaatcgctgaacagcgcatccccatggatgggcgcgaggccctgcgcagccgccacctggcgaagatggacggcgtgcccgtgcaactggagctggtggtgctgaagaaggacaactgcgtgttcgacttcacctacgtgtcgccgccggggctcgcggacgggcgcatggcggacttcgacgcgctgctggccggcttcgaatcggagcgcaagggatgacgacgcggcagcccgaggtggacgcggcggcggcctccgggcccccgagcctcatggaccgcgcgaaggagcgcctggagtcactgggcgccctgtcgcggatgacggggcaggtgttcagtcgcgcggtgcgtccgccctttgactggcgcgggctcgtgtaccacacggagtcgctgggcgtgcgctcgctgcccatcgccctgctcaccgcgatgttcgcggggctcgtcatctcgttgcagttcggctacttcctgtcgcgcttcggcgtgcagtacaccgtgggccgcgtggtcatcctcacgctgttccgcgagctggcgccggtgctcaccgcgctcaccgtgggcgcgcgcatcggcagtggcatcgccgcggagctgggcgcgatgacggtgacggagcaggtggacgccatccgcgcgctgggcgccgacccgctgcgcaagttggtggtgccccgcgtgctggcgtgcctgattgtgttgccggtgctcaccgtgttcgcggacgtcgtgggcctggtggcgggcgcgctggtggtgaacatccagtacgcgattacgctcaacctcttcttccagggcgcgctggacgcggtgctgatgccggacttcgcctcgggtgtgttcaagggcgcggtgttcggactcatcatcggcctggtgggctgcttccgcggcctcaccgtggagggcggcacggagggcgtgggccgcgccaccacccagacggtggcgaccacgtccgtctccgtgtgcctggcggacttcttcatcacccagctcacgctgagcctgtgacgtgccatgcgctcctcgtcccagacgacttccgagttcgcgttccagccgccccggccgggtgagcagctcatctatttcgagcacctgacgaaggcgttcggcgccaagcgcgtctatgacgacatggacctggacgtgcgcgccggtgagacgctggtggtgatgggcggctcgggcacgggcaagagcgtgctgctcaagtgcctcatcggattgctgtcgccagacaccggacgcatcctcttccaggggcacgacctggcgcgcttcacggaggagcagttcatgccggtgcgccggcacgtggccatggtgttccagggcgcggcgctcttcgactcgctgaacgtcggggagaacgtggcgtacccgttgcgcgagcacttcccggatatgccggcggacgaggtccgtgcccgcgtggcggagaagctggcgctggtggacctgcccaacacggagcggctgatgccctccggcttgtcgggcggcatgcgcaagcgcgtggggttggcgcgggccatcgccacggagccggaggtcatcctctgggatgagcccaccacgggcctggaccccgtcaccacgcagtccatcaacgtgttgatcaactcgatgaagacccggctcggttgcacttccatcgtcgtgacccacgacatggtgagcgcgttcaccgtgggagaccgcatcgccatgctggccaatcggagaatcgtgcaggtgggcactccgcgggagatgctccactccaccgtcccggaggtgcgtgccttcctcgacgcgcgccgcgtggaactgttccccggaggcgcgccatgagcctgttctctcccgctggaaccgagcgccgcctggcgctgcgcacgggtctgttcgtcgccgtcggactggcggtcgccagcgtggtggtgatggtcatcggccagcagtcgcgcctgttcgagcgcaagacgatgtatcgcgcctacttcgccaacgtgcagggcctcaatgatgagtcgcccgtctggctcggcggtctcaacgtggggcgggtgacgggcatcgtcttctcgcccgacccgaatgacccgcggctggaggtccagttccaggtgtcgtcgcgctacacggaccgcgtgcgtcaggactcggtggcgcagttgtccagcatgggcgtgctgggcgacaaggcggtggacatctccctgggcagccccacgtcaccgccagtggaggcgggtggggtgctcaagtcgtccacgggcggtgacttgtcctcgctgctgagcggggcgtcgcaggtgatggagaactcggtggccatcagcaagtcgctgcgggcggcggtggagacgtacgccaacccggagatggccaacgacgtgacgcgcggcgtggcggcgctgcgggcgctgctggaagaggtggcgaagggcgagggcgtgctgcacgcgctcatctacgacaagcaggccgggcgcgaggtgcgggggctgctggccaacgcgtccagcgcggcggcgcgggtggatggcgcggtgggcgagctggaagggattctgcgcgaggtgcgcacgggagacggcacggcccacgcgctcgtctacggccaggacggcgccaaggcgctgacggagctgggggcggcggccgggcagctggcggggctcatcgaggatgcgaagaagagtcccaacggggcggtgcaccagctggtgtacggcgacgcgagcggcatgttcgcggacctgggcagcgcggcggcggacctgaagaagattacggcgaccgtggcgaagggagacggcaccgtgggcgggctcatcagcgacccgacggtgtacgaggacctgcgtgaggtgattggcaacgtgaagcgcaaccgcatcctccgcgcgctggtgcgcttctccctgagcaaccggcaggatttggagcaggtgggcaaggtgaagggcgtggagccacgctccgaagcgcccgacgcggctccggcggagacggcgccctcggcgcctggggagtctgcggcccaaccctagcctgggcggacggaaagctcgcggaacgcgatgtcgctgagtcgaagctgcttcacggcttcgacgaaccgctcgctcgcgacgatgaccgtcttgaagtcgcgaaggcggaagaggtcgatgttctcgggcaaggtgcttgcggcgagcacggcggactcggatgggtatccgttccggtggctgccacaccggggacagggggcctgccagtccggagtgtggctggttggatgcaacgctccgtgcacgaggacctccaggcagtgcaggggcggtgcaggctggccgcgatagcccaaatctcctggcgcgccatgcaggcctctcacgccggcggcgtgtagcttctcaagggccgagatgcggatccacggagcccacggcgcttggaagtagaagtctccaaaacggcccttggccttgccaacgacaggacccagttgcgtgccgggctccaaaggggcggccggagggacccatggccgcagttgctcgcacaggtgccggtacgcctccagtgacagggcttgttggctccgcggttcttccagcagggcacggtgtgcgaaacgcgcgaggtccacagtggggtaggcctctccgaggccgccgtagccgccacagacggtgcagtcgatgctcgggatgcaccaggggctcactccgtcgatacggcccgtgttccgggtggcttcatcctcgagaacctcgaagaacctcacgtgctgcgcctccagcggcaggtcatcagcgcagatagtagtaggggacgatggggcctatcaggtcgtacttctggaccagcttccccagatgttcccaaacctgctgttgggaggcgccaggatacctgcgagcgaagtcggtccattcctggttccaggctccgcctcgggtcccgctatggatgcgctgatgcgtgtctcgcgcgatgacaagggtgaagtcatgcacgttcagtgcgcgagggctcctcgcgaaccacttcgcgaggtgttccgcttggggaaagagatgatgccggacccagtccggacccgagggcaggcgcggagcccggtgttcagactgtggggcgttgtgccagtcgaagacgaagacgggcccatttccgccggggagtttctggacgttgccccagcgccgatggggccccgcgccgggtgcggcgggcggggcgatggtgcccccgcccttggcgagcagcctcccagcgtcttcacagacgtagaggccgcattgtgtcgctccagcacagacccacgtgacacaccggtccacgcgagtacatgactcgccttctccgtgtggcacttgttcccatgcatgctgggatttttgcgcggtgtgcccacatcccgtgaagaccagcgcaagcaaccacgcgacgagtgcccgtttgctgcccattcatgcccccggcgctggtgccttgccacccgtggcagtctatccaaacgtgacgcagagcgccccggtgccaccacgctctggcattgctcctgctcctggctttcgtgcttccgagccactaagacggcggccctccaacgcgtcgctgccggagcgcgcgaggttggtccgccgcgatgagctcatccgccgtctctactcctgtggcttccgcgcccgcgcgccccacctctcgcatctgggcggggcgggtgctgctcttcgtgggcttcttcgcggcgctggcggcgttccccgtctacacgcccttcgactccaagctgacgctccccaccacgctgtctctgttgcgtgaagggaacctcgacctggacgaatacgcccccaccttcgagtcgtaccgtcacggcctctacgagcgtgacggccacctctacaactacttccccctgggcccttccctggccgccgtgcccatggtggtgctggtggatggcttcgtgcgcctcgccacgcccgtgggcaagctgcacccggccctggcgaagcccctggcgcactggcgtcacatctacgacgccaccggcggcgtggacctggacgcgtggaacggccctcagcgcctcttcgcctccgcgctgaccgcgctcgctggcgtcgtcatgttcatgctgggcaccgcgctgcacctgtcccgccagcgcgcgctgctgctcgccgccgtcttcgtcttctgcacgccgctgctctccaccgccagccgcgccctgtggcagcacggcccttcgctgctgttcctgaccctggtgctcctctgcctcgtccgcgcgcgcgaggctccgcgtcacgtggcctgggcgggcattcccctggcgctcgcctacgtcatgcggcccaccaacagcctctccgtgctggtgctgtcgctctacgtgctgtggacctggccgcgtcaggcctggaagttcttcgcgggcgcgctcgcagtggccatcccgtgggtggcggtgaacctcatccactacggctccgtgctggcgccttattacgaaccgcagcgcctggagctgtccgcctctcgcgtggccgaggcccttgccggaaacctcgtgtcccccgcgcgggggctgctcgtgttcacccccgtgctcctgatgagtgcctggggcctgtggatggacctgcgcgcccggaccttcacccggctgcatgcggtgctggtcgcggtggtcgcgctgcactgggccgccatctccaccttcccgcactggtgggcggggcactcgtatggcccgcgcttcttctcggacatggtgccctacctcgtcttcttcctcgtccccgtggtgcgcgcgctccaatggaaaggccccgaggcccggcgcggcttgacggccaccttcgcggtgctggccgtgctgagcctggtcctccatgtccacggcgccagctcgcgcgcggtgtaccggtggaacagcttgccgctcgacgtggatgaacacccggagcggctctgggattggtccgacccgcagttcctcggacggcgctgagccatccgccgcgtgcgtgccgcgccagcgcgcgcgtcaggtgcctcgccacgtccgtgccgccgcgcgcgtcgaagcccaggaacatcgccgagccgttcagctccaggatgcgcggcgcgccgtccgcgtcattcgtccacagcgtccggggcacgggaagtcccgcggcccggagcgcggcgatttggcatggggcctccaagatgcggacgggcccggcgccgcacccgtgcaggccatggagcgccgcgtcacccgggctgcatgcgccacttcgtccaccgctccacgatggacccgccagttcccccgtatcggcggcggcgcctgttcgtttccggtgacttccaccgcgcgtctgggctccaatctgtttcatgaaagctcttgccctgcgtgaggaccgcttcctcgacgtactccggcggctcatcgccctgactccgaagctgcagaacaaccctggcgcggggctggtgcccgaggaacggctggccgcgcaggtagtgctggacaccctggcgccgcacatcgagagcggcttcatccaggcggagtccgtggcggggccgggccaggcgtcgcgcccctgtctggtgctgaccgtgccgggggagggagaaggcgccatcggcttcgtcggcgcgcacttcgacgtggtccccgcggaccagaagacggagggctgggagcgcagccccttcgagctgtgggagggccccggcggcgtgctctacgggcgcggcgtcaccgactgtctggggcacgtcgccgtgctcaccgacctgctggcccagctggccgagcgcaaggtgcgccccagccgcacgctgaaggtggtgctcatctccaacgaggagtcctcggagctgccgggcctgggcctcaactacgtggccgagcagggcatgctcaagccgctcgatggccagccggtgtactggctggacagtgccaacttcggccccacgctgggcacggcgggcgtgtcgctgtgggagctgaaggtgacgggcgtggggggccactccggcatgccgcagaactgcgtcaacgcgctggagttgggcatggccgcgtcgttggagctggcgcgcttcttccacgagcgcttcccgcccacggaggacgagaagcgctggggcttcctctcgtcctccagtctcaaggccaccgtggtggaggcgcccaacaccaaggagacgaaggtgcccgccgacgtcgtcctgcgcggcgacatccgcctcacgcccttctacgacctggcggaggtgcagaagactgtgacggacttcatggcggagctcgacgcccgactggagcgcgacgatgcccccgcgcacttcccgcgcacgcgcacggcgggcggcaagcgcggtgagctggcgttccgcttccagggggaggggaccgagggcatcgcctgccggctggactcggagggcctgcgcgcactgaaggaggccatgcaggtggtgcgcggtgtgtcggccacgcccttctcgctcaccggctcgctgccgctcgtgagggacctgcaacgacagggctgcgacgtgcagattacgggcttcggggacatgcagtactaccacgcccccaatgagcaggcccggctggaggacttccggcagggcttcgcgattctccgcgaactgctcgtccgcctctgaggcggggcgcgtctggtggcgtgctgttcggaaatgtcgggggttttgcgcggcgaatgtcccgacatttccgaatagcgcgcaccggacactcgcccggagcacatgtgcgtggacagcgcgaccggggaccgccacagtcggtccgggccgcgggcacctccgctcgcggcggctgcgcgagaggagtggtgacgccgtgagagacttgctgatgattccagggccggtggagttcgagcccgaggtgctccaggcgctgggcgctcccaccctcggccacaccgaccccgctttcattgccgtcttcggccgggccctgaagcggcttcgggaggtgtgcctggcgccctccgcgcagcccttcgtggtgtccggctccggcacgctggccatggagttggcggtggccaacctggtggagcccggggacgcggccctggtggtgaacaccggctatttcagcgaccggatggcgaagattctcgagcgccacggcgcccgggtgacgcacgtgcgcgctccgccgggggacgtgccctccctggacgaggtggagacgcacctgtcgaagggtggcttcaaggtgctgtccgtcacccatgtggacacgtccacgggggtgctcgcacccgcggaggcgctggtgcgggccgcgcgcaagcacggcgtgctgtcggtggtggatggtgtgtgcgccaccgcggcggagaccttccgccaggatgcgtgggaggcggacgtgtacctcacggccagccagaaggcggtgggggttcctcccggtctggcgctgctcaccgtgggcccgcgggccatggaggcctggcgcaagcgcaagacgccggtggccagcgtctacgcggacttcgcggagtggctgcccatcatggaggcgtacgaagcgggcaagccggcctacttcgccaccccgcccgtgaacctggtggccgcgctggacgtgagcctgggtcagattctggccgagggcatggacgcccgcttcgcccggcaccagcggatggcgcgggccttccgcgcggcgtggaaggccatggggctgcgcctgttgcccacctccgacgccgtggccgccaacgcgctgagcgccgtgtactacccggacggcgtggacgcggcgctggtgggcggggtgaaggggcagggcgtcgtcgtcgccggcggcctccacccggacctcaagacgcgctacttccgcgtgggccacatgaaccgcgtggggcccgcggacgtcctggccacggtgggagccctggagcgcgcgctcatcgccgccggtcaccgctcggagcccggcgccgccgtggccgccgcccaggcgtcactcatcgtgggctgagcccggcctgggacatccgccctcgttcgttggctggcggatgctcctctcggcctgcggggcgaaccgggtttgattcgacagtaccggaaaaatatgcgactgttggcttcccggaagtggggggaatcttgtgagcccggaatcatccgcgaagtgaggtggcggtgtgttccccgggcgccttggaagggcccctcggggagatgaccatgtacgcgggttacgaatcgagcgcgggtggtggcgcggcctgggagctggagttgcggcgtctggcggccaccgacgacgacatggcgcgtgggatgttcttccagggcacgctggacgtcgtgggtttcctgggaggcgaaggcgcggtggcccgctgcaagggggtggccggcatctgggaaatcaacctcctccacatgtaccccatcacccggttcctccggatgtcatccacggcggcgcggctgttggccccgcagttggacggcttcgagggcgtgctgcggcgcatgggaacgcaggccacggtggacttcgtggcgtccgtcttcggacgggagttgatgcaagcggccagcggcaagccgcggctgctattgcagtcgctgggagaggcctacctcgccgcggtgacctacggcgagcgctacccgctgtggacgggggagacgagcgcccgctttatcatgcggcgtgacttcatgcccgccgcctaccacgagggcgtgctgcacggcgtgctggaggcggtgggcgcgcgtgaggtccgggtccacggtcgccaggtggggctgctcgacagcgagtacgagctgtcctggaagtaggcgtggcggtgcgccccggcgtactggccggggtgtggagctccctggcgcgggtgccgggctggtgaccgtccagcgcatcattcaccgacatggggagacatctccgcggaggcggtgccgggcgaaggggccacgttctgcttcgtcctggaggcgtcccgtccatgcgcggcgagcggcccatcctgctggcggagggcgacctgccccggctggatggccatgaagtgctgcgccgcatccgcgcggacgcgcgcacgcggatgctgccggtggtcatcctctccgcgtcggcggaggaggctgtcgcggcgcgtgggccacagggccgtgttcaggtggctgacagagggagcggaatttcagaggacctggtgaagcacgtcttcgaacgcttcggacgggcgttaagctcgcgcgccgatgggggccgggcctgggccgggccgcgcgaaggaggtggcgcgcgcttcaccctggatttgccgttggagaaggagaggcgtgagtgagccggccgttgctggtggtggatgacgacgcggacttgcgcgaagccctggaggaagtgcttcgtgacgcgggctacacggtgctgggggccagtaatggcaagcatgccctggaggtgctgggcgcggccacggagctgccggggctcgtcctgctggacatgatgatgcccgtcatggacggaggcgggttcgcgcgggccatgcgccaggtgtccgcctggcgggacatcccggtgcttgtcttctccgcgtcagcgaatgctcgccaggtcgcggatgagattggcgcttgcggccacctgcgcaaacccgtggacgtggacacactgctggacgccgtcagccgccatctgacggcgtgaagcaggcaggcgggtcctgtttgacgctccgcgttccccccggttgacgcctcgaaatcaggttggtaagtgccagcttaacacttcatgtggagggccggatgcacaccaacgcactcgcgctgctgatcttgcagctcatcgtcatcatcggcttgtcgcggctcatcggccgcggcgcgcggtggttgggacagccgttggtcatcgcggaggtggtggccggaatcgtcctggggccctcgctgctgggctggctggcgccggacatcatgaacgggctgttcccggcctcgtcgatgccggtgctgacgatgctcagccaggtgggcctggtgctgttcatgttcctcattggcctggagctggacccccagctactcaagggccgggggcatgcgtcggtggccatcagccactccagcatcgtcgtccccttcgcgctgggcgcgggcgcgggcgcgctgtggctctacaggagcctgtcgtcgccagaggtgccgttctcctcgttcgtgctcttcatgggcgtggcgatgagcatcaccgccttcccggtgctggcgcgcatcctcaccgagcggggcctgctccagtcgaaggtgggcacggtggccattgcctgcgcggcggtggatgacgtcaccgcgtggtgcctgctggccttcgtcgtctccatcgtccgtgcgtccagcctggctcaggcggcgctcaccacggtgatggcgctgggctacatcgccttcatgctgatggtggtgcggcccttcctcgcgcgcctgggcgcgcgggtggccagccgtgagggtctcacccagaacgtggtggcgggcacactggtgctgctgctggcgtccgcgggcgtgacggagctcatcggcatccacgcgctcttcggtgccttcctcttcggcgcggtgattccaaaggaaggccgtctggcggagacgctggcggagcggctggaggacgtggcggtggtgttgctgctgcccgtcttcttcgccttcagcggcctgcgcacgcagattggcctgctaaacaccgcggaggactggctgacgtgcggcgtcatcatcgtgctggcctgcctgggcaagttcggcggcagcgcggtggcggcgaggatgacgggcctgcggtggcgcgaggcgagcgccatcggcatcctgatgaacacgcgtgggttgatggagctcatcgtcctcaacatcggcctggacctgggcgtcatctcaccccagctgttcacgatgatggtgctgatggcgctggtgacgacgttcatcaccacgccgctgctgaagtggatctacccgctggaggagattgcccgcgagcgcgtggtggtgccgctgccggtggagccgggccctccgccctacagcgtgctgatgtgcgtgtcgcacgggcaggcggggccgggcatggccaccctggcgcgctcgttgtcggggcgtgaagagggcgcgcagcttcacgcgctgcatctggtgtccccggagcgcgcgtccctgcgcccggcgcagcagcgggcccccgaggaggacagcgcgctgatgccgctcttgtggcgggccgtaagcctggggctctccgtgcggccgttgtcgttcgtctccgccgagccggcccaggacatctgccgcacggcgaaggcccggcgcgcggacctggtcctgctggggtggcacaagccgctcttcagccagacgatgctgggcggcacggtgcgtgaggtgatgcaggaggccagtggcccggtggcggtgctggtggaccggggcctgtcggacatcaagcgcgtgctggtgcccttcgccggcagccggcatgaccgcgcggccctggccctggcccggcggctgaggcagcaggcggacgccgaggtgacggtgctgcacgtgacgtcggacctcggcggcaacggcggagcccgggcgcaggtggaggcgctgttcccggcgaacgagggcggcgtgacgttgaaggaggtgcgcagcgacgcgccggacgaggccgccctgggtgaggcgcgccacggctatgacctggtgattgtcggcatcggcgcgcagtgggggctggaggacaaggtcttcggcctgcagcgcgagcgcatcatccgggacgcgccgggctcgctgctggtggtgtccgacgcgtctcccgccacggcggcggagtccacctccgaagccgccaacgacggggccactgcagtccgggtgttgcccgcgaggagctgatgcatctgggagccaccctccggctgttgcgcacggatgcgggcctgtcgctgcgggacctggcgcgccgtatcggcgtgtccagcgcgtacctcagccgggtggagaacggcgtggacgcgccccctacgcccgagcgcctgtcggccattgcccgcgagctgcgagtcccgtcctcgctgctgatggacgtggccaaccggatgagcccgtccgtggccgcctacctggaagaggtgccgggcgcgggggccctcttcctggacatcgcccagcggcgcctgtccggattgcaattggcgcgcgtgcgcgacttcctggaggcggagttccctgtggcccaaggacggcgcgacgcgcccgtgccaccgctggcgccgttgctggcgccggagcgggtggtggtgcagttgtcctgcgcgggctgggacgacgtgctggacgtggtggcggagcggctggcctcctcgcagcccggtgcggacgtcgcgcgggtggtgggcggcctgaagcggcaccgggaggagtcctcgtgcgcggtgggcggcggggtggcggtgccacattccttcctgccgggcgcggtgcccaccgcggccctggtgacgttggccacgccgctcgcgggcgacacccccgacggcaagccgcttcgcgtcgtggtggccatcctggacgccgagcggggcaacccccagttggtgcggctggcgcatctggcgcggctggcggcccatgggctggcggaccggttgttggggctcagccagccggcccaggtgctctccagtctggaggagctggaggcactgcgctgactcaggggctcgtgcggccccaggtctcccacgcgcccagatcccggtagcccaggcgctgatacaagggctttgctccggcgtggcctggagcaccgcggccgtcatcctcccggcccgtgcctggtggtgcagcccgcgcatcacctgcgcggccagcccccggccccgggcctcgggcaccgtggccaccatgtagatgcccgcggtgtcgcccacgtcccgggccatgccacacgccagggcaacgcccacctctttcgcgaccagcgtgtgcacgggcagcggaggcggccgcagccagacgtcgagctggccccccagctcaccccacgtgcgcttgttgatggcgaccatgtcgtcctgcgtctcggagacctccagggggaggtccggcggggcgtccggcacgtctcccagcaccaggcccatggcatccatccggaccgcgtcgggggcgaagccggcgtcctccagcacccgccggccctcggtgtctccgggcggcagcaccacgcgccagccgggcaggtccaggcgcaggtagaagtccgtcagggcgggcagggcgtcgcgcagcgctcccgggtcgtggaagaaggcctgctgggcccgcgagtgttccgggtgccccggcagacagaaggcgtccacgcctggcaggcccaggtgccgcagcgtgcctcgctcccgctgaaggtgcttgaaggcgatgacgttcgacagcaggcgcgcggacagctcggcattcgtcatggggctctggagcgtagggcacgctccgcccggcggagaacagacgcagcgctcaaaaccgcgcaccggcgcgccgggaggattagggtgcaggggcacccatgagcagcccgcgcttctacgccttcgaccctcgcgccacccgcatcgccctcttcgtgggggcctgcgtgctggccgtcctcaccgcctgggccctggcggatgcccgcgccgaaggtggcgtccaggccatggcccgcgccggcgtctccgcggggctgatgttgaccttcctggtgtccttccaccgcctgcggccccgcacgggctggggcgtcacggtggacgcgcggggcgtgcgcgtggcccggcccttcagccagaaggagctggacctgcactgggggcagattgaccacgtgcgccggattggccggaaggggagcgtgctcgccctgttcctcaaggaggaaggccgggtgctcgtcacccggcatctcttcgcccgcaaggctgttttcgacgagttgatttcggcgctggaggaccgcctcccgccgccccgtttcgacgcctgaacaccccgtttccaggggcggcctcccaggcaggcggccaggcggatttcacgaatgtttacgcagccttgcgagtcctcgttaaccttgttcgacgtgccttgaagtggtacgcacggacctgttgcaaggctccttttcccaaggacagcttcacatggaaaagacccccgctaccggctcggcggttgctccgccgcccgtggagtatgggacggacagcattaccaagctcgagggccgcgaggcggtccggaagcgccccggcatgtacatcggcgacacgatggcctacgggctccacaagctcgtgtacgaggtcgtcgacaacgcggtggacgagtcgctggccgggcactgcaccgacatcgaggtcgtcatccacgtggatggctccctgagcgtgcaggacaacgggcgcggcatccccgtgggcccgcaccccaagttccccggcaaggacaccctggaggtcgtcctcacggagctgcacgccggcagcaagttcggcaacggcgcgtacaaggtctccggcggcctccacggcgtgggcgtcacctgcgtcaacttcctctcggagtggttcaaggtccgcgtccatcgcaacggcattgtctacgagcaggcctacgcgcagggcgtcccggacaccccgccgcgcgaggtgggcaccaccgacaagcgcggcacgcacatcgccttcaaaccagacgccacggtgatggagttggtggagttcaacttcgagacgctcagccagcgtctgcgtgagctggccttcctcaacgcgggcctgcatatcgtcgtccgcgacgagcgcacgaacaaggagcacgacttcaagttcgacggcggcatctcctcgttcgtggagtacctcaacaagtcgaagcagacgctccacgacaagcccatctccttcagcacggagcgcgagggcgtcatgctcgacatcgcgatgcagtggaatgacggctacgacgagcgcatctacaccttcgcgaacaacatcaacacccacgagggtggcagccacctgtccggcttcaaggcggcgctgacgcgcacgctcaacagctacgcggagaagggcagcctctggaaggacctcaaggagacgcccaccggcgaggacgcgcgtgaaggcctgtccgccgtcatctccgtcaagctgaccaacccccagttcgaggggcagacgaagacgaagctgggcaacagcgaggtgaagggcctggtcgagcagatggtgaacgaccagctcggctccttcctggaagagacgcccatggtcgccaagaaggtcgtggcgaagattggcgacgcctgccgggcgcgtctggccgcgcgcaaggcgcgtgagacggtgcgccgcaagggcgtgctggacggcggcgggctccccggaaagctggcggactgtcagagccgcgacccgaacgagagcgagctctacatcgtggagggcgactccgcaggtggctccgcgaagcagggcagagacaggcgcaaccaggccatccttccgctgcgcggcaagattctcaacgtggagaaggcccgcttcgagaagatgctcaccagcgccgaaatcgtgacgctgattacggcattgggcacgggcatcggcgcggaggactacgacccggagaaggcgcgctaccaccgcatcatcctgatgacggacgccgacgtggacggcagccacatccgtacgctgctgctcaccttcttcttccggcagatgccggagctcttgcagaagggctatctctacatcgcgcagccgccgctctacaaagtcacgcgcaacaagaaggaccagtacgtcaaggacgagcacgcgctgaacgagtacctgctcaagattgcctccgagcacgcgcgggtgctgacgcccgggggcgagctgggcggcgcggagctgaaggcgctgctggagaaggtgattacgtacgaggagcgcctggagaagcaggccaagcgccgggacgcgcgcgtggtggacgcgctggtgcagggcgcgcgcctgtccgcggagacgctgacggacgaggctgccctggaggcggcggtgaaggccgcctatgacaccttcgagcgccgcatgccggacgtgctgggccgcgtgcgccacgagctggtgcaggaccccgagcaccacaccaagaagctggtgttccacaccgacgtgaatggcgccatgcgggagacggtgctcgaccactccttcctgtcgtcgccggagtacctggagctgtcgtcgctgcgcgacgcctttgtggcgctgggcaaagcgccgtacaccgtgcgcgtggacgcgggggaaatcaccgtcttctccgtgcaagaggtgctcgccgccgtccgcaagacgcgcagcgtggcctgggcctgcagcgctacaagggtctgggtgagatgaacccggagcagctctgggacacgacgatgaacccggccacgcgcacgctgctccaggtgcgggtggaggacgcggtggagagcgacgaaatcttctcgctgctgatgggcgaggcggtggagccgcggcgcgagttcatcgagcgcaacgctctggacgtgcagaacctggacatctgagtccgtcccacggaaagacgcgtgggcccggtgcccctcggccccgcgcccacgtgcctttcccgtccttgtcgagccgggccttcgcgctgccgggccctcgctagcccttacgtcaggaagccggacccctgcgctgaagccatgggtcgccggtccaccgtaaggtagtcaccgttcctccggccaagtccggcgtcctccgcggcgccgcgagtgctcgcctcgcccgctggcgcctcagtgggagcgcggcgggcttgcatgtatggctgctaccgctccgagcggcgtgagcccttcagggcctccgcgcgctccttgccggacatggccgtcacgtcgacgatgtccacctcgaaggcgccccggttgtcgcccacctgcatgtcggggaaggtgcagtgcaggttctccgtgcccgtcatctggtagcgcttgccggtctggaggatgcggtgggtggcgcgcacggattcgggcgccgggccgcgctccatgcacagcacctggcggacgcggccgttggggccggagcgcagctccgcgacgtcgtctcgcacggtgagcaggtaggtggagtccgggttgaggccgcgcagcaccatctggtgctcgggcttcagcggcaccgcgttttccttcgcatcgaaggtgaacgagcgcggcggcacgtaggcggactggcggacgttgatgcggatggcgccgctgttgtcgtccagtccgccgtcatccagcgcgaagacgtggagcttccgagcgcccttgatggtgcgcgttgacgtgccgagcaggccgaagctgctgtccaccggcccgtcgccctcgatgaggtaggccagcgtgccggaggcggtgccccggccctcggccagcgacgcgctgccctgcgtccacacggagtacgtcgtgccggggttcagctcgatgctggcggtgttgtactcgggcagggggacggcgttgtactgggggcgcagcaccagcacgcgggtggggtagtccacctcgtgcattgtccgctgcggcgtgtcctcctcctcgggcccgtcctgtgcgaccgccacctccgtgctggcgcccgcgtcctccggcgcgctggggcccgcgtcctccggcgtggcggcgccttccgccaccaccgcggcgcccgcgtcctctggcgccgccacggccacttcgactggcggcgggggcgctgcgatgggcttcagctccgccgtcagcggctccaccaggttcgacgtgggcgtgaagcgcttcgtccagggcaggtggccgggcagcgagagggccagcgtgttggcctcgccaatcttgacctccaccatcagcggcgtgacgcccttgagcacttggtcgttgagccgcacggtggcgcccgcgggcttggaggcgagccacagcgtggtggtggatgcgtacatgtcgtcgaacgtggactcgcgcgcgatgacgagcttgtagaacacaccgacgaggaacagcgcggcggtggcgtagacgacggacatcgtcacgacgcgcgccttctccttccccttcgccacgcgcgcggcttcttcgcgcgccagcgtgtcccgagcgtcgtccacggaggtgcggtagcccttgccagtccaggtgcccaccggatgcgcctcggtggtgggctccttgctcttggcggcgggcacttcgatgggcgtgtcgcgtggcgcggcctgggtgggggcaggcgcatcacccgcgtcggtgctgggctcttcgtccagcgccggcacggggggcccggggcgctcggaggtgtatgtcctgcggacgccaccctcggagcgggggagctgggactgggtcacccgccgcacgccgctgctcgtgggacggcgcgctcctggggtgctcgcagaggggcgacggcctccttcgctgccgggccgtccgctgtcgctgccagggcggcctccgtcactgcccgggcggctgcgcacgccggggctggagccccgcggggcgttgctggatgggggccgcgcgcgtccctggggcgacgcttcggtgacgcccgtctgccaggcggtgagctgctcctggaaggcgggggacacctccacccggcggccctcggcggccagctcctccgggaagaggtgcgccatgagctgcgacagcagggtgggggtgaagcgcgggttgtcgcggtagagcagctccaccagcgactcgctcaagtccttcgccgtctggtagcgcgcctcacggtccagcgccatggcgtgggagatgaccgtctccatgtcctcgctgacggtggggttgagcgcggacggcggcaggcggtcggccacgaggatgcggggcaggacggtgacgaactccccttcataggggcgcttgccgcacaccatctcgtagaggacgacacccgcggcgtacacgtcggtgcgcgcgtccaggtcctgccggccctgtgcctgctccggggagaagtatgggtacttgcccttgagggtgccgggagacgtcttcgcctccaccgcgctcgtcaccttggcgatgccgaagtcgatgaccttgacctcgccctcataggagatgaggacgttgtccggggacacgtcgcggtgcaccaggcccagcgccagcccgtcctcgcccacgtgtcggtgtgcgtagtccaggccgtcacacagcttgctggccacgtggagcgccagcggctccgggaaggacgccatgcccatccgctgggcgcggcgcagcaccttggacaagggctggccctgcaccagctccatcgcgatgaagtactgcccgtccacctcaccgaagtcgaaaatctgcgcgatgttgctgtggctcatgctggccaccacgcgcgcctcgccgatgaacatctcgacgaagtccgcatcgtcgacgaagtgcgggaggatctgcttgatgacgcagggcttggtgacgcccgctgcccccgtcatccgcgcgcggtaggtgacggccatcccccccgcggcgatcttcgagaggaggacgtatttaccgaattgctgagggctgttttccgccacggggtaggagcataccttccttccttggaaagtcccggttccggattgcactctgtgcgaagtttttcagggttaccaaggtctgagccttcacatttcttcacgcggggcacctgccgtgggccgccccggcgcggttatctagcggacctgcctgcgcttgccggcgggcgggggcggccggcccctcgctgagaaagaggcgtcgccgatggtgtccgagctcccccttcgctcgcggtggggcgccgtgtgtctgagtggagtgctgctgttctcgacgccgggcctggcccgcggtggggacgggagcccggaggtcccggtggatgcgcccctccaggcgcacgtggggccttcccagcagtcgttggcgcaggtgcctccgccgccctcggagcgccccgatttcaagccgctcgcggtggcggtggcggtggtgccggggttgctcttccatgggctggggcccctggtggcgggggaccgtcacacggcgaagcggctcttcgcgttggagggcgcgggcctggggctcatcgcgctgggcggcgtgcccattgccctcacgggcgcctcgcggcgcaccattgctccgctgtacgcggtgacgctggcgggcttcagcgtgctgggcatctccgcgctggccaacctgtatgcggtgacggcgccggcgttcgacgcgggcgtcgcgccgcccctgcttcctccgctggagttggaggtgggctatcagtatgtgaatgacgctgcgttcgactaccgccacttcctcacggtgggggcgcaggcccgcttcgactcgctgcgcctgctgggcacggtgcgggtggacccttccgagggcaacacccaggtgcgcctgggcggggcgtggcggctgttgggcgcgccggagcgcgcgctgtcgggcacggatggcagcgcgctggacgtggaggcttttggccagttccaccgctaccccaccgagggcttcgcgctcatcagcggagaggtggcgctgcggggccggctggccatgtcgcgcatcagcccggccatggcgggctccttcgcggaggtcagcgtgggcacgtcggcggaggcctatacgtacccgggcgcggtgagcgacgggaacctgcacgagcaactgctcttcaccttcggctacggcgtgtggctgggccggggtgggccgttccggggcgaggcgatgctctattacgaccaccgcaaggactcgttcgcggggggcatccgctcgcgcggcggcggaatcgtgggcgcctttggcctgaggggccgggcgctgctgacggatgactggggtgtcgccgccgaggtgcagggaggcggcgcgctcgtgggccggctgtcgttgattcgtgccctgggaggtgagcggtgatgcgcgtgggagtgatggcggcactggtggttgcggggtgcggcatgcggcccgcggagaaccgcgcgattgcggattccaaggtgggccaggcgcagcagggcggggtgacgctgtcggtggcggatgggctggcgacggtgcgcgaattggcgccgggcacgctggtgctgtggggcaacgcgccggccttcaccgcccgcatcgacgtgggcgcccaggcgccgtccgactggctggtgacggtgcgcaacgcgatgccggacgcggtgctggtggccgaggaggaagggggcgcgccgctggcgcaggaggcgcttccgcaggcgctgcccaccgtgaaggtgtggcgcgtggcgctgcgcgcggggacgacagcgcggctgtccgtggcgccgccggattccgaatcgcgcgagcccttccgcttcctcgcgctggcggacgtgcaggaggccctgccgcgcgtcggcgatatctacgcgcgcatgcggcgggacgacacggcgcgcttcatcctcttcgcgggcgacctcacggagtcaggcacgcgcgatgagctgacggagttccaggagcggctggaggcgggctcgcgcattccgctgtacgccaccctgggcaaccacgagacgttcacccgcgacgccgccgagtaccacgcgctggtggggcgcggcagccagagcttcgtcttcaagggcgtgcgcttctcggtggtggactccagcaacggcacgttggaccccggcgtggaggagcaattggaggggtggctggcggcttcgcgggacggcacgcacgtggtggccatgcacgtgccgccgcaggacccggtggggctgcgcggcggcggcttcgccaaccggggtgaggccgcgggcctggtggggaagatggcgcgcgcgggcgtggacctcacgctctacgggcacatccactcctactattcgttcgccaacgcgggcatccccgccttcatctccggcggcggcggcgccattccggagacattcgacggggtgggccggcactacctgtccgtggatgtgagcgcggacgacggcttgcagcaggcggcgctggtgcgtgtggattgatccgcaggggtgctgttttagcctaccctcttgatctgacactgaacatctgggcagataggggccaccttcccgcaaggagccaggaggcccgcgcatgttcgactcgaacgagaacgaccccattcccccggcgctgcgtgcgctgcttgagctgttcaccacggagctggcggaggtccgcttcccggacatgaacggcgaggtgctggacgccgcggccgaacaggtgcgggcgcaggcggaggccgtggcgcgggcgcaggcggcgctggagtccgcgcggcaggcgctgcacgaaagccaggaggcgttgctccagaagggccagcgggcgctggcgtacgcgcgtgtcttctccgaggagaacgtggagctgagcgcgcggctggacggcatccacctgccgcgtgcggcgcgcaagggcgcccgggctgacggcggagcgttggaccccgcgagcgcggcgcagggcaacgatgagaacgcgccccgccgccggggccgtcctcccaaggctcgcgccgtcgcgggtgcatccctgttcgcggatgggtcctcgccggaggcgctcgccgccgcggcgcaccacaccggcaacggcatgttgtccgaggcctgagcgggccgcggataaacgaagccgcccggtgtgtcgcggccaccggacggcctcgcgaggactggcgcatcagttgggcaggaacaccgcccggacgcagccgtcctgcttcttcttgaagagctcgtaccccttcggcgcgtcctccagggagaaccggtgggtggcgaggaaggacgggtccagctcgcccttcaccacgtgctccagcaggcgcggcaggtacttctgtccgtgctgctgggcggagcggaccgtgaggcccttgttcatgatggcgcccagggggaacgcgtccatgaatccgtagacgcccaccacggacaggatgccgcccttgcggcacgcgaggatggcctgccgcagcgcctgcccccggtccgtttggagccgcatcgcctgtttcgcgcggtcatacgcggcgcccacgcccgtgccgtgggcctccatgcccaccgcgtcgatgcaggcgtcggggcctcggccgccggtgagttccttcagcacgtcgaggacactgtccacctcttcgtagctgatggtctccgcgcccaccttctcccgcgccagcttcagtctttcggggaagcggtcgatgccaatcacccgctcggcgccgaggaggaacgcggccttctgcgccatcagccccacgccgccgcagccccacacggccaccgtctggccgggttggatgtcgcagaagtccgcgcccatgtagccggtgggcacggcgtcggagaggaacagcgcctgttcatccgtcacgccttcgggcacccggaagcagtcgttgtccgcgtgggggacgcggacgaactgcgcatgcgcgcccgcgtagccgccgaaggtgtgggtgtatccgtagatgcccgcggtctggtagccgaacaggggctcctgcaattcacccttgggattggtgttgtcgcagagggaccagaggtcgtgctggcagtaccagcaactgccacagccgatgaaggacgggacgacgacgcggtcacccacctggaccttcttcaccgcggggcccttctccacgacggtgcccatgaactcgtggccgatgacgtctcccttgcgcatcgtcgggatgtagccgtcgatgaagtggaggtcggagccgcaggtggtggacatcctcacctggaggatgacgtcgtgagggttgacgatgcgagggtcccccaccgtctccacgcccaggtcgttgatgccgttccagcagagtgcgcgcatgggcaggttcctcaggaggagtagccgccctcgcgagcggcggggttgggccgggtggtgggaatctcgcccgtctcgacgaggctcttgaatcgcttgagggccttgagcgcgagcgcggcgggcacggcgccgagcaactgcacggccttctcgcccacgacgccgcccggcgggtcgaagacgaagcggagcgtcaccgccgtgccccagtcccgcggcgcgggtcggaagcgcacccagccttcgttgggcagggccgtgtcccccacggagcgccagctcagcagctcaccggggtgctcctccaccacctccgcgtcccattcgagctccttgccgagcacgcccggcaccttccagtgctgcaggctctcgccagaggaggtgacgtcggcgaagtgtcccatcacctggttgagcgtctccgcgtcgcaccagcggcgatacagcgcctccggcgcgccttggatggtgatggagcgctggagcaccgtcagttcgacggtggcgtcccggccacgttgccggcggagcttccggacgacgacgccgtgcttgtggacgtggggctcctgctcggtccgggtgccgcggaagagcaggccgccgccggccagggccatggccacgccgcccagcttgcctcgccggaggcccagcgtgagcagggcgccgccagcgagcgcggagacgagctgcggaaggcgctcctccgaggtgcgctgagggccgcggccgggccgtcgccacctctggctcccgaggcgtccgccacgtggagacacagcgggaaagcgggctcctggctgctgaatcgtgtcacgcatgacggtggctcctcctgggcaggcaggagtcgagcccgccaccggaaacgttgggggagccaccggggatgacaaccccgtgggcgcgtgccgcgcggggtgaggggcccagggccgccagcaggctccaggccctgcaaaggccacggcccggccgggtgccgtcgccggagcccccctccgcgcgctgcactcgaccgggccatgggaccgggcccccacccgcgttcggtggaggggcccggctcagctctgcgtggggacgtcagtcctgcgggaaggccgtccagccggccagccagttggtggtgcccaccgcgccgacgaagcgcgcggaggtgtcgaagcccgccggcggcgtggcggcggagtccgggttgagcgcgggcgagccggccaccggcatgaagttcggcgccgtcaggtgggtcgcgtcggtgagctgtggatccaccacgcggttgttcagcgcggaggcgagcacgcgctcgggctcgttgaagttggacacgtccgggttggtgatgttgccgccagcgtccacggtcgggttcggcgccgcggggatggagaccttgtcgccgcggttgttccagaagaacgtgttgcgcaggtacagctccggcgtggccgcgttccacagggccgcggaggccgtgccgctcacgtctaccgccaggtcggcgaagtgggccacgatgacgttgttcaacttcccgcccgcgccggtgttgaacaccatgcccgactgcgcggggctggtgcccgacggacggccggagccgatgaaggtcgcgttccagatttccggcgcggaccgcggcgtggccgcgttgtcgttcttgttgccggaggcctcgatgccgaagttgcccaccaccgcgttctgctgcgcgatgaagaactgaatcttcccgttgtagcccaggtcgtagtccagcgagtcatcgtccgcctgggtgacgacggcgtgcttcaggttggccgagccgccgaagaactccacgccatcatccgcgcccatgtggacctggatgtagtccaggtcggtgtccgagccgcagccggccacggtgaggccgttgagctcgttgtcctcggacagctcgaagccggcgaactcgatgcgcgcgtagttcagcttgccgcagtcgtgcgcgtcgttcgggttggcgccgccaccgtactgggtcagcggattgttgccggaggcgaagaagccctccaccgtgttctcgccgcccgccacgttgatgcggcccttgccgagcagcaccacgccgccccagttaccgggctcgcggctgcccacgggccgcgagctggtgaagacgatgggggcctgcgccgtgcccaccgcgtgaatcttcgcgttgcgggtgatgatgagcgcgctgccctggtcgcccaggatgcgggtccccggctcgatggtgagcgtgccgctctccacgaagatgtagttcttcagcgtgtacgtgacgcccgccttccaggtggtgtcctgggtgatgttggcggacacgttctcggtggtgtccgtcggcggcgggttggggttgttgggcgtgttgtcgtcgtcgccgcaggcagacgtcagggagagggcggagagcgtcaggagggaggcaaagaggcgcttcatgggtgtgcttccttctgcgggttagagggaccagcccagcgacgcgctgaaggcgacgccgggtttgtacgtctgcacgtccaccgactcctggcggagggtgacgctcgagttgaggaggttggccgcggtgagcttgagctgcgccgagccgagctgctgggtcagcgagatgtccacgcggtggaagggcacttcgtagatgtccggcaggccctggacgcccacttcgctgatgcggcggccatacacgttgtagaggacggtcagctcggtgccgctttcggggcgcgagtagccgacgttgaggttgatgacgtacgggacttggccctggaggggacggttccggttcgtctgcgcgccccccacgttggggtcacccaggtccacgtcggactggatgagcgtgaggttggcgcccacgcgcacggccttcagcgtctccgtgaggcgggcgagcgacgcgcgcgcctccagctccagtccgtaggtgttggcacccgcggcgttctcgaagctgaggtcccccgactcggggttgcggatgacgcgctcgatggggtcctggaagcgcttgtagaaggcgctggcggccaggacttcgttctcacccgcgaaccactcgacgcgcgcgtcgatgttgtggatgcgcgtctggagcaggtccgggttgccggacacgttccggcggcgcacgaagtcgaagtagatgaacggcgccagctcgcggaaggtgggccgcgccagcgtgtagctgtagccggcgcgcacattcacggtgggcgtcagcgcgtagatggcgttgaaggccggcagcaggttcatgtactcggagcggttctccgtgccggaggcgccggtgaacgggtccttcagcgtgagctgctgggtggaggactccacgcgcaggccgcccaccaggcggagggcgtccgtcggctggacgtccgcggacgcatagccggcgaagatgcccaggtacgcgtcataggcatcgtccggccgggtgttctcgcgcacgcggatgccggtgcccaggttctccggggcgaagagctgctcgggggggagcgtgcggtccaccggcgtggtgcccagcaggtagcggaagcggcgggcaccgaagtcacggaaggacacctgggtgagcccgcccaccttcagccggacggcggagaggggaacggtgacgttgacgctgccgcccgtggacgtctcgcccagttcggcgaagaagcgctcgccgctgttgggctggttggggaaggtgggcgtgcccgacggcgcggagaggttgtcgctgtagagggtgtcgcgggtgtcgggctcgtcgcggtccacgcgggacaggttggcctgccaatccagctccgcgtcccccagcagacccaggcggtggaagcctcggagctggttgaagaagagctgccggctgacgaactgcaggcgcgtgctctcgtagctctcaccgcggacgatgttgctgccgcgcgcggtgaacgtgcgggtgtcggtgccgcgggtgtagaggccgaaccaggtcagctcgttgtcgcggtccaactggaagccgacgctgcccaggccgctgaggctggccgtctcgaagccctgcgtgctgcgggccgcgtcgcgggcgttgagcgcgcccgtctcgtcgcggtcgacacgggcgaaggtgccctcctgcacgccgtcgcggtgaccgtagttggcgctggccaggtagcccagccggctgttgccgaagcgcagggtgtcgcccatggacacgcccaggcccatgttgggcagcgcggtggtgcggcgcgcctgccagatgttggggaagctgcggtactgctgctccagcacgtcgctggactcacccgacatccccaggccgctgtcgcgcggaatcgcgttggggagctggcggctcccgctggggaagcccaggttctcaccgaagccgccctgggcctggctgttgcgctcgcggaacgtcgtctcggagtcgccggccaggctgatgcgcggcttgagctcgaactcgctcgggtaggagttggtttcgatgagcagcgtgccgccggcgaaggtgccggggaggtccggtgtgtagctcttcactacgttgaggttggcgaggaggctggtggggaagatgtccagcgggacgctgggctcgtccggctcggtgctgggcagcagcgcgccgttgagcagcgtggtgctgtagcggccacccaggccgcgcagcagcacgtagcggccgtccaccaccgtggcgctcaccacgcgcttcaccgcgtcggaggcgctggagtccggcgtgcgcgcgatttcctgcgcgctgatggcgtccgaaacggcggcggccttcttgcgctcctggagcagcgcgccctcggcccggcggtccgcgcgggcctcgacgacgacttcctgcaccgcgccttcgtccgcgccgagcgcgacgtccagcttcgtcgccttgcccttcgtcaccacgacgccggtgatgcggcggccctggtagacgtcatagaagacgcgcaggtcgtacttcccgggcggcagcgcgacccggtagaagccatccaggtcggtgagcacctgcttctgggcgcccgccacgaccttcacggtggcctcgatgaggccctctccgttggcttcgtccgtcacgcggccgtagatgccggtgaagcccgggggcggcacggcggactcggccagcatcgcctcgtcgcttatgccctccatggactcatcggccggcgccgcgggctgctgcgcggtgggggcaggttcagtgcccggctgctgcgcggtgggcgcgggcgtgacgcccggctgctgcgcggtaggcgcggcctcggttccgggctgctgcgcggtgggggcaggttcagtgcccggctgctgcgcggtgggcgcgggcgtgacgcccggctgctgcgcggtgggcgcggactcggtgccgggctgctgcgtggaaggatcacccacggcgggcggagcggcaattccagacggctgcgtcgcggtgtcagtcggctgcgacggttgggtttcctcggatgggggaagaggttgcgtgacggggtcgaccgcgggagcgggagccgagcccggaacgccgggcgcctgtgcgaacacgggcgtagctgtcatgacaagcgcagccagaatggcgcgcaagggggcagtgcgagacaacacgacactccttgccgaggtgcgcgtagagaacgcgacacgcatggcatctggatgaaggggctgtgacgattcaggcggcggaccgcaaacttggtgtcacggtccgccgcggcactgcatcaatccgcgagcttgtccggcagcacgccgaccgtgatgtccccgcctcgcgcgaggtccagcacgtccatggcggcgccgtacggcacatcatcactggcgtcgaagaacacaatcttgtccgggcgcgcgttgagcatgcgctggagccgggccacgacttggtcgcggggcacttcttcccggttgattcgcagcacgccggacttgtccaccgtgaggaccaccggtggctttgcatcgggaggaggcggaggggcctcctggtcatcgcccttggcgggcaccgtcatccacatctgcttcgtcatcagcggggtgacgaccatgaagatgatgaggaggacgagcacgacgtccaccaggggcgtcacgttcatcgccgggcggatgctgccctttccgcctccgaggtcgaatgccatggcgtgcgctcctagttcttctgcttgtcgacgacctgcaggttgatgccggggaagcccagctcctgcatcgccttgaagaggccgcgcacctcggagtagcgcacgccccggtcggccttgagcaccacgggcgagtccgggtccttcgcgcgcacggccttcagctcggccatgagcgcgtcgcgcttgagctccttgcggtccaggaagaaggccccggtcgcggacaggctcaccgtggtgggggtcagctccttgttctccttgtccgggttcgtcgccgtgggcagctccaccgcggcgccggactcaatctggggcgtgacgaccatgaagatgatgaggaggacgagcacgacgtccaccaggggcgtcacgttcatctccggcgtcaggctcctacgcggggtggacatcgcgggactccttgcgagcagccagctccgggcccgtggccaccgcggcgccgttggtggccacgggcttttgcggccccaggtcctccaggtagtccatgaactcgctccgcgcggcgtccagggagagctggagcgaatccgcgcgggtggagaggaagttgaacatcagcaccgcggggatggcgacgagcagacccagcgccgtgacgacgagcgcctcggcgataccggcggacaccgcgcccaggccgccggagccctccttggcgatgccggagaaggcctcgatgatgcccaccaccgtgccgagcagaccgacgaagggcgccaccgagccgacggtggcgagcacggacatgccgcggcgcacgtcggcgctgacgcgctcgttgatgcggaccagctcacggcgcgtgagctccaccgggcccagcttgccggccggcacgcgggacttcgcgaggaagtgcttcatgccaccgcccagcagcatggccaggtggctgcccttggtggcctccgcctccttcaccagcgcctcgtgctggtgctgggtgaggagcggaccggcgcgggacgcgaattgcttggagatggagcgcgagcggaagaagacgaagaggcgttcgaagaacaccgcgagggacgcgacggcgaagaggatgagggtccacgcgatgcccagcgcgaacacacccatgtggttgtagatgtccctgagattgaaattcatgaccggttgctcctggggggcatgtgcgggtgaggcgttttccgcttacgacttgagacggaacggaaccttgaagatgcggaacacctgcggtgggctgaccgccgacaactgcgggcttgaagcgccacgtcttcgcggcggccatggccgcgctggcgaagggctcgtcgccgcgcatcaccttcagctggctgacgcggtcatccacgcccaccacgcccttgaggatgaccatgccttccaggcccttggagcgggcctcggaggggtattccggcgtgaggttggaggacaggggctccggcggcgtgccggactcctggagattgatgggcgcgacgcgaccgccaccaccggggagtgtgtcacctgcggggacacccgccaccacacccgcaggaactagcgcg

SEQ ID NO: 1272 - DNA, 54484 bp, Myxococcus xanthus
gggatttggtgcaggtgtcgctgcggggcacgggcatccggctggcggatggcgccaccaatgtcatgccggtgccacagcaccgggtgaagcaggacgagccgctgctgcccaccgagcgccgggagaacatggaggcggttcaccgggtctggcaggtgtcgtaccggcacatccggcactcgttggagcggggctggtaccaaggatgggacttgcacccgggccagctccccgtgcgctacgcggcggtgtatgcgttctttctggagggcctggacgcggcctcgcgcaggctcaatgccttcatggagaaggccgcgcaggccacgctggtgggagacgtcttcgacgacgcggccaccgggcagggcctgctcaacttcttcctgcggggcctgagctgcggcgcgctcacccaggacgaggtgctggccgcgggcctcacgctggaggagctgcgcagccgctccttccgcgacatcgtcgcgtcacgccgcgcccgggccacttccggctaggccgcgaccgtggactcctccatgtggcgcttcgctctgctgctgtgcctcacctccgcctgcgccggaccgtccgtgacgacggtccggcccgagcagcccgtgcccgtgccgccccctgccgcgaaggttccgccgccgcccacgccgacaggccccttcgcccgggagctggcgccgctgcccaggcagcgcgtgagctccgcggaaggcatcttcaccgccgaggtggaagccacctccgcgccccgcctgacacggcacgagggctccacacgcctggagattcccctgggcaccgaggccgcgttgagctgcttcgtgtacgagcgccccattgacgcggcgggcgcggtgctcgcggtggcgaaagccgcgcaaggccacaagggcgtcacggtccggagcatggctcccacggaggtcaccgtcgtcgcggacgcaccggtgatgttcgtggacgtggactacgaggtggtcgcctccggggacagcgtgagcgcgggacggctcaagctgatggtgagcgcgagcccggagctccccctgctgtgcgcccatgacgagcccggctacgcgcgcaccttccaccgcgtcaccaccggactggccgccacactcaaggttcccggccccgcccggacgcccgcgcgaacgaaggcgcttcgcgtgttgaaactggatggacggctcgcgggattcgactggcgcaccgagcaaaggctggagggaggctcgcggcgcacggaagtctccaccagcctgctgctgccaggggccacgaatggcccgcacgcggaggaccgcaccatcaccacggtcacggatgaggagggccggctgaaggagcagcgccatgcgcatgcggaagacgggcggctcacgctccaggtgacgctccgccgcgaacgggagccccaaccgcccacgcgcgccgctcccgagacggcgtaccgctacgaggggagacagggctcgcgcgcactcaagggcaccttcacgtcgaaacgagggctggccacggaagacacggtccatgacaccgtgcgcgacgtgctgcgcccgggtggcccggcggaagccgtgctcgacgtctaccggcccgccgacgtgccctccgcgcccacggaactggtgctgcgccgggtgccctcggctgggccacgagccctgacgctcaccacgggcgacgccaccgaggaggcgcgggccgccgaaagcggcacactggagtggacgaagcgcgcccttcccgagggacagctcacgtccgagctcatccacggcagcccgccgccctgagtggcactggcgaagcccgcgccagtgcggtcgctcacctcaccagagcatgtcctggtcctcggtgacgccggggacgttggacaactccagcgtgcggcttcccacgcgcaccgtgccgttgaagaagcccaccggctgcgcgaagtggctcacgacgaggcgcaggttccggtcctcgcggtgcacatgaaggggctggaagcgcaggtccaccgcgccatccaccgtcgccagccgccacggcgccatcaggtccttcgcgtcgtattcgaagcgggcgcgcgccagcgggtacagcttgtcccccagccacagcgcgttctcgttggcgtccgcgttgccctcgttgaagccctccacgaggttgatgcccaccggcgtgccgtccgccagccgccccgacgcgaaggcccagcgccacgcggtgtgccgcgccaggtagccctgcgtgtagtccatgccgcccacgcctccgtccaaccggaagcgcttcccgcccgcctccaggctgccgaaggtgagcaggccattgctcttcatggtgacgttgaccagcccgtcaccctccaccggcgccaccacggtgagcgcgggcgggccgccggccaccatcatgtcgccctcccactggaaggactgaaggcttccggtgcgcagccggctgacgtccaccaccacccggtagcgctcgtcgtcctcgccgcgctgcaccgacagccgtccgcccagcgtgcggaaggaggccttgaggccctgaccgggcttgtcgcccagcaccaccatggggccgggcgtgcccaggaagctcacgtcacacagcggcttgcgctcgcgcaagtccagggccaccgcgaaggcgctcgacgtgtagcccaggtccaccaccgcgaagagcgcggcgacctcgggcgtggccgcgaaggtgtagtgccaacgcttgcgcttcagcagacgcgtggtgcggcccggggcccactgcccttgcaggcgcggcaggtccacttcgggcaactcaccctggtaggtaccgaatcggggctcccccccggaggtggccacggagactggcgcgggagggaacaaggcgtcttgctctggcttcatctggccccattggaaggcaaaggcgcgtggctgtcatgtcaggccgccgcccaagcgccacccgccgacagtggcacctgagaggttgtgcggagcgtaacgcaacagcggcgcgatggggaccctcgtcagccccggccgaagacgatgcgctcctgggacaacaaacgcgcggtgaccgccagcgacaacaccgtgagcaggatgctggacgcgcccgcgatgaggaacggcagcgcgcccagcggctcaccacgcatgacctcgcccgcgagcacctcctggcccagcaccggcaccgcgaacatccacatcttcggctggagcggcgacagggccagcaccatgcccggcagcatgggcaccaccatcaggagggacaggtacgtctgcgcttccttgaaggagcgtgcataggtggacacccacacctgcacggcggaggcggccagagccagcggcagcacggcggcggccatgcccagggcggcgggcgcgtcgaaacgggccttcacccccaggtcctccaagggcacgcgccgcaccaccagcatgtagcccaccaacgtaatgagcaccgccgcgacggccatgaccacggtggccagccacttgcccgtcaccaccgctctccgcggcgccgggttgagcagcaggggctccagcgagccgcgctcgcgctcacccgccatggcgtcgctggccacctgcatgccgcccgcgaaggcggcgatgaccaggaagagcggcaccatgttgagcagccccgccgcggtgcgctccggcgtggacaggtccgcctcctgcacccgcacgggaatggccaggtccggcgagacgccgcgcgcgtagaggcgctggttgcccaacatgtgggcgtacgcttccaacagccgccgcgcgcgcagcaccgactggcgcgcggactggcgcgagctgtccaccacgagctgcacctcggcggtgcgcccggcggagtacgattcggcgtagtcgtccggcaccaccagcaccgcgtccagcgagcccgcccggatgcgcgactcgtagtcctccggcgccgcttccaactgcgctccgtagcgctccaggaaggccatcaggctgggggcatgctcccgccccaccaccggcaacgccagcggccggtcctgccggtaccaggaggccagcaggttgaacatcaccatgaacacgacggggccaatcagcggccacatcaacgaggtgagcaccgagcgccggtcgcgcaggtggtccttcagctccttgcggaagacggagaaggacagcccgctcattgcatcaacccctggtccgtgccgatggtggccacgaaggcctcctccaggctgtccttgccggtgctcgcgcgcagcgcatccggtgtcccgtccgccaccacccgcccgtgcgccaccaccacgatgcggtcacacaacgcggccacttcctgcatcacgtggctggagaacaccacgcaccggccttcgtccttcagccgccgcagcagcgtgcgcaccgagcgcgtgctcatgacgtccagcccgttggtgggctcgtccaagagcacgttgcgaggcccgtgcacaagcgcccgcgccagggccaccttcacgcgctggccctggctgaagccttccgtgcggcggtccgcgatgtcccgcatgtccaacaggtccagcagttcatccacgcgcttgtccagcgcggcgccggacaggccgtgcagctcgccgtagtagcgcgcgtgctcgcgggcggtgaggcgcggatagaggccacgcgcgtccggcagcacgcccagcgcccgccgggcctcctgcggccgctgcaccacgtccacgccgtccaccagcgcggtgccgcggtccggccgcaccagcgtgtagagcatgcgcatcgtcgtcgtcttgccagcgccgttggggcccagcaggccggtgatgacgccgtcctccgccgtgaaggatacgtcctccaccgccgtcaccttcttgccaaagcgcttgtgcaggttcctggcttcaatcatggcgcgcgcgtcctcaaggcaccgggccggcgaaggaggtgaagaagggaggacgggtgaggttggtgccgcacgcggacgacagcccctccacgctcccttgggtcagcaggtccagcatcagcgtgcgcgcgcagtccgcgccaatcgtgttgtggcccacgccaggcaccaccacgtgcaggctgttggagagcgtgcgcttcgcttcctcggcccacgcgggcggcgtcaccgggtccagctcgcccgacaagagcagcgtgggcaccgacgacaccaccggctcgcggtagccctggggaaggctcccacgcggccagtccgcgcagacggagaggacttcgcggcccatcgtcggaccgaaccaggtgccctgcgactcgcgcaccagcgccgcctcgtcgtagaagggcgcgtcctccgcgcacacgacggcgaagtagaggccatggctcaccgtgcgtcccaggttctccgacaggcccacgctgagcgcgacgaagggagaccagtctccctgcgtggcccggtccagcatcaacggcaccagggaggacatctccgggctgtagagctgcgcgaagagctgcgccaggaaggcgcggcgcgacaggacgacctcctccaacacaccggtgcgcgggtgcgccacctgagtgcgcgcgggcgtggtctccagcgtcgtcagcaacgcctccgtcctgggccgcaggttcggatacgcctgggtacacgccgcgtccgcctcgcagttcgccagcagccggtccagcgcctgctgcgcgtcgcggggcgcgaacagcggcaggtacaaccccatgggcgccacgccgtccaggatggcggtccgcacgcgctccgggtgctgccgcatgtacacgagcgccgcgcgcgtgccgtaggacacgccccagaggttgagcttctcgtagcccagcgcctcgcggacctcgtccaggtcatccatggcgacgggcgtggtgtagtgccgcacatcggcgtcccagccctcgcggcacttgcgcacctcctccgccgccttgccttcctcgagccgcgcggacagcccctcttccggcgagtccgtcttgcagttcagcggattcgagtcccccgtacctcgctggtccaccagcacgatgtcgcgcttgcggcggatgcgctccaccgccatcagcacctgcgtcgagcgcgacgccgcctggcccgggcctcccgccagcagcaccaatggatccggctgcggctgcgcggccagcgccggcaccaccaccacgcgcaggggaatcttgcggcccgtgcgagccgcccggtcctcgaagacctcgtaggtcccacactgggcctgcgtggccagcccctccaggcggcagggcttcaacgacagccttcgccgctccgcggggtcctggctgctcttggaacaggacaccgatgccgcagccaggagccccagggccagcaaggcgcgccaggacggaagatgggaggagatgtgtgcacggaccccggacaagggtacctccatctgggtacgggaggctccccacatagcacctcccacggcattgcattgaatcccgcgcggagaaggggcgtccggtgatacgcccatgcccaccatgaaacgtgcccttctcgtcctggccgtccttggactcaccacgctcagcggctgcgccgccttgcagaagatgctgaagggggctttcaagaagcccaccctctccttcaagacggcccggctcgcggatgcgtccttgtccgacgccaccatcaacctcgtctacgagctgaacaaccccaacggcttcgggttgaacctggccgaggtggactacgccttcttcgtggagggcaagcaggtggtggccggcaagccacgctcggggctggcgctcaaggccaacggcaagagcgaactcgtcttcccggccaacgtgaagttcgcggacatcgtccccgtgctggagaccttcctcaagcaggacaaggccgccttcaaggcacagggcacgctaggcgtgaagacgcccctgggcgtgctgagcttcccgctggcgaaggagggcaccttcgaggtccccaaggttccgcaggtgtccttccaggcgccgcgcatcaaggacatcaccctgaccggcgccaccgtggaattcccgttgtcgattaccaaccgcaacagcttcccgttgccggtggccggcatcactggcgcgctgaaggtggcgggcgcggatgtgggcacgctgtccaccggcaacctgggcaagctggacggcagcgggacgaagcaggtcaccctgcccctcaccatcagcttcgctcgcgcggcgaacgcggccctggccctgcgctcgggcggaaatgcgcaggtccgcctggacggcaagctcacctcggaatcccagagcgttcccctgagtctcaatcagctcgtcaatttcgttaagtgacgcctgcctgcactacgggcaggggaactgaacacagggttgtcccagggcgcctcagacgttacggtgggggcgtccttgccgcttttccaaggtcgagacacacatgcgccgcatcctcttcaagtcgaaaatccaccgcgcgaccgtgacccaggctgacctggattacgaagggtccgtcaccatcgaccgcgacctgcttcgcgccgccgacatcgtggagaacgaaaaggtcgcggtctggaacatcacccagggcacgcgcctggagacctacgcgctggaaggtgaggccggcagcggcgtcatctgcatcaacggcgcggcggcgcacctgaacaagccgggcgacctggtcatcctggccaccttcgcggaagtggaggaagccgaggtggcgaactggaagcccaccgtggtgttcgtggacaaggacaaccgcgtggtgcccgggcagacgaaggagattccgggcccgcagcgccgctcggcctgacgtcccgcgccgcggcggtccgctggctgttttgccccatcgaacgccttttgccatgctccccccttccttaaagggtggggtcgtgggccccggaggagtcgatacgatgaggcggtcgtgggtgagcgctggcgcgctctcgctggtgctgacaggttgtacgggcacgggggccttccgtccggatccgaacaacgacgacccgctctacggggtcatccctgtcgtgaaagcgccaccgcagaaccggtgcgctgcgctcggcacgtcctccgcgcggggctcgtgtgacgacgccctctatctggccaccgagtacacccgccggctttcggtgggtgatgagatctgcctcgagggtggctacggcgaagacccgggctcggcgtgcaaggcgcgtgcggccatcatcgacacctctcccaatcaggtgaagctggaggtgcgcggtccgaagccggactcgcgctggttcaacgtggagatgcggcacgcctggtacgaagaaggcgcgctggtggacctctacctgtccgagcggggttattgagggatgggtctctacgacagcgtggccgagcggctggccttcatgaagaagatgactccggcggagctgaagaagctcggctcggcgcggctgtcggacatcgtcctccaggaggtggcgcgctcgcgtgtgcgcatcacgaccctggagaagcgctacccgcaggcggcgccgcgggagctggcccagcgcatcgtggacgaaaagaagaacctcgccagcatggtgggcggagtgagcggggtgttcgggctggtggcgttgccggcggacctgctcttcatggcgtacctgcaaatcatcctgctcacggacgtggccaccctctacaaggtgaacctcaagacggagcgggcgcgcggggagatgctggacttgttcggctacgccaacggcctgggcccgctgcctcgcgcgggtcccaaggtgttgggaaagctggccgccatgctgttggagaagggcggcatgcagacgctggggcgcgccatgccgctggtggccgcgcccgtcaccgcctacttcaacaaccagcacatccagatggtgggcgagcaggccgtgcgcttctacgagggcttcgacaaggcccacgccaaggcgaaggcccagcgcaagaaggccagcggcgcctgacggacggcgccccgcacatttctttcggtgggtccgatatgccttccgcgccggaccgttgatcgcccaggcggggcctttgcccccttggaagacgggcggtcatcgggactcctcggtcggagggacgacgacgcccgagagacggaggcgaccaggatgtccgagctctcggcggaagtgcgggtgcaggtggcgcggttgaggaatctgctcatcgacgtagcgcgctgcggtgcgttgggcagtcccctgggtgccctaccccataccgagctggacccgatggaggtccaggccgtctggtggctgaaggcggagagcctccttcccgtcaacgtcctcgcggagcggctgggcggcatcgccccgccccggctgagccggctgctggaccggctggaggccgcgcagctcgtccagcgcgagcgctccgtgcggcatgaccggcggcgcgttcgggtgaggctcacggagcagggccgcgccctcgcggagcaggcggacgcagtggtccaggagcgcatggcccggctgctgttgcccttggaaggcgagcagcgcagcgcgctgatggatctgctggaggggtgggtggaggccctgggcggaaagaaccgcgcgccggagctgaccaccgaagggggcgagacggacgccccggtggccgatgagctggagcccgccgcggcgcccaggcgtactcacacggagctgatggccatcaccgccaacgcggcctgacgtgtgcggcccaggccctgctcgtggccatcgccgcgagcggggtctctcctaaagctggacgcgaacctcgccccctcgccggcaggcctcggcgacttcccctgtccagggcgcgtatccctccgcctccacctccaggtgaaggccgaacggcctcacgcgccccaaccgccaacgtccctgcgcatccgtgagtccccacgcgggaggcagtgagctcacgtcacttgatgcggtgactcgcgcgccgaacaccggcttgcgcccatccgtgacgagcacctcgcaatcgttcccctccatgtccacctggaaggtgacggtgccgtccaccctgtcctcacccatgtccgcggcggtgctggcgtagacctcatgaacagagaaggacaccagcaatcgatagcgccccggctccagaatggacacggccatcccatcctcctcctggatgtatgcgccggaggaggccaactcccactgcttctcgtggtgccaccgctggagaacgaacacgggatagggcttctgggtccgtgcctctatctgtgcccgcatggcgccatccatgcgcagcacgagccaccggtaggccttcacgcgccacgtcacctctgcgtcccgcacacccggctcgggcctgaaatcgaaagcctgttccgtcgcggccaccggacgtctggaaactggcgatgccacctcgacgcggaagcgggacggctcccaggacggcaaccccgacacgacaaagcgcccatcctgcgcgagcgggatttccacgtcccccggccccaggagcctcgcgccctccggtggacggaacgttccttccagctccagcttcccccgcagcgtcaccgcctcacccacgccatcgggaaagagcgaacccacgtccagcaccgccggctccacacgcccctcgcgcagaggcacctccacccacgcgctttcccttcccgccgcgctccggagtaccagccccaccgcggggtccgtgggcaagggcagcaactccagcgacttccccacgggaagtggaagcgccgtaccgtccgcgagcgcggaggcgatgtccggcgcggcatgccgaatcacgggcaacagttcgctcgcgcgctccgcgtcgcgagcgtcccgggatacaccacgcaccacacgaagtgagaacgggccatgctcgggtcgcgctcccgcgagccgcacccgcacaccggtaggcgcccgggcagacagcacggcctccacgatgcccgtggtggccccctcctcgggcaccacgtcgcccagccagaacgttccatccgctgcccaggccaccacccggtagagcggtgccactggcacgagcatcggtcccaacgtcccccccgtcgcggacggcgtcacctccacgggccgccactctgacacgttggccaggccctccagccgctcaggcccggcgccctcgcgcccctcgcgcttcgacacttcccacacgtgccggtccgcgtcggagatggagtccacgcccacgcgggcctctccctggaagggcacatccccttgcagcaccacgcgcagacccagtccctctgagtgcgagggcgccggcgccacgggcggcggcggactcacgggggttggggcttccgtgcgtacaacgggggcgcgcgcgggcgtcaccggcgcggcgacgtccacgggccacagccaccacagcgcgagcgcggccaacaccagcgcggcgccccccacaccccatgcgcgacgtttcaaggtctcaatccgtatcgctggtggaatacagcgtcaggtagatgggcgcgtggtccgccaagcgggtgacgaagtcccgcgtgttcccgatgtagtcgcgccccgccgaggagaactccgtcacgtattcgggctgcatccagaagtggtcataggcattcacgtagccaccgctgaggttgatggtggtggccacgttcagtttgcattccaccgtgggagacagcgccaccaggttcgcccaggacgccgtcgtgcacgccatgttgtggtcccccaccaggatgacgtcctggtcggtgcggctggcgtcctgcaccgacttgaacaccgcgccaatctgtttcacctcggcgtcgcggtcggagggattgccccagacggtgtgccagttgatgaacgtgtagtccgcgcccgtgggcgtgtgccgcacgcggacgatttgcggctcgcgctcgaacgtgtcgccggtgtcctcgtacacactggatgacagcagtgacaccgtgtcctcccggtacaacaccgcgtagatttccttgtacgatgagcgcccgatgagcggcgtctgcgcatagcgccacttcacgccggagaccgcgttgagctccgccacgatggccggaaccacgctggcattcatcacctcctgcaggaacaccaggtcacagccgttgttggaattactgttcgcgccgtactgccgccagatctgctccgcgtcctcgcgatacgtctgctccgcggtccacccctcgtgacgcaggttccagctgacgacgcgcagatacgagcccgcctgggcccacgtaggaacagccaggacggccagcaccaccacgcgcaacaagaaggacggaaatcccatggagtgacctcggcgtgagaggggcggccatgcggggccgccgcacgcgcggaccgagcgcgtgcaacggtcctagtggatgaggttcgtgaccggcaacccactctcctgaaaaacaagaaatgcagggtctttcaagacccactcacggcgcgattcaccctccgcgcacgtccacacgccaccgctccgcccagcaaatgcaacttgattgcatgtgattcacgatgtcacattatcgcgggcgttcctggaatggggacctggctgggacggcagagctctgtcctgccgcgaaggaggacgcgtcatcgtgagccgactcatctggagcatgggattcgcgggactggcgctggcctgcgccgtcgcgaactggcttcaccggccggtggagcttccgtaccaggccgcggagcccgaggcttccaccccgctcgcccaggcccccacaccgcggccgcgctccgtcgcgcccgggccttccacgcctgtcgccccggcgcagccggacgctcgccccatcaccaggcccacctcggcgtccgaagcagagcgctccgcacgctcccggcgcacgccccctgcccagcgcctgcggctggtgacggccctgcgcggcacgcacccctcgcctgaagcccgccgcgacgcggtgctggcggagctgacggcctccggcgaaagccacgagccctggacggcgcaggcccgggcggcgctggcgaagtggcatgcccaggtggaggccgacgtgctgcccgtccaggccgagccgcctcgatgcttcgcggccggctgcgtcgcgcgcgtcaccttcccggacagcgactcattccaggagtccttccgccgcaccgcagacctgcggctcggcgagggcaccacgcacatgcaactgccccctgagcgccgggcgtcgggcgaggtcgtggccgcgtggctcgtcctgcgtcccgccacgccctgaacacacacccctgtcaccccgcagtacccctccaaggagcaaccaccatgaagctggagttccccttcaagcagtccctgctcgccaccagcgtggccgtcctgctcgtcggctgcggcaccgccgtcgaggaggagtcccccgtggctcccgaagccgccgagctggagagcagcgaggatgccctgttcagcatgctccccgcctgcgaggagcccgaggagctggagcacgtcgtggagcacgcgtgctaccacgccgaatacggccccttcgagcccgtcaccgccgccgccctgggcgcgcccgtcctggtggatgtcagccaggcccacaccgcctaccaggtcaccctgccgcagcgctcgccgttcaactacgccggccgcgtctcgttcctcccggacgagtcgggtgagttcgccttcatcctgtcgcgtcagcgtggcctgcgcatcttcgaggccgccaccggcaccgaggtggcgcgcgagtgccgctacaccgtccccaccgaggtctgctccagcctgaagacggcctacatcgcggacctcgaggccgacaccgagtaccacctggagttccgctccatcctcccctccaacgccgccttcaccctcatcgtcgaggaggcgggtcaccaccactgacctgacccgcggagcgtcttgaaggcccacggagggagcttcctcctcccgccgtgggccttcgtccgtgcacactctggaacaattgcaccttagttgcatttgaatccaggaaacacatatgaagcacctcatgcgcccgaccctccgagtcctcttcctgaccgcgtgtgccgcggcggccgtcgcctgtggtggtgacgacgaccccgcccccatcgagcccggcgactcctgcgagcccaacggccacatccaccgggagccctcgggcgactggtgccactgcaacaagggttatgtggccgccgatgatggcctggcctgcgtgccggacccgaaccacgtccctggcgacggcttcgacttcggtgacgacggcgagcacgcatgctggcacgtgacgaacggtcccttcgtcaccgtcaacgccaccaccgcccgtcatccccgcgtggacgacttccacacctactacacggtgaagctcctcccggagaacagccagtacgtggggacgttcagctacaaggccttcgccaccggcaacttcgtcgtctacctgagcagcccggacgtgcccgtcaccctcaccgagacggccatcagcaccaccgtgccccaggccggcgcccaggccaccggcggcttctgtgacggtctgaagcacatggtcggctacgaactgacggaccgcgtccagtacacgctccagctcggccccacgtcactgcccgaactcaacatggtcatcgagcacgtgcagtaacccatccgggacgaaccgacctcccgcattattgcaattaaattgcatttgcatcatggatggagactgccggtgcccgcgacttgcggggcccggctcacgaaaggaagcctcatcatgaagctgacccagcggcccctttgcagtgcattcctcggcctggtgctggccgcctgcggccccatggacgacacagggcaggacttcacgtcggagcaggagcagcccctggaggccacctgcgccagcgtggacaacacggccatgacgacgcacgcgtgcgcccatgcgtccaaccctggcgacaacgtgaacgtgaatggcgtcacgggggcgcccgacatcagcactcagcacaagcactacaccgtgacgctgtccggcagcggcacgggcaaggtgacgtacatccccgtggccagggcctcggcgggctccaccgtggagtccgtcgcgttctacgccacgcagaacgtcaccatcaccgccgtggacaagagcgtcacgcccaacgtcacgctgaccgcgctggtcagcaccaacggcatcaccgaggacacctgcacgctgcaccacgcacgggtgttcgactcacggtcggccacacctacgagctgaacatcaccgcgcccaccacctcggtcggcatggtgcccgagtacctgtatgacaaccgcggccgctactaccgggacgcggacggagatggctacggcgccaacagcccgctctaccgcttcgcgtgtgaggcgcccgcgggctacgtcacccaacgcttcgactgcgacgacaccaaccccgccatcttcaactgctagcccgtcacccacggggtgacctgggcatcaccgcagcccctccaccggggcgccccgctcacctcggggggcgctccggcccttctccccgccccacctcaccaaggccctccgatgcgaaccgtcgccaccaccactttgctcgccacgtgcgccctgctggctctggccggctgtgacaacgacgaccccgtccctccgacgccggacgcgggcacccgtccggatgcagggaccgaacctgatgccggaacacagcccgacgcgggttcggtccagggccccacggtcatcggctccacgccctcggagggagagacgaacgtcctgcccgtggagctgttcaaggcggatgcgacgaccaccggggtgcgcaagctcgtcacgctcaccttcgacacgcccatggacaccacggcggcggatgtcacgctcgttgaccggacgacgccggccaatgcccctcgcacgctgacgggcacctggaccgaggatggcctgacgctctcggtcgccatcccccggcccgaatccgacctgccgccgctggaggaggagacggcgtacaccctggagctcggcgcgctgcgcggcgcggagggccacgcggtggacacgtcgcatgcgggactcggtgatgggcggctggacttcaccaccggccggcgcgacggcaccaccgaacacgcctgcgcccacgcactgctggagagcccggtgcccgtcaccgcgagcgcctcccccaccatctaccccgcgacggatacctcccacgagttctacggcctgacgctccccgccagcggcacgtccttcctgggctacacggaagtcgtgtcgggagagagccgggacgagcccgtcatcctgtacctcaaccaccccatcccggtggcggtgcacgacacgacggaaggcgaggacgctatcgccaccgcgctggagcccgcccggcccgtctgcctgcccgccatcacccacacgctgaagttcaccgcgcccggcggcgaccgcttcctccggctcaccttcggcccgacggagcgggagacgttcaccttcgtcttcgaacgctactgagtcagcgctcggtggcggggtgcagcgccgctccccgccccgcgcgcagcaggtgcagcgcaatccccacgcccatgacactcaccgccgccacgtagtgcgcgggcgccaggggcgacgccttcatcatcaaggtgacgaccaacggggtgagcccgccgaagatggcgtaggccatgttgtacgagaaggagagccccgagaagcgcaccgccgcggggaaggcgcgcacgatgctggtggggaccacgcccaccacgccgacgcagaagcccgccagcgcggacagcggcaccagcgcctccggcgacgacgcgcccaggtacagcgcatacgtcgccgagagcatcaacgcacagcccagccccagcgacggccccacgcccacgcggtccgcgagcaggccatacgccacgcagccgaacgtgaggctcagcgtggccacgctgctggcgaccagcgcttgcgtggcggtgattgcgtgcagggtctgcatcaacgtgggcgtcatcaggatgaccaccacgatgccggcggtgagcacccaggtgagcagcatggacatcaccacggtgccaccgtggcctcgcaacacggctttgagcggcagctcccgcaccagcgccttgcgccgccgcagctcctcgaagacgggcgtctccgccagccagcggcgcaggaacactgccaggaagccgaacacgccgccgatgaggaagggggctcgccagccgtaggcgttcacctgctcggggcccagcagtgagttcaccgccgtggccaccagcgagcccagcaggattccgaacgtgaggcccgcggtgagcgttccgcacgccagccccaccctgcgcgtgggcacgtgctccgacacgaagacccaggcccccgggacttcaccgcccaccgccgcgccctgcaccgcgcgaagcaggagcagcgccaggggcgccgcgtagcccgcggtctcataggtgggtagcaggccaatcagcagcgtgggcaccgacatcatgaacacgctcaacgtgaacatgcgcttgcggcccgcccggtctccgaagtgggccatgacgatgccgcccagcgggcgcgccaggtagcctgcggcgaacagtccgaaggcctgcagctgtcgcagccactccggcgtatcgggcgggaagaagagctcgccgatgaccttggtgaagaagacgaagatgatgaagtcgtagaactccagcgcgccccccagcgccgccagcgtgagcgtccgggcgtcgtcacgggtcaatggccgctgcggaaggtcctgcgaggctggaagggaggacatggcgggtcggtgttcgatgaaaccatggaccgcgcagccgcgctcactccgcccgcttgcggcggcgtgacacgatgcggctcaaggccacctcggtgatccccaggtaggccgcgacgtcccgctgagggacacgcccgtgcaggtggggatgttcctgccagaagcgctccaggcgctcctccgcggacaggtcgaggaactcctgctcgcggcgctccttcaggatgtagtgacgctccgccacccgccgggcgagctgggcccagcagggatggctggcctccagcgattgaaggtcatgcgcctggaatgccagcacgcggcccggctccagcgcctcgatggccgtcatggagggttgaccctgcaacatctccgcgtaggcgccaatgaactcaccttcggcgcggaaggccttgatggactcctcgccccgagcggagacgcgcaccgcgcggaagacgccctggagcaccagcccgaagcggtccgcggagtcgcccggccgcaggaagagcgcccgcttgtccagcgcctgctcccgcgccaacgcttccgccttcagccattcgctggcgggaagcggcgcgagcgcggtgatgtgctcgaagagcttcgggtatctcaagcggaaggcacctgggcttaacccaggttaaggcggccttcctccgggcgccatacaccggcggcatgagcatcaacgtctacgccgtggccacgcccttcgtcatcgtcctggcgctgggggaattcgcttactgcgtcatccggcgcaacgggtactacgccttccaggactccatcgcgagcatgggcaccgcggtgctcaaccagtgcgtcaacgtggcggtggcgctgctggtgctcccgctcttcatccaactggggcagttcgcgccctggcagttgggtgcgtcctcgccgctggagctggtggcgctcttcctgggcgtgaacttctcttctactggttccatcgcttcgggcaccgcaccaacatcggctgggccgcccattccccgcaccactccaccgaggaactcaactacgcggtggccctgcgcgcgagcgtgacgcagcgcctcttctcgttccttttctactggccgctggtgctggtgggcttcccgcccgaggccgtgctggccatggtggccttccacctggtgctccagttcatcccccacacgcgcgtcatcccgaagatgccccggtggattgagtcctggctcaacacgccgtcgcaccaccgcgtccaccacgcgcgcaatgacgtctacatcgacaagaactacgcgggcttcctcatcatctgggacaagctgttcggcaccttcgaggaggagaaggaggcgtgctcctacggcctcacctccccgcccaacacctgggaccccaccgtcatcaacttccaggcatgggggaagctggtcagcgacgcggtggccaccaagagccactgggaccggctgcgcatctgggtgatgcccaccggctggcggcccgcggacctgccgccgcgcgcctccgtgggctggcaaaaggacggcgtggagctgaagttccagtccaccgagctacccggcgcccggggctacctcgtgttccagttgctggcggcgatgcccttcatgctgctggtgagccaccacgcctcgccgctgtccggctggcagaagctggtgctcagcctgctcttctgggccatggccaccgcgtggagcgggatgctggagtcacggcgctggagccttccgctggagctggggcgggtgctcgccatgggggcagcggtgacatggtggctgatacacgcctccgcgccgcagagctggaccgcgttgtgcgcggcgtggatgggcgtgtcgctcgtctggctggtggtggtgcgcggcgccagccagggcgccacgcccgtgccgcagggttcgcgctgaacacgcgtcaggcgggctcccacgtcccggcgaaggccgtgtagcggcgcacgttgagcgtcagcgcccggtacacctgcgtgtcgggcgtcaggtccaccaccccgccgccctcgggcaccgtcacgcggtcgaagtgcgcgccatcgaaccagcggtggggctgcacctccacgacgaagcggccgccctcatcgagctccgccgcgatgggcacgaagtccacgcgttgcagctcgacgggcggagggaagtccagggccatccggaacgggacgtgcgtctcctgccgggaggcggttccttccagaatcatcgaccggcctcccagcgccgccccttccgcgcccagggcccgggacggcggctggagcagcagcgagaaggagcgcgccagcccggcgatgcccggcgagcgccccagctcccgcacctcgcccgcctcctccagcaggtcgaacaccacctcacggtcccactcgcccagcaccgtgccgccggagaagaagtgcccgtcgtgggcgtgcgcggtgggcagcaaccactgtcccagccgttgcaggacgcgcggcgccgaggccgtgggctccagcggcgaggcattctcgaagatgtagatgggccccagcaccatcaccccggacgaaaggcggatgcgccagcccgtgtcggtggtgaactcgccgggcgattcctccccgggtgccttcgcggtgcgcaggcccatgcggaagatgacgccgcggcctcccgtgccggagagaccacacgcggacgcgcctcccacgagcgcggtgcccaacatccacgtgaaggcgcggcgggtggtgtgcagcggggacgtcatggcgagtcctcctggaggtccaggtgcagggtgagcgtgcccatgaaggtgcggggcgcgcccgcggtgaagtgacgggtggccatcagcgatgggggcgcatccggaccgcggaagttggacacgtagttgaactccgactcgcgccagcgcgtgtcgagcaggttctccaccgacaggcccacctccaccgccttccaccgggcccgtgtgcccacgtcgaacaggaagatgggcgcgctgtagcggtccagcggcaggggccgggggccgatggcgctgtgtcccagggccacgttccagtccacctgctgacccgctacgagggtggtgcctcgcagcgacgcatccacgcggcccagcaactccgggatgtagggcatcaccgtcccgtcccacagcttccacgccgaggccccggacaccggcagcgtggcgcgcgcccaggccagcgaggcctggatgtccacctggtcccgcagcgtcccgcgcgcgctgacgaaggcgcccaaccgctgcgatgcgcccaccggctggttgcggcccaccgtctcgtcgaacacgaagtcctgcgacacgcgcgtggcgaagaaggcgccgcgtgcctccagcgccagcggcccgtccagccgccagcccagccccgtctcacccgaggccacgcgggcgtagggcgccagctccgcgtcggacagcgcggcggcgtcgctggagcgcgcgcccagacccgcgctggtgagccaggtgaggcgaggcgtcaggcgaatctcggcggaggcacgagggctggcgaagaagccgtaggcctccagggactcgtcggggaggcggggaccatcgcggtcctcggtgggccggttgtggtcgtccacgccgaagaggaaggtgtccaggcgcacgccgccgcgcagggtgagccacgacacgggggcagctcgcaacgaggcgtaggccccgaggttcgtggtgcggacctggttgtcgaagacggtggcgtagggcacaccaccgctgtccctcagccggcgcgagcgcgtgcgcacgtcgtcgtaacgggccacgtagccgagctccagtggctgcggctgtcctaacagcgtcagtcccggggtgtagcggccccgcaggcccatggtggagccgcggtagtacccttccgtgttgtcaccgcgctggcgctctccgtccggtggggtggtgtccagcaggaagcccgtgaagttgtcgcggatgcgcgtctgccgcaggatgacgtagccctgctggacgaagcgcccgccgcgcttcagccgtgactggagttcagcggagaggatgtggcgctgccccgccccgccctggttggggtcgtaggaacagaagaactgcgagtccgaatctggagcgcacggcatccgggagtccaccacgtccgtctcccgcaccacgcccggcgatgcgaagcgcgagccatagctggtgccgaacaagcgcagccgtgactcgtcgccgacgcgcagctccacctgcgccatgatgcccgcgttggcgtaggagcggttggggccgaagccgtggccctgacgcagcagcagtcccacgaaggtggcttcactggcctctggcggcccccagagcagggacagccgccgcgcggcgtagctgcccgtggagagggacgcggtgagtccgcgccgcgccagccccagctggtactccaccgtgcccgccacgccgaagtcgccttgggatgggtcatagggcccctcggtgacgcgcagcgactccaccagctctgggatgatgaaatacgtgtccgcgtagccgtgaccgtgcgcgtgggacacctcgttgagcgggacgccgttgaggcgcagctccacgtccttgccctctcccgcgtcgaagcctcggatgtagatgctctccgcgtggccctcgccgccgtggttggccagcatgacgccgggcgccagcaacatcaggtccgacgcggagcgacgcggcacgtccgcgagctgtcccaccggaatgtggaagtcgcccacggcgaccggcggcggtgcctgggaggcgccacgaaccgtggtggagaagaatggtggctgctgcgccaccctcccaggggtcctcacatctgaaaacccaacgtcccacatttccccctcattcgcgcgcacccggaatggaccaccagcacacccgcccttgagcgggcgggcggacagtccggactcgacaagcggttttccatggttaagggaaagcgacgctggcgccccaccgggcgccccggaggcccctgtcaccatgaccgtcgaaaacgccccccagcgggagacccacgcattccaggcggaaatcaatcagctcctcagcctggtcatcaattcgctctacagccacaaggagatttttctccgcgagctggtgtccaacgcgtccgacgcgctcgacaagctccggttccgcgcgattacggagccggagttgctggcggacgagccggccctggagctgcgcctcatcccggacgaggcgaagggcaccctcaccatcgaggacaccggcatcggcatgtcgcatgacgagctggtgaagaacctgggcaccatcgcccactccggctcgcgcgagttcatcgaggcgctggcgcagaagggccagcagaaggacatgcagctcatcggccagttcggcgtgggcttctacagcgcctatctggtcgcggaccgcgtggaggtggtcagccgcgccgccggccagggccagtccgcctggcggtggacgtcggaagccaagggctccttcacggtggagcccgccgagcgcgccgcgcgcggcacctccatcaccctgcacctgaaggaggaccagaaggagttcctgggcgagtggcggctgcggtcgctcatcacgcagtactccgactacgtgggccaccccatcaagctccaggtgagcaagacgacggggaccggcgacgaggcgaagacggagacgtcgttggaggtcgtcaacaaggccagcgccctgtggcagcgctccaagtccgaaatcacggacgagcagtaccaggagttctacaagcacctgacgcacgactgggaagcgccgctggcgtggacgcacttcaaggcggacggcaacacccagttcaccggcctgctcttcgtgcccaagcagcctccgttcgatttggacgcgcagcagcagcgcggggtgcggctgttcgtcaagcgcgtgttcatcatggaccgctgcgaggagctggtgccgcagtggctgcgcttcgtgcgcggcgtcatcgattcggatgacctgccgctgaacgtgtcgcgcgagctgctccaggactcgcaggtggtgcgcgccatccgcaagcacgtggtgaagaagtccgtggacctgctggagaagctggccaaggacaagccggacgactacctcaccttctggaaggccttcggcacggtgctgaaggaaggcctggccacggaggccgagcagaaggacaagctgggcggtctgctgcgctacgagagctcgcgcgaggagggcctgacgtccctggcggactacgtgggccgcatgaaggaaggccaggaggccatctattacgtctacggcgagtcccggaaggcggtggcggacagcccccacctggaggcgctgaagcagcgcggcttcgaggtcctctacatgacggacccggtggacgagtgggccgcgcagggcctgcgcgagttccagggcaagccgctggtgtccgcgctccaggcggacctgaagctccagtccacggacgagcagaagaaggagcaggagcagcacgccgaaggcctgaagacgctcacctcgaagatgaaggacgtgctccaggagtcggtgcgcgaggtgcgcgtgtcggaccgcctgacggactcgcccgtgtgcctcgtcgtgccagagggcggctcgccggcctacctggagcgcctgctccagcagcgcggccggggcgcgggcatgccgcgcgtgaagcgcatcctggaagtgaatccgaagcaccccgtcatcgagcacctgaaggccgtgcatgaccgcgacccggccgcggcccaggtggcggagtggattgagctgctccacgaccaggcgctgctcaccgagggcagcaccatcgccgaccccaaccgcttcgcccgccgcatgacggggctgttgacgcaggtggcggccctggcggcggcgcccgcgccagcgcagacccccgcctcggcgacggcgagctgagacgccgtcacccacgccccctctcccttcgagagggggcgcccgcagcccgggcgagcgcctggtgcgcccggctgcttcggggaggccccggacccggggaatgcccgacccgggacgggggtatcggcttccccggggcgcgtcggctatcgtccctcggaatatcgaggggagtccgacgacatgaagcgagtggttctggggttgttcgcagccgtggtcctccatgcgtgcgcagcgcacgaaaagacgggagaccgcgccgcggccgtaggggattggaaggccgcgtatgcgtcctaccggcaagcgctgaccagcgagccggacagccccgaaatcaaactcaagttcgacaccgcccgcaccaaggcgctccaggatgcgcagcagcgggcgcagacgtgcgcgcaggtgaatgactggggctgtgcgctcgccgagtccgacttcgccctgtccgtggagccgggcaacgcggagattgcgtcgttccgcgcgaacgcggcacagcaggtggcgatgggccagttggacacggccgtccagcaggcgcagcaggggcagtacgcggaggccgcctcgctgatggaccgggcgctgcagttgtccccggcgcccgaggtcaggacgcacgcggaggacgtgcggcgcatcatcaccacccaggggcgtgcccaggcagaccggtacctgcacgagggcaacttcatcgcggcccacgagctggcgcagttggtgctgagtctggacgcctccgcatcggcgtgggcgcagaacatcgccgcggagtacgagcacttcatcaccgaggaggtcgagcggctgtcgcgcgagggtgacgccgcgcgggcgcagcgtgactgggggcgcgcgcagcagagctacggcgccgcgctgagcctgcggcagggtggccgggccgcgccgctggaggcgtacgtgcgccacatggccctcgccgaccagcgcatcgcgggccgcgactggaacggggcggcggatgcctaccatgtcgcgctgcgcacgggtcaggacgacggatatgccaaccaccagttggagcgggtgcaactgcggccctaccgcgtcgtgctgcgctcggtgctggtgacgccgggccggccggatggccgggcctgggtgggcgcgtcgaacgacatcttcacgcggctggccaaccggctgacccagacggcccggcagcgtggaatgacggacctggtgaaggacctggccatgagcattccgcatgagaatcgcccgaggctgcgcatcgaggtccaccatccggatggcatgcacctgacgacgcaggggcgtgacggcatctacacggcgtatgacgcggagttcgtcgctgtcgccaatgccttcgacgaccggcgggtcggcttccaggtgtacatggacgggccgaacgggagcgagctgctcggctcggtagacgtgcccatgcgcgagctggtggagcaccgcgaggtgtcgctggagggccgctcggtcatcgcgctgatgctgagcaccggcggtgacggccgtcagccgggcccttacgccggcatggcgcacgtgctgccgccgcctccgcccggtacgccgccgccgggccgcggccacgccgccacgccgattccctgacgtcccgaggggccgggagcacggcttccggcctccagacacggtgtcaccacgcccggagcatcgttccgggcgtgggcaacgagcagatgcccacccgcgccccgaacgcctcttagcgcggcaggcggagccggaacgtagagcccgtgccgacgacgctctccacctcgatgtcccccccgtgcgcccgggcaatccggcgggacacggagagccccagccccacgccggggatgtccttcgccgcggtccggctgcgcttgaacggctcgaagagggtgcccaggtcgtcgggcggaatccccacgccttcatccgtcacggacaccgacacgtcgcgctccgaggactccagccgcagcgacaccaccccaccctcgggcgagtacttgatggcgttgctcaccaggttggtgagcacctgcgacagccgcgtcgaatcacaccgccagggcacgggcgagtccggcacggagtactccagccggtgatgctcactggacggccggtggagctccaccacctcctccaccaacgcgcgcaagtcacactcctccagccgcagctccaggttccccgcctcgatgcgcgtccggtccagcagatcgcccaccatgcgctccaaccggtccacctggttggagatgcgcaccagcgaatcgcgcaccttctccggcggaggcgccgtcttggcccgcagcagcatctgcgccgacagcttcagtgcgttgagcggcgtgcgcaggtcgtgcgccacgcccgcgaggaactggagctgccgcgcgtcctgactggcgacggtctccgccatgtcgttgaactccgcgccaatctcctggagctccggcggccccgcgcgcgccacccgggattcacgccggcctgacttgaacgcactcaacgcgcggcggatggccaccagcggccggtagatgctcgtctgcgcgatggcgaggaacagcaccacgcccgtcagcaccgacaccgcgagcaacgttccaaggagccgccccgttctccgcacggcggtcgcctcgtcgcgagccatgcgcgcccgcgcgatgctggagtccatcaccgcccgcgtcgcatccaccgcctgcgccaaccgccgccgccggtccggctccggcgcattgaggtaggcctcgacgctcgcgcgggaagccgccaccagcccgcgctccgcctccgtctccgtgtacatctcgacatgggccagccgctctggcacctcgcgcaccagcgcgtccaccccgacgggcggcccgatgtccgtgggcccgataccttccacttcgtgagcgtactggagcagcagcaaggtgaattccagctcggccgccgcgcgcacccgctccgccgcgtcgatgaggctggtggtctgccgctgcagcagggtggtcatccagaagagtccacccgcggaccccagccccagaaccgcaaggagtaccgctccgagggtgaggaaggtccgcaaccgcatcacgccctccaggggaaagcaccaccctacctgatgcgtggcgcgaacgggcatcccaccccgcccgcccgcgaacggcatccatcagcatccattacccgcgctgcacccgccctcaccgggatgtgcactgctgcactgcatggcaacccggtggcgggatatcgccgcgccaggccccatctcctccgggccaggggatgcgtgcggtacgctgtggggtccaccgtcttccggaaggtgcaggcgccatgggcttcacctcgaacgtcaacggccgggagcacgccgtcgacgcgcccgaagacacgcccctcctctccatcctcgtgacgaactggggcccggtatggctgcagcgtggggcaagtgcggcgcatgtacggtgctgagcaatggctcaccactgcgcgcctgtgtcgcgcctgcggcggccctgctgaaggagaagcctcccagggtcccacttcggctgcgctggccaatgccctcttcgacgccacgggtgccaggccgcgagagctgccgctgataccggagcggctggcggcggcgctccagacacgctgaggcggcaccgagggggcaagcccatggcccgcgcccacgtcgacaacactcgacggaggccgcgcgccatgtgaatctgcgttcgaagtggaagggtgcggcgatgaacgccgcaggaactcggatggtcgggccgccatcccagccggcaacgcagccggcgggaccagcgtatgtcgacgaccacgccaccggggcagtctgcccttccgcccgaggcctgggccccactgcttcgactctccaggctcgcaggccggccactggagcgcttcctccatatcgaggcggccagtggcatcctgctcctcgtggcggcggccatcgcgctcctgtgggcgaactcgccctgggcggagagctacgcgcacttctggcacacgccactcggcatccgcgtcggtgacttcaccttcgagcgcagcctcgaatgggtcgtcaacgacggcttgatggccatcttcttcttcgtcgtgggcatggaaattcgccgcgaggtccatcagggcgagctgtcagagttgcggcgcgccgcgctccccgccgcggcggcgctggggggcatgctcgttccggcgggcctgtacctcctcctggcggataccccggacacccgctcggggtggggcgtgcccatggccacggacatcgcgttcgcggtgggcatcctcacgctcctcggaagccgggtgccccccgccctgcgcgtgctcctgctcgcgctcgcggtcatcgacgacctgggcgccatcatcgtcatcgcggtgttctactcatcgggcgtggccatcaccgggctgctcgtcgcggcgctgggaatcgtgggtgtcttcgcgatgcagcggtttggcgtgcgctcgaagtgggcctacatcgttccagcgttcgtcgcctgggcgggcgtctactccgcggggattcatccgacgatcgcgggcgtcatcatcgggctcatcacgccggtgcgcacctggctcggtccggaaggattcgtcaccggcgctcggaccgaactcgaacacatcgcccaggcgcagccaggcgagctgtcctcccatcacctgtcggagaccttgcgccgggtcgatgccgcgcgccgtgaggccatgtcgccttcggagagcctgattgccacgctgcatccgtgggtggcgttcggcatcatgccggtgttcgcgctcgcgaacgcgggggtgccgatttccagtgaaccgctcgatgcggcgtcgtggaccgtggccctcgcgacggccaccgggctcctggtgggcaagcccctgggcgtgattggcgcctgctggctcgcactgcgcctgcggctcgcgacgttgccgaagggcctgggcatgcgggagctgctggtgctgggaagcaccgcgggcatcggcttcaccatggccctgttcatcgcgcagttggccttcacggagacgaagctgctcgccgcagggaagctgggggtactggccgcgagcggggccgccgccgtcgtcgcactcgtcctgggacggtggttgctcaccacttcggcccggcccggcgccgcgaggtccgtggacgaggcggagcgttcgacggcgctatgacgccgcccagccccaggtgtccgccacgcgccacgacgccaacgacgtcacggggacgcaggtgggcttccggctccccaccgatgtcgcaggagtcatcatcgaggtgcgctggcccgagctcgcgcacttggacgcctcctggcgacgcatccagggctcgggcactatcccggtcacgagcctcgatggctcgtcgaacactgcgggagcaagtgatgcggacatcgatgaaatgcatggggctgttgttgctcgtcctgggaggcgcgtgcgcgagcacccggcccgccgtgaccgagcccgtgcctccccaccagacattcaccatcgagtccgcgaagctgaaggagccccgccacatcaccgtctacctgccgccgggctacacgacggcggcggagagccgcttcccggtgctctacatgcccgatggcggcctgaaggaagacttcccgcacctggccaccaccgtcgacacggccatccgcgcgggcgagctgcggcccctcatcatcgtgggaatcgaaaacaccgtgcggcggcgggacatgacgggcccgaccacggtggcatcggacctggaggtcgcccccgtcacgggaggctcggcgacgttccgagccttcatccacgaagagttgatgccggaggtggagcgccgctaccgggtgacgcaagagcgggccatcatcggcgagtcgctcgcgggctacttcatcgtggagacgttcttcctccagccggaactgttcggcacctacctcgcgctgagccccagcctgtggtggaacgcggagtcgttggtgaagggggcgggtgaatggttcgcggcccggccggacctgcgcgcgggactttacgtgtcctccgccaatgaaacgggcgacatcgtccccgccgtggcgaggctccaggacgtcctccgaaccagcgcacccgcgggcctgaagtgggaagtcgaaccccggcccgacttgcgccacgacaacatctaccgggagagctcgcccagcgtgctgcgcaagtggctgcctcccgtggtggccgctgaacgcgcgccctgacgcagcgcccacgcgccgcgcggaagccctgggcatccacgcggcgcaccacgtccgcaaactactgcggaggcatctggttcgggtccatccaggccacctcccagtggtgaccatccgggtcgtagaagctcccgccgtacatgaagcccatgtccatggcgtccgccgcgggtgaaccaccgttcgccagcgcggtcttcaccatctcatcgacatcctctcggctgttggcggacagcgcataggtgccggcggtgctctgcgtcgcatcgtgcaggggcttcttgatgaagtccttgaagcgggtatgcgtgaggagcatcacgaacgcgtcctcgcccaccaccatgcaggtggcgtgctcgtcggtgaagtccttgttgaactcgaagcccaacttcgtgaagaagtccaccgaccgcttcaggtcggccacgggcaggttgaggaagagcttacggggacggctgaccttcatgttcgcctccagggcgggtgggttacgagggctttgactcccgaggcggaccgaattcatcggtcttttttcagaaagattctccgcccccccgcctaccgagggagctcctggggaaggccgaaccgcgggaacaacgcctccgtatcgaggaaatgggtcatcgccgcgatgcgtccaccggacagctccaggacgatgagcgaccacggcttgaagggcccgccgtcactgctcgcgtggtactgcccataggccggtgagccacaggcctcggtcctcaccagccgggagtccctgcagaccgcccctcgcccgaggaaccaaccgcgaatggacgcgtgcccctggagccacagcgtgtacgggggcatggagagggtgacttcctcgtggagaatcgcggtgaaggcgtccatgtcgtagcgctcgaacgcatccacgtaacgattcagcagcgccacctgcgcgtcggactgaggcacccggaactcggagtcttccagccgcaggtccgacacagtcacccgggcacgctggagcgcgctgttgaccgaggcgaccgacgtctccagcgtctcggcgatctccgtggctggccagcccaggacctcggccagcagcagcaccgcgcgctgcttggggggcaggtgttgaagcgccgcgaggaacgcgagccggatgctctgacgcagtgacgcctgctcggaggggtccacgtccgacggcaccgccagcgcgtccggaatgggctcaatccaactgttcgccggcagtggcgtcagcggcccgtcgatggagtacgcgggccccagctccatcggccgcgcgcggcgcccgctcgccgacaaggcgtccaggcacacgcgggtggcgatggagtacagccaggtccgtggagacgcacggccctcgaaccggtccctcgcgcgccaggcgcgcaccatcgtctcctggacggcgtcatccgcctccgagacagaacccagcatgcgatagcaatggcccatgagcgccgagcggtgcgcctcgaagccaaatgcctgcttcccagaatccggaaggtccttcatcaacgggcggtctatcagtcccagcaggtcatgtcaggggctcggacaggcagcccccgtatcaatccacgcgcggatgagctcacccaatgcacgctgagtgcccggcacgggctccaggccaggacccgggtcccaaccccaccccaccaggacgtcctcggccatgtggtgtctcattcgcgttccaactctctcaggacggcctccgcggcgcggcggcccgacaccagcgcgccgtcgatggaggcattgtcacggtggtctccacacacgaacagtcccggtgacagccgcaccggccggcgaggcggctccaacacctccggaggctgcgcgggcagcgcgagcggaatcgcataggtgcgcaggtgccgccatgcggacacggccggaccgaaccagtccgtcagctccgcgagcacctcggcttgcagcgtggccaggtccggcgtggcgccgacaacggacacggacacgagcgcctgtccccgcggcgcatacgccggtgacacctcgctcatcaccgccacgttgttcacccggccccggccctcgccattgagcagcagccagggcccttccacgggcggctccggcgcggcgaagtagaggcacgtcacccggttcatcaccggtggcaccatgcccggcagcagctccaccgcgctcgccgggtccgtggccaccaccaccgccctggcgccaatcaactctccgtccgccagacgcacgcggtgtccccacacgtccgccaccggcgcgcgcatccgcagcaggcccgacggaaggcgcgccgacagttgcgctggaatggcgcccatccctgactccggaaccgccgcgtatccggatgagaacatgcggaagacgaactccaggaagcggctggaggtggtcagctcccgctccaggaagatgccagcgaagaagggacgcaggaacgactcacgcaaggcctccgtgaagcccagttcgtccaggtagcgccgcgacgtgcgtgacggccgatgccacacgtcctccacctcaccggagagcgccaactgcctcagttccaggatgcgcagcttgtccccgaacgtccccacgggagcaaacaggtgcccgagcgcctccacggggcgccgcagcgggtccgcgaccgtgtgcaacttgccaccccgccacaccttcgcgccgggggcgaacctgcgcaacgtcagcgcctcaaggtccaacgtgcgccggccctccggatacgcggacaggtacacctggaagcctctgtctagcagaaagccctcatggacatccgtgcgaaccctgccccccggtgcgtcactgccctctagcaacaacaccttcacccgtgacgcgacgagcgcccgcgcgcacgccaaccccgcgagccctgccccgacgacgatgacctccggattcgacacgcacgcgcctccacacttcccgctcaagaaaagcgcccacgctcgcttgataagcgtgggaggcgcaagggagactcggaagcggttgcgggcaacagacacttgatgcagaaacaccggctgttgcccgtcccacccatgcaaccaagcgccggaatgctcccggcccacagcacccctcggagcgagagaaagcaggcagccccatgttgatcgtgatgcgacccgacgcgacggcccaggacatcgagcgtgtgaacgacgagatccgccgccgtggttggcaaccgcacgcgattccagggggcactcgcacggccgttggcatcaccggaaacccgggcgcggtggaaccggagcccttccgcgtgctccctggcgtcgctgacgccgtggccatctcccagccgttcaagctcgtcagccgcgaggtgaagccggacgacacgcagctgcgcatcggcgacctgacgattggcggctccgccttccacgtcatcgccggcccgtgctcggtggagtcgcgcgagcagattctctccaccgcccacgcggtgaagaaggcgggtgccaccatgctgcgtggcggtgcgttcaagccgcgcaccagcccctatgagttccagggcctcaagggtgacggcctggcgctgctggccgaggcgcgccaggagacgggcctgctcgtcaccaccgaggtgaaggacaccgcgacgctccaggccgtcgccgacaccacggacatccttcagattggcgcgcgcaacatgcagaacttcagcctgctggaggccgtgggggacctgcgcaagccggtgatgctcaagcgcggcatgagcgccaccatcaaggaactgctgatggcggccgagtacatcgtcgcccgcggcaacacgcaggtcatcctctgcgagcgcggcatccgcaccttcgaaacgatgacgcgcaacacgctggacctcaacgcggtgcccatgctgaaggcgctctcgcacctgcccgtcttcgtggacccgtcgcacggcatcggcgtgcgcaaggcggtgccggcgatgatgcgcgcggcgacggcggtgggggcggacggcatcatcgtcgaggtgcaccccgacccgccgcgcgcgaagtcggacggcgcccagtcgctggacttctccgagttcgagaagtccatgaacgaggtccgcgccatcgcccaggcgatgggccgcgaagtggtcaggctgggataggccatgacactcaaggaagcgctgggcaaggtggtgggccggcgcgacctcacccgcgaggagatgacccgcatcatgggtctgatgctcgccggggaggcttcgcctgcccaggttggcgcgctggcgacagcgctgaagatgaagggtgagacggaggatgaaatcctcggcgcggcggaggccatgcgggcctgcgcggcgaagctgtccccgcgtgccgacgtggtgctcgacacctgcggcaccggtggcgacggcgcgcacaccttcaacatctccaccgcggtggccttcgtggccgccggggccggagtgacggtggccaagcatggcaaccgcgcggtctccagccgctgtggcagcgcggacgtgctggcggcgctgggcgtctccatggagcgtccgcacgagcgcgtggccagggacatcgacgagcacggcgtgggcttcctcttcgcgccctcgcaccacggggccctgcggcacgtggcgcaggcgcggcgggacatggggttccacagcgtgttcaacctgctggggccgctgacgaacccggcgggcgcgcgctaccagctcctgggaacgttcgacggcaagcgcgtggagcagacggcgcgcgtgctgggccggctcggcagccgccgcgcgtgggtggtgcacggccatgacgggctggatgaaatctccccgtgcagcgccacgcaggtcgcggagctgcgcgaggacggcacggtccacaccttcacggtgtcgccccaggacgcggggctggacgtagtgcctcgtgaggccatcgcgggtggcgacgcggaggagaacgcccagcggctgcgcgcgctgctggacggcgagcgctcggggctgcgcacggcggtgctgctcaacgcggcggcggcgctcgtcgtcgtgggactggcggcggacctgcgtgacggcgtgcggaaggcggagcaggccatcgactcgggcgcggcccgcaacaagctctccgccctcatcgaagggggcttgtcatgagcacgacgggaacgttggaccgcatcatggcgcgcaaacgccaggaacttgaagcgcgtccgcccatggcacctcgcccccggcccacgccccgcgacttcgcccaggggctggtgacccaccgctccgggcggcgagtgagcgtcatcgcggaggtgaagcgcaagagcccttcgggcggggacttcccccacgcggacgtggtggcggtggcccgagcctatgaagccgcgggcgccagtgccatcagcgtgctgacggatgggccggacttcggcggcagcctggaggacctcgtggccgtgcgggcggcggtgtcgctgcccgtgctgcgcaaggacttcctcgtggcggcgcgcgaggtggaggagagcgcgcagtggggcgcggacgcggtgctgctcatcgccgacgcgctggaggatggcgagctgcgggagatggtcgccaccgcgaaagcggtgggcgtggccgcgctggtggaagcccacacggaggcgcacgccgagcgcgcgctggccgcgggcgcgaagctggtgggcatcaacaaccgcaacctcgccacgctgaagacggacacgggcacggccctgcgggtgatgccgaacctgcgctcccgggcccgggtgctggtggcggagagcggcctcaagtccctggcggacctggtggcggcgcaggaagcgggagcggacgccgtcctggtgggtgagtccctgcttcgagagcccgaccccggacacgcgctgcggaggctgctcggggtgaaggacgcggcgccatgagtgtccgcgtgaaggtgtgcggcgtcacgcgcctgtccgacgcggtggccgcgtgggaggcaggcgtggacgcgctgggcctcaacttctacccgaagtccccccgctacctggacctccccacggcggcggccctggcccgtacgcggcctcccctgggcacggtgctgggcgtgttcgtcaacgcggcgccggacaccatccgggagacggtgcgcgcctgtggcctcacggccgtgcagctccatggggacgagcccccggaggcctgttcggggtacggggtgcctgtcatcaaggcgctgcgagtcacggggccggaagacgtggtccgggctcggacgtatgtgggcgtaggagacgtcgcggggctgctgctcgacggcgcggcgccggggtatggcggcggcggcgtgggcttcgactggtcgctcgtcgcggggctggcgggaagcggcgtgcccgtgctggtggcgggaggcctgcggccctccaacgtggccgaggcggtgcgcgcgacgcggccgtacggcgtggatgtggccagtggcgtggaatccgcccctggcatcaaggacgtggaagcggtgcgcgccttcgtgcgcgccgcgaagtccatcaacctctgggagtgacagacatgaccacggagactgccgccggccgcttcgggcgctacggcggacgctacgttccggagacactggttcccgcgctgcaggagctggaagaggcctacgccacggcgagcgcggacccggccttcggcgaggaggtcgcccgcgtgctgcgcgagtacgtgggccgccccaccacgctgacgcccgcccggcgcctcacggaggcctggggcggcgcgaatgtgtggctcaagcgcgaggacctggcgcacaccggtgcgcacaaaatcaacaacaccgtgggtcaggtgctgctcgccaagcggatgggcaagaagcgcatcatcgcggagacgggcgcgggccagcacggcgtcgccaccgccaccgcgtgcgcgctcttcggcctgccctgcgaggtgtacatgggcgcgctggacgtggagcggcaggcgctcaacgtcttccgcatgcgcgcgctgggcgcggtggtacggccggtggagtccggctcgcgcacgctgaaggacgcgatgaacgaggccatgcgcacctgggtgtcgcaggtgtcggacacgcactacgtcatcggcagcgcggcggggccgcatccgtatccgacggtggtgcgtgacttccagaccgtcatcggccgcgagctgcggacgcaagcccaggcggcctttggcggcctgccggatgccatcatcgcgtgcgtcgggggcggctcgaatgccattggcgtgctgcacccgttcattggcgacgccagcgtgcggctggtgggcgtggaggcgggaggccacggcctggatacgaagcagcacggcgcttcgctgacgctggggacagagggcgtgctgcacggctcgcgctcgctggtgctccaggacgaggacggccagattcaggaggcgcacagcatctccgcgggcctggactatcccggcgtgggcccggagctggcgcacctggcgaagacgggccgcatggaggtccgcatcgccacggacgacgaggcgctggcggccttctacgaggtggcgcgcctggaaggcatcctccccgcgctggagacgtcccacgccttcgcgcgcggccgggagctggcgcgtgagctgggggcgggcaagcacctggtcatcaattgctcgggccgcggagacaaggacgtggccacgatttccgcgcggggcgtgcctccgccggtgggggtgaaggcatgagcggcgagattgcacggactttcgcccaggcgaaggcacggggcgaaggcgtactggtgacctatgccatggcgggcgacccggacctgccccgttcggtggacgtgttcgccgcgctggtcgagggcggcgcggacgtgctggagattggcgtggcgttcagcgaccccatcgccgacggccccgtcatccagggcgcggcggagcgagcgctcaaggccggctccacgctcaagcgcgtgctggcagaggcggtaccggcggtacgcaagcgatgtccccagacgccgctggtcatcatgacgtacgtcaacctcatcatggccatgggcgaggcgcgttacgcgaagctcgcacgcgagcgcggcgtgtctggaaccatcctccccgacctgccgcccgaggagagcgcgagcctgcgcgccacgttcgacgcggagggcatggacctgattcccctgtgcgcccccacgacgcccccggcgcgggcgcaggccatcgcgaaggatggccgtggctttgtctattgcgtgtccgtgtcgggcgtgacgggcatgcgcgcggagctgccgccggacctttcacagcgattggatttggtgcgcaaggccgcgaccgtgcccgtggtggcaggctttggcatctccacggcggaacaggcacgcatgctgtctgcccatgcggacggcgtcgtggtgggcagcgcgctggtgcgtgccgcgcacaccgagggcctcgaggcggcgaaggcgctctgcgccgacatcaagcgcgggctgcgacgctgaggcgcggctgcaaacgctctctccaagctgaaaattcagggataatcccacaccccgtataagcactccggctctccgcatgtgcccgcatcaggcgggcacttgcgcgaggacattcctccggaggcaacatgcagcaacggcgaaggccgtcttggagcaggacgttcctgctgacagcaggtctgttggcgggaacgggctgtgggggcaacgcggcgcccaccgagcccgaacagctcaggagtcagccgcaaagccggggctttggccccgacctcgtggttcgagagctacgaggccccagcagtattcggttcggtgagcccttcacgaccatcgtgaaggtctgcaacgaaggcacagcgcccgcgcagagccccataggtcccatccagacggacttgtacctgtccatggatggcacgctctcctggcccgacccgagcttgccacccccgacggaccaggtgctcctcgccacgctggaggtcagcgcgctggcggccggccactgcgagacgcgagccttcaccggctccgctacgctgccggggccccaaacggacggaatctactacctcggagccatcaccgacgtgcaccagaccctcgtcgaactggacgaggccaacaacaccgcggtgaccgcgctgggcatcggaaaccggccggacctcgtcgtcacggagcttcgtggccccacgagcgtcacggacagcgggacggtcgcatcgacgctcaaggtgtgcaaccaaggcaccaacgtgtcggacgacaccatcgtggagctttacctctccacgaacggcacgctgtcacttccaacgacgggcggacctccccccacgaatcaggcctcacagggaacggtggaagtgcccgaactgctcccggcccactgtgccatccgccacgcctctttcccggtgatattgccgcccggcgcgacacctggtcagccgctctacctgggcgccatcgccgatacgcccgagttctccacggaactcaacgaggacaacaacgtcttcgtgggggacctcgtcgccatgggagcgggaccggacctcgtcgtcacctcggtgcacgcccccaccagcatccaaagcggagacctgctgggcgcctccgtgagggtttgcaaccacggcacgctgcccgcgaatcccagctcgctcgagctgtacctctccgtggatggcaacgtcaccgtgccaggcagcggcagcccaccgccgccgggacaggaacgggtgggccagacggatgtgcccctcctgaaccctggcatttgcatcactcgcaacgtccagggcgccgcgacgttcccagccggcgcacccgtggatggcgccctcttcctggccgccatcatcgattccacgcaagacatccctgaactgcgtgaggacaataacgccttcacccagggactcatcggcgcaggtgcgcgcccggacctcgtcgtgaccgcggttcgtgctccggccagcgtggccccttcggcatcttgggcccctgtcagcgtcacggtatgcaacgaggggaccgtcgctgcctcggcggtcccggtggatatctacctgtccatggtgccgacgctggactcgcctgccatggggggactgctacacgggacccagttcaaggtcggcggattcggcctctccagcgtcgaagcagggcgttgcgtcacacgcgaggagcccatcaccctggaccggcccctgggtgcgccaccccaactccaagcattctacgtgggcgccattgtcgaccccaggtcgaacatcgtggagcttcgcgaggacaacaatgcctttgtcggtgagcaaatgggtctcggcaacgggccggacctggccatcacctccgtgaagggccccgccagcagcatgcctggcgacgtgcctgtcaccgcccgcatctgcaatcagggcaccgtggcctcacagaacacccaggtggagttctacctggccgcgcatgccttcctgaatgctccgattcaggggggctcgccttacaacgccgacccgcatacggcgttctccattgggatgcaccaggtgccatcgttggatgcgggcgagtgcaggacgatctccacccttgctaccgcgatgagcttccccgcggagtacatcgacaaggcgttcaatcttggagccatcatcgacccatacgcgcaggacaatgaactccgcgaagacaacaacaccttcgtcggagacttcatgggcctgggccaccgtcctgacctggtggtcactgccatcgatgctcccgccagcgtgcgcgacagcatcctcttcgcgaccaccctgaccgtctgcaaccagggcacctattcctccgagcccacgatggcgcaggtgtatctgtccaccgaaccccacctggtgctgccagattggagcgggcatggaactccgctcccgtggagtcaaacgcccgtgggcgacgtgagcatccccaccctgcacgtcgggcactgcttcacagggcaagtgactggcgcggcctacatcccgcccggctcgcacggcgaggccatctatctgggcgccatcatcgatgcgaacgactccatcgaggagctccgcgaggagaacaacgccttcgtgcgcggccgcatcggcgtagggagcaaggcggacctcgtcgtcaccgccatcaacgctccgacaagcgcgcgaatccacagtgccttcaccgccaccgtgacggtttgcaaccagggcaccgactacgcgagttcctcggacctggaactccacttctcgaccctgcccacgttggaaatgccacggtggttcggttcgggctcccccctgcccgtcacccaggcccccatcggcaacatctcagtgccacacctggacgcgggccactgcatttcccaatccatccaggcctctacagagttgccacccgacgcactgtttgcccaacccctgtacctgggcgccatcatcaacggatggggcaacgtcgacgaactgcgcgaggacaacaacaccttcgtgagcggaatcatcggcgtcggtgatggccctgaccttgtcatcacggcggtgcaggcgcctccgaatgtcgggccgttcgcgacgtttcacccgaccgtcacggtttgcaatcaggggacggagccctcgaacagcaccctcgtggagttccacctctccacggaagaggcgctcgtcatgccgcgctggagtggacccggcaatccactgccaccgacgcagcagcccattggcgagctgagtgtccccctcctgaatccagggaggtgcttcacgggaagcgctgtcgcaacactgacgctgccgcccgcgacatcccctgaccagaaactctacctgggtgccctggtcgatgggatgcaatcccaggaggagctgcgtgaagacaacaacatcttcatgagcggacgcatgggcgtgggccatgcgtccgacctggtcatcacgtcactcacgggccccgcgagcgtcgaagccaacaccgcgttcaccgccacggtcaccgtctgcaatcaaggcacgtccgaatcctatcccacggaactggaggtccacctctccaccgacgcaagcatggccatgcccgaatggtacggcccgggaatcccgatacccgccagccaggtgtacgccggcgagttcggagtccccgccttgggtatcgacgattgcatcacgctgcaggtgccctcctggtcgaaccttcctgtcctggcccagcccgaacagcccttgtatctcggcgcggccatcaatccggacctgctcgcgggtgagctgcgcgaggacaacaacaccttcgtcggtgacatcatgggtgttggcgccggtcccgacctgattgtcaccgcggtgcaagcgcccgtcagcgtggaacgcaacggcaacttcactgcctcggtgacagtctgcaatcagggcacccaggcatcgggcagcgtgcagttggacctgtacttctccacccgggcccaggtcgtgatgcctcagtggaatgcaccaggtttcccctacccgcgcacgcaagcactcatcggcgcctggaacgtgcagcccctgaatccgggacaatgcaccacagagcccgtcctcgcgtgggtggaactgcccgaggaggccgagccccatcacccgctgtatctgggcgcgatcattgactcgaaccaggcgcaggccgagctgcgcgaagacaacaacatcttcgtcagcggactcatgggtgtgggcaaccagccagacctggtcgtcacctccgtctccggccccaactccgtgagaacgggaacaaccttcaccgccaccgtgcaggtctgcaaccatggcaccgcgcccaccaacggctccatggatgtggcgctgtacctgtcgagcaacaacacgctcgaattcccctatcaaagctggccgggcgtcccccccgacagtcagagccagattggagtgatgaccgtgcaatctctgcacgccgggcagtgcgtcacgcgcaacacgcaggtgacggtcaacacgcctccggattctggccccactgggttcttctacctgggcgccctcgtcgacccatggcagaacctcgaggaactgcgcgaggacaacaacgtcctcgcggaccggttcatcgcggtgatgccgtagtcgtcgtggtctgagaacgggcccggccgagcgcatcgacgttcggccgggccttgcttcgaagtcgcatgcatcccagaaagaatgccagccacctgcctgcaattcttacacacccgcggtgccgcgttccgtcctcggcgtcagtgcctcctgccgtcacgtgcccatctggctggaagttccggacaagaacaagtcccccgggacatcctcccgccactcccatgacattcccaaacagcaccattcgacatccgggcgcccttgagggcacatgtatcagccctcaagaataacaataaataagagaacaactggcacatcgactgcagccgtcccttgtccccccagcaatgacggacgaggagacccccatgatggataggaaatggctcgggctcctgttcattggcgccgtctgggcatcgaacgcctgggccaacgacttccgagccgagaagctcgtgaacgggctcaagcaatacacggtcgccacctacccggagacgctgcgcttcacgttcaccgtcaccaacatcgacccgacgctcccctccgagttgctctccgcgaccgcgcccctgctgaagtcctgcacgctctcgcccacgtcccccctcgtggttccagcgggaggccacgtcacgtatcagtgcgaaatcgagctggagagctatgacgcgtgtctcacatgggggatacacgatgcgaaccccgtgacgcccaaccacgaggtctccttcaccagcaccttcagcatcggctgggacgcaggcgccagccaggcgggggccaacgtgctctgccttcctcagcccgacctgttctgtgacgacaccgtctacctctccacggcttcgcgctctccggaaggacggcccgcggccccctcacggctctacatcttcgaccccaccaccggcgcgctgacgctacagggtgaagccgcgcttccctacaacgcgctggcgttcaaccacttcgacaacatcctgtacgccatcgcctcggacggtgtcagcgcgcccagcttcatccgcatcgacgccaccggctcttcgagcatcatcgccccgctggacacctcggcacctcgctcggccatctggaccgcgggatccgttctcaaggatggctcctacgtcggcttcgagcacagcacccatcgcctcatccgcatcaaccccagcaccgggggcaccctctccgagcaagtggtgaccatcccgggagacttccagatggcggacttcgcgacgaatcctcgggacggccagctctacgccttcaacaacgccacccagcggctgacccgcatcgacccgctcacgggcgtggccaccgaccatcccgagcccgcgcagattgacggcaggtccgcggagaaccccgtcatgagcgccgccgtcttcacacgcgacggcgagctcttcctctacggaaccagcggccccgacacccacagggtcagcggcttccatgccgtggacgtgacgacgggaaacctgacccgcctcctcacgcggccggtgccccagctcgcgaacggcgcgatgtgtggcgtctactcctggggctcgcctcgtccgcagccgacgacccgggaccgcggattcttcggcgccagcgagagcgccctcttggagtgcctggcatacggccccatctccctcggcgcgctcggcgaagtctccaccctcccaggtgccctgggcatcctctgggccaaccccgccatcgccgcgaacaacacgcgccgcacggccctggagtccttgaaggtccggacggcgcgcgaagcgctgacggcggtctgcaacgagcgcgtcttcaacacgcgcgcgcctgccctgtccgcgctggagaatcccgcgtcgctcgaacccggccgggtggaagagctgcgtcaacggctggagcggcacaatcactctggcaagcggaccgccatcccgctgcgaaaacgaatcttcgcggtggacccgctgcgagccatggagcgcgccgaggaacctcggttctgagagggagcgtggtcatgaagattccatcccaatccaggtgggttccgggcctgctcgtggcgctgggaacaagtgcctgcgatagcagcgaagacgatttgatgcgggcgctgggagaccccgtgctggacgccttcgaaatccgcctgcaaggccaggacgcggctcagtacgagaaggtcctgctgggcatgggacaggtcgaggtcacgtccttcggcgagcccgtccgcttcgagccctcgcccaacgcacgcgccatggatttgtcggacgcggaccacgcccacctcctggggcgcttcttcctgcccaggaacgtgaagcaggtggacatcaccgtgcgcttggacgacgtgggagcgttcaaggaagacagcctggcaggcctcatcaacgcccaagccggaaccatccagttctcgacgacgcgcagcgccctggagcaacgctcacgcgtcgtcatccacctgcacctgaaggacagcctcttcgacggcaggggtggaaagacgctcctgccggcgacttacatcgcccactgaaagtcccgacgccccgagggccctctggcttccacctgcgcacgagcccgggccctgccagaatgcgagccatgaagacccccgggaaacaggtggtactcgtccggcacggagagacggagtggagccgcgccggtcggcacacagggcggacggacattccgctcctggactccggaagggagatgggccgccttctcggcgcgccgctgaaggcctggcgcttcgacaccgtctacaccagcccgctgagccgcgcggcggacacctgcgccctggccggctacggggactacgcccaactgcgtgaggacctcatggagtgggactacggcgactacgaggggcgcaccggcgcggagattcgcgccgagcggcccgactggaccatctggaagaacggcgtccccaacggagagaccgcggcgcaggtcgccactcgcgtggacagcgtcatctccgacgcgctccggacggacggggacgtgctcatcttcgcccacgggcacctgcttcgcgtgctcgcggcgcggtggctgggcctgcccccgtgggaaggccgcctcttcctgctgagcaccgcgtccatcagcgtgctcggccatgacggcgacaggcgccgcccggccatcgtgtcgtggaacgacaccacgcacctgcgcgcgtagctacaaccgcccttccaggaagttgcgcaccagcgcggggccctcgggtgtaagcacgctctccggatggaactgcacgcccaccacgggccgctcgcgatggcgcagcgccatgatgaggccatcctggctccacgcggtggcttccaattcagcgggcagtgacggcgcctccacgatgagcgagtggtagcgcgccgccgcgaagccctcgctgagcccggcgaagagccccgtgccgccatgccggatgtgcgccgccttcccgtgcaccggctctggcgcgcgcaccaccttgccgccgaaggccgcgccaatggactggtgccccaggcacacgcccagcaccggcacgcgtgactgggcaatggccgccacgctgacgcccgcctcgtgcggagtgcagggccccggcgaaatcaccaggtgggacgcgcccgaggccgcgacaccttcggcatccaggtcgtcgttgcgcaccaccttcacctcggcccccagcgtgtacaggagctgcacgaggttgaaggtgaaggaatcgtagttgtcgatgaccagaatcaccggccacctccctcgcgcgccagccgcagcgcggcggccatggcgcccgccttggcttccgtctcgtccgcttccttcgacggcaccgagtccgcgaccactcccgcgcccgaggtccacatcgtccggtctccgtccacgaagaaggtgcgcagcgcaatcgccacgtccagcgtgccgcagaaggacaggtagcccaccgcgcccgaatagggcccgcgccgctggacctccaactcgtcgatgatttgcatcgcgcgaatcttgggcgcgcccgacaccgtgcccgcggggaaggtgctggccagcgcatccagcgcgtcgtacttcgcgtcgagcttgccgcgcacctgcgacacgatgtgcatcacgtggctgtagcgctcgatgagcatcatgtcctcgacgcgcaccgagccaggcgccgccacgcggcccacgtcgttgcgccccaggtccaccagcatgatgtgctcggcgagctccttctcgtccgcgagcagctccttctccagcgccaggtcctcggcctcggacgcaccacggcgccgggtgccggcgatgggccgcaccaccacgtccccgtcgcgcacctgcaccagcaactccggcgacgcgcccaccagcgcgcgggcctcgcccagctccacgaggaaaaggtacggcgatggattcacccgccgcagcgcgcggtagagcgacagcggcggcggcgcgccccgggattcgaagcggcgcgcgagcacgacctggaagatgtctccggcgcggatgtactcctgcgcctgagccaccgccgactcataccccgcgcggtcccagcacgcggtaggcgccgcgtccccacgcatgcgcggctcgggcgcataggcctctggtggcagtggtttcaacaaccgatccgccatggcctgcgcgcgcccctccgcgtccttcagcgcggcggccacgctgccgtgcagcgacggacgggcaatggcggtggccttgagcgtcccggtgcgggtgtcgtgcgtgacgaagtcctcgcacaccagccattccgagtccgggaaggagatgtcgctggggtgccggtccggcaccgagggctccagccacgagaagcagttgtagcccatgtaccccacgagcccgccgaggaagggggcctctccagggagccgggccacggccagctcgcgccagagctggcggagcacatccaggggattgccgtcccggcgctcctcgcgcgagccgcgccacaaggtggcaccgttccggtccaagcgcacgcggcccgcgggctccgcgccgatgtggctgtagcggccgaaccgctcgccgccgtaacacgactcgaggatgaagccgcgcgaaccaccgcccagcttcagataggccgacagcggcgtatcgaggtccgccggcagctccaccgacaccggcaccgcctcaccctgctccgcgcgctgccgataggctgacttccgctcctgtgcatccatcgtctttgactcacttcccaccacgcatcacggcagggggatgggttatcccccgtccgaggggagtcctccaagcggtccgatattctcctccccacgccgcgcaagcccccgggccagcgggtgcccgggaagcagcccggggagttcccgccggtgaggcggcgtcctaccccgggtggtccggctccaagcccctcgctatctgaatgggactttgagtgccgctccttccgccccattgatgacggtgacgcctcaggggctctactgcgttcccggcggcttccacgtcgacccctggcgtccggtggaccgggcgctcatcacccacgcgcatggagaccacgcgcgcagtggcagccaccgctatctgggcgcccgggcgggcaagggactgctccatcggagattgggcgcggacgcaaccatcgacacgctcgactacggcgaacggctgcgcatcaacggagtcaccgtcagcttccatcccgcgggccacgtgctgggcagcgcgcagctgcgtgtggagcacggcggcgagacctgggtcgtgtccggcgactacaagcgcgcgccggaccccacgtgcacgcccttcgaggtcgtcccctgccacaccttcatcaccgaggcgacgttcggcttgcccatcttccgctgggacgcgacggagcaggtggccgaggacatcctgcgttggtgggacaccaaccgcgcgctgggccgcgcggcggtgctgttctgctacgcgctgggcaaggcgcagcggctgctcgcggagttggcgaagctgaccgaccgcaccgtgttcgtccacggcgccttgcactccctggtggacgtataccggaacgcgggcgtccgcatgctgcccacgcaccgggtgtcggaggtggagaagggcacctcgttcgcgggagcgctggtgctggcgccgccgagcgcgagcggcaccacgtggatgcgccgcttcggtgagcacgaaaccggcttcgcgtccggctggatgcgcgttcgaggcaaccgccgccgccggggcttcgaccgcggcttcgtgctgtcggaccacgcggactggcccgacctgctgcgcacggtgaaggacacccgggcggagcgcgtgctggtgacgcacggctacgccgagccgctggcccactacctgcgcgagcagggcgtggacgccgcgcccctggccacgcccttcgaaggcgaagcggaggactgacgcgtgcggcgactggcggacctctacgaaacgctggaccagaccacgtccaccaacgccaaggtggaagcgctcgcgcgctacttcaaggaagcgcccccggaggacgcggcgtgggcgctctacttcctcacggggcagaagctgaagcggctgattcccacgaagctgctggtggggtggacgcaggagctgacccgcatccccagttggctcttcgaggaggtctacgcctccgtgggtgacctggcggaggtgattgccctgctgctggacgcccgtgagcgcccggcgcggaccgaggagctgcccctgtccgtctggctggagcaacgcctgttgccgctgcgtcaactggacgccgccgggcaacgcgagcaggtggtttcctggtggcacgccatgccccggcgtgaattgttcctgctcaacaagatgctcaccggcgaactgcgggtgggcgtgtcctccacgctggtggtccgcgcggtggcgcaggtggcgggcctgcccgcgcccagcgtggcgcaccggctgatggggacgtggacgccctcgcccaccttcttccggcagctcgtgtcccaggacgtgtcggatagcgacagctcccggccctaccccttctatctcgcgtcgccgctggagcagccaccaggggacctgggcgaccgggcggaatggcaggtggagtggaagtgggatggcatccggggccagctcatccaccgcaagggcagcgtgcacctgtggagccgcggcgaggagctcatcaccgagcgcttccccgaaatcgcggacgccgccgccgcgctacccgagggcacggtgctggacggcgaggtgttggcctacgcggacggaaggcccctgcccttcgcccagctccagcggcgcatcggccggcagaaactgacgcccaaggtgctggccgaagcgcccgcggcctacctcgcctacgacatgctggagctgggaggcgaggacctccggagccagccgctgcgcgtgcggcgcgcgaagctggaggcgctgttggaagacgtgcctcggctccccgtctcccccgtcgtgcaagcggcgacctgggaggacctggccaccgcgcggggcgaagcgcgagagcgcaacgtcgagggcttcatgctcaagcgcctggagtcgccgtacctcacagggcgcaagcggggcgactggtggaagtggaagattgacccgttcacggtggacgcggtgttgctgtacgcgcatccgggccacggtcggcgctcgtcgctgtacaccgactacaccttcgcggtgtggaacggcacggagctccagcccgtgacgaaggcgtactccggcctgacggacgcggagattggccggctggaccggtggattcgcgcgcacacgcgggagaagtacggccccgtgcgctcggtggaacctgaacaggtgttcgaactgcacttcgagggcatccagtcctcgccgcgtcacaagtcgggcgtcgcgctgcgcttccctcgaatcgcccgctggcggacggacaagaagccgcaggacgcggacacgctggactcactcaaggagctgctccatgccagcgggtagaccccgctcgctgcgggcgcagattgccgccagtcgcaaggccctgcgcgccaccaccgagcctctgaacgcagaggcaccgtccaagcccaggcgcccccgcatccagcgcgcatcgactcgagttcaaacgaatgaaccaccgctggagcggctgcgcggctggttccgcgcgaaggggtggacgccctatccatttcaagaagaagcctgggccgcccatgcgcgcggcgaaagcgggctcatccacgtccccaccggcgcgggcaagacgtacgcggcctacctgggtccgctcgcggacgtcgcggcgaatggacagccagggcttcaactcctctacgtgacgccgctgcgcgcggtgtcccgggacgtggagaaggcgttgagggagcccctcaccgtgctggacgcggacatcaccgtggagagccgcaccggcgacacgtcctcgtcggtgcgccagcgtcagcgggagcgcctgccgcaggtgctcatcaccacgccggagtcgctgtgcgtcctgctcacgcatgagcgggccccggagctgttcgcgtcactgcgctccgtcatcgtcgatgaatggcacgagcttctcggctccaagcggggttcgcagttggagctggcgcaggcccgcctgcgccacttcgcgccgggcctgcgcacctgggcgctgtccgccacgctggccaatctggaagaggccgcccgtcacgccgtgggcaccggccagacgcccacgattgtgaacgcggcgttggagcggcccgtcgttgtcgagacattgctgcccgagtccgtggatgcgttcccctgggcgggccacctgggcttctccatgctggcccgcgtgggcgcgtggctggacgcggagcgctccacgctcatcttcaccaatacgcgctcccaggccgagcgctggttcgaaggcctgcgcttcgcccgcccggagtgggagcacctcatcgcgctccaccatggctccatcgaccgcgaggagcgcgagcgcgtggagagcggcctcaaggaaggctcgctgcgcatcgtggtgtgcacctcgtcgctggacctgggcgtggacttcggcccggtggagcgcgtggtacaggtgggcagtcccaagggcattggccgcacgatgcagcgcgcgggccgcagcgcccaccgcccgggcgccacgtgtcacatcctcttagtccccacgcacgcgctggagctggtggagatggccgccgccaaggacgcgctcctgcgccgcgaggtggaggcccgcacgccgccggacaagccgctggacgtcctggcgcagcacctggtgacgtgcgcgttgggcggcggcttcacgcccgacgccctgcgagacgaggtgcgcaccgcggcggccttcgccggcctcaccgacgaggagttcgcgtggactttgtccctggtccgcgaaggcagcccgacactgcgcgcctacccggagttccggcgcgtggtggagcacgagggccgctgcgtcgtcgcggacgcgcgcgtggcccgcatgcaccg

SEQ ID NO: 1273 - DNA, 72704 bp, Myxococcus xanthus
  unsure (1)..(72704): unsure at all n locations
gtgctctaaagcagcgtccgcgctgcgccaatggatggaggatgggcgggagaagtacggcatcgcctaccagaagttcatctgcacctccgcggacaacctgggctactacgcgccgtggcggctggcgcccacgctgcgcttcaagccctggcagacgctgtaccggcaactggacggcttcttccacgatgaccgggtgacgtacgccctggcgtacccgtccaagtacctgggcctgcaccccacgacgtgctcgtcggtgttcagcgtgattcccttcctggagctggccttcggcgtctggcacgtggagggcggcttccgtgagctgtcgcgcggcatgatgcgctgcgcgcgggatttgggcgccaccttccgcatgggcacgccggtggagaaggtgcgcgtggacgcgggccgcgcggtgggcgtgaagctcgtgggcggcgaggtgctggacgcggacgcggtggtggtgaacgcggacctggcctacgcggcgcggtcgctgattccggcggaggcgcgggaaggctcgcgactgacggacgcggcgctggagcgcgcgaagtattcgtgcagcacgttcatggcgtactacggcctggacacggtgtacgccgacctgccgcaccatctcatctacctgtcggaatccgcgcggcgcacggaccgtgacgcgctggaggaccggcacgttgacctggaggacccgcccttctacgtgtgcaatccgggcgtgacggacccgtccggcgcgccggcgggccattcgacgttgtacgtgctggtgcccacgccgaacacgggacgtccggtggactgggtgaagacggagcaggcgctgcgcgagcgcatccccgccatgctggagaaggtggggctgaagggcgtgcgcgagcacatccgcgaggagcgctacttcacggcggagacgtggcgggacgacttcaacgtgttccggggcgcggtgttcaacctgtcgcacacgtggctgcagttggggccgctgcggccgaaggtgaagaaccgggacatcgaagggctgtacttcgtgggcggcggcacgcatccgggaagtggcctgctgaccatcatggagagcgcgaacatcgcggcggactacctgacgcgcgaggcgggcaagggaccgctgccgggctggccgtatgtgccgccgctggagccggagtcgcccgttcaagctcgcgcggggtgagcgccgcgccatccagtggcgcgctcacccggcaggcggggaaggggcgcccgcatccgccgggcggggcgggggcgaagctggcatagttgcgaggcatgcccttcttcatcccattcgcggtgggtggcctggtgctgacggcactgggcctgggtgtgaggaaggtgctgacggagacgggcgtcaccacgcctggggatgcccggctggccgaggcgcgtgagcggcaccgcggggcggtggccgcgctccgggcggaccgcctccaggttcgcgatggcgtggccacccatggcgcgctccaggcgcgggtgcacgtggaggtgctggtgcccttcggcgcgctgttggagcggctggagcgctgggggcacgtccaggaagccgagctgctcgaacccgaggcgctggaggcgctgcgcgcgctcctgcgcgaatccccgtcccgcgcgacgcggcgaaactggcccctgctgggcgcgggtgccgaggtgcccgccgcgctggagtccgtgctggcgtggctggaccggggctggctggacgaggattcgccgccggtggtgctggatgggacgccgctgtacgcagtcatctcggcccgcgccatcctggcggggagcgctccggaggagggtgcgcgggcgctcgatgaggcctccgcgctgctggctcggacgacggcgttcctgggggcgctgcgcgtgcggctgacggcgctggagcagcgggtggcggggctgcatggacgggcctcggcgcagctcgcctacctggacgcggccagcttcgaggcgggcggcgaggagccccgggagcggctgacgcggctggcggtgctcgtgggccaactcgccgtgctgctgcgcacgcccgtgctgaactcggaggggcgtctgacgcccatgctcgccgcgcgtgcggaggacgacgcgccttccaacggttgatgcagcggcaccgtggcccgcgctcgagcgcgggcgagccgccgcatcagacgtagcgttcagccaactgcgacacctgtcccgtcgcgtggctcacggccgaggctgcctgctgcgtggtgtccaggtgccgcagcgtgtccgtcgtcagctcatccaattcgcgcaccgcggcgaagagctggtccacgcccgcgtgctgctgcgacacggcctccgtaatctgccgcactgccgccgcggactccttggacagtcccgccagctcgcgcagccgttcgccgctgtgccgcagcggctccagggcctcggccacgcccgccgcgccctggtccgacatcgccgtggcgtgctgggtggccgtggccatgctctccagcaagccgcgcacctggttggtggcccggacggactggtccgccaggtcgcgcatctgccgcgccaccacgccaaagcccttgccgtgctcgcccgcgcgcgtggcttcaatcgccgcgttgatggccagcatgtgggactggtccgccagcgacttcaccacctccgacacgcggcccacctcgcgggcgcgttgctccaggtcgagcatctgctcgtgcagcccggccgcgatgtcgcggatgacggtgagccccttctccgtgccggccagggactcctcacccagcttgcccacggcggcggcgcgctcggccacctggaggatgctggtggcgcgcgagtgcgtgacgtgggacgcctgctggatttcctgcgccgtggcgcgcgcctggtgcagcgccgcggcctgccgcgacagcgtctggttctgctgggaactggcctgtgacagccgctggcccgcgtcggccaggtcccccgcggaggcgcgcagcgagcgcggcatctcctggagccgctggtacagctgccacgtggacgccgccaggtcgcccacttcatccgaggagacccactgtggcggcgtggctcggccttccaccagggcctccagggacgcacccaccgcgcgagccccccgggccagccggcgggcagcccaggccgcggtgaggatggagcccagcgccgcatacccgccgagcaccaccaccggttgcaccagctccgcctccagcggccgcaccgtggcctggacgcgctcggccgccgcggtgtcgccctgcgccgccaggtccgccgccagcgtgcccatgccgcgctccaggcgcaggtgcagcgtgacgatgctggccagacaggtgatgagcagcgcggagaccaccatcgcgggcagcagccagagctggcgcgtggcgaagccctcacccgcgggcttcgtgctgggcgcgcgctgataggcgtccagcaccgtgggcatcatcacccgttcgaacagcatgtacgccagcgggctgctgaagaggcccgcgctcaccgccaccgccacgcccaccatcaccaccgacgcgggccggtccaggagcagcaccgcgccgccgttgaagaggatgccgcccagcgtccacgacaccatcatctccacgaaggcgatgctggaggggatgcgaatgagccgctccacccgcgtcgtcccctgggcgctcagggcgcgcttcatcagccacggcatcaccaccagcggctgcaccaccgcgcacaggccgagcaccaccggggtgatgatgcccaggaaaatcttgaactctcgcgcacccgacaggtcgagcaactgcatgtcgacgtagaccgcgggcgtgaaggccaccgtggtgacgacagaccgcagcaggtagagccggcgtagcagggcgccaggggtcggtagcgaggaggtggccatcggggaagcggtgctcctgggtagcagtgaccccagcgtgcggcccgaaatgctcgccgtcaatgtccagtcccgttccgcctcatccagcgtgtatggaaatgcggtgcttgtcagagagtggttggcatttaattcgtgaattacccgtctctgctcttcactcctggttgccatccaggcgggtggccctggggcgcctgcgcggctcttctggagtgcccacactctgtctccaacgcgctgtctgttgtgaaaggagacccgtcatgggcgagtggaccgacaaggccaagggcaaggtcaaggaagtggccggcgtcgcgagcggcgaccgtgagctggaggccgagggcaagcgtgactccgccaagggcgccatcaagggcaagattgaggacgccaagcgcgccatcaaggacgcggtcgactccgacaagccgcgccggggcgagccctagccgtcctgcccggcgcctgccgggtacatgcatgtgcatgtgaatgattcgggccgtgaggatgccttcctcgcggcccgttttatcgcagcgtgaggaccaggaatccacgctccctccgtatccgttgctggacggtctttgcccgctgtccgggtccagggccaccgctggccctgacgagggggagtcctccatgcatgtgtcgcgaaattcgtcgttgaggggagacgtgtgtccgcccggggcacacgtgtccgccagaagccggcctgcgcgctggctccaggggatggtggccgcgctggcgctctggggctgcccatgctgcaccgcgagagcatctccagcccgaaggactggatggccggcgcgcaggcctccgcgcagctcttcgaggagaaaccagtgctcggtgggcagatggtctcctcgcggcacaacaacctcatcaccgcgggcacgcaactggacaccgcgctgcgcaacctgggcaagccgctgttcgctggcctccacgcgcgctaccaggggggctgggcgtggatgaaggtgctcatcgagcaggcggagtccgactggcggcacagccccgcccgtggcctgcacggcatcgacctgtggggcggcccggaccaggagccggcggcgcactacctgaagctgggtgagaagcccatcgtcccctgcggcggcggccagtggggcgactacaacggcgacggcgcgccggactacctgggcgtcgacccggctcgctggaaccacgacgtgctgcgcccgctgctcatcgcggacaacatgaacgtggaccacgccaccatcgacctgtgtggcgaggggagctggcagctctactcagaggtcttcacgggcctcggtgggctgtacaatcgcacgtaccatctggtgtccacggtgtacgtccgctacacctactgggacaccgcgacgaatgcatggaagtccgagcgggtgttcacgcaccgcttcaccggaggcgaatcgttaggcgtctttgttcgcgagcaggatcgccccacctacaacccgaacaacacgcggaatccccaggagtggatggcgaagcggtggggccacgtctcgcagaacatcgcgtcgttcgactacgccggggccaatgacttccgcgccgccgtccgcacccggatggtggatgtgctgaaggaacagcagcgccagttctacggcagcatcgccacgcgcatgggccaggcgggagacgcgttgcaggtccaggcgaagcggatgacgggcacgcggctgttgtggcagtcctacgcggcgctggcgttgccgctgtcgctggaccacgacgagcacctgcgcggtctgctgtacggcgaggacgcggtgctgtcgggccacgacacgccgcaggacgtggaagtcaccccggtgctgaacgacgtgatggacatgtacgcgctgttcagcgccacggcctcgcccccggcccacaacatcctggcggacctgcacccggcggtgacgtcgcgtgccgacaggctgaaggccgccatcgacgcctccctggatgcccaggcggaggcgggtggccccgaggcgagcgcctgggtggagtcgacgctgctgcggctgcggctcagcgtcccgcagtgacgctcacgcggtgacctagcgtgaggtgtcgcgggccgcgggggaccttcctccgcggcccgtgccgttgctaccgcttcgccaccggcgggcacgcgacctcgaggaacgtcgtcgtcttcccgctcagcatgacccacaggcagcgcagcacgcagcccgtcccgaactcccggtagatgagccccaggttggcgaccacctctcgtccggtgatgatcccgcgcattggcacttcccccttcttcagcgttccgcccgaccccgccacccaccccgcctgtcgctgcccgcccggacccctctgcaaagcatcggccgtgcctcgctcggaccttctgccggacttcggacatgccaagcaggccaagcctcgtgaagggcgcctgctctcctttcttctcggtgggtacggccgctgggttgctggagatttttcagggagccgctccttggcacctctgcacgccgcggagtgttccctgggcggaggtgggcttgttccggaggcctgcccggtcgcggactttgcgacacgccgagcccggtggcgcctggcgcgcgacgcctgaatcttcgaggtgtggatgacgccaggcgccgcgcggccgtccacggagcggcggagcgaccggttgcctccgggaggctgcaaggtgccaccttcaccgctacacgcatactcacaaggtgagtcgggtggaagggaaggagggatggagatgaggccgtcacaactttcgaggacggcagtgccgctgctccctccagggctcgcccgggggcagcggggcgtgtcgcgcctggtgctgggaacggatttctcgctgcgctccgagttcgcgctggcgcgcgcgctgcgccttccgctggcgcacgggagcgtcttctgcgtgctgcacgtggcccccgtcctggacgggcaggaggggccaggtgggacgctgtcgggtgcacgctgcctgcgcaaggcggtgagctccgtgtgcaggcggctgcgcaaccgcgtggacatcgacgtgcgcgaggagctcgggcgaggggacccggtggaggtggcgtcggccgtggcgcggatgtcgggcgcggagttggtggtgctggggcgtccccatgtgacgtacccggtgcgcgcgctggccgaggattcgacggtgcggcgcatggtgcgccatctgggcgtctccgtgctggtggtggtgccgcacccggtccggccctacggcaggcccctggtggcggtggacttctcacgcgagtcgcgcagggcgctggagctgaccttgcgcctgtgcccggcgcccgcgctggtggacgtgctgcacgtggtggacacggcggcgcaggaggcggagctgcgccgcgcccatgcgccggccgagcggtggctgctgctgcggcaggagcgggagtatcaggcgcgggtggcgcttggtcgcttcctcgcgccctaccgggaggcgggccgcgagttggaggtgagggtgcgctgcggcgagccggccgaagagggcatcctggcggaggcgttggagcggggctcggatctgctggcgctggccatgtccgccgtggaggcgcgcacgccgctgacagagcaggtgctggcgcgcgcgggctgcgacgtgttggtgtcgcgtcacctttcgcctgcatcctgaagcaggagggcgcgctccgcgttatgaacgcggaccgtgtctcctcgtcctacaacagcctctgtcgcctcggtgtcgctcaaggtccgcttccagaacgcgggcagtctcttcaagcagttgccggggaccttccggctcttctggcaggccagccctcgcggcgcggtggtgctgggcgcgctgacgctggtggcggcgctgttgccggcggccatcgcctgggtgggcaagctcatcgtggactcggtggtggcggcggcgcagggctcggtggaggcccgctcgcgggtgtacgggctggtggggttggagttcgggttgatgctgggctcggcggtggtggaccgcgggctgacgctgacgcgcgagctgcttcgcgccaacctggggaacctgctcaatgagcgcatcctccagaaggcgctggcgctggagctgcggcacttcgaggactcggccacctacgacaagatgcagaacgcgcggcgcgaggcgaacagccggccgctgtcgctggtgacgcaggcgttctccatcgtccgcaacaccatcaccctgggcaccttcgccgcgttgttggtggcgttgtcgccgtggagcgtggtggtgctggtggccgcgtcggtgccggccttcatcgccgaggcgcggctggccatggcgggcttccggctctactcgtggcgcgcgcccgagggccgcaagctgaactacctggagtggattctcacgcgggacagccacgtgaaggaggtgaagctcttcgggttggggccgctggtgctgggccgctaccgcacgctcttccagaagttcttcgcggaggaccgggcgctggccttccggcggatggcctggggcctggggctgggcgtcctctcattgggcgccttctatggctgctacctgctggtggcgggccgcgcggcgagcgggacgattaccgtgggcgacatggtgctgtacctgagcgtgttccgtcaggggcaggcggcgttccagggcatcctgaccagcgtgggctccatgtacgaggacgcgctcttcatgagcaacctgttcgcgtacctggacatccccaccggcggcgaggcgacgcgggtgctgccgccgctctctccgccgcgtgggcacgacagcgccatcgagctgcgtgacgtgtccttccgttatccggggaaggatgcgtgggcgctgaagaacgtgtcgctgtcgctgaagccgggacagaagctggcgctggtgggagagaacggggcggggaagagcacgttggtgaagctgctcctgcgcctgtacgagccggtggacggcgacatcttctacggcggcgtcaatctgaaggacatggacgtggaggacctgcgcaaccgcttcggcgcggtgttccaggacttcgtgcgctaccagttcaacgtggcggagaacatcggcctggggcacgtgccggcgctggaggaccgcggccgcattgagaaggcggccgaggagggcggggccagcggtgtgattacggcgctgccacagcagtacgacacgatgctgggcggctggttcgagaaggggcaggagctgtcggcgggccagtggcagaagctggcggtggcgcgggccttcatgcgcgacgacgcggaggtgctgattctggacgagcccacggccagcatcgacgcggaggcggagcacgcgctgttcgagcgcttccaggcgctggcggcggaccggattgcgattgtgatttcgcaccgtttctccacggtgcgcatggcggaccagattgcagtgctccacaacgggcaggtggacgagctgggcagccacgacgagctgatggcgaaggacggccgctacgcgcacctgttccggctgcaggcgcgcggatatcaggactgagcgtcaggcgcgctcgccacgcaggcgcgcgatttccgcccgagcctcggcgagctggcgctcggcgtcctcgcgccgctgggtttccagttccaggagtcgggactcctcggctcgcaggcgagactcctcggctcgcaggcgggactcctccgcgagttgctgtacgagttccgcgcggctggcctcgacgcgctcgaccatgtgttcgaggcgggcaatcagctcgggtgcctccggcagggccgcacctcccaggtagaagcgcagacgctcgtcatctacctggaggtccaatcccaggacttcggatggatagaggccgtgctgcggaaggatggggcgatagacgcggcgcccttcgtccagccgccagccgctcagtcgtagccggccccggtcgaagacgaagtactcgcggatacccagccgggcgaagcgctcgacgttgcgctccaagtccttgcgccgctcacccgcgacgtgcacttccagcgcgaagtccaggcccttgccctcggcactgaccacccagcgcatccgcgcgtggggctcgacgtccaccacggccatgacgtctggggcgaacatggattcgcctgggtagtacacgggcagctcgctccccaggtacaccttgcgaccaatgcgggagaagaagctgccgagcacctcgcgggcacgcgtcttggcctcgaagtggaaatcgccctccggcgggtttgcctccgaaacggggaattcggatggaaggctgtcgacgatacgttgacgctcctcggacgagagcgcgtcccacgtctcctggggcggcgcgcgcgggtcgttcggatcgatgtcgtagggctcgaaaggcatgaggtcgtgcatgagagtaggccgcgccgccacgagggccaagtggcaggcaaggcagcgttgtcctcgaatcaggtggtgacggttcgcgtgctgacgaggacggtgagcaagcagcggtcatgccactgcttggcgtgtgagaattctcggattgagagggtcttcgcgacccgcgagtttcgcgtgcgcgcatgtcactgactcatggcaggttctcccgccatgtcgcgtgctcgagctccgaagaaggtcgatgtcgctgcgttgatgaagaaggcggacagtctgctggacgagatgccgccgcagctggaccaggcgattccgttgctgcgcgaagtcgtggcggcggagcccgagcacctgctgggactccactccctgagctggtgtttggacccgacgcggagcatggagccgcaccgttgggagcaggagttgaaggccgagcactggcggttgcgcgaccgcatcctcgagctgacgcgagggacgaagcccggcggcgcgctgacgctcgcccatcgtgcacgttcgttggccctgagccagtgggcggaagacttggtgcggcgcaagccgaccgtggcgcagctcgacgaagtggaggccgcgctgaacgaagccaacagccttcgggaactcgtgaaccaccagcgtggacgccgcgggctcgaggcctggcacgcattgacgcaaggcaaaccggagcagggctaccgcgagttgctcgccaaggtggaggagtctcctggcatgtgcgcccagggcgtgatggacgatgacgactcgctcaacttccagggcctggagggcgcctactccgatgagggcttcctggcctggctgcggaagcagaagcccgcggcacgccccgcggggaagaagggcaaggacctggatgccggactcctgctggcggcggggctggatgcgaagccgttcttcggccctggcttcgaagggaacagtcgcatgggccgggtgctggccctggtggcgttgggcgcggacctgaaggcgagggattccagcaagcacagcgtgctccacctcgccgcgatggtggatgacgcggcgctggtgaaggagttgctccgcctgggcgtcgccgccgacgtcgtcgattcgaataagtccacgccactgcatgtcgcggccgagcacggcagcgtgtcctgcatcgccgcgctggcgaaaggcggcgtgcctgtggatgcgctcgatacctcagggcggacggcgctcttcgaggcgcgtcaggccgacgtggcccaggcgctcatcgacgcgggcgcgaatcccaatgcgggcaagggctggacgccgctgcaccagcacgcacggttcaaggagcgaggccccgtcatcgaggtcctgctcaaggcgggggcggatgtctcgctgaagaatggcagcggccagacgcccgcgcaggaggcgctggagcacaagaacgcgtccctcgcccagctcatgggggccaaggcttcctcgggcaaggccggcgcgttggacgtgcagccgctgctggatgcactggcgcgtcagcgcaagacgctgctcaaggcctggtacttcgaggacaagaacgtggacggcgtcgaacaggtcctgaaggggctcgcgctgcaaggtgccacgtcctgggaccagctcgcggcctcgcttcagggcgagctcccctggacggccatggcggtggtgcagctcgcgcgggacgtgctgccggccgaggagaaggcgcctcgcctgtccaagctgccgcgcttcgtgcgcggggacctcgtggtgaagggcgacgtgcacgtcgatgggccgctgctcgtgacgggagacctcacggtggaaggcgtgctgcgcaacgcggggatggaagggatgctggtggtgggcggcacgctgcgcgccaccggtgtggacacggacggcgaggttgtcgtgggcgaggacctggaagcgcaggtggtgtggggccacggcaacgacgcttcgctccgggtcggccgcgtgctgaaagcggacgtggtcatcgcggacgaccacgacatccaggccaaggtgaaggcgaagcaccactacgagaacggcgagttcgacgcctcggacgcggtgctcaagaaggtcttcgtcgcgaaggccttcgcaaagtcggagttggaccgggacaagctgttcaacgtgctgcgcaaggtcggagccgtcctggtgtagatgcggccctggtgccctttgacggcgtcacggcgcgcgcccgtctcgaatccctgatcggcgtcaggcctggggcaggtggtcccgcaccacgccgagccagtactccttgccgtagtactggctcatcttcccgatgagcttgccctcacggaacagcaggaacgtggggatgccgaagagtccgaagcgcttggccaggtcctcgtactggtacgcgttcaccttgacgacgcgcatcggagcgtcacccaactccgccagcagcgcgggctcggccgccgcgtagatttcgcagttcgggcagccgtcaccccagaagtccacgaccaccagctcgcccttgggctccaggaccagttggtcgaagttctccgccgtcccctcgtagctcacgggatgtgccatggcctcctgcctaacgggctcgggtgtcgtgttcaacttgctcacggggctcgcggctcgaagtcctcgctgcctgctgcgtcccaggagccgccaggccggtgcccccggtccggtctggcggaggccaggcacggccggaaattcccctcgtgcggccgggcggctcaccccattgggcgctctggccgagccccggggggctaggcgagtgggctgttgccgcgttgggacgcttcacccggcggaggatggatcagcggaacaccagggccgctccggaacgcgggcggctggagcgggcgccagggacatcaccttcgtacgtgagtcccgttttccggaggaggggatgggttggacagtgggtaagggttttcaaggtatgcctgcgcgcggtggtggccgccatgtcagccggagcgagttggatcagctctggcgcggtgtcatcaaaagccaaagctcgcactgcgcaggagcgctcagccgccgtaaggttgtgcgactggatgtcgtggaggggtcatgcacgagtggttggaggcacttcgcaagtcggtaaagtcatcgtcagctggcgtctctcccgaggagattcgccgggccgaaacggagtgcggcgttccattccccgacgagctcaccgacctgtatcaggcgttcaacgggggcgaactcagcggtgaggttctcctcttccgtctgcacggcgcggagggagacccgagcgtcctggagaagacccgcctcaagctggaagggcttcccgctgcggggctgtggcgcatcggcttgaaggggcagcaccggcacctcttcgcctcgcgcaagtcggccatggtggagcagggcgacggtggcggtccgttgccggcctgggtcgaggcgctggatagcgacgactgggtctatggcacctgggagggcgagaagcggcagatgcggctgtaccgctcgttgaaggacatgctcgacgtgctcgtgccccccgcggaggtggagagcttcggtgagcgcacctttgcccgggcgatgaatgccgtccttcagggggcgctatccggcgtccaggccgacgaggaggacgaagaagcggcggagtccggcgaggcaccgctcggtgcggcggccgaggctgaagcagtcgaagaggccgagcagctcgaggaggcggagctggccgatgaggaggccgccgaagtggcggtagaggaggcggaagtacgtgagctcgcgtacgagtacgacgatggccgcccgtcttcccgttacgaggatggggccggctcgagaaaggcacgcgcgcaggcccagcagataccgctcgccatcggtggcgctggcgtgctgttcccgaaaagtgcgtcgagcagggtgcagggtgtgaagaaggccgccgcggagcccgctcccacgaaggcgcgccccacgaaggcgcgccccgcgaagaaggccgcgattgaagcggcttcggcggagctcccgactggagcggctgaagccatttcggagccggaggctgcgcccaagacggccaccgcgaaggcccccgcccagacgggtgtggcgaagacgtcctccgccaccacgaagagggcgacgaaggcccctaaccagaagcgcactgagaagaagcctgccaccgcgaagagggcgacgaaggcccctgcccagaagggtgcggcgacgaaggccgctaccgcaaaggcccccgcgcggaaggcagcggcgaagaagtccgtcaccgcgaaggctccggctcggaagggcgcggcgaagaaggcccttgctcagaagggtggtgcaaagcgggccggtgtcccgacgagcgcagcgaagaaggcgactgctcagaagagcgcagcgaagaaggcgactgctcagaagagcgcggccaagaagtcttctgtgaagaaggccgctgctcagaagtccggagcgaagaagagcgccgcgaagaagggctcagcccagaagccagcggcgaagaagggcgcacgcggccggtagtcacgggctcggaggcaaggcgcgctcccgcgccttgccccgacgtcgcctcaccgtccgtctacccctgcggcagcttgtcgaagtcgatggggcggatgcggtagcccggctgtgccgtcaactccagcggctcttcctcctcatcaccccggcggaactcatgaatctcgtccgggaggatgtcgcggaagtccggctcctcctccagcggtggggttgccgccaggtcttggtcggagatgttgatttcatcctcaccggtgtccgggttcatgtgacgccgagaggtggactcgcccacgtcttctgcccccagcttcttgaatcgcatggcctctcctcggaaagcgcggtgggtcggctgccttcgtctcaagaatgagaacccgcgggggctccggcaattctcgccgcccgcctgcctgccatgcctgcccgtgtctcagcgctccgggagcacggtgcggccagaggggtaggcgggctccacctccagcatcaccatggccagggccagcacgcgcgacagcgtctcgcgcacctggtagcgccacggcgtcgaccgtccttcgtccgcggccacgccccacgcgtcgatgcccaccgagttggcgatgaacagcgcccgcgtcaggtggaagcgctgggtgacgagcaccgcccgcttcgcgccgaacaccgtggcggcccgcaggcagctgtcataggtggacagccccgcttcgtcgcccaggatcgcgctttcgggcacaccgtgctccaccaggtagcgccgcatggcgcgcgtctcgtggtggaagggcttcgtctggtctccactgacgagcaccgtctgcaccttgccttgctgccacagcgcgatggccgcatccagtcgctgggcgagcacgggggagggcaccgccccccgcgccagacccgcgccgaacaccagcgccacgggcgcctggggcgcctgctccagggggacgatgcggtcctggtagctgaggcggacgaggtgggagagggcgagcagccccagcccacccgcggccaggaccgcgaggcctctacgcaaccacacccatctcgcaccgcctagcttcatggaccccgagaacaccggtagagaggccattgtgttccgggctcccttctccggaaagcccagagcgacatccctgtctcaggggaacgtgcccgcctgggagcccgccggctttggggcgaatcgctcgatggcctccagcagccgccggggctccacgggtttcttcaggaatgccgccacgttgtacgaagacgcatagacggcccagtctctcggattcatctccgccatccccgcggacaggatgatgacgggcacctgggccagcgcttcactcgccttgcgggtggtcagcacccggtgtccgtccatgacaggcagggccatgtccagcaccatgagggcggggcggggaggttgggccaactgctccagggcctcccggccgttgcgcgccacgcgcaccgcgtggccgtgcagctccaggtaggcctgaagggcctcacagatgtccacgtcgtcttcgacgatgagcagcggaccggatgacgtctgagccaccattcccgcaaggtaagtccgtgtcctaccgcggggaggggctgtcaagggggctcggccgcctgccatgtgcggtggggcgggcgatcgtctgcccggcggcggcaggcatccgttgaccggctcccgccccgcctatatagggggccccgtcttaccctgccccgccttccttcaggacaaagcgggtcgaacgccccacaggagctccccggtccatggcgtcccttcgcgacattcgcaagcgcatccgctcggtgaagaacacgcgtcagatcaccaaggcgatgaagatggtttccgccgcgaagctccgcaaggcgcaggacggcatcctggcggcgcgtccctacgcgacgatgctggatcaaatcatcgcggacctgtccgcccgcgccggggatgagagcctcagccacccgctgctcacggcccgtccggtgaagcgcgtggagctggtgctcctcacgtcggaccgtggcctcgccggcggcttcaactccaacgtcatccgccgcgccaaccggttcctctacgagaacacgaacctggagagcatccgcctctccaccgtgggccggaagggcaacgacttcttccgcaatcgcggccagaacatccgcaaggacttcggcggcctgtaccagcgcctgaactaccgcgccgccgcggacgtggccgaggagctggtggccagctacctcaatggcgaggtggacgcggtccacatcgtctacaacgagttcgtcaccgccatctcccagacggtgaaggtcgctcagttgctgccgctgcagacgctggggacgccggaccaggcctcgacggcgggctccacctcgctggtggacttcaagtacgagccggaccgtcagtccgtgctggaccgcctggtgccccaggccgtcaacatcaagctctaccgcgccctgctggagagcgtggccagtgagcacggcgcccgcatgagcgccatggagaacgccacctccaacgcgaccgacatgatcggcaacctgacgctcacctacaaccgcacgcgtcaggcggtcatcaccaaggagctgatggagatcgtctccggcgccgaggccctgaagtagggcattcgcgcagccgcgaccctgtctcctgggcccgcctcgtctatcgaggtgggcccttcgcgtttaaggccccggccgagcgcggaagtccgctcgaggagggggtacatgaggcagcggctgtggttgttcctggggctggtgtgctgcgtcacggggtgtggcttcgaaaccgtctccagcgggtatggaggcatcggcttcgactcgttcggcagcggcacgcagcgagagccgtatggagaaggcttccacctcctgcggccgggcaagtcgctcatcgtctacgacttgcgcgtgcaggagatgaaggacgggctgagcgtcctgtccaacaacggcctggacctcaaggtggacgccagcgtgcgctaccgggtggaccccgcgaagctcttcgagctgcacacccagacggggcccaggtacgccgacatcctgatcgcccccgtggtccgctcggaggcccgcaaggtgttcggccgctacgcgccggaggagatctactcctcgaagcgcgagcagattgaacaggagattttcgaggaggtgacgcgctcgctcgaaggcaagcacgtggtggtggaggccatcctggtgcgggacgtgacgctgccttcggccatccgcgacgccatctccgacaagctggcggaggagcagcgcagccagaagatgcgcttcaccctggacaaggagcgccaggaggcggagcgcaagcaaatcgaagcggaaggcatcgcccggtaccaggacatcgtgcgcaaggggctcaccgaggagtacctgcgcttcaagggcatcgaggccacggagcggctcgcccaaagccagaacgccaaggtcgtcctggtcggtagcccgaacagcgggctgcccctggtctaccaaccggatgggaagtaagagggtggcgcccggcatgtggttccgctaagccggacttaccagtcagttgcccgggaggcttgacccccggggggggccccggtaaagggggcccgccctcacagccgggccgaaatttcaagggtggcggcgcccgtccgctccccgtgcgaggcagacgattccatgagcgctcaagttccgacggcaggcagaatcatccaggtcctcggccccgtggtcgacgtcgagttcccgcccggcggtctccccgaggtctacacggccctcaaggtcaccaacgcgaacctgagcgccgccgctgacaacctcaccctcgaggtggcgcagcacctgggcgagaacaccgtccgcaccatcgccatggactccacggagggcctgggccgcggcatggccgtcacgaacacgggcgcccccatccaggtgccggtgggcaaggccaccctgggccgcatcctgaacgtcaccggtgagccggtggacgagatgggccccgtgaaggcgcaggagtactggtccatccaccgcgcgccgccgcccttcacggagcaggacgtgcgcgtgcagatgttcgagacgggcatcaaggtcatcgacctgctcgccccgtacacccgcggtggcaagattggcctcttcggcggcgccggcgtgggcaagacggtgctcctgcaggagctcatccgcaacgtggccgtggagcgcggtggcttctcggtgttcgccggcgttggtgagcgcacccgcgagggcaacgacctctaccacgagatgcaggacacgaaggtcatccagacggacaacctggaggccagccaggccgtgctggtgtacggccagatgaacgagccgcccggcgcccgcgcccgcgtggccctgtccgcgctgaccatggccgagtacttccgcgacgtggaaggccgcgacgtgctcctcttcgtggacaacatcttccgcttcacccaggccggctccgaagtgtccgccctcctgggccgcatccccagcgccgtgggttaccagcccacgctggccacggagatgggcggtctgcaggagcgcatcacctccaccacgaagggttccatcacctccgtgcaggccatctacgtccccgccgacgacctcacggacccggcgcccgcgacggccttcgcccacctcgacgcgacgacggtgctcaaccgctccatcgccgagctcgccatcttccccgccgtggacccgctggactccaccagccgcatcctggacccggccgtcatcggcgcggagcactacggcgtggcccgcaaggtccagggcatcctccagcggtacaaggagctgcaggacatcatcgccatcctcggcatggacgagctctccgaggatgacaagctggtggtggcccgcgcccgcaagattcagcgcttcctgtcgcagcccttcttcgtggccaaggtcttcacgggcaaggacggccgctacgtgaagctccaggacaccatccagggcttcaaggagatcgccgagggcaagcacgacgacatccccgagggcgccttctacatgacgggcagcatcgacgaggtggtcgagaacgcgcggaagctcgcggcgagctaagctgggcgcttctcctcccgcagaggtccccatgcgccgtgcagcgctcgccctggtcctgatgttcctggctccctcctccgccctggcggaggagcgcaggggacgcgcccgggtgagcgccaacgggctctacagcgtccgcatggtggaagcggcgcaggaccagtgccggttggaggtgacgcaggagagcggccccgtctggacgctgaaggagtgtctgggcacggtggacgacctctacttcgtctccaacgacggcgagcgcgtctgggtggtgtggccgctggtggagaagggcaaggccgtggcggagccgcggacgaagaagtcgaaggcgaagaagcccaaggggcctcccgcctgggcgcgcgtggtggtggcggcgcagtatgggcgggatggccagcggctccaggagaagcggctgaccgagtggctcaacacgcggcagctctccgaggtgcgccagctcacccaccacttcaagtggctggagggcacgctcggaatccccggcaaggggccccggttgacggacgccggggtggtggagttggagccggtgggtggaaccacccgccagctcacgttctgattcggttgtgcgaggagcctgatggccaatctgactggggagattgtcacccccgagaagcgcatcctgtcggtgcaggccgacgaggcgattgttcctggcggccggggcctgttcggcgtgcggccggggcacaccccgttcctgtcgctgatggagccgggcgcgctgacgctgatcgagagtggccggcgcgagtcctacttcgtcgcgggcggcttcgtggaagtgggcaacgacaaggtgctggtgctcgccgacgcggccgagcccgtcacgggcatcgacgtggaaggcgcccgtcgccgcatggccgaggcccaggagcgcatgaagggcatgtcctccgaggacgcgcgcttcgagctggagcaggccacggtgcgccgtgaggccgcccgtatcggcgccgccaacaccgcgcgcgcgtaggtttctcctccgtttcaccgcccaggagcgtcccgcgctcctggcgtccctggcgtgacgcccgggctcccctcgagcggagccggtgtccgcttctgtttccgtgacggtgcccctctggggtggcgcctccggaacaggctttccggtccgcacctcgcttcacaatgcccccaggggcctggctgcgttcgccctcgagccttcgcgcgggcgcggcggcctcctgtcagcgactgtcctcgctcgcagtagctccactgacagtgctgctttcatttgacgtgacggtgcggattttaaggtgcatctagaatgcatcttaaagcccatgccgggcgagaggagcggcaccatgagcgttacggcggagaagagtgtctacgagcagctgggcggagagccggcgatggcggcggcggtggaggtcttctaccggaaggtgctggcggacgatcacatcagccacttcttcgaggacgtggacatggagcgccaggccgcgaagcagaaggcgttcctgacgatggtgacgggtgggccggtccactactcgggcaaggacatgcgcgcgggccacgcgcctctggtgaagcgtgggctgaacgactcgcacttcgacgcggtggcgggccacctgaaggcgacgctggaggagctgggcgtggccgcgccgctggtggcgagggtgatgaccatcgcggagagcgcccgcgcggacgtcctgggacgctgaccagaggagcacgccatggccaaggtaaagcatgagtccgactggtacccgttggagtccggagagagtgtgctggacgcgctgctgcgccagggcgtctccattccgaatgcgtgccgcgcgggggcctgccagtcctgcctgatgcgggccgtggcagggacggttccagaggccgcgcaggtggggctgaaggacacgctccgggcacagggctacttcctcgcctgtgcctgccggcctccggagggcacgcagctggaagtcactggcgcggaggcgctgcgcatccccgcgcgcatccaggcgctgtcgttgctgtccaccagcgtccttcgtgtgcggctggtgacggacagcccgctggcgtaccacgcggggcagtacatctccctggtgcgcgaggatgggctggcccgcagttattcgctggccagcctgcctcatgaagacgccttggagttgcatgtgcggctccagccgggcggggcgatgagtggctggctggcgcatgatgcacagccgggagacaggctccaggtgcaggggccggcggggagttgcttctatgtgcctggccggcccgagcagcccttgttgctggcgggcacgggcacgggcctggcgccgctgtacggcatcgttcgcgacgcgctggcggcgggccacacggggcccatctggctcttccacggcgctcggacgcccgaggggctctacctcacctccgagctgcgggcgctggcggagcaacatcctcagtttctctatcgtccgggtgtgttggagggcggcagccgggacgtggccgagggagcgctcgatgtgctcatccgcgccgaatgcccgaagccgctgggctggcgcgcatggctctgcggagacgggccattggtgctatcccttcgaaagaagctgttcctggccgggctctcgctgaaagacctccacacggatgccttcttgccgagcgttccatcggggcagcgtacttccgacgccggagcccgctgacgtgcacctcaccctccatgccgactactcgctgcgggtgctgctctacctggccacgcgcaccgggcggcccgtctccacgcaggagatggcggatgcgtacggcatctccaagcaccacctggtgcgcgtggtgcagacgctggcggggcagggggtggtggacgcgcgagcgggccgctccggcggcgtggtgctggcgcgcgcgccagcggacatccaggtggggagcgtgctgcgcgccgcggagccggacttccacctggtggaatgcttcgaccgggagcgaaacgcctgtcccatcgctcccgcttgtgggctcaagggcgtcctggacgaagcgcgcgaggcgtttctcgcggtgctggaccggtacacgctggcggacctgctccgccgctcgcgcccgaacctgcaggactacttcctccccacctccgaaccatgatgtccggcacgctggagctgtttcatcgcatcgcggatgcaccgtccgcgcaggcccggcgctacatcgtggactacgcgctggaggaccgcgtgcgctttcgcaacgtggccttcgacgaagcggaagcggactggcgcaagcatggcggacataccacgcccgcgctctgggatggcacgcacctgcatcagggcgcgcaggcggtgatggcgcgcttgcaggccgtcgtcaacctggggcgcgacgacgcatgaagtagcgggcgcgcgtgtgctgacacccgcgcgctggtgccacctgcgcgtccctcgtgcgccattcccgccgtgcgcgaagcttcgagagttggacacgtgtacaggtgcgcggatgcgtgcaccctccgatgcttgccgcgcgcgtgttggttgcggtagtcagcccaccccgcgctgcgatccacgaggcgccagggatggagggtggacggtgaagaatccgagcggcggaatttcgaggacggctgtatcgcgctcgtcaagccccggcatgattcttcccgctccggctcgcggatgtttcacgggtttctctcggccgttctggcctgagcgtcggttaatctccacgaccccatgtcgctgactcccgccgagcgccaggacaggttccatgcggcgttcgtggggctcgcaatcggtgatgcgctcggctttccgctgcgcggcattccaccggcgagcctcacgcggctgcccggccttgccgaagacttcgcgccccgcccgcgcggaaagttcgccaagggccagttcagcgacgacacgcagttgctgctcgcggcggcggagagcgtcatccgcgaaggcaaggtggacggccgcagcgcggcggcgcacctggcgtggctgtggcaggagggcatcatcctccagccgcccaagagcctggcggacgcgctgcagcggctagccagtggcgtgccgtggatgagcgcgggcgcgtccctgggcacgcgctgccattcggtgctcagccgcgcgctggtggtgggcctgctggagagcggccaccgcgcgcgcctgccgcatgacgcgggcgtgctcaccatcatcacgcacaaggacccggtgtgcgccggcggcggccgccgccttcgcgcaggccgcggcgctgggcatggaggcggagccgctgacacccgcggccttctgcgaggagctggcgctgtcggcggccgtgcacgacaaggggctggccgaggaagtgcgccacctgccgcgcctgctcacctgggacaccgcgcgcgcgctgacgcagttgcgcaaggtgggcgtgccccccagcgagctgaagggcgtggacgggctgccgccgcacgtggtgccggtgctgctgacgtcgctgttcgccatcctcaaggtgccgcacgacttccgggaggcggtggccctcacgctgcgctgcggcggcgaggcggacgtggccgcggcgctgacgggcgctctgctgggcgctcacctggggacgcgcgccatccccgcgcggctgcgcaagcaggtgttgtactccgaaaacctggtggatacggcggaccgcctcttccgcgcccatcaggtccgcgagacgctggccaccgccctgtcgcaccgccgtcgccgctgagcgcgagggcagggcaggcgggcggccgccggcgtgcatttctccggggcttcactggagggagcgtcctgcccaccttgtgcgaaggagcgggccgcaaggatgccaggcaggcatgggagcgcacgtgtggtccgcggagtcatcgcaggaggcgcacgtcgtggatctcgaatcggaacgcctggagcgaagtcaattggagacgctctccacggcggagctcatccggcatgccttggcggagacgcgcctgctggtgcgcgccgaggtgatgcacgccaagaaggagctgcgtgaggagctgaaggccgcgcggaccgcgggaatcctcctgggggcgggcgcggtgctggcgctcacggcgctggccgtcctcttcgtcgcgctggggttggccctgcccatggcccaggcgctgggcgtgctggtggtgggcgtggtgctgctggcgattgccggtgtcttgctcttcgtgggacgcaagcgcgtgcccaagaagccgctgccgcacacacaggaacgcttgaagatggactaccagctcacgcgggagacgctgcaatgaatggcaacgaccgcgacgcaggcgagccctcggcaatcgagcggcagcatgaggaccaccgcatcgcccggggcatgggggaccgcaagcaggtggaggagaccgccgaccgcatccgcgacgagctgatgctcacgctggcggagttggatagacgacgcgagcgcgcgctcgacgtgcgctaccacgcgcggcagcaccgcgccgagctgatggccgcgggcgccgcgctgttgacggcggtgggtctgggcgtggggtacgcggtgtaccgcgcgcgcaaccgcgacgagattctgcgccgcaagcgccgcaaggccctggcccgtgcatgggagcacccggaccgcgtggcctccagcgcggagcgccgcccgctgggcgcggagctggggagaaagctcgtcctcatcttcgccagtacgctcgccaccgcggttgcacgaaacgcggtgatgacgctggttcctgcgcgccgcgcccccgcttctgctcagatagtttataagaatcaataattgcgacaaaataagacataaaccattctgatgcccatgacggacctgctctatgcgcgggcccaaatgggcttgtcgctcgcgttccacatcgtcttcgccgcggcgggagtggcgcttcccgttctcatggtgctcagtgactggaagggccggcgcaccggtgatgcggactatcagaagctgagtcagaagctggcgaaggggacggccatcctcttcgcggtgggcgcggtgagtggcacggtgttgtccttcgaactgggcctgctgtggccagagttcatggggcagtacggcgaggtgattgggctgcccttcagcctggagggcgtcgccttcttcaccgaggccatcttcctgggcatctatctgtatgggcgggagcgggtgtcgccggggatgcacatgtcctccggcgtcatggtggcggtgagtggcgcggccagcgccttcttcgtcacgctggtcaacacgttcatgaaccacccgtcgggcttcacgccgtcggcgtcagggcccatggacgtgcagccgctggtggccatgttcagccccggctggcagtaccagacagcgcacgtgctgctctcctgttaccaggcgagcgccttcgccatggcgggcatccacgccttcgtgttgctgcgccacccgggcgtggccttccatcgaaaggccctttcggtggcgctgccgctggcgtgtgtcaccgcgctgctccagcccgtggtgggggacttgtccgccaagcacgtggcgaaggcgcagccggtgaaactggccgccatggagggtcagttcgaaacggagcgcggcgcgccgctgcgcctgggcggactccccaacgtggagacgggcgaggtgccctacgcggtggacatccccaagggcctgtcgattctcgccttcgcggacccggacgcggaggtgaagggcctgaatgccttcccgcgcgacgagtggccgccggtggcgaaggtccacgtggccttccaaatcatggtgggcaccgggagcgccatggcgctgttggcgttggtgacgctgggctggcggtggcggaagaaggcctggccccacgggcggaagatgatgtgggcgtggctgttgtcggggccgctgggggtggtggccatggaggcgggctggctcgtcacggagtggggacggcagccgtggattcttcgcggcgtcatgcgcacggcggacgcggtgacgccggtgccacacctggccgcgcccttctggaccttcaccgtcgtgtacctgttcctgggggtgacggtggtgctcctgctggtgcggcaggtggcgggaacgctgcccacgcgcgacagcggtccgctgggaggtgaggccaatgccaactgacgcgattctgggcttcgcggtggcggggaccttcgtcctctacgccctcttcggcggggcggacttcgggggcggcgtctgggatttgctcgcctccggaccgcgcaaggcggagcagcgcgcgctcatcgcccgcgccattggcccggtgtgggaggtgaatcacatctggctcatcgtgggcctggtgctgctgttcgccggcttcccgcgcgccttcgcggtgctgagcgtggcgctgcacgtgccgctgacgttgctgctgctgggcatcgtgttccggggcgcggctttcaccttccgggcctacgacacgcgcggggacgcggtgcagcggcagtgggggcttgtcttcagtggcgccagcgtcatcgcgccggtgctactgggcatgtgcgtgggggccgtggtgagcggcaccatccgcgtggaagggcgggtggtggtgagcggcttcttcgcgtcgtggctcgcgcccttctcatgggcggtgggcgcgctggcgctgagcctcttcgccttcctggcggcggcatacctcactcacgaggcgcacgagcccacgctgcgcgaggacttccgccgccgggcaatgggcgcgggcgtggccgtgtttgtcgcggcgctggcggtgctgttgctggcacgcgagggggcgccgcgcgtctgggagggactcttgcgctcgcccttcgccctggcgctgcatgcgggcacggcggtggcggcggtggcgtccttcgcgctcttgtggacgcgccgctttcaatgggtccgtgtcgctgcggctgtgcaggcggggctcatcgtgctggggtgggccgcctcgcagtacccgtacctggtggtgccggacgtcacgctgcacggcgcggcggcgagccctggcgcgcagcgcttgttgttggtggcgctgggcgtgggcacggccgtggtggtgccttcgctggtgttgctgttccgcgtcttccggcccgcgcccacgccgggcgccggctcggaggtgtgagtcgcgcgggcgtccctcgccacgcgcaatgcgtggcggggacgaagcgacgccttagaaccgcgcgttcacacccgcgtagagggtgcggccgcgctcctggaacacgtagccttcctcgtcctcggtgcgggtgttggcgaggttgaggacgcccgcgttgacgccgaagttcttgctgatgtcgtagctggcgccggcgtcgaagagggcataggcctccacttcctcggtgccgctgagctgcgtgccaatgtactggccgcgcacgaaggccttcagcttgtccaccggcgtcaggtcaatctggccgttgagggtgtgcttgggccggtaggcgagctgcacgtcgttctccaggtcccggctctccaggaaggtgtagttcgcgctcaggcgcaccacgttgccgaaggccttgctcgccgtcgcctcgacgccgcgcaggcgcgcgcggttgacgttgcggggcacgtacaggggcaggcccgttcccgggtcggtgcccaccggctccacgcccgtgccgcgcggcgtgtcgatgaggttgcggatgttgttctggaagacggtcgccgacagggcccacgacgtcatggtccagttggcggacacctcgaagttggtgctcttctccgggtccaggtccgggttgccgatgatgccgcagcggcctcggcagctcgtcaccagggactcggtgctcatctgacgcagcgtgggcgccttgaagcccgtgccgacacccgccttcagcgtgaggtggttgatgggcgagtagacggcgtaggcgcgcggcgtgaagtggaggccgaagttctcgtggttgtccagacgcgcgcccagcagcagcgtcagcttgtccatcagcgccagctcatcctgcgcgtagagggcctgctggtgcacgctggcgccgccgctggtgaactcgtccgacttgaggtcaatccagcgcgcctcgccgcccaccgtcaacgtgttgatgcccaggtacgcggtggcgttcgcctccgcgacgatgttgtcctgggtgaggccgtcgacgccgctctccagtccttcccagtagccgcggacctcggagttgccccagtcccacttgcccttgtggcccagcaccgcgtcgttgcggtggaccaccgcgtccgcgtcgccgtaggagccgccgatgtagtactcgccgatgcggttctggtacgcgcggccgtactcggcggtaatcgtctgctgcgcggtgggcgtccagttcagcgacagccggccgttgtggtcattgcggccctcgagcgtggccaggtcgccgtggttgacgacgctgccgtcttcacgcgtcaccggcgcaccgtccgcgttgagcacgggcgagcccgggttgcgcgcgccattccatgcttggcggtggttgaagccgcccgtcagcttcatggagagcgtgtcctcgatgagcggaccgctgaggaagacgctggagcggagctcctcgccgttggcgcccacggtgggcgtctgcgccttcaggtcgatgccacccgtccacttgggcgcaatcggcttggtgatgatgttgatgacgccgcccagcgcctcggagccgtagagggaggacatggcgccgcggacgacttcgatgcgctcgatgccctccgtggggatgaggccgatgtcgaagtcgttgtggcggaacaccgcctccagcgagttcactcgctttccgtcgaccaggatgagcgtgtagctcgaatccatgccgcggatgctgatgccacggcggccctggctgccggccgtcaggctgatgccgggcgccaggcggatggcgtccgtcaaatcacctacaggcgcccgcttcaggtcctcctgcgtcaccacggtgacggaggcaggggcggaggtgacgtcctgctcggtgcgcgtcgccgtcaccaccacgggggccatctggaagatgttgtcctccagcgccgcctccgcctgctcggccggatgctcggcggccgcggaatccggcggcggcgtggccgcgtcctgcgcccaggcgggcgtcatcgtgagcagcagggcagagcccacccacttccacgtcacggacaggcggggaccgcggaaggggcggggggaaacgtcatcacggtgaacggcgcgcaaggtccttctcctcatgtgggtgtctgaactgccggactccccccgttccgcttccgcctgcggcgtccgcgggtactgactcgagcaaggccctcccgccgccgcggaagtcgcgacgtgggggacacctgcgatgcaaagggccgcgtcctgaggtcttccggtgctcagcggagcgtgcgcggaaggcgcagttcgttgcgtgtgactttgcaaatcaatatcaattgagcggcactttgcgtcctggcgggtgtcctgtcaacgcgcggaaggcggaatcttctacaccagccgtagaagtccgccttcaccgcggaggtgcccgcgaggtgtgcgtcaggcttgcgtgggccagacggcccgcggttcttcgtcgtccctggcgatgagcagggtggcgccttcgagcaggtcctcggagtccagggcctccacggccgtgcgcacgcccgcgtcggcgtccatcacccggcagtagacgcggagctgctgggcctggagctcaccgccttcgacctcgccattgcccgtccagccgagcgcgtccgtgagcaattcctccacggcgacgcgcttctccacgtcgtggccggtgcccttgccctcgacggtgtactggacgatgagggtcgtcatcgccgtgggctcaggctcgtcatagccctggtccaccaggggaccggcggcctcggcgatgaccatgtccgggtcttcatccggggggaggggtagttgatggtcttcgcccgtctcgcccacgaggccttggtgcacggtgagtgcgccgtcatgcacccaggcctcccagtagcggagccggttgccttccttcttgtagagcttcagcacgcttcgagtctcattcgaggacccctgcatagcacggagcccggggggcttttcgctcagaaggcacggccttggcccccatccacgggcagggtggcccctgtgacccagcgtgcgcgttccgagcagaggaaggccaccacgtcggccacttcctcgggggcgccgaagcggccccagggcagctcgtcacgcaccagtctggccaccttctctggatccgccttctggcgtttgtcccagcttccgccggggaagaggatggagccgggggccacgccgttgacgcggatgcggtactgcgccaggtccaccgccatctccttggtgagcgcggtgatgccggccttggcggtagtgtagggggcgctggtggcgtactcgcggccaaagatggagttgatgtggacgatgcagccgccaccctgctggcgcatggcctccacggcgcgctggctgcaccacacggcggacaggaggttgcggtccaggacggatgtccactgctcggcggtggcggaatggaaggcgcccgcgccgccgctgccgcccacgttgttgaccaggatgtccaaccggccgaaggcgcgcaccgccgcctccactgcttccacggcgccggcctgggtggccacgtccgtcaccacggtggccacatccgcgcccccggcgcgaagctgcgccgcggtggcctccagggcctccgcgccgcgtgcgctgaggcacacccgcacgccctcgcgggccagcaccgacgcgatggcccggccaatgccccggctgctgccggtgatgagggccgtctttcctctgagctccaggtccatgggcgggcgttctactgcgcctgtccgctcatgggggcgtcatggtgccggggcgttgagtcctgtgcgccagtccgggaggcatcgcctgggaggggttctgcttccgatgaccggtgccgcggccgggtgcttcggccgcgggcatccgtggccgcgtcctacttcgcctggaagcgcgcctgtgtcggggtggcccccggggtgcgcgtgacgccgcggtccgggttggcggccaggtgctggagcaccttgaacaccgtctccacctcgtccggcatgccgatgtccgccgcgagctgctcggcggtgcgggcctccgcgcgcgcctcgcgcaggcgcgtcgtcagcttgcgctggagctccagcaccacgcccgcggccttcttgcccgcctccacgcccggctggtggtacgcgttgatgtgcaccagcgtggcgtagaagcccactgcgcgctcatacagcgcaatcaacgcgcccagcgtacgcgcgctcacgtccggcacggtgagggtgagtgactcgcggtccttctcgtagagcgcgcgccgcgtgcccagcaggaagcccagcaggtagtcaccgctggtgacgccgggctccacttcctgcgagccgccgtcacggtccttcagcacctcgatgaaggtggcgaagaagttgagcacaccctcgcgcagttgctgcacgtaggcgtgctggtccgtggagcccttgttgccgtagacggcgatgccctggttcaccacctggccatccaggtcggtctccttgcccagcgactccatgacgagctgctggaggtagcgcgacatcagcagcagccggtccttgtacggcaggatgaccatgtccttgtggccccggccatcaccggcgtagtgccacatgagcgccagcagcgcggccgggttcttcagcgcatcacgctcccgcgtcgccgcgtccatgtcgcgcgcgcccttcaacagcgcgtcgatgtccagcccctgcaggcgcgcgggcagcaggcccaccgcggacgtcaccgacgtgcggccgccaacccagtcccacatggggaaggcgcgcagccagccctgcttcttcgcgtggttgtccagctcgctgccggcgccggtgacggccacggcgtgcttgctgaagtccaggccgcgcgccgagtagccgcgctcggcctccagcatgccgttgcgcgtctccttggtgccacccgacttgctgatgaccagggtgagcgtctccgacagccgctcgcccagttgcgccagcacgcggtcgaagccgtccgggtccgtgttgtcgaagaaggacacctgcatcgggtccttcgccgtgcccagcgcgtccgccaccaactgcggccccagcgccgagccaccaatgccgacaatcagcatgtgcgtgaagcgctgcgccttctgcggcttcacccggccctcatgcacgttcttcgcgaaggcgtggatggcggccaccgtgtcggtgatttccttctggagcgcgggctcgggcgccaactccggcgcgcgcagccagtagtggcccaccttgcgcttctcgtccgggttggcgacggcgcccttctccagggcctccatcgcgccgaaggcttcctccaggcgggggcgcatccgctccaggtagtccgccgggaagcgcatccgcgagacgtcgagcgtgaagtccaaggccgggacgacgcacagataacgctggtaccgctcccacagttctcgctcggtcatggctcctcctggcagttttcgcgtcgcgataagtgccgggtggcttagcgcctccgtgcgcgggtgggaagctggacggcggtgtcggtgcgcgtccacggggccgcgggcggccgggtgctcaacacctcacacggaggggcgcgccgcttcgggcgggggctgtaccccgggcggctggggcgcctctggggcgtcgggcttccaggccgggttgcggaagacgtagctcaggcgctgcttcagggagccgggcttcgccgcgtcgcgcgtgatggccgcgaactcgtggaaggcgatgcgcacgggattgaacgtctccaggttcttcgtcaggccgtacacgggcttctcgccctctggctcgaacgtcccgaagaggcggtcccagatgatgaggatgcccgcgtagttcttgtccaggtagcgcgggttggacgcatggtgcacgcggtggtgtgacggcgtgttgagcacccactccagcgggcgcggcagccggccaatggcctcggtgtgaatccagtactggtagagcaggctgacggactgctgcacgacaatcatcaccgggtggaacccgagcagcgccagcggtgcccagaagacgaagctggtgggcggcgtccacgtctgccgcagcgccgtggagaggttgtagtgctggctggagtggtgcaccacgtgggacgcccagaagatgcggctctcatggtggacgcggtggaaggcgtagtagcagaggtcgtccgcgaagaagatgagcacccacgccagcacgccggtgcccatgcgcagcggcgtcaggtggtagagcgccaggtagccggcgaaggccacgcccttccacaggacgttgatggccacgttgcccagccccatggagatgctggcaatcgtgtccttccaggtgtggcccaccatgggacggccttcgtcccgctgcttcttcacccagagggcctcggcaatcaccgtgagggtgaacaccgggatggccggggtgatgaggtcggggatgtgtgctgcgtccatggtggtccctccgtgtcggcgaactcaggagcgggcgcggcggcgaggccgcgtcaatgaggggaggaaggcgttgcgcatgaagtgggtgagcgcatccagcatgcgccggtgcgccgggtcgttgggccgagcgctgcctcccaccgcggcgccctgcaccgcgtccagcgccagctccacgatggagtcgaagtccgggtgctcggaggcctcggggaacagctcgcgtgccacgcggtgcaggttctcccggtgcgggccgtccaccgtcgccagcgccacgcgcaactccgcgtccgtgcgcgccgcgacgtacagctcgatggccgcctgcagctccgggcgctggaaggcggccccacaacatgtccaccggcgtcgcgatgcggtccctgcccgacggccgggcccccacaccggccaggtagtcctggatgagccgggggaagaggtgctccaccgccgcggcgagcagctcctccttcgtgtcgaagtgcgtgaagagcgcgccctgtgacaggcctgcccgcttggacacctccaccgtcgtcaggcgggcgtagccctgctccaccaacgtttcgatggtggcgtccagcagcttgcgccgcgtcgtttcacggcgctcctgctgcgtgcggcggacaggccgggccggcgcgtccgatggagtgttcttcgcggccattcgactcgcaggataagtctgaacttagtgagtgaccagtcactttctgtggtggagagtgagtgctcctcacagtggcgtgtgccgccacctgtccccgtacacgggtggctcgaaagggaagtggccgctcgtgaggcgcgtcaggcccgcttccccagcggcccggcgggcaggggcctgggtgccgagttcgcggcgttcgctcgggactcgggcatgattcccctcgggagggtgggcgtgccgatgccctccgcgtcgtacagcaggcgggcgcggcgaaaatccgcagggaaatacccgcgccacttgcctccgtttccgccccgccccgatatgaacctttcagccctccttcttggttctctcctggcttcggcccctgcggttccttcctcttccgccacggatgtgggcgaaatgcccgaggtcggcgttcccttcgcctgtggtcgcatccacacggtgagccagggacatgacacgggaagtcaccaacacaacgacacgcatgcgtgggatttccgcatgccggatggcacgcccatcgtcgccgcgcgcgacggcacggtgcgcctgtctcgtggtgacagcaccaagggtggttgtgacgagaagttcgcgccccacgccaactacgtcgtcatctcccatggcgatggactggagacgcagtacctccacttcagcgcggtggtggtgaagccgggtgacgtggtgaaggagggccagctcatcggcttctccggctccaccggctgggcctgcggcgcgcacctgcacttcaaggtggcgcgtgagagcggcaagggttggaacaacccgtccgtgccggcgcgcatcgctggctacggggacccggtgcgcgacacccgtgtggccgcgcccctctgcaaggacaacggcacggaggcgctcatggcgagcaacggcggtacgcacactccggggcagccggtggtgtccatttcaccggagcgccagcaggcccttcgcggcctcccgcccggggcgcagagcatcctcgacggtctctcccagcctcccgcccagggcggccagggactcaacgaagcgcgcacgtccggtggtacccgcacggcgagcggctccagcgagactcgctgaggccagcaacgcgcccgctccggcgagcagcatgaagagggcccccgcgttgacgaagtagtccaacggcagcagggggccttccacgtaggcccgcaccacgcggtagcccacatggcccagcagggccagcagcggcaggttgatgagcggcagcaccagccagcgcgcggtgcgccaccagccggccaccgcctccgccacgccggtggtggcggtgtagcgccaggcgcccgctctcgccacccgcacctcctccaacagcgtgtccacgtcggggacgcccagtagcgcgggctccagtccgctcgcgcgcgccacgctgcgcgcctccgccagcgcggtgcgcgccgcggcctgggcgctgaagtcgtcctcgaagggctccaccaccgcggactccgcggccctggcgcgggtgtgtccgcgcaccacgtccaccacggtggacgccgccgccaccgccagccccgcgggcagactgctccgccccaccagcgccgccgcgcccagcccgctggcgccccagagggacagccgcaggccccaggccgcgggcccccagaagcggcctcccgcctgacgccgcacctccgccgccaggtggccgtgcgccagccgcagccgcgcgtcgaagtccgcgcgcaggccctccgccgccttctccatccccgagtccagcgcggcgcgcgtgcgtgacagcatcgcgtccgtctccttcagcgcggcctccacgcgggtgtgcacctcttccagcgcgcccatcgcgttcgtcttgcgcacgcgcgcggccaccgcctgcgtggccaacccgcgcaggtggaagagcagggcgccgaactcgccggacacgtcccggccgtccttcgccgacagggcgctgatggcgaagacgggcacgtcttcctgggccaggccgtactgttcggaggccacgcggcgtacctgggctttgagcgtgtcgcgcgactcgggagacagctcgtccgcgaagttgaggatgaagacgagcgagcgccggcgggcgaactccgtgaggaactccacctgggaggcctccgccacgctgccgcggtgcatgacgacgagcgcgacatccgcgcgctccagcgccgcgcgggccacttcgcggtgcgtggtggccacgctgttgaggtccggcgtgtcgatgaagacctgtccgccccacaggccttgggggccgggggcatacgtcatgacccgcgcgccggagcccgccagcgcgtccgtgggcgtgccttctggcgcgaacacggtggcgaccgtgctggtgggccggttgacgccttcacgcgacagggcctgccccgccagcgcgttgaggagggtggacttgcccgcgccggtggctcccaccaacgccacgctcaggggggcgtccttgcgcgccacgccgcgcgcgtagtcgtcgacgagccgctccaggcgcgcggcatgcggccggagcgcgggcagctccagggccgtcttcagcagggaacgcagggcatcgggttcaggcaggctcgtctcgtccacgtggagagagcctgtcccggcttcgtccgggtgactacgaagaagatgcgtggagggtgcgccagcgtgcagtttccggcggggggccctaccgggagcgtcgggcgtcagggtggggcggggaccggagatggcagcggggatgcctggaggagtagaagcagtaccaccatggacctcttcctcatgtcgccgccgggacgcacgtgggccctgcgtggccgcagcaacttccgcagccgcgaggcgccgcccgtggacgcgcgtcaggcccggagggaatggctggcgctggcccgggacatcgaagcgcgtggcggcacggtggtcgcgttgccgtctccctccgagctcctgacgggcatgccctacgccgccgaatgtggacaggtggtggcgcgtcagggcgccgctccgttgttcgtgctgccgcgggtgatgagcgcgcaccggcaggcggagcgcgagcactgggcgcccctggcccggtcgctgggcatggaggtggtggacccgggcgtgggcatctgggaagcccacggcgacgtggccactttcgacggcgtcacgctgctgttctggggcggccgcacgacgctggacggcctggaggccgcggcgcggtacttccccggagaggtgctgcgcatccaggtccgcgagcccgccttccacggcaacatggcggtgctgccgctgcccgcggtggaccggctgatggtgtgtccggacgtgatggcgccggagtcccatgcgctgctgcgcgagcgcttcggcgagcaccggctgctcctcgtgacggaggcggagattcgccgctacgccaccaacgggctgccggtggggcgtgacgtgctggcgccttcggtggtgccggactcggtgcgggagcggctggaggcgctgggcctgcgcgtggtgtcgctcaccatgcgcgagctgtgtgagaagggaggcggctcgtcacgttgcctcgtgtcgcgcgcggaggtggacgccgcgacgctgaacatcccagacgcgttccggttgtcggccatcgcgagggacatcgatgccgatgggtgacgcggacacgctgcctcggcaggcggaggccttcctcgcggcgcaccctggcgcgtcgctggtggcgctgggctcgggtgagcacgcgggctcgttggacttgtcgccgctgggcgtgccggtgacgttcctgcccgccgagcggaacgcggacctcgcgatgcagtacctggcgctgaaccagctcgccttcggtggcatcggcgtgccgcgttgggtgctgtcggacctgtatctgctgccgggcgccattgggctgctgcgctgcccggcccggatgctggcagcccccgtgcgcgagcggttggggctggccgacgaggacccggccattggcgcggcctactacgcggcgccttcggtgacgccagggttggtcattggcgtgtcgctgctgagcgtgctgccgggaacgggggcgtcgccgtgggtgaagctgctcacgttgcagatgctgcgcgcgcggcggctgcgaggcgtggcccagtgggacaaccccagcgtccgtgtccattccaggctgggcccgctgcgcctcgtggggcgagtgcccgggggccatgagtatggcgaacgctccttcgtctacgagtcggagctgacggaccggacgcggctgggcgacgcgatggtgcggcgcctgtcgctgacgccgtcgctgcgtgtatccgccacggacctttcggcgctgagcgcgctgctcgaccgcgcggaggcgggcgaggtgttgcacctggtgcctccgggactggacgcggggcaggtgctggtgcgcgaagggccgctgggctgacgcgcgggcgggctcagggcgctggcgcggcgggcgactccatgtcctcttccagcgcgagccgcaacgcgcgggatccgtcgcggaggatgggcgctccatgggagaagcacagcgtctccacggggaggtggtccaggatgcgctggacgctgtgccgggtgcgcagcggttcgtcctggtactcgctggggatgaactccggcgtctcgccgtcctcgtgcgtgagcaggtcggagatgaacgcgacggcgcgcgggtgttgctgcatccacagcgtgtacattgcctcggtggggccgggggtgtggaacgagatgagtcccccgggcagcgtgtctcccgcgacgtagaagaagtcgggctgctcctccagcgtctgtgctccctcgggtgcccagacgggcaccttgaaggccttgcgcagccgccacgcggagcgctggtggtttcccgccgtcaggacgatggcggagatgttccccagcttgcgcagcgcttcctcgtcgatgggcagcgggtcaatgaggacgacggcgccatccgtgtccaccacggcgtacgcgtcactgcgcgcgccgccgatgcggtcatcggagagggtccagtggtggacgccaggcaccagctcgcttgtccgcttcgccttccccttgggctcgctcatgcggacaaagctaggcacccccaggcgttgtcacttgggcggggagggaggccacggcccggctgctccgctgcttccacggcgggcgcccgaggatacggggacgtcgtccgtgggacggcacaacgttcccgcatgatggcgcgaatctctcgcggtgtgctgctgacccggcccctggtgctcttcgacggcgactgcgcgttctgccggcgctgggcggcgcgctggcggtggcgcaccggggaccgtgttcgctaccggccgggcagcgggtggcgccgctggttgctgggcatcccgaaggcggacatgcgcagggccatgcaattggtggagccctccggccgggtatcccagggcgcggaggccctcttccgcgcgctcgccgcgtcgcctcgccgggggactcgggtggccgcgaggctgggcctgatgccgggggtgttgcagttggcccagggcgtctatgcggtggtggcccggaatcgccgtcaggcggcgggcgtggaccgctggctcttcgggcgcgcggtggtgccgcacgaataccggtgggtgcgctgggccttcctgcggttgctgggaggaacgttcctcatcgccttcacctcgctggggcggcaggtgcggggactgtatgggacgcaaggcctccggcccgtggcggagcgcctggccgcggagcgtcgcgaggaggcttcggcgctcgcgaggtggcggcgcattccgtcgctgttctggttggacgcttcggacgccacgttggtgcgtgggtgctggaagggccaggttctgtccctggcgttgctcttcaacgtggcgccccgcttcagcgtgtcgctgctgtgggcgctgtacctctcctacgtggccgtggggcgtgagttcctctccttccagtgggacgtgctgctgctggagatgggactgctggcggcgctcaccgcgcccggaggactgcggccgggcctgggtcgtgacgagccctccgcgctggatgtgttcctcttccggctgctcgtattccggctctacttcggctcggggctcagcaagctccagtcaggggaccggacctggcgcgagctgagcgcgtgcgagcactattacgagacggcgccgctgcccacgcggggtggttggtacgcgcatcatctgccgcgtcggctccagcgggcctcgaccggggcggtgctctggctcgagacggtggtgcccttcctggccttcgggccccggcgcttgcggcagttcgccttctggagcctgagcggcttgcagaccgccatctccgccacggggaactacggcttcttcaacgtccaagcctgggtgctgggcgtgtggctcctggatgacgcggcgctgcggcgggtgctgcctttgaaggacgggcctcccgctcagccacggccttggtggcgtaccggcgtgtccgcgctggtggtgtcaccgctgctggtgttgggggcgtcggaggtgcttcgccggttcgaagggtggcagcggtaccggcccgagcgcgtcggcgcgatgctgacgtggctggagtcccaggcgcggcccctgcgttcggtgaatccctacggcctcttcagcgtgatgacggtgcagcggccggaaatcatcgtggagggctccgacgacggagtgcagtggaaggaatactccttccactacaaggtgggggacccggcccggcctccccggcaggtggctcctcaccagccgaggctggactggcagatgtggttcgccgcgctcggttcgccccctggctggttcgtcgcgttcctggcccggctgctggagggctcgccggacgtcctgggcctgctggcgggcaaccccttcccggaccggccgccccggatggtgcgcgcggtgctgtacgactaccggatgacggacgcggccgagcggcggcgcacgggcatctggtggcggcgggagcggctgggcctctacgtgccgcccctctcgctggcgcccgggccccggcctcgtggacgcattcccgcgctgcaatggcatgccggggcgtgaggcgggtgggagcaggcgtgcggccctgaatctcgaaggccccttttcgtacgccgccgatggggtggggctacaatgggggcttcccacccatctccgccgtcgtgacgccgtgaagacgccgcgcattcctatttgcctcccccttgtcgccgtcatcgggctgctgagcgcctgcgggcccacgcccaccaccatgaagctggagccgctggagacgaagtacctccgcacgcctgggcagaccgtgaagctggcgtacgaggtcttcgacgcggagggccagcccatgtccgacccgaagctgcggtggaccagctccgcgccggacgtggcgcaggtccaggaaggcttgctgacggtgcgcaagtcggggaagacaaccatcggcgcgacgggtggcaaggtccgcgcggcgttgccgttggagctgaccatcctcaattcgctggacgtgcgcgccccaggcgcggacttcctcgaggtggggcgtgtcatcaagctgcgcgtggtggcgaggaacgagcagggctcttcgttgcaggacgccatgcccacgttccgctcctcggatgagatggtggcgcgggtggaggatgggcagttggtggccgtgcgcccgggcaaggcgaccctgagcgcgacactggggcacctcagccggcacatcgcggtgcaggtggtgccagcggacttcgcgcggctgggcctcaacctcacgcaccacgccttccagcggagggggcagtccgtgcagctccaggcgcgagccttcaatcgcagcggcgtcgtgctggacacggtgccgctggagttcttcacctcggactccgccgtggtgtcggtgtcgcccgaaggccgcgtgacggcggtgggttctgggcgcgcggtggtgtccgtggtcgccggtcggcggcggtcggcggcggagttcgtcgtcccgtagcgagccttccccgcgtctacggcttcggagccgcgggggccttcgacttcgccttgggcgtggcaggcgctttcttggtggggcgcttgcgcttcttgtcctccgcgtcctccgggcagggcggacgcggtccgtcgctcggcggctggatggtgaagtcgacgcggcggttgagtgccatgccttcttccgtcgcgttgtccgccagcggccgcgagcggccaaagccctgcgagcacagccgctccgccgccacgccgctctccaccaggaagcgcatgacgctggccgcgcggcggcgcgacaggtccaggttgtacgcatcgctggcgcgcgagtcggtgtgaccctcgacgtgcacccggtcggcctcggtgttctcgttcatcacccgcgcgacctcctccaggatggggaaggactcggagaggatgatgtcctggtcggtggcgaagttgagctgctccaggatgacaatgcggttgccatcgcggcgggccagcgggcacccgtccttgccgcggctgccggcgggctggtccgggcaccggtcgagccggtcgaccactccatcgccgtccttgtccgtgtccgggcagcccatgttggccacggggccagccacgtcggggcacgcatccgactcgccaatcacgccgtcaccatccgggtcgatgggcggcggcgggggctcgggcggctccttgaagcgctccagggcctcccactcgcgcgtcttcgccggaatccacaggatggacgtgaagaagctcagcgagggcgaggcgatggagcagccgcagcccatgccgccgccgaacgtgaaggtgagcccggtggagctgtaccagcgcaggccgaagagcgcctccgcgggaatctgccggggctcatcgggttgcttctgcaaccccaccgcgccgtgcaccatgcccaccgcggtgacaccgctgccgcgaaggatggggacctccgcgccgacgccgaagggcatcatgtcgcccacggacacgccgctgaagacgcggtccgggcgcttccagaagccgccgttgagcgccaggaggatgccgttctcgaagcggtagtctagcaccaggcccggggcccacgtcatctcgccgtctccggcgaaggcgtcctgggcgccagtggggaagctcacgttgagcgtcaccgcgccgccccagcccttgccctcggcgggccggcgcaggcccgggatggccaccttgccggtgagctggaggtcaccgagcacgaagctctccacgctcccctcggtgccaatgacctccaggttggcgccgccctgggcgaggatgagtggcatgtccacgccgacctcggcccagtcgaagaggccaatggtggccatgacgtccagttgaaggcggttgccgaccaggttgatcttgctcaggtctccgccctcgggaatcagggacagggggttgagcgagtagctgaggtacggcccggccgagacggacaggtgtgacagcggacgcgactgctgcaccacgaccaggtcctggggcgcgccggacggacggaagagctgcacgttgaagcgcgcgtctggctgcgcagtggcggtggtggacaaccccagcgccacgatgaggaacaggtgcgagggcttcatcgagcagggcgccgggggcggaggaacgtgagacccgcggcgagcagcagcaggaaggtggtgcttcctgcgggggtggcgtcggcggtggtgccgcagcagaaggcgccgccttgaggctcggtgcccggcttgcggcggccgcgctcgcactccatcgtcttcgcggagcagtgctccacgcccaggcaatctccgctgtcggagcaggcggtggagcaggtgttggtcgcggtgtcgcaggtgccgccgcaggggcagtgggcatctgcgaagcactcgacgcaggaggtgccgtcgcagaccgttcccggctcgcacgtcaccgcgcacgcgcccgagttctcacacgtgcgcgtggtggggttgcacacgccgctcccgcagtccccgtcatccgtgcagcccacgcaggtgctgccctgcgcggtgccattggagaggcagaagggggtgtcgccatcgcaggcgccacagcgggggccgcagtgcttgtccgtggtgcaggacgcgcattcaccactgaggcagaactggccgtcgccgcactccaagtcgttgcgacattggacgcagacttcgccgtcgaggcagtaggggcgctcgccggggcacttcacgcagccagggccgcaactgtcggccgtgttgcacgaaggcacgctgtccacgcagcggccgttggcggtgtcgcactgctggcccgcggcgcactggctgctggtggtgcactccacacaggtcggcgtggcaccgggcgtcagcgccaggcactgggtgccgttggggcagcagttgcaggagttgccggcgcacgaatcattggtggcgcagggcgagcacacgttgtcggtgcaggactcgccttgagggcagtgggagtcttgcgtgcattcgcgacattcgttgatgtcggtggcgcagacctcgccgttggtgcactggctgtcgttcttgcactcgacacatgtgaatgtttcggtgtcacaggcgcccgtggcgcagtcgctgtcttcgttgcagccggtgcactggttggtttcgaggtcgcagcggccgttcgggcactggccgtcctcggtgcactgcacgcactgggtgcggccgttgaggttggcgcagtggggcgcggactcgccgcagggggagcagtcctcgccgcagaagagcgaggagtcgcagggcgcgcagagggccgctgcgttgcagtggtagaaagaaccgcagccgccagtgcctgggatgttcgcgaactggcggttgcactgctcgcagcggttgatgtcgtctgggaaggagggtcgtccgccctccgtgtggaagaagagctctggcggagcaagggcgaaaccggctgtgttgagcttgacgatggggtcggtgctggcgccacgctctgtatctggaaacgcaccgacgaacgtcgagaactcaagcgcagagtgctcactgacctgagcgtagaggatctctacgggatagaggcccggtctctcaaagaccacggtgttggtcgtgcgccaggacgcgattccgagctgcggtggccggttgatgacctgatacggcgtctggctcaggtcatagatgacgaagctgacggcatcgtcggcatagagcccgaagtgtagagggacttccacccactgtggttggacgttgatgtatccgcgaaatcgggcgccgaaggacgagaacgttgggtgtggggaggcacatncgcctttaccgcacgaaccaacggagttcacgaagtcgccgtagcttggctgctgaatcgttgggtcgtttggatcgcctagcgtgatgttgttcgagaggtcgaacaacgtgcggagtacggaggtgacgcgtcgcggcctgctcgactccatgaacgcattgaaggtaccggggaatgtggcctcgctctgagagaagtccacggccggattcgatgatgtgcttgatgccatgcacaacccggtgccgactgctcctggtgaaggagctacgggagtcccacggatgcggacaagctccggttccttttcgcctggctctggctgcgcctgcgcaacactggcgaggcacaccgacaagacagtgagcgcggtacgcgcgatgcgggacaatggcgatttcaaagccccgcaacaatgagggatatctcccacaaccgcaattccggcaacgtgcggctttccgctacgacgtcgcaggtcctccggaggtcgctcaacggcggagattcagtgggccgttgctactcggaatagtttgaaatgcaggtcgctctgactcagacccgcttgcagctcacgtccccatcctgggagcggatgaacgcggcggtgagctccgtgcccagggccgcgcacagcacctcgaaggtccgccgccgagcgccgccaaccacagacggctggctggccagtgtctcgggatgtcgcacgaagatgttgtagcccacgatgcagccatccgcgcggagcacggtgatgccatcggtggccatcattccccgcagcaactgcgcggcggcgcgcacggcggtgcccgcgctgtcggtggggtccacgtggtagcgctccaacaacgccacgatgtccagcggacggggcaggatgatgccgtccacgaacagcgtggagcccgcgcgctccctgggcagcaccgccacgagcgcgccgtgggagccctgcatcacctcgaagagcacccggcggaagaaccctcgcgcacgctcgcgactgtgcgtggtgacgcggccgtgacgacgtccgccagctcatccatcacctctggcggagaggccgactccaccctcgcgccggacaggtacacgtgccggcacagccctccgcccgagcgcaactccaggatgttgtcggcgagctgaagcacacccacgacgcccgcgcccctgtcctcgacacggcgcagccgctccagcggcggtctccgccaaagggaagggggtccgtccggaagacgccggtaggcgaagccctccgggacgcgcaggaagggtacagcgcccaccagcgcccctggcccaacgggcggcgcactggttgagcgcgcgctggatggtggcgcgcgaacgcggaccgatgccgatggcaatcggggtcatgcccgcccaggggttcgaagcatctgtcccaaggtcgtcttcccacgaaaggccatgggaaacaggggggctccctcctcgggaatacgcaacaaggtgacgatgagctctccgatggcgtccgccgtcagctggcaggacatggatgcttcgtccaggaacgtgcttgacggcatcggtcagcaggcggccgaaggacaggacgagaggtggggagcccagtccggctgggtccgagccgttcatgagacactcagcatgacgcattgtcgccgggcacgcacggacggagtgacagcgggccaggaggcttgttccctcgccgaggcgtcatcgtgcgccggtgtccgcccgttcagccccggctgatacagggtgtcagcgccgctgggtacactcggggcgcacggcccgtcaggacaagcctgcccgggcctcgtccaggcgggccgccgtctggttccagtcgctggccagcccgtcgagctgcttcaggatgtcggagaagtaccgcgcctccagggctctcgacagggtcgcgccgtgggcatccgcccacttcttcgtgacacgcgcccgcacctgggcgcctagcaggtccacgaagcgctccatcagcggcgtggacagcaaggtgcccgcccagacgaccgcgtcatggcccatgccgcccgtggccaccgtcaccgccgccgccgcgcctgacggcacggagtacaccagcgtcgtcagtgtctggagaatctcctcccgcatgtcgccctgaagctccgcggagaccaactcccggcagtacgcatacagcgtggcccggtccgccgcgtgcgcgtgcaggggctcgaagcccagcggctcctccagcttcgccagcgtcaccggaccgaaggcttcctccagcttcgtccgcgtctgcgcgtcggcgcgccacgcggccacttccggagcgaaggcatccaccagccgccgcactccgtccttcagcgtctcgtccaccgcgtgggtcggcgtgtccgcgcccggggcctcgggcgcggtgaaggactcgcgcaccttgcgcgtgacgaaggtgagcgccgtggccagcccccggaagggcaggcgcacccacttgtggaactgactgcgcgcatccagttcgtcgcggaaggcgtcgatgagcacgtccgcgggcacggccttcagcgccgcgtgcgcccccaccacgtccagttcgtggcgcagtcgcttgcggagccggtcgggctcccgcgccgcctccgaggccgctcgcgacacggcctccatctccgcgcgcgcatccgcgagcgaggcttccagcgcccgggccttcagctcgcgcgcgtgttcggcctgtcccagcagcgctcccagcgcgggcttcccgtccaggggctccgtggccaggggcttcagtcccgcctccacgtcgggctggtgcggcgccaggtagcgggccagcgccgggtggcccacgtcctcggcgagcttgtccaggtgcccgcgggccacctcctcgcgcgtggcctcgttatagacgagcaggtacggccgcccatgccccacggccgcgcgcaggaagtccaccagcgcggcgttctggtacgtctgccggctcaccacgaacgccagcacgtccacggtgacgagcaacgcctccgcgcgctcgcggttgtcgcggtacacgctgtcgaagtccggcgtgtccatgacgagcagcccgcgaggtaccgcgtccgacagcgtcaggtacagccggcccggaggccccgcctggtccacgggcgccgcgtcgccggaggccacgggcacgatgtcatagcgccgcgtcaggaagtccttcagcggcccggtccacgtctccgagtgggccgccgccaggcactgcttggtgagcccgccctcgggcctcgcgggggacagcgccgcgcccaccagcgagttgaagagcgtggacttgcccacgttgttgggaccggcgatggccaccagcaacaggggggagtccgcggagcccaggcgggggagcaggtcgcgacgcaggcgttcggccagacggcgcgcgagctcggcgtccgaggcatccgggaagcgctcgggagcgggcagagcgtccagggcggacgcgaggcaggtgcgcagggtgtacgggtctctcatcaccagaagtcctcgcaccacagcacgcgggacgccccgtgcccaggcacttgtcccaccaggtgtcggccggggacagagcaggtggagcgcggtagggtggtcccatgcgccttctcgccgcctgcctgctcctgtcggggctcgtcgcctgcaccgccgcgaatacgaatgcccccgcggccgccgcgtctcacgccaagggcccgttgcccttcatcgaggacgactacgcccgcgcgctcgccgaggcccaggcgaaggggctccccctcttcgtcgacgtctgggcgccctggtgtcacacgtgccggtcgatgaaggcctacgtcctgtccgacgcgtcgctggcccggcacgcggaccgcttcgtgtggctggaggtgaacaccgacctgacgtcgaacgcggcgttccaggagaagtatccggtggagttctggcccacgctgtacgtcatcgacccgcgtcaggagaaggccctgctgcgcttcgccggcagcgccaccgtggcgcagttggagaagctcttcgaggacggtgagcgcgcgtacaagggcggcgtcaccggcgccgaggccctgctggctcgcggggacgcgctctatgcggagggccgttcggccgaagccgcggagacgctcgtggaggccctggccgaggcgcccgcggactggtcccgccggggccgcgcggtggagtcgctgctgacggcgatgtacggcgcgaagcagcacgaggcgtgcgcgcacaaggcgctggaggagctcccgaagacgccccgctcgctgtcctgggccaatggcgcgctcttgggcatgtactgcgtgctgtcgctgccggaggaccacgcggcgggagcggagctgcgcggcggcctggaggccaaggtggccgaggccctggcgcccccggccatcgagatgtccgcggatgaccgctccggcctgtacgaggtgcgcgtgcaggcgcgcgaggtggcgaaggacacggcggccgtgaaggccctgtcggaggagtggctggcgttcctggagggcgaggccgcgaaggcgcccaatccccaggcgcggacggtgttcgactcgcaccgcatgctcgcggccatgaagctggagacgcccgcccgggcgattcccgcgctcgagcagagcgagaaggacctgccccaggactacaacccgcccgcgcgcctttcgacgttgtaccggctcgtcggccggctggatgacgcgctcgccgccagcgaccgtgcgctggcgcgcgtccagggcgcgcggcggttgtcggtgttgtcgggccgcgcggacatcctcgtggcgcgccaggacacggcgtccgccgtgaagacgctggaagaggccatcaccttcgcgaagtcgctgcccgcctcgcaggtgtcgccgcgcacggtggccgggctggagaagaagctcagcggtcttcaggcctcggcgcggtagccgccgcgcgggtgtccaggtcgaacagctcgtagtccggggcctggcactcgcgcatggctccgtcggtgaacaccagcatcgcggtgccgggtgctggtggatgcggcgcgccgtgggcgtagtccacgcgcgttccatccgtgatgagatgccgcagcacgccgtcgcgggcgccggtgggtggcatccccagcatcgcgcggcttcgcttgtcgcgtgtatggcccaccacctgcgtcaggcccgtgggcagccgtctcgggtcgaagcggcgccggggcgtgccgcgcacgcgctcggcgtcctcgggtagcaggctggggcgctggaagaagatgcccgtgccctcgccgtgggccgcgtcgcctgggtggtgcagtcccggaatgacgagcggacctcgagtccagcccgccaccgccgcatccagggccgcgttcagcgccgccgccacctggttcgcgtcctcgcgctgggcgggaggcaggcgcgtcacgtccaggtcctcctgtgtgacgcccgcgtgcagcaccagcaggtcgggggccgcggcatgggccacgcggaagcgcttcacacgcagcaggtgctccacccaggtgcgctgcaccgcgcggaagttgccgaagtcgcgggccaccagctccgcggaaggaacttcgggccagcgcgcgaggaacgcctgctccgccgcttcgtccgtagcgcctccctggtagatgcggtccgcttcggcctgggcctcggcgaagcgcgcatccgtgaagccggccagctcacccactcgcgccaggtcgtggttgcccagcagcatcaccgcctgggtcgccgggtgggcggccagccacgccaccagcgccagcccactggcggcggcggactcacgctcggcgggcttgccccagtcgaagtggtcgcccaccgagatgagctgcacgtcggagcgaagccaaccctcgccggtcaacagtccgtggtgcgccaggatggccaggacctggtccaggtcggcctgcgggtccccaatgacgagccgccgccgccagacatggtcctccgccgggacggagcgcggcgcctccgccgcggcctcggcggcccgggcgagcgcggcctggatggatgacgtcttgttcatgaactttggaagaagcgggcgatgagcgccgagcggctttccacctgtgccttgcttagcagatgcgtgacgtggacttccaccgtgcgctcggcgcagcccagccggccggcgatggacttgttcgtctcgccctggatgatgtgcgtcagcacctcggactcgcgcgcggtgagcgaccagcgcgccgacagggcctgcacgcgcgcggcggcgctggacgcggtgccggtgtcgatggccaggtaatgcggtggcaggccggtggtgagcagcggcgtcatggtcagcgggccggagcagggaatgccctgggcgccgcggcgcagggactccatcagctccgggtcatgccgttccagccgcgctcggccggcattgttggcgtgcaccacgcggccactggagctgacaatccaggcggcgcgccccagcgcctccatggcgacctgcagcgccgtggacatcaggcccgactcgcgcagccgcgtttccatggtcagccgccgctggagcgcgggcgtcagggcctggagcaggcgctgctcgcgctcggtgaagggctcggcgcgggccaggcccacccagcccaggagcaccggcccatcacagacgagcgtgcgcagccattgcatgttctccacgccgagctgccggaatatcgtcgcggagcgtgcgctgatgcgctcccgggtgctctccagcgattcctcgctcatgcccagccggcgccccacctcgctggctgacaagtcatgcagcggcagttggcgggccgtctcggtttccgtcagcgagcggaaatgcagcgcgcggttgcgctgagcaggctcgggccgggcgggattgaaccaaccccacggttctccccaggcagacacctggttctcgatggccgcgtgcactgtcgcggcggggagtgggaagcccgcgcaatgggcgtagctcgcgtggtagcgctcggggcccacgtccacgccataggcgacggcgcgctcggcccgcaaagcctctcgtaaagcgcctagcaccgggggcagggattctgtcccgggctcggcctccacgagcattgcctcaaggtccgtcagcaggccttgctcctcggaattcaaacgaatcacggttttggaagtatacgcctgtcagggtttgcgcccagtccctgccctttcttcacgcacgtcttgaacgttcagaattgtccccacggggacttcttggctttcaaatgttctgggtttttaatgacccagggatttccccaatagccggacacggggcagtggcggaacactctcatgtcggcccccggggggagggccgccgcggtgaactgtgagcgcgcgccgggcgctcggtttcgggtacccggtgcgccgctcctttcccacacgcctggcgcccgcactccaacccacgaggatggctgcctttgtgggcccaccagacctcatgggacatgcaggaagcgaggcaggcgcccggggggcaccaccctgctcaggaaatgaagcatgcccagggccaggtaggccatgcccagggccagtgcggcccagcccagccaggcgctgatggcgcccgtgcccaggcccaccagggcccagatggcgagcgccgtgcccacgccccagggcatggccgtgcgcaggtggggcggactgaaagcaccacccagggcgcagaaggcggccgccatgacgccaaagccgaaccactttggctcctggacggggaagatggccgccatggatagcagcgccgtgaagagtccaagtatcgcgagtcccagggtcatggcttactccgtggccgttcctgggaaaggtgctcaccgagcgcgtagcgcgtaacgcaccttcggttcgtgggcttcgcggcatgccgcgtggtgtcgtgcgtaaaggcgcgaaatcgcaacatccttccgctcggcacgctgctggctaggctgccaatcggttgtaccaccgtgcgacggccggcccacgtgaagaacggatggacacctggaaatgcgttcgatgaagacgaagaagtccgtgaagcgcgcgctgtgcatggcagtggtgatgacggtctccggatgcagggcgcccgcggcgttggggcccggaggcggcatgagcgcttcagagggctccgactccgccgcttcgtccgagggctccgactccgctgcttcgtccgaggggtccgactccgccgcttcgtcggaaggctcgggtgaatcgagccagtcggactctggtgcgtcgtcggagggctcgggcgactccagccagtcggaatcgagcggttccagtggagagggctccagccggtcggagtcgagcggctctggtgaagagggcacgagccactccgagtcgagcggttccagtggagagggctccagccagtcggagtcgagcggctctggtgaagagggcacgagccactccgagtcgagcgacaatgagtccacggagctcgcctctcgaagctccgaggaaggcggcacgagcgagggctcctcgggaacggagaaggcggacggtgaggcgtcgcgctcccgcagcaacaacagcagccagtcgaacaacaacgacgtggcgtcctcggtgacggtggccgcgctggtggtggggctcggcatcatcatctggcaggcgtatgccgcggtggagcggcgccgaggggtgtctccgaaagaggcgggccgcgcggcccaggtgtacctgcgggcgcgcacgcaccagcttcgtgaggacctcgccctgggcgcggggccgacggtagaggacctggcggcggcggctcgcatccggcgtgagcacctgggcctcttcgggcgcgtgctgcgcgcgaaccggaaggagctgctcgagatggccgaggcgagcaccctcacgccggaccgcgcgctcgcgtggatggagcgggtgggagagctggcgcgtgccgagccgttgctggaggaagagcgccgcgcgttcctcgcggcaccgtcccaggagggcaccgcgacggtggcgcactgatgcgctggctgcggctgctcgcgctcgtcttcgcgctgccggtgcatgccgacgatgccctgtccgcgcgcgtccaagcgctcgaacaggcgggcgtggtcctgcggggcgccgcggcggccgacgcggacctggtgacggaggtggaggcggggctggaggcgctgcctccggcgatgcggcgtccgcccggtggtcccctggaattggtgctgcacccggaggcagcgccgctgggcctgggcgatggctcccccgcgcgtcccgactggacggagggccgcgcgcggttccacctctaccagtacgctccatcggaggaacgccgggccacgctgcgtctgtctcgactgacagaagcggaggtggagcggttgtggcgccggcgcgcggtggtgcacgcggtgatgcagcgctgggatgacgcgaaaggctggagcggcaccccggcctggcgccggctgtcgggttggatgaagcccttcgagcggcccctggtgtggaaggaggaggtccgccttcgctacgccggagctttcagccgcgccatggggcagcgcagcgcctcattggattgggtgacgttcgccgaggaactgctcgtgcccgtggagtccctgcgcgcggacgcgctgccggtggatgaccacgttcgctgccaggagttctccaaggcccgtgcactgacggagcagctggaagcgtcgggcttgggcacgctgccgccgcgcggcgactgccccgccttcgaagcctgggcggagctggagtccctgtcgcacttcgaggtgctgctggtggcctccacgggccgtcagccggagtccctcttcggacacctgctgctgcgcccggtgtggcacgagggcgaggtaccacgggggcctaccttcgaacgggtggtgcaactggtcgcgctgacagggatggagtccaagggcctgggctacgtggtgaagggaatgacgggggcctacgacaccgtcttcctcacggggacgatgggcgacctgtcccacgaggcgctggagctggagcagcgctccatccgccgcttccgcctgcgcctgaagcccggcgaggaagcgcggatgctggagcgggtgtgggagctcgagcgccgcgggtacatgggctactacttcttcacggacaactgcgcgagcgcgctcgtcttcctgctcaacggcgcgctggagggggggcggcagctgcgtcctcccggcacgctttgggtcctgcccaccgccacgctggacaccctggcccgggtgcaggtggaggagccggggggcgagacgtcctccctcctggagcacatcccggatgcgttcgagtccaccggggaccgcgcggtgcgtgcgcgctcggcacagcaggatgcactggacgcgctggccggacatgtcggcgccgatgaactcgcgcgtctccggggcgtgcatgcccggttggagtcgccggagccacaggtccgcgccccggcctatgacgacctgcccggagtggtggccgcgctgatgcactcggcgaagacggcgtcccgcgacacggtccgcgcgcacctgcatgcctacgtggcgcacgcggtgcgggtggagcgcgccgcggtggaccgtgccgacggcgagcgcctgcgaatcgagcgcgagcggatgctcgcgatgaaggtgtcggttgcgggctcggcaagggccggcacggccgagcgccagcgcgtcttcgagaacgaggacgcgctccagcggaggctcgcggtgttggaccgcgccaccctgctgaaggatgcactggcctccgcggagcgccgtcctcccacgcccgaggaactgcggacgttggtgtgggccgagcgaaccgaggccaccttccaccgtgccaccgacgtgcagggcacgctcaatgacggcttgctggcgaccgtggacccggtggccttcctgcacgaggaccggcgccgcaaggtggcggcggagacggcttgggcggaaggcgcgctgcgggagtccggagcggggcgcgtgatggtggccctgggcgtggactttcccgaaggggcagcggcccggcccctggtggggctacgcaccgcgggcatggccgaggcgctgggcgatgcgcggctccacggcttccagccgagcagtgagctgcgggtgctcgatggcgagctgtttctcctgccgcgctggggggtgcccaaggtggtggcctcggacctgacgctgttgggctaccgcacgctgctgcgcgagcttccccagttccgtgactccttctgggattcgctcggctggggggccgaggcccgcgtggcgtcgagcgacgcgcgcctgctgcgctatcgcgcgtcggtgcaggcggaggcgttgatggtgctggacgaggacgcgcgcttctcgcgcttcaccacggtgggcgtgggcggcctggccgcggtgcactggaaccgggatgtgttgacgccggccgcggggccgcgcctgtcactggcgcatcggatggggctgttcggttcgggtgccaacgcggtgcggctggaggcggcctacgcgcccacctggagggtgggggacacacacttcacccacgaggcgggcgcggcgctccagttggaggtgtggctggggcgcgcggggcccttcggcgtgctcctcacgccccgcgcgcaggtccagtgggagggggcgatatcgcccacgccccactgggaagccctgtcgccgtctacgtggttggccggctcggcggagcggcgtctggcacttgggttcgaggtgcgctgacaggggcgggctcgccaattttgtagctcgtccagaacgggtggctgatggcccccgtcacggcgccgatgaagatgccgatgacgtagagcgccgtgtacccccagaagcccaggccatagaagatgtggccctgggtcgccgagccgatgaagaggaagaaggcgagggcggcgggcactgcgacggcggagagggcggccgcgccgagcgcgcgcggcagccttcgcgcgtggaagccgccgaaggtgccggccaggagcccgttgaacatgggcaggaagaacagggccaggctgatgaacgccatcaccagcgtgctcacgatgaaccggttgtggaccggattgatggtgtctggcttgaaggtcaggtccgcgggaatctcccggcggacgtactcgtagcgcggcttgggaccggcaagggccttctccgggtcctgcgtcaggatgcgctcgggcatgtctggctacctccctcgggggcaaatcaacgtgtgcttgatggccatgagtttgtgacgccagcgggtgcgcggaagggccgctggccgcatcggggggcgggccgcctgccgggccctggaattctccctccggaatactcgcggagtccctggatacccgagtcgaggggcccgaagatgcgcgccggacttggcggacggtggcctccggctatgctgccgcgcccggcagcacccccatctctgcccgtacggaattttccatgagctttcgccgcaaactgctgacccttgcccttgtctcttcctccctgctggccgcctgcgtcgtgcagcgtccgttctatcgcgacgtcgtccagcccgcgggctcctcggtggcggccggtaccctggtggacctcatcgtcctggactcggacaccaaccagcccgtgaagggcgccaaggtgatctggggcgaggactcccgttcgcgcgagtcctacgtcacggacgaggacggccgggtgtccttcgacgtgacgccggcgctgctgaaggaaaacccgctggtggaggtcgtgctgcccaggggcgttcggagctaccgcctgcaggtggtgcccgcgacggatgtcgccgcgcccgaggaggcggaggcctctgctgctcccgcgacgcccgaggctcccgccgtgccggaggagacgccggcgacggaggctcccgccgcggcgcctgataccagcaactgagtccgttctctcttccgcgcgaggctcagccgagcttcgcgtggaggaagtccacggtgcgctgccacgccttcgcggcgttgtccggtgagtagacctccggacgcgtgtcattgaagaaggcgtgctgtgcgtcgtagcggtgaatctccatggggacgccgccccccttcagcctcttctccaacgcgtccacgcgctccggcgagcaccattcgtcattgttcgcgtagtgcccgagcaccggcgcgcggatgcgtgacacgtccgcggcctcctccggggggatgccgtagaagggcacggcggcgtcgagccccggctcattcgcggcggccagcagcgtcagcgcgccgcccatgcagaagcccatgatggccaccttggtgccgggctttcgcgcgcgcagcgcctccaccgcggcgcgcaggtccgccgtggccttgtcccaagccatcgccttcagcatcgcgttggcctcgctggcgtccttcgtcacgcggccttcgtagaggtccaccgcgaagacggtgaagccttctcgcgccagccggtccgccacgtcgcgcgtgtggccgttgaggccccagtactcatggatgagcaccaccgctccgggcgcgtcgcccttcggggcttcactcagatagcccgccagtgcctggccctgcttgccgatgagctgcgtctgtcctgtcatggcttcacccttgcgaggttgtggaagggggcgcagcttaacggccgattccacgaacgcgcgcgcgaacccgccgccgtgcccgcttggcgacagaggactggcatgtcgaaggcattcacgaaggaggactcgggcgacgacagcgtgatgcccgtccgtccacgcgcgtcctccggggagaagcgctacatcaccccggagggctaccgggcgctccaggaggaactggcggcggcgcaggggccggaccccaaggcgggtgagttcacggagctggaggcgggcgtgcgccgcaaggagcgcgagcggcgcgtacaggagctggcggcggtgctggaggacgtgcgggtggtggagcccgacgcctcgcaggccggccgcgtcttcttcggcgcctgggtggaactggaggacgaggacggcggcccagtgcgctaccgcatcgtcgggccggacgagtctgatgtgaaggcggggcggctgagcgtggagtcgcccctggcccgggccctgctgggcaaggaagtgggcgagtccgtggtggtggatcgcccccgtggccccgtggagtacacagtgacggccgtggactacgccgcgtcctgagccgggctcagcgcctggtggcgatgacggtgctcagcacggagaagggctccggcatcagtccgtcgcgcacctcgacggtgaagccttccgtttcgagcagcgcgcgggcccggggcaccaggaacgtcaggtagtacatgacgaagggcggattccacagcgcgttgcgcgcgcgcatggcggcgttgaagcccttggccatccagtagcccgggcggagcttcgacggcgggtgcgcagtgacgaagaggaagcggcccccggggcgcagcgcgcgggcgatgcctttgacgagccttggctcgtcctcttcgaggatgtgaccgaaggcgccgaagctggtgacgacgtcgaacgcgccgtcgaaggggagcgccagtgcgtcgccctggatgaactccagcgccgcggtgcccggcgcctgcgcgagctgctggcgcgcctcgtcgagcatgccttggctgaggtcgaagcccaccacgcgctcccgcgcgagcggacgcaagaagcgcatggccgcgccggtgccgcagcacacgtccagcgcgctgtctacgctgccgggcgcgcccaactgggcaatggcggcctcgagcaccgcatccggcgtgcgaaagggcgtgtactcgaacttgggcgcgagcaggtcgtagccgtgctcgacggacgtgagggcctgcgcggccagctcccggagggtggggcccttgcggtggaacatggtgtctcggggtgtatcgcacccacaccggcccctccctctgaaaatgcggccggtatcgggcattgaatgttccgtggggggccccgtcagaaggttcaagcaggacgacggaggaggacgacaatggcgctcaagacgggtttcgcggtgctggctttcggaatgatgttcctcggctccacggccgcgcatgcgaaggacgacaacgagaagtcgcggttctcccagcagcaccggcatgacggccgcggcggcaacttcggtgtccacgtcgacgcccgccgccacccgggacccgcgccgctgccgccgccgcacgctcggggccgctacgaactgcagacggtgaaccgctgggtgcagggccgctacgagcaggtgtgggtccccgaggtgtgccgcgagcgtaacaaccgtcgctcacgggtgacccggtgcaccggcggcttctacgagcagcgctgggtgccggcccgctacgagccggtccaggagtgggtgtgggtgacctacgctccgggccgggtgcacgtggccagcgccggccgccgctagacgattcgaatcacgggggaccgcgccgcgggcgcgccgggatacgggggtagcccggcgcgcctcgcggcagcaggtccgcagtgcctttccccgccgggcctgttactgaatgcgccgcatggcgaccgcattcatcaccggggctggcatccgcatcggcagcgcggtggctcgggcgctcgggcgctcgggttatgacctggcgctccatgcgaaccgctcccttgagccgctggaagcgctggcggacgaactccgaggcctcggccgtcgcgtcaccctgcacgccgccgacctgagccgcccggaggcagtggactccctggccgcgcaagtacgtgaggcgtggcccgcgctggacgtggtggtccacaacgcgggcctcttcgagcgcaccgacttcgccgccatctcccgcgaccagtaccgcaccatgatggcggtgaacctggacgcgcccttcttcctcacccaggccctgctccccgcgttgcgcgccggcaaggacccgttggtggtgcacctcaccgacgtcggtggggagcggccggtgagtcactacgcgcactattcggtaagcaaggcgggcctcatcatgctcacccgcgcgctggcggtggagctggccccgcacatccgggtcaacgccgtgtcgcccggcacggtggccttccccgaggacttcgacgccgaggcccgcgacgcggtgctgcgccgcatccccatggggcgcgagggcaacgtcgaggacattgcccgcaccgtcgtcttcctcgcccgcgaggcgccgtacatcaccgggcaggtcatcgccgtcgatggcggcaggagcgcacagctatgagcgccgaacacgcattccatccccccgtcatcacgacgccggacggccgcccgctggacgtcatcgagattcggggcctcacggtggactgcatcgtgggcatcttcaacagggagcgcatcgcggcccagccgctgcgactggacgtggccctgttcctggacacccgcgccgccgcggtgggaggcaggctggcgcacacggtgaactacggccggctcgcgggagagctgcgcttcctgctggaggcctgccgcttcgaactgctggagtccgccgtcgagacggtgtgccgctacgtgctggcgccgcccaccgacgacgtcccgcgcgcgcaggtccatgcggccacggtgcgggtgacgaagccgctggcgctgggcgggttggcggtgccgtcgctccagattcaccggacggccgcggagatggtgtacggccgggaggagaagggctttggccgcgtggacatcatccacgagggcgcgggctatggcgtctaccggctgcgggtgaagccgggaggctgcatccccacgcacgcgcaccagcagatggaggagagcgagctggtgctgggctcggggctgctgctgcagttcaagccggtggcccggggcatggccttccactggccgcgcggcttcctgcaccgctacgacaacccttcatccacggagcagacggtgctctgtgtggacaggccgggcttcatcccgtcggatgaggtggagaccgagccgccgccggaggggctgctgcccgtcaccggccactcctattacccgctggatgagcccgcggcgccgggctctctcgcggagcaccaaccgtgagcgggacggtgtcttcaaggagcgccttccatgagtgaggtgggcacgcgcaaggtgctcgtcactggcggtgggacgggcattggtcgcgcggtggcggaggccctgctgcgcgcgggggggcaggtggtggtgtcgggccggcgcgtggaggtgctggagtcgctgacgacagcatggccgggacaggccttcgcgctgccgtgtgacctggcctcgctggaagcccgcgaggggctgcttcgccgtgccgccgggttgctgggagggctggacggtttcgtccacagcgcggggcaggtggtgcaccagccgccgggccacatcggcgaggacgcgcttcgcgcgcagctcgaggtcaacctcatcgcgccgctgcggctgggcgagcaggcactggaggtgctggagccgggtggggcgcaggtgttcatcgcgtccacgctggccacgaggcccgtcgtcaccagcgcggtgtacagcgcggcgaaggcagggctccttcaggtgatgaaggtgctggcgttggtgggtgcggcgcgaggcgtgcgtgccagcgcggtgctgccgggcgtggtggagacggacatggtgcgcgaggtgcgcctggctcccggcgcggggccgctgtccgagcccgagtacgcgcggcggcaggaggcccagcttgcgggcttgcgggcgctgcatccgctcggacggttggggcgccccgaggacgtcgcagaggcggtgcgctacctgctgggcgcgtcgtggatttccggttccgagctggtgctggatggagggctactgctgcgggagtgaggcgcggtatgaggtggcctcggctcacgagaacgacgggatgctcctcgacagacggcttcagctcttcgtggtgttggtgggggtgttcgtcacctcgctggtggtgggcgacatcatcagcgtgaagctgttcgaggcgaaggtggggccggtggtggcggtgatgtccatcggcatcctgcccttcccggtgacgttcctcctcacggatatcctcaacgagttctacgggaagagggcggcccgcttcgtgacgtgggtgggcttcttcatggccatcttcgcggtcgtggtgattgccatggccgtgcaggtgccgtgggcgccgctgacgcgtgcgccggacttctcgggtacggtggaaggctcgttcaacaacgtcttcgccggctcacagcgcttcctcgtcgcgtcgatgatggcgtacctggtgggccagttctgcgacatcgccatcttcaacgggctcaagcgactgacgcgcaaccggttcttgtgggtgcgggcgacgggctccacgctggtgtcgcagctcctcgacacggtggtggtgcagtacgtggcgtggacgggcgtgctgcccaactccaccatcctcggcatcatctacacgtcctacgtggtgaagttgctggtcgcggtgggcctgacgcccttcatctacctgggccacgccttcgtcgagcgcaagctgggcatcgcccccctggtgctgggggagaacggtgaacccattgccccgcccgcgccgcccgtcacccaggaggagcagcctcgcgccgcctgagcgcgaggggcccagcggttcagcttccctgccgtaccagcggcgtgaggatgtccgtccagtgggagaagatggagaagtgtccgccgccggggaagaagcggggcaccgcacgcggaatccggttcgcgaggtaccgtcccatctgcggcgggacgatgctgtctccctcccagtaccagaggtccacctccgttcgaatctcctccagggggacgttccacggctgcgcgaggatgtgcgcctcgcgccgtattcccgccacgcccttgcgcgtggcttcgtagcgccagccctgcacctgcgcggcgatgcgcgggtccgcgagcaccgcgcggtcatccgccgacgcctgggagcgcaggcccgccagcgctcgcgagggattggcgcgcacctgccggtcatgcatggccatcaatggatgcagtagccactccggccacgcggccatggcgtacgcgttgcggtagtcccggttcacgccctccatggcgcccggccgggccaggggcgccgcgccggagacgagcgccgcgcgggtgatgcgctcgcccagcttccacgcggacgcggcgacgtaggggccaccggcggacacaccgaagagcgcgaagcggccaaccctcagcgcgttggccagttgctccaaatcattcgggaagtcgagcagcgtgcgcccaggctggtagtccgacaggccatagcctggccggtccggagtgatgaggcgcacgcccaacgcgtgagtgagccggtcatccgggtggcgcatgtggcgcgagcccgggttgccgtggatgaagaacacgggcaggccgctcaagtctccagactcgacgtatgcgagccgccggccatcccgcaggcggacggtgccttcgcggacctgcacgcccatggcttcggtgtcggacgaggcgttcatggttccatcggtttcgagcgcgcgccaatccacgcggaaatagagggccacaccttcgtcgcgcccttgctggaggcggacaggccaatgtggcccacggggtagcgccgcgtctcacagtccttcgagctgaccagggagggcagcggctcgctcatcgccggcagcgcgatggtgtcgtgctcggcgatgacattgaggatggcgcactggatgcggcgcaggtccactcgctcgccgcccacttccatgaggccctgggggaagaggttctgctggtagcagtccttgatgtactgccggtacacctcacccgggaagggcacagggtccgcgccccagcgttccatggccagaaacgtggtgacgaactccgggtcgtcgatgcggcggcacacctccagccaccgggtgaggcgctgcaccggcgcggccatgaggaaaccgctctccagcaccggcgtggggacgttgccgtaggcgtccaccagcgagtccacgtcgaagtggttggcggacgtccacagcgtgtagaggccgcccttgctgaagtccaccggcgtggcctgggccacgaggttgcggacgccctcggggtacagggacgtatacgccagggccatggtgccgcccatgcagtagccgtagagcgtcaaatcccggctcttgctcacgcgcagcgtccacctcaccgccgtctggatgagcccgccgagcaggtcatcccaggtgagccgctcctcgtcctgtcccggtacaccccagtcgatggcgtagacgtcatatccctcgcgggtgaggtgctcgatgaggctgcgccctggaaggaagtcgaggatgtaccagcgattgatgagcgaatagacgaagaggatgggcgtgcggtggcgccgtcgcggggccgcgtagcgcagcaggcgcatgctgccgcgcgtgtacacgacggtgtgcggcgtggcgctgatgggcggctcgcgcacgcccgaggccctttcgatgaagggcttgaggtacgggtacggattgaagggccgcgacttgagcgcgtgtgcgacggcgcgggtcagctcgacctgcccggtgacgaaggagcgaagacgctggggcgtggacgcggtcatgtcagcggcggcgcttggagggcgcgcgctccttgggcgggggctcgggggactcaggctcgggctccgcgccttcctgacggtggagcaggtccaccaccagttccaactgggtgccgagcgcctccacctggtcattcatccggcggagctggtcgcgcaggttctccacctcggaggtggtgggcaggcgcagggtgcgcagcgcgccttccaccaggccattgcggcggatgcgggcgttgaatccctggcgcatgagggagccgctcacgcgcaggtacgcggggctctcggtgaccttggcggccgcgcgggtgaggccctcctcggcgcgggtgaagaccttgccggtgcgcgtgtccgggtgggtgaggtggcccagcagcttcagtccgcgggcgaggagcccctgggacggcggcggtcgttccggatgactcatggccggcaggttatctcaagggcgcggcgcagggacggccgcacctggctctatcgttcccaaagtgaaccaagaattaacttgcgtgcctcgaagggctcggcatcgacatgggcgctaccggtgtacgcgtccaggcgctgccaggggttgccttcccgacgatagacctcgagcaactgaatgcgcgggtccgcgaaccacagatggttcacaccctcgcgggcgtagagcgtcatcttcctcgaacggtccagggcttcggtggagggggacaggacttcgcagagccagtcggggacgagctccacgcccgtcacgtctggaatctccggcatgcgttcgcgccgccacccggcgaggtctggcacgagcacgttgccgcccaggtggagctcaggcttcgggaggatgacccagccgcccgggccttccgctccgagctccgggtcgaacggcgccagttgctggctgcgccgggaggacctccggggtgcagggtactccagaggtcctcctggctcagccctgtcgcttcaccgggaggggcccgaaggactgtgacaccggcatcagcgacatgacgttgatgttcacgtgcgcgggtcgcgtggccacccagtgcaccgcgtccgcgatgtcctcgggcgtcagcgcctgggtgttggcgtagacggacgcggcgcgtgtgtcgtcgcccttgaagcggacgttggagaactccgtgccgcccaccagcccgggctcgatgtccgtcacgcgcacggcggtgccgtgcaggtccgcgcggaggttgaggctgaactggtgcacgaaggccttggtggcgccgtacacgttgccgcccgggtagggccactccgccgccaccgagcccatgttgacgacgtggccccggttgcgcgccaccatgccgggcagcaccgcgtgcgtgcagtacaggaggcccttcacgttggtgtccaccatcgtgtcccagtcctccacgcgggccgactgcgccaggtccaaccccagcgccaggcccgcgttgttgaccagcacgtccacctcggcgaactccgccggcagcgagcggatggcccgctccacggcctcacggtccgtgatgtcgagcgtcagggggagcacccgctcgcccaactccgcgcgcaaggcctccaaccgctcggtgcgccgcccggaggcgatgacgcgcgcgccgtcctggatgaagcggcgggcaatggccaggccgaatcccgcggtggccccggtaatcagaacgttcatggcagtcccctcgtggagccagccccgcgagggcccggcttgtcagtcgtcttcgccttgatagatgcagccactggtgcacgtctcgcggaccaccacccggctgagcaggggcaggcccggacgcaggcgcttccagatccaccgcgacaggttctcgctggtggggttctccaggccttccacctcattgaggtagtagtggtccaacttcagccgcaggggctcgaaggcctccttgatgtcggagaagtccatcacccacccggactgcgagcccaccgggccacgcacgtggatttccacccggtagctgtggccgtgaagccggctgcacttgtgcccgggcggcacgttgggaagccggtgcgcggcctcaaaggtgaattccttgaagatgtccaaggcgtctcctgacagcgggtggaagcgggctcatatcccgcgcgttcctcctggcgtcaaggtacgccctgcctccctgaaacaccggcatgtctcgcctcgccgcgcgcccacgcgcccggggaggcccggctcggcccttcgctctgtgtgaaaaatccccgggaatattcccgcgcgcgttgcacacatcacacttcagctccccgcgacggcccacctgtcggtgatgcggagcatccgtcccaaccccgcgaaaccacgtttcctgcctcctccctctacgtcccggcaggcaggggttgccgcgagcggagggaatgaacagcgcggggctcggaattggcggccgtcctcgcgagcgcctcccgcgccgcgacccacaccaggagtccgccaggatgcgcaaccgctcgccgtggttcacggccctctgctccgctgccctgctgtccttgttggcctgcgatggcaagggggagctcacccaggaaggtggctcgcctccgggctccagcgagacgccgtcgacgggcaacccgtccgttcctggcacgcctcccaccaacgatgacgacgacacgacgaaccctggaacgccggagcctccgccggtcatcgtcgacatcccggatccgccccctcagcccgagccccaaccccagccagaaccggagcctccgcctgaacccgagccccagtactcgcgcatcctctgggtggcgcccaacggcagtgacagtgcttccgccacggagatggcgccgctgcgaacggtgacgcgcgcgctggcgttggtgcggccgggcgaggccatctacctgaagacgggcacctacgccgagcgcctcaagctggaggagaagggtggctcggcgtccagcctgctcacgctgcgggccgcgccgggcgcgaagccggtgctgaagccgtccggcagcggctcctccatggtggacgtgcgcggtgcgtactggagcatcgaggggctcaccatcgacgtggcgggcaatgcctccttcgcggtgctgttccgcggcgtgggtgcccaccacggcgtgctgcgtggctccacgctgaagaacggcaccgcgggcgcgggcgtcaacgtgtgtgagaaggccagtgatgtcctcatcgagggcaacaccatctcccacttcaaccgcaacggagatgacagccacggcgtcatcgtccagacgacggcgcgcaacgtggtggtgcgtggcaacgacatccaccacaactccggggacgcggtgcagtgcatcggccccgagggcggcgctaccatctccggcacgcccttcgacaacctcctggtggaggacaacgagctgcacgagaaccgtgagaatggcgtcgatgtgaagacgtgcactcgcgtcacgctgcgcggcaacatcatctggggccacaagatgtcatccacctcgcgcggcgagggcgtggtggtgcacctgtccgcgaaggacgtcaccctggaggacaacgtcttctacaacaacggccgcgccatcagcatcggcggggtgcgccagggctcgccgcccaccaacatcgtcatccgccgcaacctggtgcgggacggcctgggcggcggcgaggagggcagcggcatccgcgtggacacgacgtcgaacgtgaaggttcatcacaacaccgtctggaacatgcccgggccgtgtctcaccttcggccatggcgacaccggggccagcgccagcctggatgtgcgcaacaacgtcttctccggatgtggngtggcngtgcgcggcggccccgggcgctcgggggccgtggtggacgccaacctctacttncgcaattcgggctcggccctctccggctgaacggcgtggacatgggcttctcgcagtggcgctcgc

SEQ ID NO: 1274 - DNA, 707 bp, Myxococcus xanthus
gagattattagtgagctattttagagaaattgtcgaaaaagaagggcatatgtaaaaatagatttactaggagaactattgggaatcatggagattttcaatagttcttttgggttacagcccgttgaacaaaacatggttatatcgtttattgatgaattctcataaaatgttacataattataagtaaaagaaattatttcatgtttttatataaatgctatcatgaaatgacatttttcgatataatatcacataggctttatttattaagcatgtcatataaaggagattttctgcaatgacaaacaaattgtgtgtagttggtttaggatatataggtttaccgacagctgttatgtttgccaatcacggcttatatgtacatggcgttgacctaaatgaaatagcaccacaattaattaaaaataagcaacttcatatagaagaaaatggcttacaagaacgtttagaatcagcaattgacaaccgccactttacggtaggcacaacacctgaagaggcggatattgttattattgctgtaccatcaccaagtaatgaagataaaacggcgaacttgaactatgttcgacaagcgacaaaatcaattgttccttacgttcgtaaaggaaatttagttattttagaatccacagttgctccgcgtacagttgaagacgtgtgctaactgtgctaaaagaaac

SEQ ID NO: 1275 - DNA, 556 bp, Myxococcus xanthus
atgcgccgaggaagaccaatgtgcatccacaaaggcctggctgaccgcctggcttccaaaggaatgtccggttgaaatcggacactgtgtgcaaagcgcgtacaagcgggcaccggctctctgttcactcttaagggcaccagaacgccatgcgcccaagagcctgatggggagtccgctcaagccaagctaacacataggatgcatacttgtctgcggcacccgagtgcgatggcccgtgcatcgaccaccgtcacgtcacatgcaccaccatggctcgcggctgccgatacacccggtgcacgtccacaggcagttcatcactctccaacgactgggctttgccctgctcatcgccatttacctaaccctgccactcgagcacgcggacggccaccctgccgtacacctgcacggactggtgcgactgttctacctctctcgtgagatgcacaatgggcacgacattgggctcgtcctcgttctgacatcggcgaggccttcgccctgctggtcatgaccgtgtggctggtacgcgacaggcgctgctgggcgc

SEQ ID NO: 1276 - DNA, 372 bp, Myxococcus xanthus
ctgcactccccccggaacatgggctgatcctactacatcctggcccgacaggaggactactatcgagcctcccaacaggacctcccgttggcactcctcgctgatgcgaactcaccttgaacacagggtgcgcttccacatgcggacggcgatctccggactcgagcccgcgccgtcctggacgagtcctaagaccagatggtcctcgacatgccccatcggcctaggtatggctcctctacatatgctcctgaccagccgaaagagccgggtggatcccacacagtggtgagcgagggtccccgctctctggcatcaggacgtggaggcccctggacgaaccgctggacatggaggacgagtgcggtggcc

SEQ ID NO: 1277 - DNA, 570 bp, Myxococcus xanthus
  unsure (1)..(570): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1278 - DNA, 117 bp, Myxococcus xanthus
ggctcggcattgatggccatcccggggtggggccctctgtgaccgacgactcgacggcacatgtctcccatgtggcacgcagagctaagccgaactttccaaagggcccccttacac

SEQ ID NO: 1279 - DNA, 599 bp, Myxococcus xanthus
gtaagtataaaaagtaaataagtgcggatatccttagttacaaagtatacaggaagaaattatgtaaatggccagccaattcaggtatttttatctcatccacttgtttataatacaaacaaaaacgcagctgcaatggctgcgttcatgactgttatccacattgttctatctcatctaatcgcacaagttcgactttaaaagcatgatcaatcggtcgaatttcacagtaccctgaatcatatacgtgaatcagtacaaagcgttttcctttatatagcacttctttgtaggctgtcacgagatacaccctttcttttcataagtttgtttttcattctatgaacaaaaaacgacgtaattgcctaatataaaaagaatttttaaggttgataaaattgcttggcaaaacaagttcgcttatactgtactgtgattctatttacgtataggttctgattaagaacagctttagcatatggataacgaaacaaaacagtagtacataaggagcagtacatggatattaactatttatatacatttaaagaagtagcgaagtgggggagctatacacgaacgggcgaggaattagggta

SEQ ID NO: 1280 - DNA, 1039 bp, Myxococcus xanthus
  unsure (1)..(1039): unsure at all n locations
aaaaaaaaaaaaaaaaaaaaaaaaaaaaaaaaaaacaaaaaaataaaaaaaataagccttcaaaaaacttaaaaacaaaacaaaaaataaaaaaaaaaaaaaaataaaaaaaacaaattaataaaaaaaaaataaaaacaaatataaaaaaaaaaaaaaaaaaatattaaaaaaaaaaataaaaaaaaaaaaaaaaaaaaaaaaaaaaaaaaaacattataaaaaaaaaaaaaaaaaaatatataaaaaaaaacaatacataaaaaaaaaaaaaaaaaaataaataaaaaaaatcaaaaaaaaaaaaaataaaaaaaaaaaaaattaaaatcaatcataaaataaaaaaaattaaataaataacaaaaaaaacaaaaaattaaaataaaaaaattaatttacaacaaaataaaagaaaantaaaaaaaaaaaaaaaataatatgtaaaaaaaaaacaacaaaaacaccaaaaaaaaaaaaataaataaaaaaaaaaaaaatgaaaacaaaaaaataaaaataaaaaaataaaaaaaaaaaaacaaataaaaaaaaaataaaaaaagataaaaaaaaaaaaaaagtaaaatacataatttaaaaaacaaaaaaaaaacnccgcataaaatataaaaataaataaaactataaaaaaacaaaaaaaagtgttttttcttaaaaaaaaaaaaatctcccctaaaaacataaaaaaaaaaaaaaagaaattaacaaaggctctaatcaacaccccaatataacaaaaaatcctaaaaacaaaaaaaaaatataaaaatataaaccttctaaaaaaaaaaaaaattaaaaacactaaaaaaatgagggaaaataaaaaacaaaaataacttaaaaaaaataaaaaaccaaataaaaaataaaaaaataaaagaaaaaaaaaaattacaaaatatccaaaaaaaaaaaaaataaaaccataaaaaaaaaaaaaaaaaacataaaactaataaaaaaaaaaaaaaaaattacaaaaaaaaaaaaaacaaaataaaaaaaaaaaaaa

SEQ ID NO: 1281 - DNA, 171 bp, Myxococcus xanthus
gggaggcgccactgcctccggacgcacggcgagtatggggggtacgcacgtccctccgtagtttaggacgggcgtgcgctgcaccacctggaggaggccctcgagcaccgccagaccatttagccggtgccgaaggtcctcgccgccaacctcgaaggtggccgcatggag

SEQ ID NO: 1282 - DNA, 569 bp, Myxococcus xanthus
cggcgtattttctgtgcggtgaaaatagtgttcaagcgcatgcgacatactatcaacaattccattgactgtttggtcgcgcggcactgaaaacgtgtacgccggatctaagatagaaaagacgggaaatacatgagaagacgtccaacctagcttttcttttgtttcccaatttgtaataacagaagttgaattcatttcagatcctgttgccgcaagtgttaagaccgttccaaaaggaagagcacctgtaatctctactttgcgtgtaattaagtcccatgtattcccttcgtacacggctccagctgcgatagcttttgtacaatcaatcacacttcctcccccaacggctaagagaaaatcaatgttttcttttttacatatgtcaacgcctttagctaccgtagtcaaacgagggttcggttctacaccagacagctcgtgaacaactgcgttaatagactgaagttcagctttcacttcgtcgtatacgccattttgtttgatgcttcctcctccgtatactaacagaacgtttactttgttagtgtaagaagcaagctctt

SEQ ID NO: 1283 - DNA, 660 bp, Myxococcus xanthus
gtccccaaagaaaacaagtcagcgtctgtatggaaagcatattcaagcaggcgtttcgagaatggagaaatttgaagcctgtccgtacgctcattttgcttctcatgggctcaaacttaaagaacgaaaagttttcaaattagcagctcctgacataggcgagttatttcacgcggcgctgaagatgatttcagacgagcttcgcggcggtcaaaaagaatggaagaacttaacgagaaaagactgtcagcagctttctacggctgcggtgcacgaacttgctccgcgcttacaaaacgagattttattgagctctaatcgtcaccattatttaacgcataagctgcagcaaattattgaacgggcgtcgcttgtgttaagtgagcacgctaaggtgagtgggtttgttcctgttggattggagcttggatttggacctagcgcggagctgccttctatgcagttcacactgccaaatggccatacgatggaactcgttggtcgaattgacagggtagataaagcggaaagctctaaaggacttttactgcgtattgtcgactataaatcaagcgataaagcattaaacttagtggaagtgtactacggtttatctcttcaaattttagcttatttagacatagtcgggacggatgctga

SEQ ID NO: 1284 - DNA, 590 bp, Myxococcus xanthus
actacagcaccgaataaatcccatcgtcaaatgtgcatcatcaatatttaagttaacgagttcagatacacgaattccagtagcataaagcaattcaagcatcgctttgtctcgtatgccaaaaggcgtcgaagtatcaaacacatttaacagcgcctctacttcctctgcatttagcacttttggcagcttgcgctcaagctgcggagtatcaatatgaacggatggatctgtatccgctgctttttcccttagtaagaattgatgaaaagatctagttgaagccacatgtctcgcaatcgttttagatgatttttgctgatcacttaaatatttcagaaaattaacgatgtggagtcttgttacttcattaaatgatttcagctgctctacatgctctaaatattgagcatacttttttaaatctcgttcatacgaatcaatcgtatttttcgccagtccccgctctactactaaataatgaataaaatcttgaatttgatcattcaatagcctctactccccgttttgataaaacataaataaacgctccagccacgtctgatctttgttcacacttgcttgcatga

SEQ ID NO: 1285 - DNA, 651 bp, Myxococcus xanthus
ctctaaagatcattaaagataaagcatatcgccagcagatcttaaattcactgcctgttggaattatcacaatagaagatgagacaaatagtatatttgctaatacctcagcaaaacagtttttagatctcgatgaaaaggatatttgccggtatatgaaggaatgtcctcaatataatactgaattttggagcatgttgaattcgggagaaattcacgaaaataaaaaagtattatttggaacgaaagagacgtgctattgctttttagcctctcaaacgcagctgtttaatgagaagaacgaaagcattggaaggattttttatttcattgatatatcggataccgaagaattagaaaagcgaatgcatcagtctgagaaacttgccttggttggagaagtggcagccggagctgctcatgagattcgtaatcctcttgccgtgattcatggatttatatctcttatgaatcagtctctttctgatgaggagaaaaagcgtttttacctgcctctgcttatgaaagaactagagaggattaattacatcattgaagaaatgctgttgttatcaaagcctgggactccggtgatgaaaaaagtcagcatgcaggatattattaatgagttattgcctttgattactcact

SEQ ID NO: 1286 - DNA, 649 bp, Myxococcus xanthus
  unsure (1)..(649): unsure at all n locations
tgaatagacatgttttcttttctcttttcactttccgttgttacgtcatttttcatatcaaacgtaaatgcatcatcggtagtgctatcggttaggactgctttgaactgcttagccgttttgttatcttcatacggaatatttttagttacgacgttaagttttcctttatcgttagaagcattttttacgcccatgttcatatcgcgagctacaacaacatcatcttgaacgtacacagttgatttaacaccgccagggtaagtcgtatcttttgcttctttttggaagtcttgaagactttcttttactgattttttcaattcttttggatctgccatatcttttaattctggatttgtcgctgctgaagatttaaacagcttagacacgtgatttgcatagatagtatgaagcttgtcatcttttgctacctttgcaataagcttatccataaattgttttgtttctttgtcagacatgttaagcgtcacgcttgttaactgaagcgttttgccatttgttttataatctacatttttttcttttgtaaaataatcgctgtctaactgatcataaatgaaccgttccgactcttttgcaatgganggtttttatttttccgttaactttaagtcttctaaactta

SEQ ID NO: 1287 - DNA, 711 bp, Myxococcus xanthus
caggggcccttattaatttatgaggacggacgccgcttacgttagcgggacttatttattatttgtttcctgcgtttagcgaatgtaaattagctaaactgcacgtatggttgcataatataggattaccggtcatgatgattggtttatttctcatgatcgtactagaaaaccaagcttttacacccctagtggcagtaggagcaacacttacggctattggcgttttaattttcgtatatcacatccttaaaaatttgaaacctgaacgataaaccaagaaggtcgttgacgatggctgctaatttcaaaaggaaaaagaaccagctatagcgaatatacatgtaaacaaggtgaaagtgcgatttacataaaggtgtgctaggcatctttataaggaggggtaagctgcaggaatttctagctcttataaaagccaataaaagggctgattataagtttcttgcggcggagatactatgggagaacatcaacaattagtgcgtgttagggagctagcaaatgaaattattcgacttcgtcttcaagaccgtacgacttatgacgaattagagttgcaaaataatgtagagttgttgtctcgttctgtggttgacttagtaaacattatgttagccgaagatgtggattcgtctacttctttaaaagctacagcttctaaaatgaaaatggtgtataataacatgcatc

SEQ ID NO: 1288 - DNA, 606 bp, Myxococcus xanthus
gggacaaagatgatgctgcacaaacgaagtacgtcatcgaacagctgaccgaaggtaagcttcgcaagatcatgaagccgctttacacgaatgaagagaaagctaaacagctgctgcagcaaaataaagtggcagccattgtaacgctgccaaaaggttttagtcacgatattgctcatgggaaaaatcagcctttacacgtcattggaaacaacaataagccgcttcagtcacagctgtttcgctacgtgatggaaagtgcagccgactacacgtcagctgctcaaagcggtattaatacggttgatgcctttttagaaaaagaaaatgtttccgatgaaaagagacgcgcagaatttaagaagagcttagtaacgtttgggcttcatgtattagatagaggaagtttatttgatgaacaagtagaaacgagtttctttcagcaggatatgaagcaatattatgtgctgtcttttgctgctttgctgcttatgatttggagctaccgcggatggctgcttgctagtgaaacgcagacttctcccgtgctggatcgaatgaaaacaagaggtgtatcgtttcttcgcatttatttagcgcagctga

SEQ ID NO: 1289 - DNA, 770 bp, Myxococcus xanthus
caaagaccagccagccctcagtttcatccagcggctacaatttttgtgatttcagattttattggccgtcccaaccgtttgtctccagcggatctaaaaaaatttgttgattcaggatttttttctattcagtctcataccgctactcatccggatttaactaagacgaaaaatttatcctatgagctagctgattcaaaacgaaaaattgaagccattacgagccagcccgttattgctgttgcttacccttacggaaaggtcaatagccgcgtagtcgaagaaacaaaaaagaattatacatttgggctttcaacgattccaaaattttttactgaaagtggacaaaaaaatgaaaactatcttattccccgtctgtacgtcacgtattctacaacgattgaggattttgctaagctattaaaagaaagctaaaaaccctttccttaaaaggaaagggtttttagaattttgttatttctagtcctcgctcttgctgccattcagcataaaaaacttcgctgtattcctttattttcttgattgccagctgtttttttaaccacttttcatctacgtttgcttcttttaaattgccaggcactacttttgcatccatgattaaagcaataggtaaattaagttgagaataaaggatgtttaaatcatttttcgtcggagggccgaattcatgtttaggagcgacgctcacctctccattcgttttaaaatgacatattctgcttcatacagtgaaaaatacccttgct

SEQ ID NO: 1290 - DNA, 274 bp, Myxococcus xanthus
tgttttcggagacactgcacacacataccgtatcccgacacaccaactccaccaccatgctgaagatagaactcttcacccaccgattgggtcccataaggcacaccacttcaccggtggtcacggtaggggaaacaccggacaccacctgcttgatgcctcgggaactgttctacaggtgctatgagaacagtcacgagatcatcgagccgggcgaccctgcgcgtagggggcacgtccgaaagaacctgcctgactgggcgcggagtgccca

SEQ ID NO: 1291 - DNA, 235 bp, Myxococcus xanthus
acgagggcgggcacttagacggccgttggaaacaacaggcactacacttttgggcacgcgacgcagggcaccagcccaaagggcggacttaccatatccggaacggcctgctataaaatcctggtggatgacaccgagttgccagacacccgagaaaacggccctgatgcgaagacgaccactcgcgtcacactggaggggaacataatatgtggacacaaaatagcatccacct

SEQ ID NO: 1292 - DNA, 115 bp, Myxococcus xanthus
ccgcccctcgggccacctgaaggcggtgggcctcggatgggccaaccacttgtagttcaagcagctggtgcacttggctctcacgctggcggtcaaccccatacctacggttcgt

SEQ ID NO: 1293 - DNA, 585 bp, Myxococcus xanthus
agaatcttcgagaagatttatattttcgtttaagcgtcgtaccgattaccattccatctttgaacgagcgccctgaagatatttttccgctgctcacacattttgccgagcagtttgaaaagaaatataaccgaaaaagaacgtttgataatgcggttattcacgcactgctttcccacgagtggaaaggaaacgtacgagagttaatcaatgtgattgaacacgcggtggttgtatcttcacaaacgctgattacaatggagcatttgccgcattctctgcataggaaaaaacgggttcagcacgttgaagaacatggggaaatgaagcttaatgacgcgttaaacgagctggaaaaagagatattagtaagagcaaaaaaacagtataaaacgacaacagaaataggcgaagcactcggaatcagtcagccttcagttgttagaaaattaaaaaaacattctggtttttaacgtctttggcacgctctttgcatgtaaaacaagtacaaacacattacttgatagattgcgaggaggaaatcagatgacgcaggcatcacttacacagttaatgaacagttta

SEQ ID NO: 1294 - DNA, 349 bp, Myxococcus xanthus
gctcttaccgcggggcacccggcctcatggacgctgttcctacgccaagcgggggctacccggtgacccgccgggaccccgacgagggcacggaccccgaacgccccaaccgcctgggttgggggagacccacgcatggacactctcgcgggcggactgtggccgtcatatgggccacatacctcttgcatttcgaaggaacacactttgaagccgataccaaggccgcccaacaggggaacgccctgggatcgaccccggagcgccacaagcgaagctactgcttcgacgcgcctctcccttgcgcacctcggcggaggtcgccccgcaggcttttggatgcgaggac

SEQ ID NO: 1295 - DNA, 574 bp, Myxococcus xanthus
  unsure (1)..(574): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1296 - DNA, 500 bp, Myxococcus xanthus
ccatcagcaacgagaacgccgtgtgcttaatcaccaccacgacgaacatcacaaccaggatgtcatgggcaagcacggccagcaccatggacacaagcaggaccccctggaccattaggcgactcacggtgtgcataagcacagaggacatacctgccttttctttctctgcgagcacttgcggaacaggatataatcactcaacccctacctcaccagcacaggggcctctcccacagtataggactctcagaggagcgccaggatcacgtgaactattttaagtccattgccagccgccacgctgttctttgcgtacatggcctgcttcctcctcactgagggcgcgcatggctcgtgcgataagatccagctgttcagcccggacacctgcacgggcaggtccagcgggcactaccgcatgacggtgatcatgctgctgcccaccgcaagtgctagaagacgagcgcaatacggatgacggagatagtctgcacctc

SEQ ID NO: 1297 - DNA, 438 bp, Myxococcus xanthus
ctagcccacgaatctcatctgatgtaaggccaccaccgagcggacttatatgccgtgtgacggactacgtcgctcttcacacgtggccatcttcgtctacaatgacgacaggaccgccttgaggaacttctgcacctagcgcataagctacaacctgatgctaggtcatttgggcaacaatccatctcaactcgccatggggctgggcacaccgggcatcaagggcctgaccgcccaggacgcgtgcaggctgactacctagtcacctaggacaccttgattcagttaggcgctatcgtcatgaccgagtctatcgactttgataaggacactggatatgcggatgacacccgcgcactgacgcagcagattagaacatcagattacctgccgagcctgaaacgagacgggctatacaactgaggagggcgtgcatgc

SEQ ID NO: 1298 - DNA, 329 bp, Myxococcus xanthus
ttctgcctttgcctgcggcgcaccgcctacctcgcgtgcaaagagaacggcgacgagggcaccgcgctctcctaccccatgatcggacagaagaggaccttcaagctgttggaggaaatgtacgggcgcctggggacgctggacaccagctacttggtgttgcccgcgatggaccaccgcaacgcgctcgactgctataagggactggagccactgtcccgctcctagagccagccgatgctcatgctggacatgagcggggtcatcggaaagtgcacgttgcacataccaccgcttgagcgtgcccttcaaggcggacgtgctgggcc

SEQ ID NO: 1299 - DNA, 592 bp, Myxococcus xanthus
aaaccagaaacacacgccctactgcaagcgatcctgtccagttaaaggcagatgaatttccagcaccgattccgcgcacagaaagcgggaaaatggctgctaccatgatccacgtaagcggcgcccaagaaaacgcatagcacaggataaagcaggaaagtgcaattaacgtaacccagttaacaacggattcattaacgcctactgctccaagaatagccggtgtaaaaaaggaaagagccattcccgctccgccaaccgtaagaatggtacggcggttgaatttatcaacaaactgcagaaaaataagtgttgtcacaacgaagattaccccaacaataaccgtaaaaccagcaggctacctgcggcgctaaaccaacttgacgggcaatgcttgttgcataataaataattgaggtggagccttgaatctgctgaaaaggtgccattccgacaccgataattaaagctaaacgaaactttttctgagacagctgtttaatgcctgaatgttaatgcacaggtaccctttgaatgtcaaatactttagcttcgactttccgctgctgaggaacgaaacgtgcgcagaact

SEQ ID NO: 1300 - DNA, 87 bp, Myxococcus xanthus
  unsure (1)..(87): unsure at all n locations
cattcaccccctcttgccccacgttaccctgtagcacctcgttgagaacatggcgctcacngttttttaacttccccctcctcaccg

SEQ ID NO: 1301 - DNA, 626 bp, Myxococcus xanthus
aggatttgtttacctgatgcatggaaagtagcttgttgctggagtgcgtgtcatgaacactgcgggcgcattgctctagccgagtgagagcgactgtgcactacaacctgttctgatgtctctgcacccacccggagaagatggacgtggaagagaccgatgaaatcatccagtcgaatgcggaaggtgcggacgcccaccttagcatgcatctcaccttcgcgaaccatggccaatacaacgatgacttgtgcgagctccatatggtcatggatgtgaactccgaggatacctatctccggcacaagcttgcccatctgatgatcgacgaagcatactacctgtctgccatcacctaggctaatgatgtgaagcgcctgtagccctacaacttcgatgcgcatctgaaatagaccgtctactatgcacagaacggcttgtacacgaaggcgaaccatgcctatgatcgtgcgctggcactgaacatgaaagacctgttgatgaactacaacgtgtgcgtgctgtacgatctgtggtggcgtaccaaggactccgtccagtacatgcataattcgatgaccgccaacctgcccaaggtgatcgggtgggttgacaccgacctcatg

SEQ ID NO: 1302 - DNA, 516 bp, Myxococcus xanthus
ccgtgaccattgccgctcctgacgggactgctggctgctgcgctgcatgatgggcagagacgcacatttcatgggcgggggacacggatggtgccacaggtaatcatgggcgctaccgagagggacttcctgtggacaatgccttacaccttacaactcatgaaaacttggacccggcccgcggcggggcgcttgtgcgtgtacgcatcaccaattactgggatgtccccgactgacacgagcctgccgctcaactcgttcacgccaccggcctcggttgattggaacacctaggcgcctgggtgaacgcggccatcaccgcccacgtgacccggtagatgctcacccacaccgggacgctctacaccgcgcgggtgcccgccaacgacgtcacgatgtcatggaataccgacgacatcaggcccctgaccactcgcattgacttgatggtgaacaccgggtccaagatgcactacatatactcctacgtaatgctgctgccagtgtacggcacct

SEQ ID NO: 1303 - DNA, 482 bp, Myxococcus xanthus
acgtgccgtgcgcagctacactcccttctgaagaagaccgctgatgtgtcatggcggcgcgcatcgcctggggctaccgtactcgctccctacatgctcaggctcaagtgggcgcatgcacacccctgctcgcgaacgatgagcgtgccagcgaagatcgaaacgatgctcccttgccggggttgactcgcaatgcgcctgggggggacgctcggcttctactacagctgcaggaagaacctaccctggaactggacgtcatctggaccgccacccatattgactcgcagacccacggcaagggggatgctgacccgaacttcatctacctaggttaccgtgctggcgcggatggtagggacactcatgctcgacgacagcatgcaggccagcctacttaccggcgcaccgatcgtcatgcttgccacatgtgagggggggctgcccaccacgtcgctccatcttgctgcaagcgtacccac

SEQ ID NO: 1304 - DNA, 506 bp, Myxococcus xanthus
ctgacgccagccctcatggaaggcgtactgcatgctgaggagggggaggacctctttctggttaacagtgacgccttcgtcatcaattaactgggagagcatgacgcgggcggaccacaagggctggccaaaagcgaatacaagggagaggagctggcagacactctgtctcgatgcaaacttctaggaggtggggcaccggcactggagggcgccggagaacaggagccagtatagacacaacagccctcacttcaccagttaagcaccggaaagcgccctaagatgtccttgtaggaggagatcacggagaacaccttcaagacgctgctggccgaaggcacctccgcccccttgccgctagtgatggcgcgtgcggaggacctatccatgatgggcaagaccattggtaacaagggccgctcgaacgacgccttgctgctggccaacaacatgctggtcaaggcgagacccgtcaccaacgcatgcatgttgacgggacagga

SEQ ID NO: 1305 - DNA, 314 bp, Myxococcus xanthus
cgaaacctcaggatgactttatggctaatgacaggcctgcagggtaatcccgcacatctggatcattatgagagcgttctgaatgccactagccttgacggagttgtgaggtaaattcgtggtgccacgactccggcaggagatggcgctttccacgtggggtcttggctccaggacttcgggctgactctctgacgagaccaccggggcttgcagatggtgttcagcgatgtctaacgcgtccctcaatccagccatctggagagtgtggtgctgctccaggcaccggcgctggacgtcaccatgactgacga

SEQ ID NO: 1306 - DNA, 382 bp, Myxococcus xanthus
gacatgagcagcatgaacgagagtacaatgccccacataacgccagtggatgcctccggctctaagtcgtcgtggtggatctgcggactaatatcacggctaataacatacaacatatccaccgcctgcaaggccactgctcacggatgatgggcgtagctgtgcgactggtccaccacgacgaatatcacgccgacagcgttcaccatgccgatgagcagcggcaggatacacgaggcgcgacgagaaacgcctcgaggcccgcagcgactagctgcatcagcaccccttagggaatgttctgcgagccgattgccaacttcatcgacagggacaaattccgctgcggtgctcacaaggacacgcccaccgtcattcctta

SEQ ID NO: 1307 - DNA, 168 bp, Myxococcus xanthus
cgccttgcgggctttgctgaggtcggcctcgcacccgagcaatcgcctgaaccaggtcgccgcaacggaaccggcttgggcatgcacaccaccgggcgattgcgcgcgccacctctgggagagcataatgcggcaccacctggccacacacggcaatgatggcgacgg

SEQ ID NO: 1308 - DNA, 421 bp, Myxococcus xanthus
ctaaaggtccttcgggggcgcctgcagaggccatgggggccgctccccctgctgatgaaccacatctgacggggcaactgactccctgagttctgtctgagaacgtcgaaagcggggagacggagggggccgaaaacgtccatacccaccgccatgtggctggtgttatgcacgaggaggtgcttgccgcttatgctagccacccagcgtgggatcctgggccaagtgccggctggggactcgttgagctacagcgcgtacctgctgtgccagccggtgaaaatgtccatgttccggctgggccctatgacaccctgttgagtagcggcgaacgaatgggcgaagtctcggggtgacgcgccggaccccttggctgcgaggagacactggataactttccagtacccgtaccgaaatggcc

SEQ ID NO: 1309 - DNA, 428 bp, Myxococcus xanthus
ctcctcgacgagcagctgcaccatgacctgctcctccaggagctggagaaaggcgcttttcaacccagaaacgacgatggttccacggccatccactgacaggcccatcacgaagtgatccaaccacacgtccttgcttaccctggtggcagggatgacgcgaccgcccccttcgatggccatccccgaggtcgtacttgacgcacaaatcgacaactagcgccggtacattaacgactgcacctctcttgacaacggatgcgtggcacacctcctgcgcaataccgagcccgtctacgtagttaaccctgtccccttcctcatacagtcccatgacgaggccaacacgatgaccgcccattacgtgcctgaactgggacatgcaaccggggccgtaatcctcgcgcgcacgcgctcgggatccgacg

SEQ ID NO: 1310 - DNA, 745 bp, Myxococcus xanthus
tgctctaaagctacaaccaatacgccaaaatagacaaacataaccgtcatatccagtccgttcataacagattcctccttattatgggtcaatttatcttttgttgaaacaaagagcttcttaaagctttagatcacgtgaagacttgtgatttctgttaatgcttcgtctaacacgcgaagcccggcgtcaatttcttcttttttaatcgttaaaggaggaatcattcgaatcacttctccgctatttccgcaaaggtaaaacagcacccctttttccaaacatttgtctaaaatctcaagaagaagatttccgtcaccttgctttgttttcggattaataatttcaattccaatcattagtcccactgaacgaatgcttccgatcacttcatgcttcgcttttaaatgctgaagctgatccgctgcatattgccccattgcttttgagttttcaattagcttttcttcttttagtacgtctatggtcgcaagtgctgctgaacaagcaatgggattgcctccaaaagttgttccatgtgtaccaatcggccacttttccatgagctgtttggaagctacggtagcacttagcggaagtcctgatgctatgccttttgcgattgccataatgtcaggcgtcacgtcaaacgtttgagctgcaaaccactctccggtgcgtccaaagccggtttgcacttcgtcaaaaataagcagaatgccgtgtctgtcacatacttctctta

SEQ ID NO: 1311 - DNA, 648 bp, Myxococcus xanthus
cgcccggttcttcaaaaatacggcaagtacttatttattcatgataagcattttgatctttcggaaaactggtttaataaatacggcgcgggcgtgggtttctccgctcgttttgtcccggttgttcgacacgcgatttcgatccctgcaggtattgctaaaatgccgttttggaagtttacgtctttaaccgtgttagcgatgattccttggtcgattttatttatttacttaggcggaaagctaggcgagaactgggcgaacattgaagacgtagcaagcaaatatacgcttccgtttgtagttgcggcatttgtgattattgttctttatttcgtattcaaacgcacgcgtacaaagcgcgtataagatcgtttttggactacaagcatggcgaaaagccatgctttttttgcatgcgcaaccagaagctcttttatttgctcatgacttcttcaagtgctattatttttcatacccactaaaaaaggagacgatttaacgtggtacaagaaatggtattaaatgatatgcctattcaaaatttacagctttgaacaaaaaattgtaaaagggcaaaacaaagtttcagttgattttaagggaaccagtgaggaaaaatcatgatattactaccccttttaattt

SEQ ID NO: 1312 - DNA, 357 bp, Myxococcus xanthus
gtgctctaaagggtggcgcttaagggagcctcatcaacattctactgggagcactgcagcgcctactgcgcctatgcggaatacaacatgcgcctgcccttatatctctggcagtcccctgtacagataaacggccaggcctaaaagagctcacactatggctgtggagacatcatgctcagcaaggactgcattacttataagtccttacctgcccatacacttggcgaccaggacctgaccgagagctttgtttattgtttgaggacctccttgcgccagaggctggaatttatggcgcacaatattgccgccatactactcacagacggggagctgccgttctctggaaacacc

SEQ ID NO: 1313 - DNA, 639 bp, Myxococcus xanthus
tctaaacgcaccgagtgggtgcagcaggcctacctcgccggcggcgggagccggcttccctacgtcagcgcctacgcggtagcatcctggatggctcctacctggaacgggaggatgagacgacgcccctgaccgagcgccccatccgggactatctctacaccaaggtcgacgcggaccacacgctgctcttcgagaatgcgcccgacttcctcaacccggtggtgctgcccatcttaatgtggtgcgacctcgacacatacctgctggcggaggtgcaggaggacgagccgacccccctcttacggtagacctgcggcggcctttacctgaccgccacatgctacacggccaactgcaccgagggcttcgcatgctgacggcggacaaagtctctggctgctacgcctatttactgaccaacagggaaccggggaagctgcggaccttcattaccaccatcttctggacacacggggagaacgccgtcaaccgcaccctgatatacggtgcgggcggcacggtgggctccgtcggtgactggatacgttgcaccgtggaccatcgcgagtagagtccggttaccctcacggaggacgtgctcatgccgtgataggtgacactcctttaaaactagga

SEQ ID NO: 1314 - DNA, 194 bp, Myxococcus xanthus
ccacggattctggggagagacccttcaggcccactttaatttcctttggattccgggtcgcttcttgggggaaaccccctcgcgcctgatggacaccgactgtatttaccccggcaagaggatgggctgggccttgtcctgggaatccaagaagagcatgcacccacctcggcagcctcgacttacctccctac

SEQ ID NO: 1315 - DNA, 776 bp, Myxococcus xanthus
gtgctctaaagaagttcgcaaacttgcagaacaatccaatcagtcagccgaacaagtagcaagactcattcagcatattcagcaagaaacgtttcaagccgtagcattcattcaatcaggaactgctgatgtaaaaaacggtattttactagccaacgaagcggaaaatgtttttaatcgaatcgccgacgcatctacgtacgttcacgaacaaattcagcaaacggctgcttccgcacagcaaatagcagccggatctacgcaggtgctccatgccgtcagcgagatgaccgcttttgcgaaccaatcagcggcaagtagcagcagcatttcttctgcttccgtgcgtcagctggaatcgctgcagactatcgaccaaacggcggaatttttaagtgagttagttgaagagcttggcagcgtaacgggaaagttagcgaagcaagcgtgagtgaggtagagcagcagatgacgtagacgtacataatttttagcctcttcattagaaatacgattcgcttattttccagttatatgtgataaaatggaaggataagtaattcatcttttatatgggggaatggcatatggatagaatggaagaacttacacaggccgcaatgagtggaaataatgaagaaataaaagttttgattggtgaaaaccctgcacttattaatgaatttaatttagacggatggacaccgcttcacttagcctcgtattttgggaaagaagaaactgtaaaactattgctatcattaggagcgaacatg

SEQ ID NO: 1316 - DNA, 51 bp, Myxococcus xanthus
aggtgtgtcgggcagcgcgggactcgacacttccggagggccgacgagggc

SEQ ID NO: 1317 - DNA, 646 bp, Myxococcus xanthus
  unsure (1)..(646): unsure at all n locations
ttcgctaatggatagaagggatgtttttgcatatgagtggaggcctgagagtttgtcttttcattgttggtattgcactcaaagtgacagctgttttgactttgatttttgaaatgaatcttgtccctattcacggaaggagtctcacttattatgctgaagcgataggtatgaaactccccattatctgttttgtccttggttttttttgtgtagcagcaagcttttatttgcctgctaaaaatcgccgcaccagtaaatagcaagggcaggagactaactaaaacgtttgactgcaaagtttttaacatttaaaataaagtcaataagtttaaaaagaaataggataattattcctgaatctttttagatatacggaaatagaggtgattggatggggcagtgtaccacgttggcgaagtagcattatatgcaccagtgtcaaagcgtacaatacagtattatacaaacctacatttgcttcacgcatatcgctctttatcacataatcgctcttttaaggcgttaacagactttaactntataaagattggaaactactaaattntttataaatgaattggaagagagaatcagcgctgaagcaacatcatgaaatgaagcgatgtgagccattgcttcacat

SEQ ID NO: 1318 - DNA, 614 bp, Myxococcus xanthus
  unsure (1)..(614): unsure at all n locations
aaaaaaaaaaaaaaaaanaaatttattatgtaaaaaaaaaaaagaaaaaaaaaaagaaaaaaaaaanaagagggaggggagagatatataaaaataataaaagagagagggagagagagagaaataacagaaaaaaataaaaataaaaatgagaaaacgaaaatagaataaaaacaaaaataaaaaaaaaaaaaaacaaaaaaaaaaagaaaaaagagaaaaaacaacaaacaagaaaaaagccgaataaaaaaacaaaatacacaataaacaacaaaaaaaagaacaaaaaacaacaaaaagaaaaaaaaaagaaagacaaaaaaaaaacaaaacaaaaacaaaataaaaaaaaaaaacaaaaaacacacaacaaaaaaacataaaacaaaaaaaaaagaaaaaaaaaaaaaaaaaaaaaaaaaaaaaaaaaaaaaaaaaaaaaaaacaaaaaaaaaaaaaaaaaaaaacaaaaaagaaaaaaaaaaaaacaaacaaaaaaaaaaataaaaaaaaaaaaaaaaaaaaaaaaaaaaaaacacaagaagaaagacaaaaagaaaaagaaacaaaaaaaaaagaaaatcaaaaaaaagaaaaaaaagacaaaaaaa

SEQ ID NO: 1319 - DNA, 500 bp, Myxococcus xanthus
  unsure (1)..(500): unsure at all n locations
tctaaagatctcgtggatgatcgagcggaacacactcatgacggtgatgatggcgtcctccacgttcggattcttgacgcgcgtgtactcgatggcgttccacatcacaaccgtgccgcccaccgaaagcgggaggtagatgatctcctccggaatgtacaagctgacctgcgcgaactggaacatcctgacngcggggcccaaccggaagctctcggctcaggcgacgttgaggttcatcaccctgcgagcgctacaccatgaccgccttggactagatggtggagccggtcgtgacgaaatggtcgccactagctaggacatgacgtgcgatgccacccatgtccacctcctccacgatgtgctcggtctgattgggaacctcgacggcgctctccaggcccaactgcacctccagggcttacgcatacaacaacacacggtgcacctctgaccgcgtcatcacctagatcttgcgaggctccagccacccgacgtgc

SEQ ID NO: 1320 - DNA, 511 bp, Myxococcus xanthus
cccgcaccattgaccatggcgagtgacactggaggcctgcccagccggttaaactatttcctgcacctggaaactgacctggagacggttgggctcactgaccatgatgttggacggcccactctgaaccacccgctgtggctgtacacctctgacttctggggccgaacccactgctgcttggaccagagggaccagacgacgcccgtgttgatgaccgccactcacaaagacaggttgacctcccagccggtgagcgcgtcgaccggtcagaaactgacgaagctaccgaacacaccgaaaaattgaccgttaagctccgctatcatccaggttgtggagaacacctctgcctatgccctgtctacctactgctatgtcagctcccaggccccccaggcggacaagccctactcgacggtgcccttgggcgccctgatgacttactaggacgacaagacacgccccttgttataggacatcgcgccctcacccgggcaggccggggcgc

SEQ ID NO: 1321 - DNA, 754 bp, Myxococcus xanthus
  unsure (1)..(754): unsure at all n locations
cttcactggctgtttcttctaactctactaaagccgctcttgattccgccagcttactcttcatttcttctaatgtctgattttcattagaaggcgtaacttgagccggtgcatctacttttcgagaacggtctaccgctaaatgaaacggcttatcttcggttggctgatctacaccgttttctaactgatcctttacacgtgaaacaatcatgcgctccatcaaatataaatgttctaatacttgcataacgctccatgtattagatgctggctgctgatttaattgttcatatgttaatgattctacactgttcaatacatcatttcgaaactgttcatttttgttcattgttcatcctcctctaggattcctctagcttatcgtatcaaaaaactcttctatataaaaaggatatccctttacttaaccatgttttagctgcaattgtttcacgtgaaaaaaatattttttctatttgacatagatcaactgaagtgttatatttagatttctggcttttctttaagagctggacatagtgaaagtaacttgaaaggatgtatcgtacaatgcaaggtaaaaatactggcattcgacacatgtctttgaacaaaacttattcacactggatcggcttcngagccgtaaggatgcaagagaggtagggcttgcgtcgtttagttaatcgatcatgtggaaaacaaccgcgcatggatgaatctgcagcacatcatgctatggcctacacac

SEQ ID NO: 1322 - DNA, 582 bp, Myxococcus xanthus
  unsure (1)..(582): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1323 - DNA, 106 bp, Myxococcus xanthus
ccttgaccaacaggcggtcaatcgccaagggcatgcgcatgccggcccttacagctgccgagcggcctagggtttgttgaacggccggaaccaccacggggtgcgg

SEQ ID NO: 1324 - DNA, 198 bp, Myxococcus xanthus
tgggcaaagggacgccaccggtatgaccgcccaatagcgtcgcgtacatgctgggcacctatggaagtcttacaccggggcctgtctaaaaagggcgcgctgtggatgcacaaggtacgcaccgggcttactcattacctgttctggagggcgctccgtcactactgtccgcgacagcgccatacgtgcatggatacg

SEQ ID NO: 1325 - DNA, 479 bp, Myxococcus xanthus
accccaccctgcgccggaggccggggggagacccagatggagacctccgcggactttgacggtcacggcgggacgctaccggtcctgccgccggtttggcctgggggcctgcgcggcagggctgggcgagctggggcccgggggcgctgcacggcgactctacacgggacgcacctgacctcactacgtctgcagactccgtacgaccagtcggctgtgcctcggcggtgctgggtgggcgggaggagcggcccggggctgtggctcgcgaggatgacccgcagggcatggcacaggccgacgtgctacggctcaccaccgcgtgggacctggggcttggcggtctgtgtcgaggctgggccacggtactgtctcgccggtgattgccggccctgattcactccgcccgggcttggtaccgggcggcttcgatgcgccgagacgtcaggttggggtccctggtgatgcgccgcttcggt

SEQ ID NO: 1326 - DNA, 382 bp, Myxococcus xanthus
cggaccaaggcacagcagggcacggcacgagatcggccgctctggcagctgggggacagcaaggctcgaacacgaaaggcaacgggtagagcaactcgcccatccgctgggggacgaggaaacagcacgggacctgcagaaggcgcctgaaggccatgacggcggcgacaccctccacccgagggaggcatcacacgaaggatacggtgacgacgaccgggacggcatcgaggacggcccgaagacggaattcccggagggaccgtagctaccggcaggcggagtgctcatacccacccaccaagggggggacgagggggagtggtttatccacgacgcgaacgccgtccacctgccagccgactgccgacaccccctagcc

SEQ ID NO: 1327 - DNA, 667 bp, Myxococcus xanthus
aagaaacataaatctcacgtatacgtagcggaaaaggagatgttcgtcttattaaaagaaggcgttccagctgcacactaccctccaattatgacagctaaaaatgcccgtaagctcattccacatgatgctagaagaagtcatgtgtacgtaacggtcagtgaatcaccttattggaatgaacgaattaatttcagggagcagttacgctcgagcgaacgtgctagaaaaaaatatgaaggtatgaaatacgagctttcaaaacgattgtggaacgatatttctacctatgagtacaaaaaagaagaattcattcagcgcagtctataaaaaaacgtcatttcaattgaaatgacgtttttttaattaattatcttgtaaaacaatggtctcaagcttatcagcagtatttactgcgagaaccgtatagtttttaccgctttgaagatttgttccaggaagacttagtatttcttttccgtctgctgtggaaacagataaatcatacgaacccggatttactacttgataacctgaaatgcttttaaaagacagatctttaaataaaggagcagcccctttaggacctacgtttaccgcaggagcatcaggagataaatgagcaacacgtaagcttgcttttccatccatcccttgcttattattc

SEQ ID NO: 1328 - DNA, 239 bp, Myxococcus xanthus
cacccttgaaccggcccgcgtgccgtattggttcgtggtgaaccaagcgccggccccatttctttgcacccccattggggggggggttgaacccttcccacaagttaagcacaccattttaccccttattttccgggcaaacccaaggattgcccttaacgggctttccctttacaacccccccccaaacggggggcttggggcaagccttttggccaatgcccgggcccccggggggg

SEQ ID NO: 1329 - DNA, 606 bp, Myxococcus xanthus
gtgctctaaagaaacttccttgaccgggctacccactcctacgccagtgccaaagtgccggtcaacagtgtccagccactgctgggggggcctaactcatttcacgactaggggggcgttcggttcattcgcgcattggaagacagggccaggcccatgcaggaccccagcattgagactggcttgactggatctgcacctgggaggaccacggcgatgctccgatggttcaaacctacggatacgatacccatactcatcgaagtcggtgattcttccactgaccaacgtggccatagacatgtctcatgggtcgagctggctgtcactcacgctcggtgtgtaggcaaggaccgtcccaggagcatggggctgtccactcagcgactcccccaattgaaggaacgtgacgattcagagatttgtgcgtcccacggcctgccacgggagatgcggggcccccaatacaggagcagctcggaaggaccgatggaagcgccgctgcccccatcccgctgtggtcattaatgtacgggctctgcttgacagcactacgactttgatgggatcatggcccatgacacacgggggtatccaccccatact

SEQ ID NO: 1330 - DNA, 727 bp, Myxococcus xanthus
ccaaccgtgctgtttctatggccttcaggacgttcggttgtatcacgaagtactaataccggcacacctaatgaaggagcttcttcttgcacgccgcctgaatccgttaaaatgatatgagcacgcgaagcgaaattatggaaatctactacttctagaggttcaattaattgaatgcgaggatcatttcctaacacttcatctgccaattcacgaacaacaggatttaaatgtacagggtagactacttgtacgtcatcatgttcctctacaattcgtttaatcgcacggaacatattgcgcattggttcaccaaggttttcacggcggtgagcggttaacagaattaaacggtcatcccctacacgatctaataccggatgagaatattcttctaacacagttgtttttagtgcatcgattgccgtgtttcctgtaataaacaacgtttcttcttttttgttttcttgcaataagttatgggcagactttgtagtaggagcaaaatgaaggtccgctaatacacctgttaactggcggttcatttcttccgggtacggagaatatttattccatgtacgaagacccgcttctacatggcctactttgatttggttataaaaagccgcaagacctgcgatgaaggttgttgttgtatcgccgtgtacaagtacgatatcaggctgaacttctttcatgacttgatctagtcctttgaggccacgtg

SEQ ID NO: 1331 - DNA, 251 bp, Myxococcus xanthus
gtgctctaaagatcctttgggacgggggtgcagtgctgggctgccgtgcataggtgtggcaaatcaccagggagctggagctctgggacgacttacccatgcagtacaccgaggcggtgatggtagcgaccactgcccatggacgggggcggttgctggaggttcacatcgtggtcttcgtggatgtgaccggtctcgatacccggcccttggtgatgactggggcgggcgccaaccccctgctcacgtgg

SEQ ID NO: 1332 - DNA, 87 bp, Myxococcus xanthus
gggctagggagccttctaaatcctgtgcgcgaggccctccagggcttcggggttctccagcaagggcgtgtgtccctgctcgagggg

SEQ ID NO: 1333 - DNA, 418 bp, Myxococcus xanthus
ccggaggagcacgagtatgtgctcttgatgaacatccacctgcagactgtcaatgaggtatgcggggcgcacttggtcgaccccatcctggagcatttcaccatcaccaagactaacgactacctcatctgacgatggtgcccgtcttgtataccgacctgcatcaattgggaaaagctccgccttgcatgaaattaggggacctgccgttcttactactggccgtaacggtcggcaacttcttgatggtccatccatgcaactgacgaagaaatgggctgggctgcggccgagcgtggacagctagacatgaaactgctggacaagagtgacattgctcaaaaccttaataatggtcgagttcagatggacacactagatcagaatgtctaccaggctgttacggatctactagagc

SEQ ID NO: 1334 - DNA, 688 bp, Myxococcus xanthus
atcgctagttccgcattcagctttgtaatagacgccggctctatgaacactgttgaccctttagaagatgtttcaacaatcgttcctccaacattatttttataggatgccttgatcggaatcgtatagcggtctccttttttactgatgaagaagtcttgaatatactctttgtttttaccgtttcgtaaaaatttcgcaagctgttctgaaatcttagcttccgttccttctatatgtcttctgatacgcttaagctctttgcttgccgcagcgtctacttttccggctttaatcgcaaaattaatttcctcttctatacctgtcagttctttcatcgaatgggcataggaacttaagagcgaagcaaaaaattctttatccaccatatattgttttacttttctacagccttttaaaaaatcggatacgcgcattagctcttcgggctctaaaatcatgcctttttcaagcttttcgatgactcttcctatacctgagacacctgatagcggaagtgatttctcagcatctagaagtcttcgtgcttcccgtggttctttaagtcgggtttttacttgtttaagaaatgtgctcggcttgaagttatccattaattggtttcccagctcacttacgccgtgagaatttacgaattcttttaattcctgatacttgaatttttcaa

SEQ ID NO: 1335 - DNA, 617 bp, Myxococcus xanthus
aaaacctgccagtaaaaatgattatattcgaattcagaagtttttacaaaatgcgggtattagcacagcgggtgtagaagaacatattgatcaatttgtcatcatggaaagtgaagaaggcgagctgctagcaacagttgggtttgaaaaagaaggcatggacggaattcttcgctcccttgtcgtgtcaccttctttgatgcaatctgatattctgctgctatttaaaagtatcgttcagctggctcaaaagcatggtgtgaagcaactatatttactaacaaataaggcatcctctctgcatttttttcaaatgatgaattttcagcaaacatcttatagtgctctacctgatttgttaaaagaacattcgtatttaaaacagttaccaaatcctaaggatgtctacgtgatgttttatgcagctagttaaaaggaaatgtggataaatcattttaatggggtatccacaatgttattcacaaaaatctaagctttatccacattttgtggataaagcttgtttgctgatataatgaatgcatgtattttactgtttttgatacatattgtacttttaaagtaaaaaaaacctagatatagaaagaaaaagggag

SEQ ID NO: 1336 - DNA, 608 bp, Myxococcus xanthus
agctctcaagagtagcaaacattccaagtttatcagacaaaagtcgtccaataaacatgcccaatagcggcattcaaatatgaaatataccgataacaacaccaatgtagaaaatttggcgaaagcgtaaacgaattaaccccattcccaaaccaactgagaaagcatccattcctaaggcaaacgccataatgactaacgtgatcatttcactaattaactgagatacattcatctttaccctcctcggacgtgctcctatttcaaaatatgcacattcgaaaaggtttagaagatgaattttattgcttaatcacgtgatgtcctgcagctttcattaatcgattcataacggcatgaccgactccttcttcagaaaaactttcactaacgataatatctacatcgcactcattaaatgaacgaagagactcatataagtggctagcaaccgtctctaaatttgagcgagatccacatgtaatgacggcatcggctttatacacatcttcatgttcagatgtcggtaatacccctactcgcttaccctgatcttgatagtgatcaataatagattggaaaaaatctgaactgccgtcaacaatgac

SEQ ID NO: 1337 - DNA, 689 bp, Myxococcus xanthus
  unsure (1)..(689): unsure at all n locations
taaaatgattcaattgactaaggaagcaaaaaacgctgtaagtggagtggaggagccttcgggtacgcttattattggatcttctgaaagccagtgtacctatagattgcctcccatattaaaagagtttaaggatcaatttcctaaggttaaaatgatttttaaacctatttattctcaagaacaaacaagagcgcagctactagacggcactcttgatatcgcctttacaatggagcctattcagcatcatgatgcaaatctacatacacaatgtcttgttgcagaagacttaaaaattgttgcttctcctcagcatcctttagctgataaaacggatatctacttagaagagcttgaaaatgagactctcttgtataccgaatcaggttgttcatatcgcgtagtgttggaaaacttgtttcgtgaggcgggtatttgtacatccactaaatttgaatttgcaagtgtggaagctattaagcaatgtgtgatgttggatttaggtattgcgatattgcctgaagtagtggtaaaaggagagcttgagaaaggaatattaaaagaattggcttgtactaaagtggatacgaccctttatacacaaatgttttggcataaagataaatntatgtctcttcctttacaatcgtttattcaattggcttgcagtacttttggtttaaata

SEQ ID NO: 1338 - DNA, 645 bp, Myxococcus xanthus
tgttttcagatacttattcatgccgatggtaatggtttttttatctttaaaggcgccattaccgttgccgtttgctgttgtaataactagaagaaaacaaatcatgctgattaaaaatagtttcttcatgcaatgtaactcctttataaagttttaaatcaatatgactgatatgtagaacggatgctaaacacaacgaagtgtatacccggtttttttaggtggtaaacataaaaaatataaaatgtgaaatagagtgggtgatttttcggcgttataaagttatttttagctaaaaatgtacatcgtagttaagagaaaatatgggaaataaatggataaaataagtgactgtagaatcagtcttacatgttatcactcttttttttactccgtcaacttcaagtcaagagtaattcggcaattgagccgtataaaccgatacgaaaaaatatctttttaataaagttattttttaggaagaataggtgattaaagagctttgcatcagcttttaccttgaattgttaaaggaagaaagataaccgtgagacatataagaaacgtgagaggaaattgataaaataaaaaaatatttttgaaaccagcataccgataaattttgattgaatttaaagattcaga

SEQ ID NO: 1339 - DNA, 638 bp, Myxococcus xanthus
aattaattgaagatcaaaccgatatgaaagtaaaccttcgttcgtcgcttgggaaaacggtatttgtatttgaggctctgcgtaacaaggaaattgatttgtaccctgaatatacggggacagccattgtgacgcatctaaaggagcagccggacagcaaagatgaaacacaggtgtacaagcaggcaaaagaaggatttaaaaagaaattcgggcttgtctatttagatccaatgaagtttaataatacgtacacattgaccgtgacaaaagaatttgccaaagaaaataatctaacgaatatttcagatttggcaaatgcaacagataaagtaaaagcaggatttacacttgagtttaaagatcgtgaagacggctacgtaggcattcaaaaagaatatggccttactttcccgaatattaaaacgatggagccgaagcttcgctatcgcgctgttgaaaaaggcgatattaacatgcttgatgcttacgcaacggatcctgaaatcaaacagtttggtttaaaagtcttaaaagacgaccagcagttcttccctccgtatcaaggagcgcctgtgcttcgtgaagatacgctaaaagagcaccctgaactgaaaaaaatcttaaatcaactgggt

SEQ ID NO: 1340 - DNA, 602 bp, Myxococcus xanthus
aactcctgctctttttctacatcaattttgaaatcgggatagtctgcgtataaatcatgaacgtacacatcctcctctttttttactcgctctgcccacgctttattaatacgagaagatgctaaatttggatgcgctaaaataaccagtgttttcattttgatactctccttctgatgtctgtgcttgcttttttcttttctattttttacgcttgcctctcacgtcttgttcactcattctttccttttccttcaggaaatccgagttcgtttacacttataaattaccagtattatcattctgcttcaataaaattgactttgcttttatcacctttaatttttttatgtacccaaaacggaagataaaggacaagaaagctaagaatcatgattccttcaatccatactaaataccaaggatgaggtccaagaacatccagcaaggaagcgtgctctggctttttcatcatgtataaataattcgcaccgagtaaacgattcatgacatagataaaacctccgtacagattaacaaatactacgcttacccataaagaacgaaacgtcggctcatatctgcaggcagcaattagcata

SEQ ID NO: 1341 - DNA, 506 bp, Myxococcus xanthus
cgtgctctaaagatccccccataagcatcggacgagctactttagaaacgtcaagttgacgctcagggcacactacgccaacaaacccgatttgccacgtggcggtctccactgactgccgagagcgtgccgccgaacgggagcgcaggaaaccctaaggtgcgcacagaactgtaccggctttgatgacaacccggagaatacataccttacgtaggcgcaggtccaccctaccatccgacgtgggcggagctcgcgcatcgacttgtatacaccatgactatccggaattaccctctggtcgctgctgtgaccagggcgaggttcactctacacaggtggccaagtcatgtcggaaaggtcattccgcgtcttcaagacaagacaggcgaccgggcacgtctcctgcaaggaatctccgttcatggagtggcagcgaaactgctcgttgctggggctgcgcattagcttgccatcatgctcaaactcctggaagtagacctaga

SEQ ID NO: 1342 - DNA, 446 bp, Myxococcus xanthus
acaacacaccgacaggtgctgtgccaaggggcgatgtacacgcagatggcgctgttgcaccacgagaactcttaggactcgcggggcttggccaccaaaatggctgccctgggttggtccatggacatgccccgcaactggtacctcaccaactcctttgctctgtaggccggccggcaccccttgcacacggagttctgggtctcgctgagcatgctctgcgcatagggcgactcccaggtcttcacgaacgtcaaggaccccacgatgatcaacgagtaccagggctgcacgctcgttccagccgagagcgcgaactgtaccgactactgcttaatccagacgattaggagacactggtcgctcttttagctgatcaaggagttgaagcgcacgcctttgctcgcgctgtgcagggaaccgaagcgcccatacatgacggcgga

SEQ ID NO: 1343 - DNA, 678 bp, Myxococcus xanthus
gcttctccgcttgcaacacgcgtcgaaatcgctttttccgatgagaatgttaaaatatcattcacttcaattagtgcctcaccagtaatggcacgttctaattcatctgccagcatagggtattctttttggtaagaagcaaacagttcgttccactctgcttctgctttcatccctttttcttctagcttttcaaaatgagcttttacttcttctggaacatagaagttttcttcagcgtcccagccgtaggcttgttttgttgcttttgcttcttcttctccaagcggattgccgtgtgctttatttgttcccgctacttttggacttccgtagccaataattgttctcacttcaatgagcgttggctgttccgtgttctgtttcgctttttcaatggcgcttgtgatttcatccacgtcatttccatcttctacacgtaaatactgccagtttgcagattccgctcttttttggatattttcgctaaatgaaagatttaattccccgtctaacgaaatatcgttggagtcatataaagcaataagtttaccaagcttcatatggccagccattgacatcgcttcataagaaatgccttccattaagtcaccatcgcctactaacgtatacgtatagtgatcaataacagagaaaattgggtttatttaaattttg

SEQ ID NO: 1344 - DNA, 611 bp, Myxococcus xanthus
cttgaggaaattgtagaagctacgggaagcagtaaagggaatatttattatcactttaaaagtaaagaagggctttttctttatttaatagacgaatgggatcttgagtgggaacgaaactggaaagaaagagagtctctttacaaaacaacaagagataagctttttggaatagcggagcaaatcattttagatgatttgaatcatcctcttacgaaagctgcggatgagttttttaacaacgaggagaagggcagcgacatcgaagagcgaattgatgagatggtgaaacgacacgtggagtttaaccgggaacttttgcaacagggcatcgatgaaggcgagttttctcataaaaatgcagagcagcttgcagtaattttagaagggttgtttgttggaatgagccgcatgtctcgaaaaacgagtacggaaaatgccctgcagctttaccattcagcaatcgatgtatttttaaacggaattatagcaaggtcttcttaaataagcggggatgcttattgcggcaatgagtaatccctcattattttgtatttttatagaccgaacgttcagtatttttgtaatcaggaggtttatatgtcattatt

SEQ ID NO: 1345 - DNA, 107 bp, Myxococcus xanthus
ccgtcgatcgactgggggcccgggtactaaaggcggaccgttgatgtctcgattacgatgcagagcggaacccgaccgtggcgtttcctcttcgcctggcccatctg

SEQ ID NO: 1346 - DNA, 296 bp, Myxococcus xanthus
  unsure (1)..(296): unsure at all n locations
ctccttcacttcctttggcgcgctcacccctgccgtgtgccgggaccgtctgccgctaatataggggagaaantttttnttttctatnantaacaangacttattcttnatggcctcgttcttcctcctcaactggccgtcggcctccctcaaaaccccctccctcttcacccccaaggacacgcccccttcgacccaggacttcctcacctccctgaagcccccatacaacgccttcttcttaaccccggcccatcgcgccttctcctcccccccagccgccatctttccccttt

SEQ ID NO: 1347 - DNA, 478 bp, Myxococcus xanthus
agggcatgaaaggtgggggggtcccgcaccctatgcataacctggccctaccgccaagtatccgccaggacacggttcttgaacgggaacaagaccctgacctttccttcgctgaaggggaccaggaatcggacgaacagcacctagtccatcgcgcttgcctgctcgaaggggttggagatagcgctagacaccatgtcgaccgagcgcatgacacccacttgactgtccgctctcacggcaaatgccagcttaactgtctggggacccacagagggtgaccccgcgtgctcaagacatttcatgacactaccgcaatccacagctctggatggctgcgctgaccggagggatggttgatgctagcggtgcaggattccaccaccggctctgactccaccactcacctccagttccttcatgacggcgtcggtcaccacaccccggacaccgaggacgaaaagccgcaccttggctg

SEQ ID NO: 1348 - DNA, 75 bp, Myxococcus xanthus
cttcctggaaagtagggaacccacatcatctcggaaatcttggccttcaccttgggcttgacgctgagctaatac

SEQ ID NO: 1349 - DNA, 59 bp, Myxococcus xanthus
ctcctgcaccgcgggctcgcgctggcacttcgcgctgacgtcgctgtccgccggggcgc

SEQ ID NO: 1350 - DNA, 579 bp, Myxococcus xanthus
ttaattttcccccagcgcctcactatcagcagttaaaagaagggaaagaagtagtattaaaagatggttttctattcaatggacaagagtttgtaggagaacctaaaaaagggaaggtcatcacggttttaggagatacaagaaggtgcacgcaaagtgttcagcttgctatgcatgcgaatgtgttaatccatgaagctacgtttgcagcgggagacgaggagcttgcttacaactattttcattctactgcaaaagaagccgctgaaattgctaaaacagcatcggccgagcgtcttattttatctcatatcagttcgcgttaccaaggagacgcagtcagccagttagcagaaggagcaaaagaaatttttccgaataccgatatagcagaagacttaaaaaggtttacgatttcataaaaaaagccgaggatatcctcggctttttttaccatccgcgttcgtactgaacgggtgctgaaagtgtttcatttaattcttttgccgccgtgcgcgggaagtacggatcgcgcagaagttcgcgcgcaacaaaaattaaatcagcgcgttcgctttg

SEQ ID NO: 1351 - DNA, 220 bp, Myxococcus xanthus
catactgccacagccttcgacgtgcggcgctaggagatacagaacctccagggactggccaacgcctatggcctgggggataatgcactgggacttaggcatgatcaaaacgatggcgttgtgctggcctgaggttcaccacttctcagcacgtatattgcaacatattaatgctacctggcctttacccggacttgtacacgaaaataagaacaggggc

SEQ ID NO: 1352 - DNA, 686 bp, Myxococcus xanthus
ctctacagctgccaatcagcagatgaaaatgaaaagtaacttatcctgctttgcctgtaaaacaccgagacaatatatatgctcccggtgttttttgtttttgctctatttattattcgcgttttccataactgcaaaatagttaccttcactgtctgaaaaattaaagacttttcctgaaggcatcgatacaatttctcccaccgttacgcctttagcagttaaatctctatataattcatccacattctccgtaaaaaacagaagcgaaggtgtcccgacatttaattccggctgcatttttgctattagctgcttgttatgaaggataatggttgtttcagcacccgctaccggcgctagctcaatccacttcatgccttgctcattattttgctcggacataacctgaaataccattttttctgtccaaaactttaccgcttgatcttgatcgtttacatacaccataatttgaccgatttttttaatcattgctttcactccttctatatagatgaaataattccttttgctactgtatctgccgacttttcctttgtgtaaattgcttgcttagccagcacctcatttgacggatgcgttacaaaatgtttgttaagcttaaaaacatcttcatcatccgttatttgctgcaatctttgatgcaatagatgtatggactc

SEQ ID NO: 1353 - DNA, 60 bp, Myxococcus xanthus
ctttgcgtttcgcagccgccccgatcggttggggctggctgggttacattgcggaatatc

SEQ ID NO: 1354 - DNA, 548 bp, Myxococcus xanthus
atggctggattccgagcatgcaccagatgggtgtacaccgagggtgcgggctcaaacaagcgcgttgacggcggagcaaaggggcttccgctcctgcatgtcctgcaggcgcgcgggccccaccatgcccatggccaacaggagggcggacgcctggtacgacaccgtgtgcggcagctgggactcgaacatcatggagcgtagcgcgaggggcccggtcaagaggttcaccacttaatccacgtgctgcgaaagggacggcggcatctccgcccgcctgcccaagtccaccgacagccacaatgcctacagaaggcctcgggcatgcttcgcgatggactgctccagcccctgcggcaccgtgtgggacaagaacggactgaccatggtgaactagcccttgaacaggtcgggcacgatcgtgatctcctaatgacccacgccgaagaagatcgttccacagacggccaggctgccgggcaggctattgaagacggcctccaccatcaggctgagcaggatggcgaaccagatgtggacctgcggca

SEQ ID NO: 1355 - DNA, 640 bp, Myxococcus xanthus
tgcttctattggattatcggctacagccattgcacccgggaagtttgctacagcggagcatatgaactttactactgttttatttgaaacgattggtacggttacaactgtagaggaagagcagcttcacgctgtaacaggactatctggaagcggcccagcgtatgtctattatttagtagaagcaatggaaaaagcagctgaaaaacaaggcttggatacgtcagtgtcaaatgaactaattcttcaaacgcttatcggtgctgcagaaatgctgaaacagtcacctaaaacaccggccgtacttcgaaaagaagttatgagtcctggcggtacaacagaagcaggaatcgaacagcttatttctcataacttccaagaagcgatgatgcagtgtattgaacaagctaccattcgctctaaatatttaggagatacgattgacgaaaaaatctcgagtaaacgttcgtaaaggttcacctctttctaaaaaaagaaagaggtttttttatgattaaaaatggataagcagattatgtgaaagatatttcaatgcggtgatataataacttttgtttaaagtatcgaaataattggaggttaaaccgaatgacaacaaaactatatttcaccttataca

SEQ ID NO: 1356 - DNA, 148 bp, Myxococcus xanthus
agtccccataccggcgtccggacttgcggccatcggctctgaggcaaggccaatgcgatcttcttgtgcatccgcgaatgccctacacacgcccgcccggccataccgaaggcacagcggcaaacccagggccggctccgaagactat

SEQ ID NO: 1357 - DNA, 612 bp, Myxococcus xanthus
  unsure (1)..(612): unsure at all n locations
aaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaataaaaaaaaaaaaaaaaaaaaaaaaataaaaaaaaaaaaaaaaaaaaaaataaaaaaaaaaaaaaaaaaaataaaaaaaaaaaataaaataaaaataaaaaaaataaaatattaaaaaaaaattaaaaaaaaaaaaantaaaataaaaaaaaaaaaaaantaaaaaaataaaaaaaaaataaataaaaaaaaaataaaaaaaaaaaaataaaatataaaaataaaaaaaaaaaaaaataaaaaaaaaaaaaaaaaaaaaaaaaattaaaaaaaaattaaaaaataataaaaaaaaaaaaataaaaaaaaaaaaaaaaaaaaaaaaaaaaaaaaaaaaaaaaaaaaaaaaaaaaaaaaaaaaaaaaaaaaaaaaaaaaattaaaaaaaaaaaaaaaaaaaataaaaaaaaaaaaaaaaaaaaaaaaaaaaaaaaaaaa

SEQ ID NO: 1358 - DNA, 639 bp, Myxococcus xanthus
gctaatatgactttaagtgtatacttacgctgttcggccatgttaagatcttcctttcacttacacatagcgggatttgaattcttgtttcttttccacttttaatataataaccgaagccagggttaacgtcggcttcttttcggtcataaggaagtgtaaataagctttgctctgttttcttcatcaacaacacagcttggccaatttgcttcacttctgttgttaacgcgtcaaatccttttgaaaactcattgttgttccctgcaacaatcaagttaaagcccaggtggctataatttttcatcaattttgtaatacgatcctgcaagacactgtctaagttttgctggaatcgtacaaatccgtctaccacaagcatgatcggggcaaatgaaaggccgtgtacggttccttcctgcactgcttccaaatacttattttcacgtcgctgcaatcgttcttcggttaggtcaagccagtcgacgatctgttcttttgtttccatgtaaacaacttgctcttcagctgcatagcttgataaaccacggtcaaccgaatcaaatagtccgatttgcttcacgccttgttcaagcgctgtttgcagtatgactttcactacatttggctttccttttt

SEQ ID NO: 1359 - DNA, 654 bp, Myxococcus xanthus
  unsure (1)..(654): unsure at all n locations
atgatttgtatcctcttcagctgaagcgcatcactaaaaatgaacttttatcggtgaaagacgaccttgaagtgattgccattaaaagcaagatggaaggcgggttgcgttaactgctcaaattattaaaagcggcttaactgataaagagcttgccgttattagtgagcagctgagtgacttgcctggcgtcgatacgacaacttactgggaccgtatgtatacatacgatgacttacttagcacgctgcttggtaaaatcacatcggcagacgaagggttaccaagcgaaaacttacagtactacttgtcccacggctacagccgaaatgaccgagtaggaaaaagttatttagaaaagcagtacgaagacgttcttcgtggtcaaaaagcgcgcatacaaaacgtaaccgatcgctccggcaacttagtgagtcaagagaccgttactgaaggtcagcgcggcactgacttaattttaacgattgatatggaactgcataaacaagtcgaagatgttttaacgaaagctgtacttgaaggctctgcgaggaaccgcttaatggaccgagcgtttgctattatgatggacccacatacgggagacattttancaatgggaggaaaacagcttgttactgacaaacaaacagg

SEQ ID NO: 1360 - DNA, 255 bp, Myxococcus xanthus
accatccgggagcgaccgaagccatatgccgacaccgagtacatgagggttttgcccatgacacgtgccgacagcaaggagcgcagcgggtgggagtccagagggccgagggacaggaacatcctcacgtacgaggaccccatgcccatgcactagagagggcccgaaaagcggagaaacgaggcggacaccatgaatgccctggctgaggcgctagtcaaggacgaagtgcacccctacatcgggggctcgaac

SEQ ID NO: 1361 - DNA, 584 bp, Myxococcus xanthus
taagggccttttggggtaacagcccctttaccgaaaagaagcgctagcagaagtaaaagcacacgcgcaaagtatgactgatgctttaaatgaaagcggtatcttaccttatccggttgtgctgcaagatttagctgtgagtgctgatacgattacaagcatgatgaaagaagtgaattaccgagatgaagttgccggtgtaatcacgtggatgcatacgttctcgcctgcaaaaatgtggattcgcggtaccaagttactgcaaaaaccggtgcttcatttggcaacacaatttaacgaaagtattccttgggaaacaattgatatggattttatgaacttgaatcagtccgctcacggtgatcgtgaatacggctttatcaacgcgcgtttgaacaagcaaaataaaattgtagtaggctactgggagcgccccgacgtacagcagcaaattgcacagtggatggacgtagccgctgcttataacgaaagcttcaacattaaaatcgcgcgtttcggtgacaatatgcgcaacgtgggggtaacaaaaaggagataaatcgaagcgcaaattccatttggat

SEQ ID NO: 1362 - DNA, 351 bp, Myxococcus xanthus
gaccacacgcgggcgccgggctctttctcacacggcttgccggagggcgtgggcgggaagagcagggcgagcaccgggccggcatggccggtgtccttctcgccgcggacctcgaactccaccgcgcccacgaggtaccagatgcgcagcttgccgtcgtaaccggcggacaccagccggccgtcgcgcggtgtgaaagcgagcgctctcacggcgccttaggggccagtcatgtctcgctgcacgccaggagtcactgcgaaaacccatagcacgccggctgtaccccggcccggcgagaacgttccggaagggatacccgccactagtcgccggagacgggtggaggcc

SEQ ID NO: 1363 - DNA, 347 bp, Myxococcus xanthus
ggaaccgccaagactaggccgtgggggtgacgtccccgccctccgggatgttgctgtgcctggactgcacgaaggtggaggccgacactacctactggccgcacttcacggacgagctgcgcaagggcgcgtttccggcgaagttgattgaggtggcgctctttcacaacgtcccattgctcgcgtatgtgctggacacgctggcgttcccgatccccacgctcgtgggctttgtgggctttgggtttctgggcacgcgggagcatgggcgcattctcacgcacgagggctccgacttcggacagaccctggtgctggtaatcatctatgatctgtacgtgaaccat

SEQ ID NO: 1364 - DNA, 679 bp, Myxococcus xanthus
ctctaaagaacccataatcaggtcttccaccaactacagctccttgaatcgaaaagatgtgcgcggacattccgcatagaaaggtcatcataataattagcagtgactcaagtagcccatagatacttcctactctccccatcatgtcaacgggaatgctgttttgataaaaggtttgaaaaccagcacttgcaaaagctaacgcaaaagataagctaaaaaatcctgttcccatggtttgaaaagaagacgaacacgcgtacagcaaatagccaagcgatactcctacactgccggcgcctatgagaaagttcgccgacagcttctgagccaacagtgtattcacaactgcgccaatcataatgccagcgcctgctacgcttactaaaaatccgtattcgctttcggataaatgaatgactcttgttgcaaatgaaacttcaagagaatcaattgccgtggccatgaccattaagaaactgaacaatacataaatggtgataatgtatctgttagctctactgaaacgaaacaccgctttccaatcttctccaattgtgtttacagagagtttattttctttagcttctgtttttatatctaagttcggcattaataaagtaaccattcctgacaccacgagcgctgcagcattggcatagatagcaaacacaggcgt

SEQ ID NO: 1365 - DNA, 375 bp, Myxococcus xanthus
  unsure (1)..(375): unsure at all n locations
cttntnggagtgaccgatagcctatgccggcccggtgtacattattcttatgtccaggtcgagcgccgtcaggatggtgcggacctactggtaagagttggtgccgacggactgcgacacgcacatggcccaggaccccaggcccatgcagtatgtagggcccgaaatgccgataatcgatgcggactccatggctttcctccccgtgcgtattgctgagtacaaattgctacccttgttcgggcgcttatacggggggcaggccgagttcctagatgttgtttacgattgatggagcatcggctgtgtggttccgactaccgttgggagcgacttgatttcaaactaattcgcatcgagggagatagatgctgg

SEQ ID NO: 1366 - DNA, 386 bp, Myxococcus xanthus
ggagatcggtcccgccacactgcgattgctatgagcaggaatgcgaccccgacataaatcaagggagggtcgtggagcaaattggagggagggcgcggtttctctctggaaagagctggatcttcgagcattttctgcgctgcatcgcgaaatgcctggatccttttttctggaggggatgcaggaacaccaggcagaggcaagaggggtcttattctgtatgttattgcgtctccaatgtggtatatgttgaatatgtttaggtcggcgtcttttgcgagcttggtgagcctcgcttcccagtcatgagggggttgatactttagttcgattttttcgggatctggctttgtcatgggtggagggtggggtttggtggtgcatct

SEQ ID NO: 1367 - DNA, 323 bp, Myxococcus xanthus
aggcttgggggaggcggcctaggctgcaggtctttttaccccatctgatgctcgggctggtgacacgtttggcgcccttgcatgacggggacttccatatcgtctttttggacaaaaaggagcagagacatgcagaccacgactctgactagcccgatgaattcgtactccttgaaccacactaccatcaggatcggcctgctgctgcccgcggatctaatgaccactgccatgctgtgtgctctacccattggaaggagatggccaagactctgaagcctttcggcctcgcatggatgcaggatgacaaggcagacgtcgac

SEQ ID NO: 1368 - DNA, 380 bp, Myxococcus xanthus
  unsure (1)..(380): unsure at all n locations
aggctttggctgnagaacgagtagccgttgatcggcgcgaagcacgacgccacgcaggggggggtggtggttatggcaacnggagaggagaacgccaaagaacgccacccgaaggncgattcggtggagaaggcggcggaggcaagcaactggaccgggcagctcgacagaacgaccacgggggagccgatggtgccaatggccacggagaagcgggcgcgcgtcagcggggcggccacattcaagaggaacatcacccccactgagagggaggcggggggagaagcgcaggcggagccgggaggacctggggggcgcaaagatgcggaacgaggggaagggcgctgccacggggcaaggcccgagggcctaaagaaacg

SEQ ID NO: 1369 - DNA, 536 bp, Myxococcus xanthus
  unsure (1)..(536): unsure at all n locations
tgctctaaacggcctggccggactggaccttcttcgtccattcacccgaggcggcctcggcggggggcgccgcggccggcacctcggcggcggaaggcgccgtgggcttcgccggcgtcgtcgcggaaggcggggtaccaccccccatggattccttcttgtcggagtccttgcaggcggtgagggtaaggcagaggaggacagtcgtcaggaattgggtccgcatggcgcgcggaccttagccccttttccaatggattccaggggcttacggggtcatcggtcggcatctgtcagataccgggagtgaaaatcagtaaggtctgtgagtctggacgcaacaaatggccagaaagcccgatgatccgggtaacgctacaaaaaagcccttcaaattcccgtaggagcacactccatggcgcctccgattcgccgcaacgagccccgtcccgtcccgccgcctcccgtgacggcgcgtccgacttccgccgctcncgcttctcctccggcgcgcgcggaggcccgtcccgggcagt

SEQ ID NO: 1370 - DNA, 257 bp, Myxococcus xanthus
tgttaggtgtgaccaggagccgttgctggtggtgtaatgcaaggacgatgggactcctaacgacttgtacgagctggcgaatttgtgtactaatcccgggttcccgatgggattgaaacgcaaggacgtaatgtggccatgccacctgtaacgcttcaatgccacggatggtggagagcttcagcggccgtgcagcgtgccagtgcaaacattaactggggagtataatctgaacacggacgtgctgcgcatatacc

SEQ ID NO: 1371 - DNA, 467 bp, Myxococcus xanthus
ttcgaccctgatttgcattggtctgtcatccatgcaacgcacattgagccacgtggcttgcgtgcacctgctgatgaatctggatgtggggctgacttccatgacacatggttctcaggccgctgaggttacttgtttgaccagcatgcagaccttgtgatcaacgtacaagggcttgtgcacgacctgctgctcggatggacggtgctggacacgagggaatccatctcctagggtgcggcgaggatgatgaacgataccctgctgtgcttcatctaccacatgatctccagcaccagggactacaacgtgttcatcctgctgtatgagacgaggatggatgacaccctgcacaccatcaaggtgcacgtctaccggggtgagtgcaacaatgacacgctgttgctctccatctagacgatgtacctcaccaccatgaggacgatggccatctggcgaatcactga

SEQ ID NO: 1372 - DNA, 391 bp, Myxococcus xanthus
gcccttgctcaaaagtcgggcgtggcacaccgttagcgcatctcatccgggcaactggtgcacgaagacatggtgcggccccatccgtcagtgctgatgcccgaacgcatgcactgcaaagaccacgtgatggtgtcgcacgaccacacggggcgcggggaggtcggagcctacgcccgccttgtctgtctgcgagaggtgctcagggcccaccaacacgcggagcacggcgttccgagacacctcgctcttgacatgcgatcgcgtcgtgcgcatgacatgacacatgcccaatgtagagtttggttgcgggcgaaaccacccagcgtgttacgataggcacgactgcttatacagcatcacgtgcgccaccgggcgaggtctgatgtga

SEQ ID NO: 1373 - DNA, 578 bp, Myxococcus xanthus
agctctaaagcgctccgctttctctcatcaaacaaaaaatatccattcccgcaaactctccgtacccttgatagcacgactcataataaactttaccaggtgtcaccaaataacactcccgctgccacgacggctgcttactgtagacactcgcaatacttattccactcactgcacacttccagctgcaaattccaaccatataacgcctccaacgacttaatagtctattcatctacaacttttgatgaaatcaaacgtcctgagaaatgtacagcattttaacgtcgaccaaaaacctacgctaccagattccctgaccccttgaattcccccaaaaaggtccacctatgcggaagttggcagcccgcaagggaggacaacttccgcttaggtctagctctgtctccgtggctaaagagcagccacggagacagagctacatcgataaaaataaaaaaggtctgataaatcgaccatttctggtgattatcagacctcaagttttctgcatttgagcggcttatttgctgttcaagcgaattagccagcaggacaatttcatgatctacatattt

SEQ ID NO: 1374 - DNA, 511 bp, Myxococcus xanthus
gtgctctaaaggctcctagcgctcgtgctccaccaacctcaacatgacgtgtgcccagatgcacttgggctcactgcccatgaaggcccccatcctgcctagaccgcacgggactaaactccgaccatgctttaacgcggagcactacccgcgcgcaggtgcagttcccaaacaccacccttgcaactgatgggttggtgcaccggccttgcataactcctgtcaacgaacatgaccctccactgctggaaattgcgaacccatcgacttcccacacactagcagttactcaggcaacgccacccaatacagtgaagatctgctctgccccatggcatggctgacagctcacgcttatcataagccaacctgacttttccacacaaaaggcccatcaaaggtctttatccctcctgacaggcggcgccatgccggggctcctcttcatccttttgctgcatgccatgcctggatcactcgatttcaccactgggcgctggcacctcaaccg

SEQ ID NO: 1375 - DNA, 387 bp, Myxococcus xanthus
gggctggcgcttcaacttgggggtgctggacgacccgatgcagaatctcaacacggtccgccccgatggcgacacccggtagggatcccaacggctcgaacagacggtggactacaccggaaaggtcgacacgatggcgatcctggcccgacagaataagataccaaccataagccaggagacgggtgtggagggtgtctaccgctgccaccaggatcagcaggttcgcgctgccctcaaggcgcgtccaatggggactgctgccgacaagaacgaccttgaccgccctgaagacgatccccaccaaaaagtcctggggacgaacggccatgccaatagcgccgttccgaagattgctctggaccaaggcactgacggccctaacca

SEQ ID NO: 1376 - DNA, 477 bp, Myxococcus xanthus
tgctctaacgggtgagcgcttggcggtgatccacgagctgattccgtgcctggtcagagtttgacaggtcttgaagcacaagctgatgggacggccactgctcacccagaccagccacatgatctactgcacgatcatggaggtggcgaacgagaccctttacgcgttcatggacctgggctactaggttgtcaactgggagcggcgtaccgcgcacgcggacatgacctactaccttgatgggcaatgcaccagctcgcacggaatacaatactttctgttcatgcctaggaagctcgtgcggtgcaggaagaccatggggctcttactctataccctggggactatcagcccggacggatacctcgaccccgtgggcatgaacaccgtccaccggctgatgtaggttgtgctgcacctccacgagtgccagtagcatatggactggaagatgcttctgcccaccagtgttggcac

SEQ ID NO: 1377 - DNA, 550 bp, Myxococcus xanthus
gtgctctaaagagcgctggggggaccatgctgggatcataccgtgggatgtgaggccatggtcggcacgactgactagaccacccggacttaccggcaaacactgtccgggcggacctgaacctgtaactgttcttgttcttcaccagtgacactgcttcttcgtgcgcgccccagccccactggcagtggcggctgaccatacaacgagtggctagacttcagctcccgccggtacagcccgctcctgccaggcgtggggcgcctcttgattgccaagctgcccaatctcaaacgggcgagggtgctccccgggcggaccaccacgtacagcgccacggtgcacccggacgacctaggactcccacccctgcaaggcgaaggcagagggatggcccgtgcggccggactcctgcgactggcggtggtctcccccagacaggtgacccgcgtggagcgcaccacggtgcggcactgcgcccagacacgggacggctccctgtacgtcctgtccactgcgacgcacgacaatgatacccctgtcacaatga

SEQ ID NO: 1378 - DNA, 617 bp, Myxococcus xanthus
tctacgatttatgctctttttgagcatctttaaagcagttgtacattgctttgctgcctaaatgattagcggagtgaatcgtaattcgatcggcatataaatggtgttttaccataaaatgcacgagcatcaatccattccgtgtcttgctgagtaaatcgtgatcgagtgacaaatgttcaacatcgaatgaccttagcaggtcaatacattcgtcaatcgtttcggctaaaacatgaccgtcagggcacttgcgatagtcgtctagaaaaacattgattttcatgactgattctcccttccttgccttgtatttagtgtaacatacataatgtcatatacctacctaagtctattcgacaccttttaagctattccttcttaaataggggtaaaaacacgaatttttatcattatttgcatattcacggcgaataaacaggaaataaggaaagagatgtcgaacgaaaagtaaataaataaacagtttaaactggaaattaactttttttattctgtgatctttgtttaacaaggtcttttaaatcccagatttaacaagggatggaaaaggtttaatgaataaaagattgtgagaaaaaaacgataatttgcga

SEQ ID NO: 1379 - DNA, 404 bp, Myxococcus xanthus
gccccggcactcaacctaatcacggtcattctgcgcgtcatggccgacctccacatcggctagcacttcgggctgcacacgatcttgccggccacaggccagtccacgagtccggtcactatgcgccgatccttgacctagctgtggatcatgaagatgacctgatcctataagtgacgcgcttgacaggccgcgaacataccggacacggcgcgttagaccatgttgataacgcattccaccctgctcgtgatgtaaaccacgccgcgcttgccgcacatgatctggatgatgttgtacaactactcctagttcgcgcgcttcacctgcaccttgtaccggacacacaccatgtacgcctcatccactaagccggtgctgctcagctacgtgcacaaggcggt

SEQ ID NO: 1380 - DNA, 376 bp, Myxococcus xanthus
ttacctgtgcgcctaagtgtatgatgcacatatggatgctggacacatacccgatgttcctacggcccgaggatgttgggaaaccggttatgtgcctcttcagagtgagggacgcgcgcgattggagcgggcggactggccatggtgataagttgtcgcgcaccgtacgctgcttccagcttaacggcgatgtccacaggttgctgctgaagccgaactgcctgatcagaacggtttatccggtgaaggtgacgggcacgggcatttatgtgcgatgcaacttgcccgagctgatggtcgaccgcaccgctagaatacctccattgcgcgtgtggcgcacagcattttaactgttcaacgtggacatgtaggccag

SEQ ID NO: 1381 - DNA, 480 bp, Myxococcus xanthus
ctaagcatagcgtcggtccatgtgctcgcggatgcggggggccgcggctggctgaggctccactagacaacccaccaaagccgtaccccacggcgcgctggttgatgcctgccacagcacgcgccgccaggctgtgacggacttggtctgggattctggcggggcgctcgacggacagggggtccgggagttcctatgcctgcggtgcttccgttgtgcccggggtctagggggtgccccatgggtcagggctgtgcgccgcctcgggctcaacgagttctacatgtacgacctctatgagctgaatgggatccgaacgggacatgtcatgaacttgctactctaccacttgttggacgctgtcttcatctacaacccggcggtcctgcgcacccagagcgagaccgcgcacgtgagcagcgcgctgcgctaactgcagacgggcaataccaagatctacgcccgttggatggtcatcgc

SEQ ID NO: 1382 - DNA, 653 bp, Myxococcus xanthus
ttgtatctcttactttttctaattgagctgaaattttactaatatccatgttctctcactcttttcatttagttttaacactgcaaaaaaaagacaaaaaagcaccttgcatgcgcaaagtgctttggtatgtactcacattccctgcgctggcattatccaacaggttcaaatggtcaacaggcgcccctgtactctcagcctgccccgcgcaagctcccatactattcttgttacgtttaaagtttactattaaccttttttatttgcaaccatttcactgttttgcccataaaataaagcttcgctataggctgagtggtgttgtaaatcttacagctttactaaaagcatcattaaaagacctccagtaaactactggaggtcttctatcccctaaaaattctatcatttttcttgaatcgcttgatttctcacagctgtttttcggtcctttcctgctcttaaagataaaagaaaacaaagcagcagtacaagtgcagctgatacgtacgggtaattaatgtttatatcaaaaagaaagcctgctacaacaggtccaataatattaccaagacttgtataagcagaatttagtccggctacatacccttggtcgtcttgtgccatcatcgacatttgcgtgctgattg

SEQ ID NO: 1383 - DNA, 543 bp, Myxococcus xanthus
ggccagctcactgcagcctcctagcagcaccgcccatctggaaaacgtattgatgaccatctcacccaccctgacgaactcgttgcctgcgaccgcccggaccttcaagaattgccactgaacgagccactccgccccatagacaaggacgatctcctggcccgaccagatcgagttcgccacacccgcggggatcgccctcagcccaaacgacacgcacttgaacgccgcgccatagctcacgtccattaggatgcacatccccctgcgctggaagacgttagacctattaagggctatggtccgcacctgctatagcacgatcgcaatccccacatagaccgcgttgagcatgaacacccttccccggcctgtatgacaacctgttccgaacgcggcccactcgaacgtccgatacgagaacgccaggcttctctccaggagacaacgggtcttcggccattcagaatgcgacaagggcactctcgggctcactgcttgacggacgtgggcttgatgaccgccttgcttttcttccataga

SEQ ID NO: 1384 - DNA, 507 bp, Myxococcus xanthus
ctctaaggtgctctggttcgcggcacagttgaatgtgaagggcgacggaggcttgcccttcgacgtgcctcagcgactgggcaaggcgcgccgcaccctggtcgagctgcgtgacccggcctggcgttcgtacctggcgtggttcgaaatctacgctgcgctcgcggcgcccgccgccgaggaggcccgttcggccccgtaggccgcgccccagggctcccggtgctccaaggcgagcgggctcaggcgggcagcgcgcgtgacagcgcctgccgtaccgccgcgcgcacgggcgcggggacctcatccccggggatgcgccggcacagggacaccgtgcgcttgagcgcgtcacacgcgtcgctgcagcgggggcagcgggacagatggtcctccaggcgcacacaggcggcctggtccacctcctccgcggcgaactccgacagctcctgcgccagctccggacaccccgcgccctgtccgtgggcgccctcccccaggaggggg

SEQ ID NO: 1385 - DNA, 227 bp, Myxococcus xanthus
ccaccgtaccaaggagccttgacttcgtttacccccgaaacgagggtcccttgcttgcatgctcaaaattccacaaggaatccaggggcttaagaccactcagtgtgtcacatgcgcgttgacaggtcgacgcaaaagcggggccaacccattctaagcactcctctgacaggtggccagccgggctcaaaacgcttgttggaaggccgaacccgttcccccaaggt

SEQ ID NO: 1386 - DNA, 734 bp, Myxococcus xanthus
tcgcacaatataaggaaccgtaaatgtttttgcgatcttccccggcttggctgaaaataaaaagattcggctgttcatagcattggcttcgccgatctcgtgcgtgaccaaaacggccgtttcttgataggacatcatagaccttcgagacaccttcttcacgcttgagttttgtttgaacctccagtgcttatataggctactccgacaccacaataccctgctcattggccattcatccgactaaagcgaccttttgtctcatgcctccggattactggacgcggatataggtcatttacgtactgtacaccaattaattttacaaccgaaggggctttactctctgttttatccgttcgctgcccgggaatttcaagcccaagtgagatattccttttagtggttttcctctgccacaaataatcttgctgaagcatataaccgatgtttgggactgatgttccaatattttcaccgtctattgtgacagacccgtacgttggttcaatcaagcctgcaataatcgatagaagcgtcgttcctccacatccgcttgggccgacaaaggaaacgaattctccttcttcaatagacaaattaatgtgttcaagctcagtgcccccagactttgtgcgaaggcacatatgttgaatatcttgaatgtgcatttttgccatattactccctcattgcatcttatgacaattcttgttttactagcttgctgggac

SEQ ID NO: 1387 - DNA, 723 bp, Myxococcus xanthus
cgtcaccccggacgggaagccttggttcactgtcgctcagacagatacggggcatgggacggttatgattaactgcgtgtagacgatggcgctctgcagacaatgggttcacagcaatatcacttgacgtaatgccgccttttgcaacgataaagtctggacgaacgtttaagcggcgaacaatgcttgtaaccgcatctgaaatttttaccgataatttaagctcttcttcttttttgccttcgccaagatctaagcgctcgcgtcttgtatacacagctaccgtttgaccttgtgaaataagcttatctgcttcattgataatacggttcacttcttgttcaaacttttcaggttctaagacaagatgacagtcaaattcaataaattcaatgaagctgcatttctttaattcttctaactgctccgttgattttttgacgtgtgaaccaaccataattaatgcgtcgtttgacgacttctctttaatgagctcttcttttgttaaaaggtctttatcgctcacgccgcccattacttttgttagagccgcagcgcttcgatacataaagtgctttccaagcttcatagcgcgaagaagcgcaatcgtcacaacttttacgtctacataatccactgcgttcacgattactttgttaaagtctttcacttccattaactgatttgtgatcgtcactaaaataaagtgcacgaatgctcccc

SEQ ID NO: 1388 - DNA, 693 bp, Myxococcus xanthus
  unsure (1)..(693): unsure at all n locations
ctaaagctcactgatgagcagcgccagcggcacgcccgcgatggcctttcccaacaccagcaggaagccggtgagcatggcggccgttccgagcaggttccatcccggcggcaggaaccatgtcgtggtgatgatggccatgggcatgaccgtggtgagcaccaccatccgcccgtactccgcgcgaggaacgacgccaacgatttcccccgcgcgattgccagccccactgccaatcacaggcacgctgtctgccatgagctccccccaacggtgtgttggcggaaatcctagcgatggggcgcggcaggcgttccgctgtgccggggcggcgcccctggtggacgggcttccagcactggagggcagtggacagacgcgagggcgccgtgcctcaggcgcgcgtgcgagggatgcccagcttctggcgcttctcccacaatgccttgcggctgatgcccaggcgcttcgccagctccgtctcgcccatgtgctcctggtgctccatgacgaagcggcggaagtactcctccatggattccggtgaggcgccgctggcttcctcggcggcggccggngctcctgtcggcggattcggtggacgctccgaagctgtccgccgtgtcgggcagctccagccccaggagtcccgttgtcaccaccgggccatccgcgaagatgacggcgcgctcc

SEQ ID NO: 1389 - DNA, 284 bp, Myxococcus xanthus
ctctcaaggccaaacagaagccgaccacctgcacgagctggccgacctggacgacggccgcgggctccagattgtctagctattcttacgacacgtgctccttgttgaccccatcgatgacattctgccaggctcgtaagtgtttcataccatacaggcgcgtgacctgctcttccaactgcacatggttggcacctacgacactacctgggatggggttggggctaccacggcccggggtctacacattgatgagcacagcatcgatttcatctacatcaatc

SEQ ID NO: 1390 - DNA, 390 bp, Myxococcus xanthus
ttggactggaaggtctgggtgctgcgcaccccgacgtatatgtagacgtggcacacctagggcatgccgtttaggcagaaagcgtgctcgctcatggggtggatcacctggcttatgaacacggacttcgaatggagcgggatgaacaacaccaccgccctgatcatgtacaccttcgacatggacgccatgcccttcttgatggtggaccatgtgtccaggatagtgcccctggagcgcaagtccatgtggtacacgctgctcaagagggcccacgacccggatgatacgagcctgccctgccggctgtaccagaaagtcgtggataagtccatatggcgccgtcatgccgtggccctgaaacactgcggccagcgcacgtccgagctg

SEQ ID NO: 1391 - DNA, 198 bp, Myxococcus xanthus
tgagggggccggggggccccaaggggccgggggaccccaaggggcgcaggggccctcggggggacctccgggggcggaggggctcgcggggccccgtggagaggaagggctgaaagggccacgagggcccaagggggtggaaaggccccgcggggggatggggccccaagggtcgcaaggggccaaaggggacacggg

SEQ ID NO: 1392 - DNA, 260 bp, Myxococcus xanthus
ccttggtgatgagcttctacatttcgctggcaggcagctgtgagacacgaaattccggccggtggactacttcgggcctgcggatgatgcctagcttccaagaagcgataagtgacgcaggtgcctgacaagcctcccagggagcttactgactatcggcaatccgaagaggcgcgcttggggacaccggctggtgcctgttgccccgttccctttcactaagtccatatgtatgatggagatacccacgggcagacaga

SEQ ID NO: 1393 - DNA, 232 bp, Myxococcus xanthus
ctctaaaaatgacatcgcgttgtccgtggccattggggccggagaacaacccacccgcccgaaggtttttcggaactttccggttaattaacttcgcttccccgggggggggattaaattgcccccccattgggttattcccgtggaaacccaacaactttttaaaaggttggcccgtccgccccaaaaaatggcccccaaagctttaaaaaccaacccattgccacctttt

SEQ ID NO: 1394 - DNA, 400 bp, Myxococcus xanthus
tgctgttgtgacagctctgctcgtcgctgacgtgaatcatgtgcctgagggacgtgagatcggtcctgtccgatggggcgaattcctcacacctgattaccctcatgctgtactcctgttcggaccacggcgtggggctgcgcgtgaccctgcgggcggtcttgagcgtgttcttggaagcggttccgaccaccaagacgctgagctacggctagggcaccggcctcatcatgctgtcgatgcagacgtgcctggcgccgtgcttcaacgtggacgcggggcactatcttctgttgggactacaacgacttagtggactggatgggcgcgacgtcgagccgagccatcatggtcattacgagactggacgtgcaactacgtgatctgcagagtgacgcct

SEQ ID NO: 1395 - DNA, 310 bp, Myxococcus xanthus
acggtgttgaacgaaaccccctacgcgctggtggaccggctggcggacgtcgtcccccttagcctctaggacatgaaccacgtgcgccagctagggcacacaaaggggggcaagccggaaccgccggaccccgtcaactcgctctgttgtctgtgacgcatgacctggtacacgcctccgcaccgcccgcgggctggcacgcgctgactctgccggagctgcatgtcccgccctcgccggcccgacatggacatagggagggtcctggggaacttgcagacacgcctgggcaggacgcggtagccggggc

SEQ ID NO: 1396 - DNA, 334 bp, Myxococcus xanthus
gagcaccgcgcacgacatctctccttagccccagcccgagaacccccaccacctgctgtggagggaagggcagcccccagggcggagaaggtgacccacacccgcaaacagcaacgccacctcgggcgactcgccggagagcaccaccgcgcccgcgctcaagaggatcacctccaccaccgcgacagacgtgcaacgagcaaacagctcgcgcacgcgctccgaagcgccggggcggcgcaccacgctcacaatgcgcgcggacagtccggccatggacgcggacccgaagacgaagtcaaccgcgccagcacacaggccgagcacgcgcaca

SEQ ID NO: 1397 - DNA, 105 bp, Myxococcus xanthus
gctctatacaatactaggacgaggggctggatctgaaaggggtgccgcgctaactggaggtggtgggcgccggtgccatcgcctgtgattaccctgggatgttag

SEQ ID NO: 1398 - DNA, 443 bp, Myxococcus xanthus
gctctaaccgcttggcgagtctcgggcggttggatgccaggctcgtggtaaaccgggaccttgaaccgcttgccgagtacgtctgagcgatacaatgccgagggcaagctgagggcgcccatcaaaaggcagggggacgcaccccttcctggaagaggccgctggcaaactttacggacccgggccccataaccgagccctccatggcgcccctaatgaaggcctggagccagacccttggggttctggttcaaacttgcttaaacgggccacatgagggactcccaccacccggggactgtacttacaaatctgccacccgggcgtaacgttatctgaccctcccacgcgggccggagagaaggccgcctccactctgccactgacgtcttggggactgaaggcgaagacaatttcacaaaacgtgacggcgtacttcgggt

SEQ ID NO: 1399 - DNA, 599 bp, Myxococcus xanthus
gcctaatgactaaggggcgcaataggccggttccggctccacttacggaggactgcggcatgcgatatacgcgcgagcaccaggtgttttactgattgactagtccaataatgggccacgcgcgtgcacccgattgacgtgggatacggatagcttcacaaaaagctgaccactgactcatgggtgcggtcacaccagcgcgtatatgcgcgctacctaacaggagaatacctgccagatacagtgggtgtatgtgttatagacctgagcttaatatcactcacacaagggctgccaccagtgctaacgtacatagcaccaggcggattatcactcgcgctagctaagccctagctataggtgggggctgcaccacgtagggaaagacggcctggtgcctgatgtccatcccaatgaggatggcatcgacactgtgacggactatgtactcgaacatggcctggacgatctcgggcagatggactacactgtgccccgccccgttggcaatgacgacgcacttgctctggtcagcctgcgctatgttctccacgactttgccggctatggcggaagccacacaaacgcactttgtgtac

SEQ ID NO: 1400 - DNA, 730 bp, Myxococcus xanthus
  unsure (1)..(730): unsure at all n locations
aaacctttatgctgaatgccttgttcaattaagcttgttaactcttttaaattcgttgaaaagctttgcgctacaaacgttgccccggaagttaacgccagctccatgacagataaagacgactcaattgatccttcaggcgtactttttgtcttgaatcctacttcactgcgaggagatgtttgtccttttgttaaaccatagatttggttatccattacgatatacgttacatcgatgtttcggcgaatcgcatgtaccgtgtgtcccataccgatagcaaacccatctccatcaccgccagatgcgataacggttaaatcacgattagccatttttacaccttgagcgattggaagcgcacgtccgtgaataccgtgaaaaccatatgaattaatataaccagagatacgtccagagcatccaatacctgaaataacagcaagctcatgaggttctaaacctacgttagcagatgcgcgttgaatggctgcttgtacggagaaatctccacaccccggacaccagttaggttttacactgttacgaaaatctttaaacgttgccatttaacacaaacatctccttactttttgcgtatacttcttgcggaagaaatggatttccatcgtacttcaatacgctttgaattttatcatgacttgcgatattcattttaaaatattagcaagctgtccagtagcattgttntcaacgacaactacttttt

SEQ ID NO: 1401 - DNA, 473 bp, Myxococcus xanthus
tgtgctctaaaggacatgctccgccttgttacgcggactgctcttcccgcactagccatgcccgccatactgggactgccacggtcaacctgctgcctgtgtgaagagtgaggaccggaccatcatgcatccacccgaggaggtcaaggccctctggctgttgttctcgcgccatgtactggatctggctgaccggccgacgaactctcacccagacctgctgcgccactacggaaggaggccacgccctccttgccaccgcctccaaaacaacccgtgtcctgatggaaagggagctgatggaccatgcccccgagagcctcacatgccggaacgtctaccacccgaatctaaacagcacgcgtgtccacagcgcgccattgaacgagcaagaatgccagctgagcgatgatcctagacgttaccgcgacgagcccggtgacgaatcgtgtcgtgactgcatgcaactccat

SEQ ID NO: 1402 - DNA, 773 bp, Myxococcus xanthus
  unsure (1)..(773): unsure at all n locations
gtgctctcaagttttatttttaaatatttctgatatatggtataatttaaactgataaaaagatgctgcatgtatgctaaaagagcaggccgtatggtttcgctcttttgttgtttttacgctatgtggcacaacgaaagaaggaaatagaatggaattatggaaacgaaacttgtacatttgctggttcggttctttttgcaccacagccgggatgagtttagttattccgtttttaccgctttatattgaaaagctgggagttcacgatacaagctccatcagcagatgggctggtattgcgtttggagctacctttttaatggcggctattgtttctcctttatgggggagtttggccgataaatacgggcgaaagcttatgctccttcgcgcaagcttgggtatggcaattgttatgacttctattggttttgtgcaaaatgtctatcagcttgtcgggctgcgctttttaatgggggccgtttccggcttcatctctgcagccattacgttagtagcgactcaaacacctaaagagcacagcggtaaagcattagggacgttgtctacaggggctgtatcaggatctttattaggaccgctagtaggcggctacttaggagatacaattggattgcgtcacgtctttttcgtaacaggcgcatttatgtttttgtcttttttaattggaaatntaattcaagaagacaaaaaagagacggcgaaaacgacgaaagagtctaacattgggttactttctcttaagaatt

SEQ ID NO: 1403 - DNA, 213 bp, Myxococcus xanthus
ttgggtggtggcatctgcgggggacccagacagacagacctgcaacgcatgcgactggcgctttactgtcgcgctcccccggcggggtggagggtcccgttgacctcatgagaggtacttgagaaccgaccacgtagactgggatgctgtgaactcgccactcaacacctgagctacgacgcttggttatcgaggagccttctccccactgga

SEQ ID NO: 1404 - DNA, 56 bp, Myxococcus xanthus
gggccagaccgcccggggggtttccgcccaggttgggacccgtcccacgcggaacg

SEQ ID NO: 1405 - DNA, 388 bp, Myxococcus xanthus
ctctaaattgcctcgcacgagcggtaaagcatctgctacccgatcggaatctggccacctgggacgtgatgctgaccgtgctgaactgcgccctgacggttgctggtgtcttccccatcatcaaacagattctgtagcagagatggggcatttgccgggctctgctggacgcggccctttacatttgtcacgacgagaacaagggcctacacgatgacctcctggaacagctctacttctggggcgggatattaatcatcctggggattgccctgggctggcctcttgctgatcccccgactagctttcatgcccttactcgccagggtgctgaagtgtttacgcctacaggtcatgctacctgttgtgctgaacccgggtggtggac

SEQ ID NO: 1406 - DNA, 419 bp, Myxococcus xanthus
aaaaccttagtggatttgctgcataccagtccgtgggccagctggacgagaccctcaagccccagtatgccattgcgctgcttcgtgtggaggaggagggcgtcagagtccatgcttaccacctccaagcgataatgacactcaacaactaagtggcacgactgcaccccgctggcaaggcgctcaataaacacccggagatctctgacaggacccgcatgtaagacggatgtatgaactgcacgaccgcgacccacggcgaccagaaaaagggcgctgattagagtagcccgaatgcatcaaatgtccacggctacgaagcgtactaccaccttgctgaagaggaggggcacatccaaggcgtgctctaccagactccggctaggctttacaccctggtcgtgtggaattgccaccac

SEQ ID NO: 1407 - DNA, 676 bp, Myxococcus xanthus
tcttaacattgactaactgcctgtttaaatcatttcattatttagctatacaagcctgcacactattttattataacgtatattctgtatgggttgtttaagtgatgttgaatttgattaattgatgtcttttcataaacattttatactaatagcaagtaaacagtacgtaaatacccgtttttcttctatttataacgctaaggaggattttttgattgttatcacaatattataccgtaaaacaagaaggttcacatgaaatcactattcaaaaatctagattcatttgtcatatgaaacgtgtaacaactgaggaagaagctcagcaatttattcaagacattaaaaaacagcactggaatgctactcataactgttcagcttacctaattggagaacgagatcaatttcaaaaagcaaacgatgatggagaaccaagtggaacagcaggcgtaccaatgttagaagtgcttaaaaagagaggcttaaaagatacggtagtcgtcgttacgcgctatttcggaggtattaaattgggcgcaggtggattggtgcgcgcgtatggaaaatccgtttccgaagcgttaaatgaaataggtacagtcaaacgaactctcatggcggttatgcatacaacccgtcaactatacatgggcttggaaaaaattagaaa

SEQ ID NO: 1408 - DNA, 375 bp, Myxococcus xanthus
tgaggcgtgcccacgtcgactttgtgctaggcgatcttctagttggtcggtacggcgctgtaagatccgaacgagggcgttctgatgaaaatctggcagatgtacgaccaggaggggaccttctcgtctgaatagaggcgcaccataggcacgacgcacatcgtgaagtcgctaacgataccctcttcgatctggaagatgccgaccttcgctgacgaggaggtttcccggtatgagatagcgagggtcgccatgtactcctcgccgcttgggattggacttcaggtttacaatttcttgcacattacactggcgactatcacgttgcccagagtggtagtactcccatcccggtacaatgatcgcaatgcgctt

SEQ ID NO: 1409 - DNA, 194 bp, Myxococcus xanthus
tgccagacggcaggattcccgcggcgccttcaccgttaagaataccggccactagaacttgggcaccctcgggagggacgcctccacctacaccatctccacagagggcgagcgcctgcgctcggactctcacggcgctactacgggatacgtcgtcggtagagtgcgcacccgacgagggatctatccgatgt

SEQ ID NO: 1410 - DNA, 415 bp, Myxococcus xanthus
gggctacggcctgcgtggtcccctgagtctgcgtcttgggggggggggcttttctacggtccggccagggcgcatgcgattggcggtcggaacgcttgcttcggagtgggacgctcggcagtgccgtcgggcatgtatctcgccaagaggctattttgcaacgcccgggctgggacgaatatgacgcgggcggatgccggccctcctgacgcgggttgtggatatggaggacgggactgacgtcctgggggactgtcggggctcagatgacctgcccgcgacgggacgtgatgctgaccggggatggtccacgccggatgctgagcgcaccgggtgacgcaagtggcgcggacattttaccgcagttctggacgccgggggagatttgggcgggcctggggtgaacccgagcaca

SEQ ID NO: 1411 - DNA, 91 bp, Myxococcus xanthus
cgcgtcccacagcgcgcgctgggccgggtccacctgcctggcatccgccaaccacatctcttatgctatataacacacctgcatatatcga

SEQ ID NO: 1412 - DNA, 440 bp, Myxococcus xanthus
tgtgctctaaaggcggggatacacccgatcctctttcgcgcgggctgagcgactccatattctaactgtcctggaccaagaccccccagttgatcaacgccatcttactggtgggggacccgtccccaagccagcccaaccacaactgaaaattccagatctgggcaaaaaatgcccgcgagaagcacatggttaccaacactgagcggggcccacgcgatgccgagtctgaagcacctgcgcggtgcaaccataaattaacggaccctaccttgcactccattgaccatcgcggatgactctgcgccagaacgccatcgtctgacgggtacctggcaaatgtgaacgctgcaatatgccccaggacactctacacacgcccctgggcggtacacgcccaaaacatagtccccgctcgtttcataggagcactagctccc

SEQ ID NO: 1413 - DNA, 617 bp, Myxococcus xanthus
  unsure (1)..(617): unsure at all n locations
ctctacagtcttcagcaagcccttgctccatttggagaaatgttcaaagcagcatttaacgtaaacggtgtcgttccaaataatgaagccatcgttgcgattgcactgagtaaatatggttcttcgaccgcattaattatgttttttggtatgattgtaaacctgctgattgctcgttttacacgatttaaatatatttttctgacaggacatatcactttgtacatgtcatgtatgattgccatcattttatccgtaagtggttttacatcgttttcattaattctctttggtgctttaacggtgggaattttcatgacgctttctccagccctcgttcagccttttatccgtaaactaacaggtaatgataatgtggcattaggacattctggagcagttggttttgcagttggtggtctcgtggggatggctgtaaagggaaagaaagagattgtatcaacagaaaaaattaactttccaaaaggtctcggcttcttacgagacagtacngntagtattgcattaactatggcgattttctacgttattgtcgctctttttgcgggccctgttatgtcgaaggtaattaaatgacggaaaaaactatattttat

SEQ ID NO: 1414 - DNA, 511 bp, Myxococcus xanthus
tctaacagatatgaacatcgtccccagtcaatgatgcctgaaaccatattggtttgattaacaatcatgtttttaatatgaagatctccgtgaactagtacatgtttttcttgatagtgaatttcttgtatgtcatttacatagtcttcaagaatctcttgttttgaataaagattacgctctttcatttgcttgacatacttttctaacgccggctttcgcttcatcatatccaatctatttaattcatcaaatggaacagcaagctcttgcgcttttgaatacggatagtgatgcagcgtgcgaagaaaccttgctagtacagaagcagattgtatgtgctcttcttctgctaatcttgcacgtggagttccttgaacgtaatgatagccccgaaacggccaaagatatactgcatttggcttaccgaaaaaaatgggctctgcaatggatagcggcagctgagaagcaaagcttggtaaaagctgaatttctgcttctaataggtcta

SEQ ID NO: 1415 - DNA, 758 bp, Myxococcus xanthus
cggcgtgtcctcgcatctttccgttatggaagttactttattatcagcgctcgtgtatgccggggctgctcagtttattatttgtgcactgatggttgcgaacagttcgatttcagctattattctcacaacattcatcgttaacttacgacattttcttttgagcgctacggtcgcgcctaaattcacaaaatattcgttattaaaaaacgtcggaattggagcacttctgacggatgaatcatttggagtgtcttcaaataaaattgcaaaaggtgagccaattaatgaccgctggatgaacggattaaatataacggcttacgtcagctggattattgcctgtacggcaggagctattttcggtcatttgctatcaaatccagaagcctttgggtttgattttgccttaacagctatgtttttagctctgcttgttttacaaatcgaaagcgtgttaccttcaaaacttaatcattatttacgtttaattctttatatggcgattattatgattgtgctgtcttttttggtaccttcacatgtagctgtcttaatttcaacgattattgtagcgacgattggggtggtgacggataaatgagtatccactattcaacacttatcattattttagggtgtgcccttgttaccgtagttcctcgtattggtccgtttttagttgtgcgtaacatcgcgctgccagaacccgtattaaaatggctgtcctatattcctatttgtattttaacagcact

SEQ ID NO: 1416 - DNA, 362 bp, Myxococcus xanthus
ggaagccgtgcgcatattctcaccgagctgcgcgccgacgtggaggacagttgggaccggttgatggggccgttgctggaggcagagctgcgctcggagctgaaggagcgcgcggaccagcaggccattggcgacttcggggagaacctgcgccacctgctgttcacaccgaccgctggcgcccgcgcggtgctggccctggacccgggccttagcaccggcaccaagctggtgattatggacgtcaccggcaacgtggtggagacgatgacgctctactccgagcgcggaccggatgagcgcgcccgcacggggaagctgctggccgcggaggtgcataagcacaaggccggaactcgtcg

SEQ ID NO: 1417 - DNA, 775 bp, Myxococcus xanthus
ctctcccgtatgagtattgacatggcaaaacaagcggtatcagaaggcattacggctattgttgccacgcctcatcatcagaatggcagatattttaatgaaaaagaagctattttacagagtgttgaacaattaaatagtttattagttcgtgaaggagtgccattaaccattttacctggtcaagaaaaccgtatttatggtgaaatcttagacgactatcatcaagacaaaatactcactttaaacaatacgggaaaatacttgtttgttgaatttccttcgagtcaagtccctcgatatacggagcggctgctgtttgatattcaatcacagggaatcatccctattatcgtccatccagaacgaaacagtcggttgttagaagaccctgatcttctctataactttattaataaaggagcattagctcaagttacagcttctagcttggttggacaatttggaaagaaaataaagaaattttctcaccagttaatagacgccaacctcgtgcattttgtttcctcagacgcccataacctccaacatcgctcttttcatatgcaagaggcgattgatgtgattgagagtgagcatggaagagattattattatatgtttctagaaaacgctcaatgcgttatcgacggaacacagtgttacaaagaatcttcagaaaaaattatgcggaaaaagtttctaggcattttttaatgcctaaagggtagaagctattgagcagtatagaaaccatgaaagaaattgatcattt

SEQ ID NO: 1418 - DNA, 450 bp, Myxococcus xanthus
gttggcatagaacaacagtgcgccatgactgcgcgtccacccgctgctggtcaatgacggccagcttttttatttgccgagcagcccgccccctccggcgccgggggtctgggtgcgattcactaggacactggacgccacgggcacgggcctggtgctccagtgcccccgccacccgcccagataaaggttcgtcaccagccatagggcctgccccaacggctccaacgctgaggaggcttgcaccatcctgaccgtgcagcgcaagccggatggacccaccccgatcatgggaaccgagcgccgcaaccgtgaacaatgagggcggatatacctgaagacgctatgtacctacgctgagaacctgatgagcgggagctgcatggagctgaactatcccttcaccaccaatggcatggcgacggacaaccggttcgcctggcgctccct

SEQ ID NO: 1419 - DNA, 184 bp, Myxococcus xanthus
tggatgatctacaccccctctacgagcagctgttccagctacaacaccttcctagttacgatgtacgccaagcccactggatgaaaccacatgtagccatgcatgatgatgagtccggaactggagccggcggacgtccggttcatctaccgacctaagtaacatatcattgatggccggttca

SEQ ID NO: 1420 - DNA, 398 bp, Myxococcus xanthus
cgctctacaaggggcgtgtgctcccggtgtgagacccctgtgccacacgccgagtcgggggaggatgcctgtctcaggggctccttctacaggtacatgggggacacgcccacccaccgtagggggactgcttgacaattcatcaatgtctcgcaaatgctgactctttattacgcctgacgaatggggcccagtggcaacttctatgcggggcctcatgctttgaaggcggagcacccttgcgactatttggggacgcctgcccatcagtccacggtgtttgacctgatgcgctcgtaccacttgatgatcatcacgagcgattcgggcataatgaaaaactccctgtcgctgagcgtgctgctctccgttgtaatcgaaaggcccctacaggacgg

SEQ ID NO: 1421 - DNA, 317 bp, Myxococcus xanthus
tgaaccgtactctggcgggcacaccgacggagcgaacctcgtggtggacatgtgctccgactcctcgcgcgagtgggtgctgcactcgcaggaggtgttgcaagcgttcccccacatgttgtgcaaccaagacctctacgcccgcggcgtctacgcggacctgcccattccggggcggccgcatgacgtggacctgtccactgctgaccgcaccggggaggggctgcttaacatggcgccgatctttctggtgatccccaacttcacaggctggatgcaagtggccagctactccattgcaagagagctcgagccca

SEQ ID NO: 1422 - DNA, 505 bp, Myxococcus xanthus
cttgcaaaacaaaggatggagtttttttttatgagcaataatccaattttcttgcgctggactgcctaaagcgacaaacacaatttttgctcttgaatcattaatcgtacgtgcaataacttcttcatttttttcatagccatttaatgttccaacaattaaaatccctggaaacatctcttccaatttagctttggcttcatctgcaatgccaggcttggctccgtataaaaaaattcttttaccgttattagttgcttctttgcacagcttcagcatcatatcaatacccgttacacgctcacgaatacgtccctttttgagctttgaagctaaaatcacaccgattccatctggaatttgataagtcgcttgatttaacagtgactttagttcctgaccttcttgtgctttcataattttttcaggattgattgctacaataaatgattttcggcctttatctatatcctgaagtaactttgccgctagctcatcgtacgtg

SEQ ID NO: 1423 - DNA, 687 bp, Myxococcus xanthus
gtgctctcaggctaccgtctaagttaatggtttcgatgtctacttttttcgaagcgtaatcataaaacgaaagcatttcaccgaacattaaattcgttttcatattatcgccaaccgcttcgataagattgccatatttattaagtgatccaatggaagcagcttttttaatcatggcttcgatcaactgctgttgtctttttcctcgctcaatatcgttgtcttgttttcgtgttcgagcaacagctaacgcttcttcaccattcaaatgttggtttcctggttttaagacaatagcattatgacgatcttttgagtccttttcactcatcgcataaggtacatcaaaatcgattcccccaagtgagtctacaatgtctgtgaaagctttaaaattcactttaacatagtaatcaacagggacattaaacagctgttctaccgtttctacagttgcttttggacctccgtacgcatgcgcatgcgtaattttatcttttttgttcacttcaggtatataaacccgcgaatctcgaggtatgcttacaagctttacggttttatttgtttcgttaaaggtcgccaaaatcaaagcatctgtacgggctgattttccgaactttctggtttcactgtcatctacgcccataaaataaatggatatatcatcttttttgggatcgattt

SEQ ID NO: 1424 - DNA, 285 bp, Myxococcus xanthus
actacctccagtgtgctctaaagagcatcatgactcgatccagcccgatagctgtccccaccctcctcgtagttacacaccggactcacggggtaaagctatacatgctaatgggactggggacactcatgccacccgggcgaatcaatcacttacacaacgccctccactgtcttccgtcctaccaacccgaccaactggaagtcgtcgtcagccatttcttgcactatctgacctcaagaaactatccaaccaatccctcaatcagaagccctctgagaggca

SEQ ID NO: 1425 - DNA, 744 bp, Myxococcus xanthus
ccgcagctttattttgcttgtattttttcggaacgctcatttcttttcctagtttccagccgtctttataagctttttgctgtaaagatttcacatctttattcgaataaaaacctgctttgtaccatttttctagttgaggcttgtcctgaagacttttaggcgctctataggtctgataagtgaaagctgagtcgtatccatctgcttttacgtctttttgtttttgtttctgtcctttttcatatccttgttcaaaggttgtttgcaattcgccctctgcttctgcaggtacttcgagtggaaggtcgtgatagccttgtacgtagccttgcttttcaaactgctttttttgctgattcagtacttcggcttgagcggtttcaaagccttctgtaaaagcctgacgtgtgacatcctcatcatcatacatgctgggaacactcatcgaatcattttcaagaccttgttcatagccttctttctttgctttaacagataggtccattaaagaaatagcttttttgtagccttgaacataacctttattccagtcggatgacttagaagggaaagggtcgatttccgattgaatagtagcatgtttgtaatcaaggacgccttgctgatagccttcctcttcgcggcagccatttcaatttcttgtcagtcttgagttctttctcttttttgctgctgccttttttatatcctaccgtataccccatcataaaccacgtgaat

SEQ ID NO: 1426 - DNA, 421 bp, Myxococcus xanthus
cgagctctccaggatgtgttaccgtggatcgcgtccactcccaatccctctgggaggggagcgaacacgattgacgcgacttcccattcacccgcggaccactcaccgacgcctgtgataactaccgctcatcaagcgtcagagggggtgtacataccagtttctggtatatctatggcgctatgaccacggccacctgacacagtccctacggcaccgtgggatctaccacaaaccgcagatattgggggacgtaccgctcccagtgcggagagagaatcggctcgcccctgttcgataaacgaggctgtatgcctgggacatcgattgccatgtatagtcctctccatcgacaacccctacctgaaggtgatccatcagtgcttcgcactcatcagcggccggagcctggctgatgact

SEQ ID NO: 1427 - DNA, 528 bp, Myxococcus xanthus
acgaacgtggcggtttcgtcatcggtggaatgaaaggtcttaccggtagggaccgcgaccggcaacagattgtgttccagcagcgcaatgaccgcgtccccaaacagcccggagggtgcttcctcctccatcttctggtgttgccgctggatgaaacattccagatggacatactggatgaggtggaccggctggacaacgacaatctggacctcaatgaggcgggtggccctgaagtagagatcaacgtacactccttcgttgccgactgcatacttggcccgttccgtacactggggtgagaccttctccatgtcccgcttgctactggaaaggggcatttcaatgtcgcacgcggcactagtgctgttgattaggactgcgttgccaatgcgcgttgggtccgctgcgaggctcgcactgtcgtccccactgcctatctggatggaatgcaagcggacgctcgggggcacaccaactttggagcctatctcttgcttttgattgatggcgaggaattcggctggg

SEQ ID NO: 1428 - DNA, 619 bp, Myxococcus xanthus
gtggctctatttatccaccttaattctctactaatggactcaccgcaacattttgttcattttccggctgacctagcggataaattcttgccgtatcattttcttcgcttacatgttgaatataaacggccgtatcgttatacgtaacgttagccataacgggtgaatcagcaatttgttttgctcgctgcttgtccacgtttcttcccccctctatgctgatatacatataaggtttgcttaaagaatggatgatattcgccgtttataatcgttctagcgctttttagcggtgcggtagccaaggtaaaagatgaaagaagtatagataataaatgcagctccagctagcaagatcattttgtgatgatgccaaaggtctacgtatgttttgatgaagaccccttttgtaagtaaaatatattgatacacaataaaaccaaccgccaaagcaagaaacagcacgcgaaacaaacgaatgaaatcaatgttagataaaatggaagcagcttttacccagggcgatgtaggaggcggagcttttttggtgctgcggctcttcggcttttgtttctttgcaggcggagcttttgattcttctattttaggtgctggtttt

SEQ ID NO: 1429 - DNA, 439 bp, Myxococcus xanthus
tgcgctggtcactgcagcagagcgggcgcacttgggctctgacgtgtagaatccccaccacggagtgaatcacccgtgggtcaaatacatgttcttgctgtgggacagacccatcgcgctggtggcggcttgcgatttcttcgagctggactagagcgtgccccgcgagttcttctggccgggcgtgaggtacaccatgccggtactgtacccaccgacagccatgttcgccatccccccgccgctgaacatctccacgggatgcgtgtgggggacaaaggcgatgacgaggatgccatacgcggaggagcacgccctcatggtgtcaggcccttctggtacccggacaaagggacacacgcgtgcagcagcttatttgtgaaatgacctgtccagattccggaaggaaaacccggtaccccgaggattcgaatatggg

SEQ ID NO: 1430 - DNA, 519 bp, Myxococcus xanthus
agctctacagtaagtcctctgtaatcctcctcttcccaacttccactaatgcaatgagtgaaaaactgcagtttactctttcagcgaaattccgctgattcaaattgtagcttttccgaatcaatttgatggtgtctttatccatattgtcacctctctttttttatataagtggcttccaactctcatagaagccgagacgttgttaacaactaaaactctagcagacctaaaacaaaatgtctatcattttttgttccaaaaacgatcttttttggaaccatgattctttctatactgaaaagaaatgttatgagtggaaggaatttggtacaataggtaaatataaataaacaatccatgcaggagatggtgtagtgattattggttatacccgtccatatagcgaagatgaaaacttggacaaacagttacaggcgttgcagccttttaattgcgataaaatttatcatgaaaaaacaaattgcataaaaaaaaagagtagaattcgatgagatg

SEQ ID NO: 1431 - DNA, 581 bp, Myxococcus xanthus
tgctctaaagatgggattttgaacagcataaaatgaatcggaccgaacgtccgctgacgcgaaggaagctcctgtaacaggagcttttctacggctgttttaaaatgttgacttccacagcctcgccttttgcgggaacagaatactgaacgcttttgtcttttttgagccatgctttaacgagctgtccttttttgtatgtttgatcatctgcaacttttacataaataggctgtacatcgctagaaccaagtatttctttggttgtatagtcaagcgcggtatctcgcggaatgacgtttgcaatgagaatttcattctgtttcacttgtaaaatgcgcccttgaactaaatagccggccggcttttttgactgctcggcgttatccgaacagccgcttaaacaaataaaaaagagaagaaaaagtgcagctgattgaacggtaaacttcataaaatctcctttccgttttaacatgactaccattatagcgcgtttgaccatttcttttccagttttcggagaaagcaagaggtaatcattgacgttatttcagcgcgcgtgatatgttttaaactca

SEQ ID NO: 1432 - DNA, 664 bp, Myxococcus xanthus
ctctaaagtagcatattttctcccttgtaaaatggttgtatatcaagatgaaagtgaaacaaagattggcatgcctaggcctacggctatgattaatatgcttcataatgaagagctccaaacactagcagaagacatcgaaacaagattaatacgctgcattgatcaatctgtataagtcctgtgattccgagaaagaaaataacaaaacaaaaagatacctttacgtaaggtatctttttgttttctaactttattagggtatgaggagtggaaacgaaatttttgatacatgaataatttgctttcagatgcctaatctaaaagcagactgtaataaaaaggatgatattatgaattttatctggcaatctgtaatcttgattttaacgggaatcttattgttgagaatagcgggaagaaaatcgattgctcaaatgacgctcgctcaaacggtcggtatgatttccttaggtaccatcatttgacaacctattggtgagaaaaggatgctaaaagccattggggggggagcaatttttggtcttgctattttaagtttagaggacttacaattaaaggttaatggatttgaaaaaattctgacagggaaatctaaaatcggtattaataatgggcaattagatactaagcagcttaaaaa

SEQ ID NO: 1433 - DNA, 477 bp, Myxococcus xanthus
tcccggactggctggagcagttgactctgaggagccacagggacagacaatgtggtgtgctgtcctacggagagcatactccacttgctgtcgggaatgggatactgaaccgtccgcactttgatgctactgcatgattgcacctggtcgcttgaccgctgtactgttccagacatgcgagcatggattccagaactcgccgctccagacgcctggtgcgtgctgtggacatgccaaaagatgtacgaggcggaggaggtatcacattggtcgatgggactgggaccagcgcgtgtgatcctgtaaggcaacccggaaactatgccgtgagagctcagtgaggactggattgaagaactattcataggcgcggcttgcgagccggtcaacctgaagcgcacctgaccatgcacttgctgctccccgtcggacttatgctttgacactactaccttctgggagggatcctcgcgcgct

SEQ ID NO: 1434 - DNA, 186 bp, Myxococcus xanthus
gcacccgtatcagccggttctggagcaggtgcagcccctggtgaacgtctatgataagctccccgagccggatctgcctgaagacctgaaggtgaatgtggtcccgcatcatctccaccgcgtgaacttgctgaccttgctccgggaggcgggactgggtgaagtgctcgccgaccacacgcggct

SEQ ID NO: 1435 - DNA, 291 bp, Myxococcus xanthus
cgccgctcatgctgggggcgctcgcagagcagcgacaggtccgccaggtccagcagcaccgcggcgtccggcgccagccgcgcggccttctccagcgccaccagcgcgtcacccacgcggcccagccgggcctccagcactccggccagctcacgcagcgccgccgcggccagccgcttgtcgccctgcgcctcggccacccgcgcgcgcacctccagcgcgtcggcgagccccgccatgtcggcgcgcttgcgctgcaacgcgcacagctcgcccagcgcgggcaggtca

SEQ ID NO: 1436 - DNA, 536 bp, Myxococcus xanthus
ttgtaaagctctcggggtgcgcccatactgattcaggtggttaataacgtccgctgccgggtttcaccgctggttacggagaaacccctgcacccctctcattttaactgggaaagagcgccttcgacgcagaagcaaatggccaggcatagtgatctctacctcatgctttgccccatagagctcttccctgaacgacactttatgacatatgcatgcatctttaatgatgcaccctggcacccatcatatatcaagggggcttatggacctgagtacatacgtcaagctctggataaccttgatctaatacctaccatactcaaccagtgataagcccccgaggcgaccgaccgttcattaactctaacaacggaggtgcttgctcgcatcaacagcgtacctggaactgcaagcccacggagcaccaattgataggaaacccgctctctgatggatgcaagcccccagtacaggtgcctgttcccgagagcgcgttacctgctgcgcctgttgctgacaaacccacgctgacc

SEQ ID NO: 1437 - DNA, 279 bp, Myxococcus xanthus
ggacgaacctgatggaggccgccaacgcggtgggatacctcatccggtactaatgttccacgcgctcctctccatgctggagatgcccctctgagtatcttgcggcaacccgcccaataggagcccgcttgccacacgccgatgggacgaggcgcatggaggcactagaaccacacctaatgtgattgacgcaccctggcccgcgctatgcgagagcctcgtggtgactgaaacgcaccccctgtcccacatggctgacaataatgcctgactccaggc

SEQ ID NO: 1438 - DNA, 231 bp, Myxococcus xanthus
gtgcttcttaagggttcgtcttcttgcgcccgccaccttcgccgccattcttccgccgcgcgccgtcgtcgagcgcccgtggccaaaccctggtgcttggagccacccggtcgcagggaggcaaccgccgtcatggccagccccggggctgctcccggatgacctcccctacgtctccctgctattggggagcgggaggccatgcccggccgagatttctggacactgacc

SEQ ID NO: 1439 - DNA, 62 bp, Myxococcus xanthus
gtgctctacgcccccgggtatcgagcagagttgcatctccaccaacctgctgttcggcgtgg

SEQ ID NO: 1440 - DNA, 383 bp, Myxococcus xanthus
tcttccaacagacgctgggccgacggtatctgggggcccggtgcaccaacccgctggaccaagactatcacccgggcggtgggtcgctcacctaccgcaagggcgcggtgcacccggagattctcgacatggacgtgctgtccgagatcatgttcgcgggccacgtgcttctggacatcgggcggatggtcagtgaccacgacgatcgtatccaccggaacctcatccgggtgggcgacttcaatgaccacgcccatgctggtggcactgcgcacgacctcaccctcgatgagagctctggagacactaacgtgatcagggctgagcttctgcactcctgcgccctgctggggggggggccgcgctacatacgggcctacaca

SEQ ID NO: 1441 - DNA, 744 bp, Myxococcus xanthus
aggaagcaggctgttgctattttagaaagggcaccgcaccgtcatgcgtttaattattccatttacgaccgcagcggacagggagcagtagtcgaagcatctggacgaggcgttcatgtacaaagaggaacgatgatggggtgtacgaaccattttaatcagctggtcgaagaaaatcgtcatcatttggtagagtcaaaggaaaggctcgatcatattcgagatcatattgaaaaaaagctatcgcctcttgaagctttttctttatttaatgaagatgaatacggtatttttaaagaagattaccggaattctgctggaacgcttcatacagtggcatatgtaccggagacgctgcaagtcattgtgggaattggacgaaaagcaaaacctcttattttctcgtttgaggattgggtgaaaggagaacaattaactataacgaaaataaaaggaacggtaaatacagacgaaccatttccgtttcagtaaggagcagcataatgagaattgtaacgaatcaagagatgtatcaagtagatgattatatgacgaatacaattgggatgagtgaagagtcccttatggaaaatgccggacaggctgctgcaaacgcgctgagtgagcgaatcgaaaaatatgaaaaaatagggctgcttataggaacgggaaacaacggaggagacggctttgttattgcccgtgctttgaagtcaaaaggctatgaagttgacgtctgggtag

SEQ ID NO: 1442 - DNA, 709 bp, Myxococcus xanthus
  unsure (1)..(709): unsure at all n locations
ctctccagaggcatccttaatttctttcagttttatattattgaaaaatttaatttgcctatcaaaagcgctcagctttacgtttttttatttatgattgcaggggtgtttggaacattctttggaggtccgcttgccgatcgtttcggaaaacgaaatattttattgttttctatgttagggtcagtaccgtttactttattactccctcacgtttctctcggagtcgcagcgcctcttttaatactaatcggctttattctccagtcaagtttcagcgtcacggtcgtctatgctcaagagctgatgccggggaaaattggcttggtttccggcttaattgtagggcttgcttttgggatgggagctttaggagctgttgtattcggtaaattagccgatgtcttcagccttcagtttattatgctgttttgcagctatttaccaatcctagggctgttaacatggctgttgccgagcgataagcgtgtgaaagaaatacacgaagtaaaataagaaaaagaaaaagcaaacgcgccttagcatttgctttttttatgagcgtgaagcaaatttcaagacgaattcatatttttcttctaccatagatacaatagaaattgnaaatcgaaaggaagaatcagctatgatttaagctagcgtattgatcagtctcagtttcaagcgatcacaccaangagcgtaaacg

SEQ ID NO: 1443 - DNA, 627 bp, Myxococcus xanthus
gagaccctgcgcgacgggggctacatccttgcaaggcgactcacgggcactgaggacgacgcgcagtcaccgcggatcaccaacgccccagcatcttcagaccggacctgacgaatgccaccgccttcagctccagcaccacttcgacacgggcgacccgcccaaaggtgctgcccatgacgaaccgatacattgccttgtggggtctgtacacgaacttggtcacacccgagctgacggacgggaacttgccccacgcgagatcataaggccccacgtcccaggtttgaggcaccccctatgagacggacaacaggaggtacgacttcctgtgcacgcacatcctccagcgcggcgagctggggaactaatcccggaccgactgctgagaggccatctcgctgacgcagccctactgaagcggcccacatatcttcttagcctgggtcagccagctcacgggcgcctaggcagcggctgggttgcccaccctgcgcatgctgaccagactatgcagggaccccttcacgtacaagtggacggactggactgaacataccccatactggcgcaggctgcgcgatatctcacaactgaggctgcacagctgccagttggcgacgaccc

SEQ ID NO: 1444 - DNA, 482 bp, Myxococcus xanthus
gaaacagcgcaaaaaacatttgaaacatggcgtaacgttcctgctccaaaacgagcaagattaatgtttgcgtttcagcatttactagttaagcatcacgaagagttagcgaaattagttgtacaagaaaacggcaaggcttttaaagaagcttacggtgaagtacagcgcggtattgaatgcgtggagtttgctgcgggtgctcctactttattaatgggagaatcattaaataacatagcggaagaaattgattctgaaatgttccgtttcccacttggtgttgtcggaggcatcacaccttttaattttccaatgatggtaccgctgtggatgttcccgcttgccattgtatgtggaaatacgtttgtattaaaaccgtctgagcgaacgccgcttttagcaacgcgacttgctgaactttttacagaagcaggagcaccggatggattattaaatattgtacacggggcacatgatgt

SEQ ID NO: 1445 - DNA, 600 bp, Myxococcus xanthus
ttttttaacagacgatgtacaggagcgattgtaggataccagccttttggcggatttaatatgtcaggaacggattcaaaagcagggggaccggattatctagttcttcacatgcaagcaaaaacaacatctgaaacattttaattggaaaataaggaggaataaatatgacaactgaaacacaaaaaacggtgaaaattattgagcaaacagaaaagtttggggcacataactatcatccgctgccgattgtaattgaaaaagcagaaggcgtatgggtacacgatccagaaaataataaatatatggatatgctaagcgcgtattccgctgttaaccaaggacatcgtcatccgaaaattattgaagcattaaaacgtcaagctgataaagtaacgttaacgtcacgagcgtttcataatgatcagcttggtccatggtatgaaaagatttgtaaattaacaaataaaaatatggctcttccaatgaatacgggagcagaagcggttgaaacagccattaaagctgcacgccgctgggcttacgatgtgaaaggtgttgctgaaaatcaagcacaaatcatcgcatgtgtgggcaact

SEQ ID NO: 1446 - DNA, 316 bp, Myxococcus xanthus
cagggcattggcccacagcaggcatacacgcagctgggctagccgcgcttgtgcgccccgatggtccactaccagcacgcgtgcgtggccatcatcatggagcgggccccgccgtagtgccacacggtcaccagcgtgtcgtatttctcgcccaccgtcaggggcctgtggtacaccaggaccgtggtcccgggacgcccctgcatgaggctggccccagggatgggaccgacgtccggacacgcggtcttcgtactggacttgtccatgccaatgcccgaggccatgtggcataccccctcggtcgtgaggcccg

SEQ ID NO: 1447 - DNA, 406 bp, Myxococcus xanthus
tgctctaaaggctccctgggctgctgagccgccccagcccgctgcgcgtgtagctgatcatgcaggtggacaccttgttcgattgcgagctgtgccacccctactaggaccggctgttgttggagcggctgccggtcgtcatgctgccgtacctgctcggtggccaggtgacgcccctgtcaccgcgggccgacttggaggtgtaggccggtggacacgacctgttggtgccggacgggagacagaaggctcacacatccagcttggagacgatgattcttcaggtgaaccgtctgttgcagggggccggcgccccggctcgctgggcgcccaccgaggaggactgaattctggcgccgcccgggttctcagagctgctggtgctacacaggtgctcggttcgcca

SEQ ID NO: 1448 - DNA, 686 bp, Myxococcus xanthus
ctgcatatgttgttagctcgctagaagcatctctttggtcttttctgcaaagtgatgactacaaagaagctgtacttaccgctgtgaatttaggagaagacacagacacaataggctttattaccggtactatggcaggagcatattatcagctggatggcattcctgaagagtgggtttgtcagcttgctaaaaaagaagagttagagaaagcgtgtaagaagtttgcggatgcgtgtgtatgaaaaagacaatgaaaagaagctgtatttcacgaaatagaacaaatccttatcaacggaaacaaaacgcccgaatatgcaaaaatacaagtaagcaatgataaaaaagggttccttcttggagactttactagcgaagaaacaaaaggctatacgtttaagagcttgcaaagtgtgaagctacagccgcatacaggccctgacgaacagctagaaagatcgtacaaaggaaaagaaagtgatcagatatatgcgctttctcttgcagataatataagtatacaagaagtaaccatcttaggaatctcacatcaggagacaatttctactgggttataataagggtcgataagcagcttacctagatgggtgagctgcttatcttttttaagaatctaccacaattcaatttgatttacaatccctttctctcttaatttaaag

SEQ ID NO: 1449 - DNA, 559 bp, Myxococcus xanthus
agccccgctctagtccgttctttgtcgaagccaccgtgatggactgtgcgccagggcactgctctccccgagcaatcgtatgccacttaggcattgctggcaccaatgacaacccaatcctgaaggagggcgcaccggtaccgtcaaccggggaaccccggccgtggttcccgctgtggtaagcacggaacactagaaccggcctgcataccggtacagaggagctaccaagtgacctggaacaacaaccggaactcgcgctgaaagacacagcctacactctgtaagggagaccgccggccttgcaacaccgtcgtattgccaccgggaaggaccgggagcacaccatccacatgttgcgaggtgacaacccataccgaatgcggacgctgaactaatacgcacgacgtcggcccgtgggagtcctattgagggcaggacgcacgcaccaactgaggataggcgcgaccatgtaccgtacgtacgccgtctttcgtgagggcggcgaccaagtaggcagcggtctgcgcacgaatgtaaggggagatcttcgcacggc

SEQ ID NO: 1450 - DNA, 654 bp, Myxococcus xanthus
tatcctttacagattgtaggtccccttttggcgcatggtagtcatcttgccctcggtatgaatcaggcggcgcaacgtgaataatgccaggagcaagcggttcatatttatatttacgctgagcttggcccgttgctgctagtgcgcccattgaatttccgtgataccctcggtaacgcgaaataaatttgtagcgagaatgctctcctttttgctgatggtattgacgcacaattttaaaagccgtttcatttgcttcagatccgctatttgaaaagaagataacatagtcatcacctagcatttcatttagcttctctgctagtttgatagcaggtacgtgagattgagtgagcggaaaataagccagttcttttagctgctcgtaagctgcgagcgctaactcatcccgtccatacccggtatttacacaccaaagccctgccattgcatctaaatagcgatttccttgttcatctgtaatccaagcaccttttgcttttgtagctaccatcgttgcatccggactgtatggtttcattccatgccatacatactgctcatcttttgcacgcagatctttttcattttgactgacctgtaccatcttattcactcccaaattgctagcgcgggatttttttctgtatgaaa

SEQ ID NO: 1451 - DNA, 404 bp, Myxococcus xanthus
gagcgcatgctgtacttgctcctccatgactgacgactggcgcccctgcaccccgacgaggaccttggggagcacccgggccctctcgaccagccgctgaacggacatgctgtgggcgcctactaccttgacctaacctagctcttcgtcctcaccgcatgggtgatttaccgcgagggccaaatcctggggagaacaacctactaacactagctggataaacagcacgtgcttacacccgatccctacatgctcatacatatgtggaccctcttcgtgtgacgggtggatgacccggggcacacgcagcaggggcttaacctgatgactggccagacggaccatctgaccatctaaaactgaccacatgcatgtactgggcgcgtatggtaccgcacccgcac

SEQ ID NO: 1452 - DNA, 668 bp, Myxococcus xanthus
gtctttaacaacgatggttgggcttttacagctaaccggacgctttcctgcatccgcttggtttagccctccaggaatagcatcaaaatcagtaagctcgttgttgagtaaaaatccatggtctttaaccataattcctgtaccaaaaggatgttccacagttgatgtacacgcgacaatattgccccagcggtcaactaccgtgaagtgagttgtttcactaagctcgcgttcaggttcataaggctgacgcacaacgttcactttttggcctttctcataatcccacgggttgccaaaatcaactttctcatttttatgcttccaattaattaatttttgacgttcctttatatattcgtcatttaaaagcccttttaatggaatgtcactgtaggctggatctccagagaatgcaattttatctgaaaatgcaatgcgcatagcttctgcaaacaaataatacttttcccacgatttcacgtcgtactgagacacatcgaagttctctaatagctttaaaatttgcagcaccgtagctcctcctgcactaggcatgttggaagaagcaattcggtatcctttataatctccccacacgggttcatcaatcttaatctggtattctttcaaatctgacagttccataaaaccgccgtgctctttta

SEQ ID NO: 1453 - DNA, 668 bp, Myxococcus xanthus
ggtcactattagcctatgttgttccaaatggcgtatcggctactcaatataagcgccttcaggactcaggtctatatccttattttaaagaagtatttgtttcagaagatacgggctttcaaaaacctatgaaggaatattttgattatgtttttttacgtataaaagagctgtccgtacatgaaacattaattgttggagattctttgagtgcagacattcaaggcgggcagctagccggtattgatacgtgctggtttaatcctcaggaaaaaaagaatgatacaaattggaattcaacctatgaaataggaaggcttcaagagctttataccctgcttaatgtaaataatgaagtagcttcggtacaagtataaaagtgtataaatgttaaaaaacacaaaaagtgctaaccttttctttaaacaaaaaggggtggcgctttttctattttatggctttcacaggcttaaaatatgctagggatatcggtctaggtacagtaatcaatacaaatttaaacagttttatcccaaaagcaatagggtattttaccaatatcccagataaagtaagtaactaggaggtcgtaaaagatgattaatggaaaaagtttatctcgttcaggaaagagttcatatagaagagaaacagcggttggaaaaaca

SEQ ID NO: 1454 - DNA, 806 bp, Myxococcus xanthus
cgtctaaacagcaagctaccacatcgtaccctttttcttgtaaccatttaattgcaactgatgtatctaaacctccggaatatgctaaaacaacttttggattactcatcatctattcctcctacaaattatatatatattaatacaaccgttttaatttttattcatttaatctactattactttaacaactttttaatctattttcaatagttattcaaaaaaaagtatataaattcacgttttttttaatttaataggatgaaagctcttaaaatactgtaaaaatagacgtgaatgaatattcctgccttaaatgcattgtatatttatatgcataaatcaagtataaatgatttatttttcacttaaagtagctctggcttttgtcattgtataaaatggaagggaagaggtgaaaaaatggagcgcttttttacttatgacaacagactcggtataaaaattcctgctcttgaaagagaatggacattctattctgaaaaagttcagcaggatatcctcctaacatgggaatccattcgagggcaaattccagacaaaattcaatctgtagaaaagaggattaatcaaaaacaagcggcgttagaagatgagactaattttatccgctcctgtgaattaaatagcgagataggagaacttgcttctattattaatgatttgtggctttggtatcgaacaaatgaggaaatatcagaaaaagttcacggatagacaaaaaaacgagtctcatgaaaaattaatgagactcgtttttcttatccagcaaatagcggtattgg

SEQ ID NO: 1455 - DNA, 754 bp, Myxococcus xanthus
ctaaagcgcccaccgcatccgttccaacgttcgaagctcctgatgaaccctgcgtatggaaattcccatatcgctcctagaccaattgctgtcccagcagatgctaaaataaaaccgaggcgtgaagaccactgatttcctttactcatataatgttactctctcctcttctaaactcaaaactcatatgattagtactgtaccataaatgcagaagaaaatcattcccgttttacttttttctataaaacgatatctatatagaatagaaaaaatgaagaagcagctgcctcttcattttgagtttgatgttactattcaaaaattattctctgtacgatgattcgtctccacggtaggcttcttgatttgatatttcttcaatatgcatatgcccttctctctctaaacgaagaactgtacgctctgcatcttcataactctcgcacgtcacttgtttatattccatatcgtctttatctgtgtaagccactaaatatgtttccattttaactcctcctatataaactatatgtaacgtatgttgcctttttcgtttatttctaaacatataggctccaaacataaagcctagcatactataatagcggaacttcaatttaaaaagttgaatttttcattatgcaccgatgcaacatggaggttacgcttatgacatttattttatcattcgtaccaattggtggtccttttggtattttaattagcttaattgcttttacagctgcttttt

SEQ ID NO: 1456 - DNA, 712 bp, Myxococcus xanthus
gacgaatttgtttttcaaccagctctttgcctttttcaatattttcatcgcggctttgctttttaaagaattggcgaattttatttttggcttgagacgtttgagcaagctttaaccagtccttgcttggaccatatgaatgcttaaacgtcaaaatttcgataatgtcccccgttttcaaacggtaatcaagcgtaaccatcttgccgttgacttttgctccaatggttttatttccgatttcagaatgaatacgataggaaaaatcaattggaacagaacccgaaggaagctcaatgacgtcgccttttggcgtgaaaatataaaccatgtcagaaaacaaatcaacttttagagattccataaactcttctgcatcgtttgcatcattttgaaattctaaaatttctctaaaccacgttaacttttcttcaaatgaagcatgctcagctgtttttccctctttgtaagcccagagagcagcaattccatactcagcaatttggtgcatgtcaaatgttcgaatttgaacttctaacggatcaccttttggtccgataaccgtcgtatgaagagactggtacatattttgttttggcatcgcaatataatctttgaaacgtcctgccattggattccagcacgtgtgaataatccctaacaccgcatagcagtatttaatgctatttacaataatgcgcacagctagtaa

SEQ ID NO: 1457 - DNA, 387 bp, Myxococcus xanthus
cacccagcgacggagtttctgcgcactggcttcggtaaagggcaacatggtcacatctggtcatgcggcacccagcatctctaccctaaggaaaaccaccacatgaatcaaaccattttagtcctccggagcatcgacctattcaacctgctggcctgcgtgcgaaatgaactcttggacacgacggagacactgacgctggagcggatggacctggtgtactgttccaccgagggtgcgatgactgcctcgttctgcgacatgggcaccaacctgttgtcatgcaacaaccactccgtcaagcgctacctcgactaccagctgtgtccggaaagcccgcgctctaacttggagtgccgtctgtcggaacaggcgtgccagaacctc

SEQ ID NO: 1458 - DNA, 663 bp, Myxococcus xanthus
aatatggaacactggaaccatttaggggaaatagataaaacgggttcactaaaagaagcagctggtaacctgcatattacgttacctgcattaagccaatctataaaaaatttagagaaagaactaaatataatgatttttcatcgttccagaagaggatctattccaactgaagaaggtcataggttaattgaaaaggccagcgctgctttattgaaaattcaagaatttatggatgaagcagaagcgtatacaaatacaatgaatggtgaaataaagattgcaacctacccaggaccaatggagattctcgttcgcttaataacagaaattaaaagagaatatccgaacataaaggcttctgtctatgaaaatagcaccgagtatattatagataaagttctagatggggaagtagatgtaggtttcattacttatacagaaaaagaagaaaaaaagtatcggaacttggtatttaaaaagttattggatggtcatatggtagctgcagtaaataagaagtcgccattagccaaacaaacactcattactgaagagatgttaattaaccagccaattgttttatataacgacaagtatattcaggaatttatgaaaggttttagttcactgccatgtgatatcttggttactaccaataat

SEQ ID NO: 1459 - DNA, 622 bp, Myxococcus xanthus
  unsure (1)..(622): unsure at all n locations
gcccgtgttgtgtccacctgcgcaannggttgagctagcccgaaaaaattgttcaatgctacagtcggttattgactgtatagaagtgacagaaaccttcgaaataaaataaaagtggacattgtccacttttatatttcttttggtttgcttccggctttatcaaaatagcgcatgcgttcaggagtcagctgaagaagcaaaaaatttgggtcatctggacttttaatccactcttttaacttttcattccaaaatttcttttttaactcttcgtttgtttctacatttactttggcttctacctctacatacggatcactccaaccttgcccatcatagcctaataaaatatgaacgtaagggtttttttctagttcttcgactttgtgggtatctttattggtggcggtgtaaagcacaagatcttcatgaaaaaacatcataaagcgtgaataaggttttccatcttgaatcgtagctaacgttccgattgtatagtcatccagtaccgataaaatttgattttttacatcattactcattttttcactcctcattctatctcattatccttggtagtttggctgatttttaaatatcttaatcaaaaatcaattag

SEQ ID NO: 1460 - DNA, 353 bp, Myxococcus xanthus
ctcaagctggcggcgaggcttcaggcccagagctggcagatgctccactgcatctttgaggctctgttcagccttgacactgacccgatcgacggcctgaacaggtctttggcgctggagggagccatcctggatgcgatgctcaggacggacacccatgcggacaagctggaccgctgccgcatccatcgtcttgcaggggccattacccagcccccctgcgggctcttgaaccgactagcgatgcacctgcccttccaggaagactggatgctgtcgaacatcttgcaagacgagctgtgagagctcgatcacgccaacgcttgggcgggtgactgacgccagcatgacac

SEQ ID NO: 1461 - DNA, 673 bp, Myxococcus xanthus
ttacattaattaaatgcccgtctttatgctgtctgaccgtctcaaattccgttttcgattcccctgattgaatagtcttatgaagttcgcacacgggctcctttaaaaacgaaggtataatcggaagaggcttttgataaatttcttcaaacgtccagccgaatgtattctcaaacgcagggttcacttgaagcgttttaccctctaagtcaacgatagcaacagcatctgcgttatgataaataaaaggctgaatctgttcttttttctcctgataactagttatattcacgcaatgtcccataatttcaggtttttctgtgtaagataaaggggttaagtttactacatagcgtttatcatttatttgaagctcgtacataagctttttctttttatttagcgcttcgaaaaaatgctcatacgagatccattcttctagaggtattttttgctcagaaacgctttctccttgatacatactgtaaacaagatggtcacctttttgtttgtaagcaaatatgattcctagattcttagctgaatgattttttgcatgtaatcggactatcttttcattttcgtttattggtaatatttacctaccccctaactagcatttttcctactcggtctcattctcttaattttacatgaggcggttaaaaattac

SEQ ID NO: 1462 - DNA, 63 bp, Myxococcus xanthus
cccatgtgctctaaagcatgctgccgggtgcctgggtggtgctgcgcgtggatgggcggggct

SEQ ID NO: 1463 - DNA, 416 bp, Myxococcus xanthus
gcagcaggccgctgagcctgagcgccggggagggaggcttgacagcgctacaagatgggccgacccccaatttcgtaagcgacaccttccggagtccagccggcatgcccaaaacggaccctcgggggcgaactaccccgaatggacgtggggcggtcacacttcggcgggagcccctgaatcgtcccacatttggtgcaggggcgtgacctgtgtccgacggtcttgcgattgccagactgatacgcgacgagatgctcaagcggggcgagctgccgtgttgtcagaggattccgagagagcaagggggctccagtgggccgaaatatgggccgacgtacagagcggagcccctggacgatcgatctctgtgtgagcagccgattggggctccgtctttggaaggggagtagcgc

SEQ ID NO: 1464 - DNA, 580 bp, Myxococcus xanthus
ctctaaaggagcacacgcaggtgcagggcgcctcgctggtagagttatgacacgaacccgacactctggacaccgccgattcctgggcgcagttctgggtatctatgttggaagaggatggagaggggaggaccacggacacctggcccgcgacactgaccctctgctaacagccccacatggcatgctcgatggtgacgtgggcttgtggcctcgggactttgtgccgctctgcggcggagcatgcggcaacctattgcttccggacaaggatcacgaggtgggatccggcttccacggacgagaccaccatcacgccgtgcgactgcgggggctggggaatggccgtgctcgtctcgccgatagccccgggcgaaatcggcagcaccgatacgacatcccaggacggattggacaacgtatccacatgctacaccggagcgaggggaccgtgcaaatctgactgcaaggcccaggtggcgtgagagtaccccttaaccaggccaactgaggccacctcacactgtaggcagcgtgaagctcctgacactctgggcctaaaaggggtcaccgtgcggac

SEQ ID NO: 1465 - DNA, 55 bp, Myxococcus xanthus
gccttctccggggggattttgttggaccttatgattggggaaccaacctgatttt

SEQ ID NO: 1466 - DNA, 663 bp, Myxococcus xanthus
  unsure (1)..(663): unsure at all n locations
gcagtagttattcgcggcggagcactggaatcattcgttcctgtcttctctggtacactaggaagtcttggacgcaaagatgcaattggtacaatcggcggaaacaaaacgcaattaaaaggtttaccagcatcacttatgaaagaagcaagtaacgttcgctacttatctcatatcaaaggattattcgcattagcttattaatccttcttaaaacgaaagaggaatttccctctttcgtttttttatttacataagccaagaaataagaagcggaagcgtaatcaacgataaaatagcactaatgacaaaagcagatgccgtttcgttttctaagctttcaaacctcaaagcaatcatcgcagctacagcagacccaggaaaagctaccagtaaaatagcttttgtcacttcatctgaagataatcctatccatactgcaattccaagcataacgatcggttgaaccgctacttttaagacagcgatcccaagcgcacctttactgaagttaatttttccaattccaatcgttactcctaccgcaaacaaagctgctcccgatgtgatacttncgatttgatcaagcatatcctgtaacagtttaggtgactgaaagccgcaaagcgttaaaaatcactccaattaacgggaacacatgcc

SEQ ID NO: 1467 - DNA, 683 bp, Myxococcus xanthus
cctgttactcgacgagaaaccggctcattaaaatggacagcatttgctgtggtctaccctttggttgtcgcttatctcgtagctttgcttgtacacactattggaaaagtacttggtttttcttaaaaggagtgaataacattgattattaacattttaattggggttttgatttttgggtatgccctttatcatatgacaaaattcttccgcaagagtactcagggaaaatgtgcaagctgcgcacagcaatcttcttgtgcaacggatgattgcggtattgactgggataaaacgattcaagaagctcaaaatcaatcatcttaatacattaaaaaagcatcctgatagacgggatgcttttttaatgttacgcaactagttttaaaatgagatgagaaaggacttccttttcctcttcactgctgactttccataactcatgaaggactttttcttctcggtttcgaggctcctcatttttggctaaatagctagccactttttttgtagcagctgctaattgttcctcatttaacccgagctttttaccaacatgaactttttgagtaaataatcagtaaacgtatcaaaattctgcaaaattgcttcttttttcttcgtccctaaattatctacccgttcttcaattttattcatgtcttttggagttccttcattca

SEQ ID NO: 1468 - DNA, 383 bp, Myxococcus xanthus
tgtctatacatcggatatgctcaattgtattaatttcttttcgtgctttttcagcaagagaaattgcacgttcagccagctcttttccttctgtagctagacgttttcgtgcaacatctaaagaagccagcagcagataagaggttgatgttgttgtcagcatgcttaaaatagactgtacgcgttttggagaaattaagccttcgcgtatgtttaaaatggaactttgcgtcatagaaccgcctaatttatgaacgcttgttgctgccatatctgcaccggcctgcatagcagacagaggcaaatcatcatggaagtgaatatgaacgccgtgagcttcatcaacaagtacaggcacttgatacgagtgggcaatttctacg

SEQ ID NO: 1469 - DNA, 160 bp, Myxococcus xanthus
gcgggcttgctgatggacccgcggacagccagggatgcatgacccgccgaggaccctgtcgtatggcgggccccggatgattgtgcacacctcctccgggtggcacctcggcgtacaccggctcaatggcgctccggatgaccatggcgcatccgctgga

SEQ ID NO: 1470 - DNA, 434 bp, Myxococcus xanthus
ttatgggcaacggcgtgacgtacgaccctatcggcgcgatccacatgacgctgcgcccattcgcgcagatcaaggtgcccacggactgctcgcggagctagcggcaccctaaggtcatggcgcgcgagctcggatcttagaccttgaagacaaggaacactccgccccccggcacgacgacctgcgtgaaactccgaggcccggaggacaccttgggaacgcgattgtccagcgggacactagaagatccaacgaacacaccattccagatcacttaccagtcgagggagacattaaccgaaccccttcgcatggaggtgaccatgctacgctactgcttcaccatacgtattgacgcacttgccctctaccagcagtcactgtcgccgatgcttgcgcactttatgacggcgcaactgacggtcgatggcatc

SEQ ID NO: 1471 - DNA, 598 bp, Myxococcus xanthus
ccgattgcggacgaacttccacatatacctgcaactggacgccctgttcgagcatagcacggaggggggtctagccgatcccgtggatcaccagcgggctcaacgtgctgcaggcgtcctgcacggcatacgtgcccatgcacatgacggcgcactgggacaccactgcggccatggatgcgtggacttgaaggatcaacagagacccgactcacggagcgacagcaaccctggagggggagacatccacggacccctggaacctgccgccattgaccacctccttgtgcaactggtgcaactacacgaggggctgctaattacgtcgcgcaaccatgggcacctgccagggcaggaccatcatcttaatgggactgttgagctagccatcacggacggctccaccctgcatgaacgtgactgtgatgcccggcatcaatgcctacggaaccaagaagtccatctacagttcaacctgcagcacggtcacctgttgcgggcgcactggcttaggctgccacttgacagggacggcctgttccgcacgacccacctcatagggtgcgaggggtgcgcctcgggcatgcttgcaccggag

SEQ ID NO: 1472 - DNA, 71 bp, Myxococcus xanthus
tgggggaggttggggcccaaaaccttcggttcaaaagggggcttattcccgattggccggtgttccccttt

SEQ ID NO: 1473 - DNA, 540 bp, Myxococcus xanthus
gcgccggtattccaggaaccagcctggtgaatagagcaggaccctatgggcttgccaaggagctcatttagcatgggggattggaccttgattatcacgcgcaaggcgcacaccacgaggtaacgcaggagctggactgtggtgcgggcgccaccctcctcatcctgattcacctgggccccaaacaacacgcgaaaccggaccgtctgctggacgggcgggactatagtggcgggctcctcgcgcttgagcagtaaaacgaggaaatgatgcaccacaagctggtgctcctttccggagacggactcagctaccaggggcgcggcttcatgaacaaggggatgggaaacctccagcacatcatgtggagagctgctcacctgagaacgagaagtactctctccgagagaggtctacccaccagctggtgtagagcatgctcagcacgagcgaccgtcagggcgaaactcaggctctggacgatctggatgtgcacaacgtgagatgccgcctgtttctcgccatggaaggagacaaggt

SEQ ID NO: 1474 - DNA, 590 bp, Myxococcus xanthus
caaataacccagagtatggctgctaatttaaaccatttagggttttttgctatatgtaaaacaaaagaagcaggtatttttgtttctgatgaaccaggaagagcaagagtgcttccactgtcttatgaaaaactggcgcagctaagagagcgttcgggcattttggtgattccaggattttttggctactctgaagaagggaacatggttactttctcgcgcggtgggtcagatattacaggttcaattgtagcagcaggagtaaaagctgacttgtatgaaaactttactgacgtagatgctatttacagcgtagatccaagacttgtggaaaagcctcatgaaatgaaagaagtcacatacagagaaatgcgtgaactatcctatgcaggtttttctgtcttccatgatgaagcgctagagccggtttataaactaggcattcctgtatgtgttaagaatacaaataatcctgaagcaaaaggtacatttattgtagctgagcgctctcacggcgatacgccagtagttggaatcgctggggacaaaggtttttgccatattaatgtgagcaaatacttattaaaccg

SEQ ID NO: 1475 - DNA, 389 bp, Myxococcus xanthus
gcccccgacagtgctcgtgcatgactagtgcaccgggtccgacgagaccggaagccacttgtgcacatggcggccatacttggcgcatgggattgacgagtgtgtacacaccgcgcaggcggttggcgcggcgctcatgagtgtacctgctcactgaaagccgggcactgctcgaggagacgaaggtcctggtgtacagaacacccaatcgcatgaggagtcattccgcgccacctaatgacaaaccacccagtgcagggccggcgctcatgacatacccttgcaacagctgatcccacaccagctggactgcgtgagcataacaccgattcaccgattagcatcgagtagtgacatgaaccacaagccaattactggctgggccattg

SEQ ID NO: 1476 - DNA, 481 bp, Myxococcus xanthus
ttctaaatctgccattttggctgccctccagtccttagtaccagcgcaacttcatcgccctcctgaagcacgggattcaccgtgccgtgcttgagacggagcatctccacacggggaggtgcctccacccggatgcacactaggggatgcggcatatcttccccagctggcatagcctcggcgacacttcttatcgaacctggtacgaccaccaccataaccagcatggcctgaatggggaccagcatacaccgggcgaaccacggagagtgtccctcctgacggagaacctgccactctgacaggactgcggcccggacacgagataagtgcgcccggagcccaatctgctgacgatacctacgaacgtgctacacccgtgcaccggaggcagtacattgcatcacgtgtcgcggttgtgcgactccctgcgacccctgaacacacacaagatccgacaaatgtgtactcatacctgacc

SEQ ID NO: 1477 - DNA, 544 bp, Myxococcus xanthus
aatttaaaacgatggaattttcaaatctgcttcttagcttagaaagtaataaaattgatctgattgctcataacatggctcagaacgctgagcgaaggaaaaagtttttatttaatgatgaaacatataattattctccgctttatgtaacagttcctaaaactcgaaatgatattcattcattaaaagatttagaagggaaaaaaatgattgtaggagctacaagcaatgcggctgtctatctagacaaatataataaaaaacacggcaataaaatcgatgtagtttacgccggtcaaggtgcggatgatgctaccactcaattaaaaacaggccgagcagatgctacgcttgcgacgccattttccatcgattttagcaatcaagcgctaaaatttcagcaaaaaacggttggagatattgtgattaattcaaaagtgtattttatgtttaacaaaaaggacgaaaagttaaagtcagaagttgaccaagcgattaaaaaactgaaaaaagaccggacgttaaaaaaactcagcacaaaatg

SEQ ID NO: 1478 - DNA, 368 bp, Myxococcus xanthus
ggacaggtattccacgaagaggacccacatccagtttaccgaaggccggtcactcaccggcagggtctttcctgcctactgcgggtactgcgcgaacagccacctcttgtcgggctgttgcacgcactagaagcacagggtcaccttcagcagcggcagcaactgcccgccctgaatatccaccaggttgtgcaccttggactcaccgaaccccttcagaaggtactcgacgaactgcataccggagatgtagttctctccgaactggtacggggcgcactgcttgggcgacaggatggccgagtccagccagactccggaggcctacaccaccgtgtcggaccagcaggtcccaatggggctgaggg

SEQ ID NO: 1479 - DNA, 377 bp, Myxococcus xanthus
cggaatttgcgccgaactatataaagatgcattgtgtgcatacactgggacagtcttcaatatatgctgaggggggaccaaccagctggccgggtggaaagacattgaagagaaggacatgccgtagaatggaacaatcctccttctttatgaaaccaagacgggctaacatcactttgcggttctttttcgccttcttgtactgaccatcaaagacaaagccgaacgataataatggggggatccggattatgttcttacatggaacgaatccaatgaacagccgcactcattcaaaaattgggtactgggatacggcccacctgaatagacaatactgcactcccctatacatgtacgatcaagacttaattgag

SEQ ID NO: 1480 - DNA, 254 bp, Myxococcus xanthus
ctgaaacactggttccttgaccacgagcctcccattcttcacccgacgcagtgcttcgagatgcgggtgcaccaccccatccagaccggcaggcggatgggcgaggacttccccgtgcgtacgccgcgggagacccatgccgactgtggcttcgaccaggatgactgggaggtcctccacctggaaaaccacctgcccgaagaacatgacctgatggagcttctggatgtgcccctgcaaaatgacccggccgc

SEQ ID NO: 1481 - DNA, 261 bp, Myxococcus xanthus
accggcgacggcggcggagtacctacgaagccgtggggagtcggtcgattttcgcaagctagacgctggcggtacccagctgatacactggggctcatgagtcgactgcccggtggcatcctatcaacgggacccggggacgccctacgtatcggcaccggagcgccctcctgccggcgcaggtggccaagctgaggagtatccgaacaagtacagcgcatcagcgatgggcaaatcatctgcgggactctccgccatccg

SEQ ID NO: 1482 - DNA, 641 bp, Myxococcus xanthus
ggaaataaaaaacactccgtttataaacggagtggcaaaggacagtacaaaactgaacattgccactttcctacgctggtatgagccagatcaggttcaaagggatcaagaaaacttgtctcagccggtcggcacccctagtggacttcctattagtctatgtttaacttaccatatattctgaaaaatagaaagcgttacggaaaattgttccctaacggtttttatctcttaaagaggtagcttcttgaagctatttttaatcatttttgtttaaaaatgcatatttttagggaagaagaggtattaatgaagggaagagccgttttcgtctccgaaacattcccatataaatagaagaaaggagagaacaaaatggcaaaatttcgtttgtatgctgtattaaatacagtaggcttggctattacacttcttgtgaattatttagcaaatgcgattccaataggaggcaaaacaacggcagaggcttctgcgcaagttcctacgttgtttacaccagccggttatgcctttgctatctggggcgttatttatttgttattaaccatttgggttatacgccaattttttgcaagagaagatcaaaaggaaatatatgcacgtatcggcatttggttttt

SEQ ID NO: 1483 - DNA, 116 bp, Myxococcus xanthus
tcccttgacctgacgcacttcagcttctagcgcggccgggggcccatacgaaaatgggtttatttcaggacccagccttaacagttcggcaatcggcgggtcaatgggccaaagct

SEQ ID NO: 1484 - DNA, 293 bp, Myxococcus xanthus
gggggaaagggagaaaagaagacgaggcaggagcaggacccaaccataaacacgaagagggggcgaacatgaaacaccaccagcaacccagaccggcccagaggcaagcaaacaacacaacggcaccaaccaaaacagcagcagaggccgccacgtaatgaccacccacagagcacacaacaaactcagagacacccagacgcacaggaacaagacgacgagaccagaggacacggagcccgggcgggccacaggcctgtgcacgaaaagcgccgagggcctcaccggcgaca

SEQ ID NO: 1485 - DNA, 452 bp, Myxococcus xanthus
gggcccgggggctgctgttgatggagccgccgatcgacgtttcagggtggccgcggtggctgactccgagtaatgacgtggagttcctggcgctggctgaacgagtccacgctctcattccggacaatacgcctggttgtgtctactgtaacgatgacggcacgcgccaggcggactggttcctggatcacctgctgcgattcgtggtgggtgcccctgctcagagcgaaaacgtggggcttgttcaccccctggtggtcgtggtcggtgtgactgtcctcccccactcctgggtgcgcttggtgctctcgatctgccggacgttggataccgaccacacctccctggactacgtgagaccgtggacactcctgtccattttcttgagtgaggaacagggccacaacctggacgcggaggacctctggctgtcgatgatgcgctggtcgcac

SEQ ID NO: 1486 - DNA, 764 bp, Myxococcus xanthus
cctttccgagcgaagtagctacctgtaccccactcagatttttagtttcataagaataataattgtactcaatttttttctgatctaaaattcgcattacgttcgttttgtctgcttttttacccataattatcaccgataccatcataacacgtttggttttcatatctccatatgttaggataggtagattattttgtttattaaaaaagccactagagacgctagtggcttttttcattccatacattcaattgttctactgcatcaatacgtttatctacagtctattctatatagttaagattttcaccttaactatataggtgacattttactttatgcttgctatcaatcactgtatcttcaggtgtttctttcatgcagcggtcaaatgcgaacgggcatcttttatgaaacgcacagcctgaaggtggattaagaggagaaggaatttcacctttaacctcaattttttccgtttttcatgttcgttaatcgctgggacagatgataaaagaagttttgtgtaaggatgacgagggtttgaaaaaatctcatctgttggtccttcttctactaatcttcctaaatacatcacgccaacgcggtctgcaatatgtcttacgacgcttaaatcgtgggagataaagagatatgaaagcttcatttctctttgcaaactgcgcagtaagtttaagatttgagcttgaatggatacgttcagcgctgaaaccggctcatcacaaatgataagctttgga

SEQ ID NO: 1487 - DNA, 95 bp, Myxococcus xanthus
accggggccaggccgacctttttccccacgatttgcggggggatgaccaaacccttcaacatttggcccaataccaaagggggcggcaacccccg

SEQ ID NO: 1488 - DNA, 737 bp, Myxococcus xanthus
  unsure (1)..(737): unsure at all n locations
catgtcggacgactagataaggattcagacggcttaattttacttacaattgacggcaatattattaacgaaattttacgtgcagaaaacaagcatgaaaaagaatatattgttgcagtagataagccgattacacccgagtttatcaaaaacatgtctgagggagtaaaaattttaggtacaaaaacgcttccttgtaaagtgacacagctgtctaagtacgagtttcaaattattttaacacagggcttaaatcgtcaaattcgccgtatgtgtgaagtgctcggatatgaagtataccgacttcagcgtacgcgtattatgaatattcacttaaacaacttgcctgttgggcaatggagagatttaacgaaaaaagagcgtacgcagctattcaaagaattagactatgaacctaaagagtggtaaatcaaaagacaccagcctgttagactggtgtctttttttattcgcatacaactacttgtctagaaaatacgcttttgngcgctacgcagcgatctgaaatagaaaagccagcttcatgaatcatatggtcaatcgtgtctactgtaattacgactactttatccgcaaagcggcgagcgtgttttaaaatagaaagctgatcttcaggcgtcgcgtgggtgtagagattgtaaggcatgtcgatgatcgctacgtcatagggagtggtaacatccgaaatccgtcccgttttgacatcaccctttaag

SEQ ID NO: 1489 - DNA, 559 bp, Myxococcus xanthus
tctaaagactaggcgtctgcgtcatcacggcaaggcgcggccacggcatcgaaaggacccacccgtcgcgcacaaagcgctatgacgttcatcaactgggcccagggaaccacgaaacaagcgtcctccgccttcacggggccctttaccagctccgacatgacatgatggggggtctcggtggtggccaaccgggccgcctcatacgccaccaacaaccttgacggtgccgattgggcgccctcggcgatcgcatgcaccgctttcgcccgcaccgcgacttgctgctccggtgccagattattctcaaagcgatcgccggccacgggtaagtcatcgaacccattgggcaggacatggcggtgaacacgcacccaaaaagcctccatttggcgtgcgggctgctctcacgggggggaaaacgcggggcgctctttcaccggtacatgagtataccactgagccgctagggcccgctgaacgtgcgtgcgcaagaacaccggggtgacgcgctcaagtcccagagcacactccccccacacgtttggggcgccgctca

SEQ ID NO: 1490 - DNA, 611 bp, Myxococcus xanthus
tttactatcagggttgttatcgctggcaactttagtgtgggttctttttgcgcttaaagaagacagtatgcctcaaccttcagcacatgcatcttcaaaagcgccagctggtataccttctgtattaatagctgtattcgtagcggctcttttcatttttgcgggtgattccggacgttctatgtatttgccgctgtatataacggatacgttaaagcaatccgtttcgattgtaggaattctttttaccgttacgtctgtttttgaactaatatttatgccgttaggaggctatttttctgataaaatcggagtcaaacgcttctttgttatcggcatagcttgccaagtgctttattttgttttaacaagccttcatttaccgctgagtggattgattgcgcttcaagtattttatgctttcattctatccgctacaatgggagttggcatggtgtatgctcagtcactggccccgcgtcaaattggactagccacgacggcatatatgacagctatacaaacctcaacagttgtcagcagcttagctatggggtcactagttagcgtgattcccgtgccttctactttttacattttagcttgttttg

SEQ ID NO: 1491 - DNA, 493 bp, Myxococcus xanthus
ggagcgctacactcggacaccagcttgaacgatggcgtagccctattgccgccaccgtccacgagcgcctgcagcgaacggtcccactgcgtcagcgctggctgcatgtactactgagggcagcgccccgcatcgatgagtacctgtagtgccaccaccccctgctacctctggcatacgatctcgcacaggctcttcgcgtgcaactggctccagacgccaaaggccggctgccagacggacgatgctcactcgctcacggacgcggaattggattcgagctcctaccagctcctgcatttattgaaatcttcgggactgaccgcccatgatctcgctgccgatttcatgatcctgggactgcacacgctactgcggctggtgcgcatccacaatgggaactacgacacctgacctgtcaatcccatctattccagacaccgggtagcatttatctcctaccagattggcaagggcgacaccctctccgagc

SEQ ID NO: 1492 - DNA, 715 bp, Myxococcus xanthus
cgtgctctaaagtgaacattcaaatggatatacgtctttaaaccggccgtttgtggcaaatttcagtcgtgctgtttcgtttgtttgctcaatcacggtgaaagtagaatcacgtaaaaagccgtgctgaggcaaagagtattcgtgctgatcaacggtatactgatcattttttaatcggcctacgattggaaacaatacgggcgatactcgtccccaataagcggggtctccgctccacataaactgcaggcctttttctttatgaaatacttctacaacttccgctcctttttcttcaacgctgactttcatttcgctattttctagtacaatcattacaacatctcccaaatcattgttgtacgctagagctgtctcaaacgtactggctttgcttatattatacccttcttggcaaaaaaggtattaatttccctatttttgttcaaattaatatagaaaaaggagggttcaaatatgaatcatgcaacattattgctcattaaatttgcagcggcacttattgcgtttggtataggccttgatttattttttgatgcaaccatcggagacattatttcttttagcttgctaacgacagttgtgacatatctagtagtggatcgaattgtactgcctcgagtgggcaaccgggatgccattattggtgaatttgttctaacatatatgagcgtatggatttttggcacat

SEQ ID NO: 1493 - DNA, 104 bp, Myxococcus xanthus
ctggaggtggtggtgcaggtcccccagctgtacttcctggagaaaggtaaccccatgccccttgagcctgatgcggggcccagactagaagcgctggagatctt

SEQ ID NO: 1494 - DNA, 712 bp, Myxococcus xanthus
aagggagaggcaccaatacgacatatatccgaaagaagatgtgaagccaattcttttaaaggcgctacctgacctgaaccgcactagtgacaaagaactagaaacgcgttatgacgtactacctttcactcgtgcagtatctgaaacgcttggtgaagagcgcaagtgggtacactacggtttgacttcaactgacgtagatgatacagctctatcttatttattaaagcaagctaatgaaatcttgctaagtgacgtatagcgctttgtagaagtactaaaggaaaaagctcaagaacataaatatacggttatgatgggacgtacgcacggtgtacacgctgagccaacgacatttggtttgaaaatgggattatggtatgaagaaatgaagcgtaacctagagcgtttaaaacgtgctgcagctgaagtggaattcggtaaaatgtcaggagcagttggaacgttcgctaacatcgatcctttcgttgaaaaatacgtatgtgagaagttaggaatttcaccagcaccaatctctacgcaaacattacagcgtgaccgtcatgcacactatatgtcagtactagcgttaattgcgacatctattgagacatttgcagtagaagttcgcggtcttcaaaaaagtgaaacacgtgaggttgaagaaatatttgcaaaaggccaaaaaggctcatctgcaatgcctcataaa

SEQ ID NO: 1495 - DNA, 626 bp, Myxococcus xanthus
  unsure (1)..(626): unsure at all n locations
cgctctccagatctgccactacatctgttggggacaaaatagcggctagtgcaaatgccgccggtaacggaatggaagggataagccaattgattagatatccccctactgccaccgttacaaaaaccagtcccagcgctagtaataaaataggtgtacgaagcttccaaagagcagctcttgacacgtttttcccatcattaaataatagcggggcaataaataaaataaaaaataattcaggttccaaatggacatctccgccaaatggcaatatagcaagccctgctcccaaagctatttgaactaacggaacaggaataaatggcacaaaatgattaatgatattagatagaccaatcaaagccaataagactaatatcgtcagaaaaaattccataaaaacaatcgactcctacttctatttacatctctttaaaggtatcacgttgtctcttttcgttcattttataatgtttagtttacgctttttctgcaaaaaatgttgcgggttattaaaaagtgttctttcttttcgataagtttatttctacggagattaagggaacagtatacatgatattctttatttaccatatanaatcagcttcattcaaactttttat

SEQ ID NO: 1496 - DNA, 367 bp, Myxococcus xanthus
gagctctccaggaggatgtttccgtctactccgacgtggtcacacgagctggccggcacgcggcgcgcgccggagacgttcactacagggcccggctggatcaacgcgcgcccaggaggcgtacaacgcgcgcccggagatgggcaacgccctggcgcccagggacaacggcggcttcgactaagcctaggacgccctctgtcttgaccacggggtgctcgggctgaatgccccccgctcggtggcgacacacgaaactgccttagtgcacaatctgttgggccgggtcgaaggataggacgttcttcacctggcgcagcgacggatcctggcacccggggacaccagattaccgttactgcgccga

SEQ ID NO: 1497 - DNA, 646 bp, Myxococcus xanthus
ctctcttgaaataattcagcccaatcattacctgatttaaacctgaaagcttcccgcgaatatgagcaggtgcaatttctgacatataggcaggaactagcgaagaagccgttcccactgctgtacctaaaaagacgcgcgcaatcgttaacgtaatttcctctggtgcaatcgctgaacctatggagcctaacagaaaaatgatagaggaaattaaaattaactttcttcgtccaaacttatcacctaataatccgcttaaaatagaaccgataatggctccacccattagcgatgaaactacaatccccagccacagcggacttaaatgaaacgcttcacggatatgaccttctgcaccagcaataatcccaatatcataaccgaataaaataccggcaaatgagccgaagaagaagataaacttacttgatactttactcatgattatatcccctttgtattgtcttagtttttcttcctgccacacttatttaaaacgctttcatttatttttaaatacggcgttcttttactgacgctatattttcacttccaaggaagcagcgcttccttggaagtaatgatgcttacttaataatgacgtactttaaattcacaagctttggataactcacaatttgat

SEQ ID NO: 1498 - DNA, 664 bp, Myxococcus xanthus
gggcccagatgcggcgggcgttatagccggtgtgcgaaatgaaagcggagcccttggttggcaccatgattctttctgccattgaggactactgctgctgtgatctcgtctgtgcaaggtggagcggttaacatgccttcggagagacgagctcatctttggttgaagaacctcttggagaactcccgagaggattgatttggatcccgatcactcgatcgcgggatgctgacgagccctgaccagcgatgcattaggacgggagccacactcatgcacttcaagccaaacggacttgtacattggtaccgacaccccaactttcgtacaacgatggtaccgattgttgaccttcttgatttgaccgatcctgtcggacaaatgacatgattggaccatgatcttgacccgccacatgacaggactgattataccacggtcccctagatgccaacgagggccaccgctgcaacccacgaggggatcaatgccgctgctctctacatggctcatgacatgtccacgtacacgcacggttgatcatgcttagcggcatgctggaactgctattgaggccgctggccgacgtgctacaaaggccggcacgcgcagttgactctcgcacactagatccggtacagtcgctaggtctgtctaacgagcg

SEQ ID NO: 1499 - DNA, 131 bp, Myxococcus xanthus
acgccgcggccagggttatcctggagataaaccctagggcgctcccggtccaggtgatggacgcgctcgcgggcgccgccatcttcggggccgtggtgaaaaaaaacgccggggcctggtgtttcccccga

SEQ ID NO: 1500 - DNA, 499 bp, Myxococcus xanthus
ccgttctctaaagtctccaggtcgttcatggagcaaatcgtctagcaagcaattcattgttagagtgtcttgtattcggaaaacgggcagggcgtcatattttacataaagcgagaacggtatctcgttatactcccgttcgttacgtctataaaggcatgcctaaaatactgcctgccacaagacaaattcagcataaaatgatggattgtgtaggaatcattcgtcatgaaaacgaattggctaccattgtgcatgaattcacaaattatttggatggaatacctcttgatcaagaagttatatattcgagggaagctgcaaccatctgcaatatgctaactgcaggtctgcttattgccgagtcctctcttgcaagaaaagaaagtagaggaggtcattaccgaagtgactttccgcatgaaaagcaagagtgggagcataagcgaattattaagcagtctgctgcttcaacaaaacaatcattgattttataagc

SEQ ID NO: 1501 - DNA, 289 bp, Myxococcus xanthus
aaccatgcggcgcaggcccttgttgccatcgccgacacgagcctgagcgccacgcggttggccatcatgtccagcatggacacctgcggcccagagcgccgcgagatggacaggatctccgactcctatcgagaggcctccaccgcgaccgcccgcttgttctttcggtgggcctcgtactagagcgtcttcgatcagggaaccgcctgtggccccgtgtctagcgcggcctgacagaaccccggcttctcccaagactactgaacgccctgccacccagtgacgggct

SEQ ID NO: 1502 - DNA, 608 bp, Myxococcus xanthus
ctctacagccgtcctttttttgaaaatgcccaagcagccatttttcgaatgttagaattccgcactgagcatcagctcatgctgaagctggtacaggaacagcagttaggcactacagcagtgcaagacgtgcttgtgcgagtagaagaagagattttgacttatataaaaaacaaaatcgaaattgcgatttctaaaaaagaaatcaaaccgtgctacccggagctcacagcttttttactatttaaaatgtacattgcactcgtctatgattgggaaaaacggcatgagccgctttcagaagaaaaaattgctgaattaattgaactatactttttacgcggtctgtctcagtgagataggcttttttcatagaaaaaacaaaaaaggtctcatgacgagaccttttttattgctcattatcatctttttttacgccgtttaattctgtatttcctgtttttgcatcttcttctttatgatctacttctgtatttccttgctttttaagtttgaagtaggcatcaataacatcacctgtaatagttttactttgtccgccagaattcgctccagcaacatacgcagaaggaataacaactgctaca

SEQ ID NO: 1503 - DNA, 759 bp, Myxococcus xanthus
ccgttgcagtcgggacatacatatacggttgttcccatacaaggatatagctcttgccgaagttcagtatgaatcagatctacgactccggtcgcaaacagtaaaggagctgcttcgtagttcgcagagtttgtgatgacgttaaacccatctatttctttttgacactgtatgacacaatcttctttaaattgaatgccgtagctttttgcttgctgccttcccgtttctcttagagtttgcccgcttattccctcaggccatcccaatatattttgataattcttgcagagattggaacgtccatcgtttgaatcaataaccaatacactgcgcttatatcttccaagctgaatagcggcttgaagtcctgcaattcctccacctataatgacacagtcatacttgtctgccacagcacatcaccccagcttttactattttctaaacgaaagcttcagtttctcattatctgtttttggattatttttatacgcgttatcgtctttattttttgaagtcattctacatacaaaaaaccgcctcagcagctaccctgtctagagacggctttttataaaatgaaaaaagacgatattactcatttttctttcctgcttctttttcattaattttagtgatcagctcttctttatatacttcactatctttcccgtagcgtagacggctatgacaggtgggacatagtgctgcagcatccattggcttagcgagtccgctctctgatagctttgaaag

SEQ ID NO: 1504 - DNA, 68 bp, Myxococcus xanthus
cactatgtcccgtgtgcacgacgcccgtgctgggtattagacctcactggcacgaccctgctcggggc

SEQ ID NO: 1505 - DNA, 53 bp, Myxococcus xanthus
gaccgcgaacaccttttgaggcatccgacggacatcctcacatgtgccaggcg

SEQ ID NO: 1506 - DNA, 107 bp, Myxococcus xanthus
gggaccgacagaacctggacttcatgcaggaccccatcttgagcatccccagcttggaccctaaggacaccacgttcatggccaccaacagcatgttgtgcttcacc

SEQ ID NO: 1507 - DNA, 629 bp, Myxococcus xanthus
  unsure (1)..(629): unsure at all n locations
cctgttaagtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1508 - DNA, 640 bp, Myxococcus xanthus
gcacggactggagccgcgccctgtggacacacaccagaggcagccccagctcctcctgaatccgagtcaccggaagccgcgtgagcgccgaacccgacggcttcagaatcgcgctgtccgtgggacacgcaccggcctgggccacctcgtcacacaggccgatgcggcgcagggccgccgaggcgttcatctgaaccgtgaggcccgcgcccacccatttcaaggcgtcggagcgctcgaagacagtgacggagaggcccgcgcgccgaagcgcgcaagccagcgtgagtccaccaattccagccccagccacgagaacatgcctgggcgatgacgtgctcatgcgccgcgctttaacaggtatgccgtggcgagtcgcgattcatgtgcaacacagtgacgggaggtcactgctgcaccaccgccgcggagttgccatacggggtctggcgctctgacacgtacttcacgggcacggctcacccgaaccaacggcccgcttcgggagcgaagacgcggacgcgttcggccagcgacggcggcagtcgcgcgcgcaacgtggcgtggacggattcaggaggaagcgcctggctgaagtgcatcaggaccaggggcctcgttgcggaactggtccgcgcgc

SEQ ID NO: 1509 - DNA, 763 bp, Myxococcus xanthus
  unsure (1)..(763): unsure at all n locations
gcacactggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1510 - DNA, 363 bp, Myxococcus xanthus
ggccgccaacaggtacagcgacggaggccgcgccgactaccccacccacgaccacagcgacagggccgccccgcgagcgcccccccacaacccgagcacggcccagcacacgacgcacgtgaacaccgaggccgggcagcgccacccgctcgggcacgtgacggccaacgcgctcgaggccccggaacgctaccccgccctgcccaaccacacgaaccggccgcccgggcggccctaccaccgcccgaccgcggacccccacacgcccaccttcaacccccacgaggcacacgagcaccagctgccgaacgacaacatccaccacctgggaacgactgaccacgacgcgggcctgacccaggc

SEQ ID NO: 1511 - DNA, 113 bp, Myxococcus xanthus
ggtccaccggtattgtctttaataggacccccgctcacactttcatggacaactgcggcggagcgggcggaccgcccgctcataggaccacttgcttgatgcagcccgcctcg

SEQ ID NO: 1512 - DNA, 714 bp, Myxococcus xanthus
tgctctaaaggaacgcttcgcggtgtagggtaccggattgatatttcatgaagcacaaacgtttctttcatttgaactctcttcgccttcagcttttatctagaagtttactcgttattttgagtttactgatgctgataggcgtttttcaatacgtatttatgaagcaatttatttatacaaataaaattagaagcatcgaagaccaaattcacttgattcccgatgatgtctggaagcacgatattgaaacaagccagaacgtaaaacaatcatcaagaccaatggtttatttcccgggcgttaatattacctttatcaatcaaaaaagcacctttttacggctggctaaggatccacatcattcttacttccctaagctttctgcatctgcatacaaacaagtaatgaaaaacagcaaccagccggacaacacgacgagcctcataaaaaaaatggatggtcatcaagagcaagtcattgttttaaaacccattatctttgatggagaaatacagggagttattcaaattaatactcccacagaatcattaagagacctcttaatcagacaaatgctcatctttttaatgctttcacttaccgcaatgaccattgctttttttggtttttcttctggtttaaaacagacggtagtccctttgtttactactactaaaaaagtagagcatattaatgccggaagcttacatg

SEQ ID NO: 1513 - DNA, 342 bp, Myxococcus xanthus
tgctctaaaggcctgacgtgcacatggcgatatatcatgtgagccactgtgattgacactacttgtagcgcggggaggcgcgaggggtgttgaaccaggagacggacaacacgcggataggcctacggggggatcctcctgattaccagccagacgccgctctacaagtgctggccctgctacgacatcctgtacaacgtcttaaacacggccgatataaccccgctgtgcctgttggcctaccggctgaagtccgtggggtgggtgaaagtgcccgactgaagcggcccctgaggctcatggacgactggctgcacgcatatggatgagaggggggtgcgc

SEQ ID NO: 1514 - DNA, 257 bp, Myxococcus xanthus
gtcctggtcccgaagccgtcgaggccgctcctgcgtcatttccaaccggagcctgaacccgtccaagagttcaaacttccaggcatcgtccacctgctcgattacggcacggtccctgacgggcaccccttcatagaaatgcattggcaggagggtaggcacctcgcgcgggacctgcgtgtagccggtgcgcacccaccaggaaacgggcttgacgctgtacgagcccgtgagcggcaacctgcgcacgcctgcac

SEQ ID NO: 1515 - DNA, 606 bp, Myxococcus xanthus
gtgctctaacagccaccgagacaccgatcggagacgccgaatggggacgcgaggggccggcactgttagtgagcgtggatgctgggcccgatgatgtgacggctgtgggcggggcccacattcggcgagacccctcttctcccaggtgcgtgcacggaagcctgatcgcgcgccatggacaacaggcgcgcgacatggacatcaagctccacgacgcaccttctccgagaggctttgcagcatctgcgccagcatctgtgcatgcacctggggcacgaaccagacagccagatcatccgtctgtggcgcaccgctccgaatgtggcaggccacggagtacgaccggatgacgccagagatcaactgcaccacctgcttgatgtactgccagtagaccttgttgccctgtaggatgaagaactccttgtggtggctcttgatggacatgtggccgtgctgaatgacagtcatgtacccggtgggaaaccaggcatcacccgtgaaggagcacgccctgaggtccgacatatacatgtcgctggacgacaactgctcactcctggtctggatgtggcacaccctaccttaggaaaccacctgggaggg

SEQ ID NO: 1516 - DNA, 252 bp, Myxococcus xanthus
catatcagaagtggaatgccactgcatgaggtcatcgtattaatgctcgtggacctttgcttgtggtacgcgaagcaccggcctcccttgatgacagtccggaggaagccctcgttttacgggagcagggggagttctgcagtgtgaatggcagctactggcggggatgcccctacaactggaaggtgcaaggggctggcagaaaccgcgttcccatcaacgcgtccgaggactacaactggggtatggtga

SEQ ID NO: 1517 - DNA, 83 bp, Myxococcus xanthus
aatgacattggctggataaggcgcctgcgcccgcgcatgagtgcttacgggtcttgcaggccgacggcatgcgttttagtgcg

SEQ ID NO: 1518 - DNA, 630 bp, Myxococcus xanthus
tccaaacaaatggttttcaatggtaatgcggctcaactcacgttcttcagcaatttcgtctaaagattttccttgctgaaatagctcatacgtcattaagtgagagccttcttttgatgaagctcttgctttttttggagcaggcgctgaaacttctcgctttcggtctggatgttcttcacaaaactgtttgatttcagtcgtgaatcgttctccgtatcgctcttgtttttgttctccaactccttttacagtggcgaactgttcaagagttaccggaagttttgtacacatatcatgaagagtgtcgtctgagaaaataacaaaaggaggcacgcccgcttcatctgctagctgctttcgaacggagcgcaaatgagcaaacagttcgtcatcttggacaatttgcttcacttccatttgttctttcctcatcactttttccgtaccaagaagcacccctttttctttggacgctacggataaagtaggaaatgacccttgtcctactaaaataaactgctctgaaatcaaatactcgataaaatcgctcacttctttagccgaccggtcgctcatgacgccgtacggtttcagtttatcaaaacccaaattaacttcttttttatt

SEQ ID NO: 1519 - DNA, 336 bp, Myxococcus xanthus
gagggcctgctctgtttctgatcctgggccgtgagagcgaacgaagacgttctgagatctggtctactgcactgcgttgctccctacacgaccgactagcacgttcacgccagggagcaccgacagagttgaccacgtggtcatgcacatggacggacattcttgcatggaaagcgcagtccgtctgccctgtttagagcgcggcgcggacacatacatcgacgctccgggcggaaccagccacctgactacgggctctggacccagcattgagtacagtcgggttgatatgtgccatgcctactgcacttgcttgggggtgccacaggccatcac

SEQ ID NO: 1520 - DNA, 127 bp, Myxococcus xanthus
acctgtcttccagagtatgaaccccgcggaccgccccattgtcactccagaactacacccctgcaaatcccctatactctggggcggcgggcgggctacggggacttgaccccgtttttccttgtgc

SEQ ID NO: 1521 - DNA, 722 bp, Myxococcus xanthus
cgtgctctaaagacttcttaacgcctcctgttcgttataataactttttataatagcttctcttacagctgattagcttaggtacccttcatatattcgctaaccggccatcaacaattgttattatgagcgatgtagaaccaaagaaaaagtacgcactttcaagtgatataggtacctggaggttacaataagcgtaaatactaaagtcatgaactattgggtattctaaaaaaatgcttacacctagaaaattctgcgctatagtggtatgataaacatcagaaaaaatgcgaaaccatgcatttaaccgttatctctagaacaaggagagttgttaacgtgaaaaaatataatattccagtggaagcggcattagaagtcattggaggcaagtggaaagtcgttattctttgccacttaattaaagggacaaaacgccctgtagaattaaaaagaattatgccgcgcgttacacaaaaagtattaacgcagcagcttcgtgagcttgaagcagacggcatcattattagaaaaatgtacaatgaaatgccgactcgagtagaatattctttaacagattacggatggtctttaaaaagcattcttgattcactatgctcttggggagaacatcatattgaaaaaacgtaccctgataaagaagctgtacttatgcagcctgtataagaagtcactggttctaattaaaaaaagctgac

SEQ ID NO: 1522 - DNA, 206 bp, Myxococcus xanthus
gggctctacagcacatgcctgctagggacactggatgtgcgtagggcgatccggcccaaacgtgatgtgtctctgatcgggcgcgtacaccaggtgagacaggatggtgcctggctgaacccgggcacggttcgtgccaggatccatctacagcacgcgggaaaaatgctctgtacacatatgacaactggcagttcagaattgcc

SEQ ID NO: 1523 - DNA, 569 bp, Myxococcus xanthus
gtaaaggccccggggtggaggatgaactggagcgccacgtgcacgcgctcgtactggggccaggcctacattcgaaagaagaggaggaggatttcgggcgtatccaacagccggtccgaggtgacccggggatggctctggaccaccacgaccgcgtgctgaacgctaagatgcaccacgcgatcggacgccagcttgtacggctgggcgatggccgctgcgtccatggggtgcgtcatcaacagaagcgttaccgtgactgccaccgtcagcaccaccgggaaagggtcctctagctgcgcgtacagggagcgcatggccgccacgcccttggtgaggtgcactgattatcggacgagcctcgcgcttggctcgtgtcactgtggccggatttgaatcgggagcacggacagcgtcaccacgaacaaacagttgaagaccgtggggggcaatctcagactcacaggactgcacacatatgggcggccgaggataccaacgaccaacggtgacacccaggatggtgtcatagggctcctccacctgtaggcaattgcggaagaggaggc

SEQ ID NO: 1524 - DNA, 371 bp, Myxococcus xanthus
acgccagcgcgcttgcgtcagcgggctgtccggcgtccaggtgttcgcggcggccgagtaccgctccgtggtggcgagcgccacgcctcccgcggagccgcccgccgccaggagctctccggcgggcagcagcgtcagcgtgaagcgctcacgtccctgggcgaggccggcgacgggcgcccaggtgttggtggtggcgtcgtacacctccgccgacgcgagggctgctccacccgcgtcacgtcctcccgcgatgagcacccgtccatccggcagcagggcggcggcgtgcgcggtgcgcgccccggccgcggacgccacggtggtccacgcctgggtgcccgggtcgtacagctccgcggaggcgagca

SEQ ID NO: 1525 - DNA, 646 bp, Myxococcus xanthus
gcccccttgctgcattccatcgcgaattgacagcgcaggtaacgttggcgttctgtctgtacatgctaattgatgtacgccatatgacagatgttagttggttcatggagtccaccatgcgggaggtgaccagctgcaaccatgagggcatgccggcccacataggcaacaggagccatgaataccacaagagtgcgctggacctctaccacgcactgtcctacaccaacagcatcccgttgtggctgcttacgccgaacgaactcatgaacgtgcgcgggcgttactacctcaagggccatggcttgagcttggtcaccacttgcaacggtctgctgtacatgtggatgactgggtagttacgatggagctgaagattggtcgaggtcttgctgtgcttcagcgctgtcaccggcttcatggatgccgttgaaccacatcgcccatgtcagcgccttatggtaccactacagccatgcagcaaccagaaacggctgggatctgtggctgatcggaatgcctatgcaatcgcatgcccgtggatgcggtgtccaaagggcctggggggaatattggactacacttgattaatgtaatgcgtatataacggccacgacggaagcgtgtgggcaaccagatgagactg

SEQ ID NO: 1526 - DNA, 409 bp, Myxococcus xanthus
  unsure (1)..(409): unsure at all n locations
tgtgctctacgtgtgcgaataaccgtgacacacacccatgctgagcgccggcgtagccgtgctgatgcactggcgtcctcgcaaggcggcctctatccacttgatacagatcagcgccctgatccgcaccctgatgttcctgcctgtaccggaacaccaaggcacgaacctggcccggttggagcattacagcaaatcccgcgtcgttttggcagaaggacgcatctcggccctctcacacgaagctgacgataccccaccggctcagggctgatgctagctatgctcgactcaggaactgcttgcgcggtctccgggtctctcaggcgaatntgcacgacctccgcttgagggcacacactgcgctgctcgcatgtgctccgctgctacatgcacgcgagaaacacct

SEQ ID NO: 1527 - DNA, 657 bp, Myxococcus xanthus
  unsure (1)..(657): unsure at all n locations
tacgtctggaggatataatttcttaagatggttaggcgcagcgtttgctcctttattatcaggagttataggcaatgccgtagcgcctcaagctccttttcttgtagcagcgattcttggatttgtagcttttgttattatggttataaaagtaaaaacaacttctcaaacgaatgaagctgtatctaaataaacgttgaaataaaaggctttttcctgtaaaaagccttttattttgttttatgttataatagtaaaaacgtttttaatcataaaaatgaaactctttaccaacttgtacgtatactttatatgtacataaattctttttaagagcgtgatgcccatggccacctgtcaaaattgtaatcataaatgtgaactggaggacaacctttaaacaactgttaacattcagaaacgttttataatgcccacactgtgacaaacaacagcatatctctgccaaaacccaaaagcgattatcaatctactcatttgcaccccttattatttggcttattttctcactatttgactnttcctttccatccattgttgtcgcggagcttattttcttcatagcagcggttattatgatgccactctcttatgaagtaagcagcgaagaaaaacccttgtgggaataaaaaaacc

SEQ ID NO: 1528 - DNA, 589 bp, Myxococcus xanthus
cagaaaagagctgggttgacctgctccttttacttgtgaagcattccctacagaatttttgaacccttcttgtttttcagtagaagataatccttgttgttgagctttctgctcatttcctgcgttttgacctttagaagcagcatttcctttctcacctgccattcctgcctttttcattccttcatgcagagctggctgtttttctttatttccttgtgtagctaacccttttccgagacctccaactcctgctgctgtctgaagagcaccactaccaagaccttttcctacaccaccaatccctttggcaaggttggatcctccttttgctgatctgccgatcatgttgatgccactttcaagaccttttgccatcgcaaatcctcctgccagagcaccccaaccacttttgagacccgcatcgatgccaaagagaccgtcacacatgagtgggccatctacgacccgaataatataggcaataaatgcaataatatacggaatacccgctaatttattgctaaagaagattgtacccaataaatagacccttatagaaacgaaaaatcataataaataactagga

SEQ ID NO: 1529 - DNA, 648 bp, Myxococcus xanthus
aaaacttgtacactgttatattagcttgtctgtctctatattgcaattaaatgacatacatactataacgctatatgctagaaaacatgcccaataaaaaaaggctttgcttgcttcttttatcgttcaaagaagcaagcaaagctttattttatccctacaaattaaaatcatttgcaccgtcatgatgctgattttgttgattatgatgatcctgctgatggttatttcgcttgaacatttgctgcacgcgttcaatggcttgaggtgctgtatctaaaatcttttcatataaatgtgtactttcattaaggtgaagcattttaattccgcttccactcacaattaaaaaggcaattggcgtaattgatacaccgccaccgctacctccgccaaatggatgacctgattcttgctgatgctgccctggagaagatggcgcatgcccttctactccaaactcgcttccacccgctgcaaagccaaaacctacttttgagacagttaaaataacgctgccatcaggtgtttctacgggatcaccaatgattgtattaacatcaatcatttcctttaaattttccatagctgtcgacattaaacttttaattggatgttctgccattaagaataacctccttatgtttt

SEQ ID NO: 1530 - DNA, 514 bp, Myxococcus xanthus
tctacagcacgctaaccgggctccggccgatggcaccgatcaccgctctgcccgccctaggaacgctcacacgagcttctagcaggaaggggccaatacgaggtcctcagcctccagaccctgcttacggacgctaaccgaaaatgaccattacgcccgctgggaattacccgcggtaacccaggtctgacccacgacgaagatgacgtccacccacgcatcaaacttctctagcaacgagttctcggccggagcagacgcctttggggatacgacggactaaccctacgaggctggaggcaacttgaggggcaccccacactcaacgagagcctcactctaggacagacctgaggccttcaccggtgtcagcacctcgcatggagcaacggactccgccgtggccgtcacctatgacgccgccgacatcatctgacgctccactggcaggaacctgaccacgaagcggtcacacgaggtcatgtgcagggtgtccacccagttcagccccata

SEQ ID NO: 1531 - DNA, 517 bp, Myxococcus xanthus
cgacctccagtgtgctctaaaggtagtcatacgtggcgaagttcgcgatgcccaccacggggttgaagaggttgaggatggggtcatccccatcgaatcccatcaacaccgccaccaacggaggcagcgccgaggccagcgccacggaagccacgaacatcaagcgcaccgccacgggcgtggccagccggtccgggcgcaccttccgccccaaccacaccgccagcgacaggaagagcacgccatacgccggcaatgccagggtggccatccgcagggagaggcccttcagcggcaggtccgaggaccccacctgcaagccccagaacagcgcgctccaggcccccagcaggaacaccatccagcggaagccccgcagcgcgccgggccgcaacacggaccaaggccgggtggtcgcgcgcagcgggcgcgcctgaccatccacgtgcgcgaccacgaacatgcccacgcccagcatgtggacgcccgccaggagcgagaacatcttcggaacact

SEQ ID NO: 1532 - DNA, 449 bp, Myxococcus xanthus
gccccgggacccttcggcgcagtgggagaaaagttctgattctgtgggaatgcgacgactctcgcgggtgcggaagaacatgtcctgggattacgggtcccgttgaaacctgcggctggttttctgctgagggcaggggccccgagcgcaccggaggccacgcccaccaacgtgtggtgggtatgttgacggagggccgtctacgggctgactgggtgcgggaacgggtcgtgacttgggcagacgaggcggctcgccccagacccagccatgcgtgccacggccgtgggcgcgcaggccgggcgaggcggaattgcggcgcggtatctggtagctgactgaaggactcacgccacgggatggggcaagtcgggttctcgccagctgcttaccacagtacgggcccccgtcgctcacgccagcgttctatgcccagctgacaaggctgc

SEQ ID NO: 1533 - DNA, 703 bp, Myxococcus xanthus
gctatgtgcaaacgtacgaatcatgatagcatcgatgatttcagattttacgcgtgctgtatcagcaatcgtttctccgcgtccaatttgtaaatcctggctgcttaaaaagagggcgtttcctccaagctgcatcattcccgcttcaaatgagactcttgttcttgttgaagatttttcaaaaatgagccccagcgtttttccttttaacgatgtgacgattgcaccatttttatgcttttctttcagctcaatggcgctttctaaaagtgacataatatcgtctgatgataaatctttaagcgtaagcaaatcttttccctttaaattcgtatttaccgatactgtactcatgatactgtcacttcctttgtagttttttgaaaccattcttgtagtgatgaaacgtgatattcatcgacttggaacgattggaaaaatagcgaagccgtttctgcctccgtcataaccattaaaccgtgttttaatgctgacatacggctttctttatcttcaggctgtaaacttacatataataaagcttctttcgtttttacccattcactaacttgtttatctttaacaagaggtaatgcccggctttgcgcaaggtcttcaaggccctgtgcttctccggtaatatacacttgtgcagcaccttttttacttgacacatactgatgggatactttttttgctgctt

SEQ ID NO: 1534 - DNA, 472 bp, Myxococcus xanthus
  unsure (1)..(472): unsure at all n locations
gctacaagcgcccataccgctacgggtagtccgagagtccccccagggccaggagcttctcccctgtaccacacgtaagctaagcgtccgttgtttgatagcgacagaannccggcgagggagggtacccagccaggaccgtgcacccccacaccgaccaagatgggatcacggcgcttggcccgcagcaggctcttgatactcctcgttagatcgccctcgggtcgtgctccacgtctcgtccacgcgtctttagagacagaccctttcttctcatagaaaggctcttcagctggccgccgtcttccgagtacgtagcttctgaagggcgcttcttcgatgacactcgggcattatcatcgcggagcgctggacaacgcccggtatttgcactttgttaacagtacccccgcctcgctttcggctgggcttctgggtagacagtgtgtagaacgctgcacgtccacacggg

SEQ ID NO: 1535 - DNA, 505 bp, Myxococcus xanthus
cggaggtgcacgcgtcaccttccgcgacgaggattggcgtgcccttcaccttctccaggcgcagcttggtgtgcttcgccatggcgcgcagcgagcccagggcctccacgcggaagccctgctcggtgctctccaccagggccaccgggcccagggcctcgccgttggtgaagcgccgcgtctgcacccagaccagccgctggcccgcctggagcgtctccaagacgaggtcctcctcggagagcttctccgcgggagggagggcctgcgagtccggaccggcctccacgcactcgtccgcggccgggtcctgccaccacaccggggcaccggcgcagtccacgctggggcgcgggttggcacccgtgtccttgtcgtagccgtggagcagcagcgcgaaccaggtgtccggcgtggggaacgagcgcgcgttggggcccgcctcggcgaagcacatcgacggcttggggacggtggcgcagccgggcagcagcgacagcgcgac

SEQ ID NO: 1536 - DNA, 265 bp, Myxococcus xanthus
cggcttcaagaacgggccgaattccgccaaggcgccccggggggcccagaagaaccacaacgatttcttacccgccggccaggttgcaaatgggcccccccacgggaacccggaaggggtccttccgggattcaacattaacaaggggcaactttcggttgggccccccggggggaacttccgcttgggcgtgaaggggaacaacgggtggtccttgttaccccagccagaattgaatggggcccaggtccgcccttcccccttg

SEQ ID NO: 1537 - DNA, 299 bp, Myxococcus xanthus
gtcccggtatactgtgccttgagacagggcgtcatctccatggcgcaacggataggagctaccattaccactgaaaggcgcactctccgaccatgtgcctatcttgtgatactgccgagaaggctgctatgcctctgtgttctctcctatcttcgagacagagatgtcctggaatgtaccgcgaaagatgagccacgcgttctacagtgacgagtgacacgactgctacaggaagaacgtgcgagccatacgggagaactgagaccgagctgtcatgcgctcccataatagcacatcgc

SEQ ID NO: 1538 - DNA, 137 bp, Myxococcus xanthus
tgtccttgacgcgccgacctcttgccagtatagcgcgagggcacccatccctgcactggctgtgtttttttccacacgcgagatgagcctagggacgctggctgaagtgcggcacgagcctgcaggaaggggcgccc

SEQ ID NO: 1539 - DNA, 259 bp, Myxococcus xanthus
tacgactctccagtgtgctctaaagtgccctggcggacataccagaactgcaccttgatacgccttggcttgtaggagtgaatgtcatcggacttgaggccaatcatagaggctgtttgcgagcccgaacgttgtggtaatggcgtaagacaacgctgacagaagggaactgttttaggaaataattagcactgatttcttcacagggaataaatcgggtaactgactgctctgatgtgaggatgtgagccctaatgca

SEQ ID NO: 1540 - DNA, 69 bp, Myxococcus xanthus
tcccggctctaaggcatcgccatccgggcgtagaactgattcacgttcgacttgatgaccgggccccgc

SEQ ID NO: 1541 - DNA, 518 bp, Myxococcus xanthus
tgctctaacggcggcgatgggcgggttgcgcacctgagacacgaggtggggcttgcgcgtgctcaggttgtggttgcgggagctcgcccccgacaagctggcctacctgctcatggagacgaccggctgcttgccccggtgcgtgtgggcaacatcgccgagcgcgagtgcttctccgagcacacggaggggctctgcgcccagctcatgtgctaaatgggcccgctcatctccgcgcgaagccacctgaaggaccagacggactcgaccttgggctggatcctgcacacgattgaactccacgacgtgatcgtgctgttgtccaccttgttctccaacatgcatgctcgcttgcggcataaccacgagctgcaggcccgtgaggcgcagctcttccaggaccccttcgaccgccggacggagacgacacccatctgccaggtgaggctgatgcggctgtcctccgaggcggaggtgcgcccgaacaagcagacagtggaagaccacgcccggctgga

SEQ ID NO: 1542 - DNA, 667 bp, Myxococcus xanthus
tgtatgttgttacagccattggccatacttggtccgtgccttgttttggactgataaaaatgtcacagcgttcagccatttcgtttttgcgcaaatctgcgacgattagttgttggtcatgaagctcatgcgcgcgtttgatacgagttgctaatacagggtgaccttcggcagggttagctccaacgatgataaccagtgcagcttttgcgatgtcttttatcgtgccgggatcgtctcccattccgactgttcgaaataatccatcggctgcaggagactgacagtagcgagaacagttgtctacgtcattcgtttcaaacatttggcgagccagcttttgaataacatagttgtgttcgttggtaatcttagaagaagagataaaaccaacggatccatgtccgcactgctgattgatagagtttaacctgctcgctactaaatcgagcgcttcttcccatgatgactctacaaatgcgccattttttgggattaaaggcttagtaatacctttctcagagtttacaaaatcccagccgaattttcctttcacacaggttgaaatagcgtttgcgggagcatctgagctaggttgaactttaaggatctcgcggtcttgtgtgcacacttcaaatgaacatccaacttgcgaaaatgtacagac

SEQ ID NO: 1543 - DNA, 322 bp, Myxococcus xanthus
taacaccccctgcatgttcaccctgacatgcagctgtgctcacggccgtgacgaacgcactggacgcggacatgcagtttgctgaaagcgactcgctgaactgggtgcgggccatgttccaacagccacgcatgcacgagatgaccgtgctgacggtggtcttccgctatgacgaccagaaggtcgttctgcactgcatgattggaatgccttacaccatgggaaacatgcgggtgttatagggggtgggctacaccacacggcattgggatcagccgctcctgatgggggtggatgaccataccagaactcagtgcacgtt

SEQ ID NO: 1544 - DNA, 306 bp, Myxococcus xanthus
ctcggctgccgttactcctgggtggaccgtaccgacaccctttagttgcggcggcggatggacaaggacctgccccccacgaggacgcaggggatgaccttgaccagcgagttcaacctcgtggaactggacgcgtacatccagagcagcatgtgcttgcccaacccctatatggaccttaagaccttggtgagcgggagctgattcaagcccggctctagggacagggactggtggatcgcccactgcacgatgacctgaacgccctcgccgacgtggtcgggcacgccggtggggcctcgccac

SEQ ID NO: 1545 - DNA, 658 bp, Myxococcus xanthus
  unsure (1)..(658): unsure at all n locations
atatccgcatccaaaaaataaaaactatggaatagaaggattcgtttccatcatttaattaacttttctgccttttgttcttgattgaccagcactgtatcacggtaatttttaccccaatcgtacatggctgttaaaataggcattaaactttctccttcttttgtaagtgagtattcgactttaggtggtacgacaggataaactttacggttaacaattagatcttcttccagttcccgcagctggttaaccagcatgcgcggcgtaatatcaggaataagcgattttagttccccgaaccgttttgttccttcacgtcctaagtgccatagtatcagcatcttccattttccgccgataatagcaagcgttaattctttttcacagttaaattccttattaagctggctcaattgtttcacccctatgaccaatagtataaaatttcttttacagtacttcttattataccggtgctgacaatccttttacaaaaatccggcttgtatctttccattaaaaaatttagcttttcttactatatagntattcttgactagggagatgtaaaaagtggcctttaatcatgttttttatttttaaggaattcaattgtttaaatataaaaaaagatgggaaatcactcagtaacgat

SEQ ID NO: 1546 - DNA, 415 bp, Myxococcus xanthus
atgaaacattttctggtaaaaaggctcaagagggaggcgttgctggattaggagaagaagatacaacaaattactcatctagcacaggaagtggagacggagactacgaaaaaaacgaagaacgtattaattatgaagcgaatagaattcataaagaaatcgttgaaagtccatacaaaattcaagaccttggcattcaagtaatgatagatccctccaatgcaaaagggaaatcacaagtgtccgatacacttgagtcagacgttcaaaaaatgttaggcacaattgtccggacttctattttaaaagatgccaataccaaagctctctaggataacgcggtcagcgataagattaccgtttccgttcagccgtttaatggacaagaaacagctgacagcacagcaagttcgat

SEQ ID NO: 1547 - DNA, 278 bp, Myxococcus xanthus
gcgcccaggaagcgccacgtaacgcgcgctgaggagccagctacgtcgcaattctgggacagcagcagctcgcatacagcgacctccttggctatgacagaaacgagctgcgcatccgtggaagcctccggcactggatgctcgtccatcccggacagccgttcgggcgagacgttctccacccggaaggggatcgccacctactatacctccatcgagggcaccttggacaagtccattgacgcggtgtacacctacacgtaccaccgacgcccatg

SEQ ID NO: 1548 - DNA, 789 bp, Myxococcus xanthus
  unsure (1)..(789): unsure at all n locations
cgtgtgctctaaagttcttttttcacgaacgtccttagcataacaaccgagaacaaacagcaaaccgttctaacaaaaaaagagcttgataaaatcgctgacgcaatgaagcagctatctctgcggattgagaagatggcccattcctcagaagaacttgaacggttaactgaaaaaagttgatatgcaaaaaagccttctcagcttgcacaagaaggcttttttattttttcaagctagcgggctcttgagaagaacgttcgatgaactggacaaaatcatctccgtatatgcttcgaatcagagccgtcagctcaacaaagtcaggcagctctccataaacatctcgcagcggcatcgctccttgaaacaaaggattttcaagagggttataatcctcgatcgtttttaaaaacatcttttttccttcttctgtgagctgcacgtatgtattccgcttatctttctcatttttagaaagggtaagatagccccgcaggtgcaatttttttgcaaagttaaaagctgtggataaatgcatgacgcctagctttgaaatgtcggtcatcgacgcaatttccagctgataagcaatccctaaaatgtgatgctcattaatgctcagatcgtacggcttaacccactgttcccaatccttttcagtagacttccaaagagctttgcttacttgcatcacaagctgattaaacagcatggcatctttaatcgtatcttgatttaacgtgcgtttcacctcttcacttcctctctagaanatgcaccgttcac

SEQ ID NO: 1549 - DNA, 668 bp, Myxococcus xanthus
tagcgattgcaagagcgtggatgaataaccctgaaattatctttgcagacgagccgacggctagcttggattcagagcgaggaagagcggtcgttcaaatgcttgcagatgaagtgaagctaaggggaaaagcggttgtaatggttacccatgaccaaagaatgctggatttatgcgatcgcgttgtgtggatggaagatgggaaattagtagaatcaaatagcgtgcaagtctaaaaaagtgctgctcttgacaagagcagtacttttttgcgttcttcatcatgtgcatatttgtcttctcggtttgccgccttcatacgttcacttcctttattagtaaatcagttaggtattcatattccattttattaaaaagcgtgtattgaaaataaagcaatgctatttagaaagtaagaaacaggagataacagaacaatgaagaaatagtaaaaaggtgatgaaatgatgaagaaatggaagacagctgcaggtggacttatcatagcaagctttacaggatgttcaagcagtggatttcttgaagaattcccgccaaaagcgtatctcgaagcaagcaaccatctttatgaaacaaaagttggcacttactgctggaaaaacacgtgtgtggataaagcaggccctttagaattgttaaaaacagaa

SEQ ID NO: 1550 - DNA, 639 bp, Myxococcus xanthus
acgaatctcctagtgtgctctaaaggatattgtatcatttttgttcgagctaaatgaaccatgtcacacccttcagaagtgcttgcaataaatgtttctgatggagttaaatttccatacagtgttgagacagccatattttcaacaaaaaccgtatgtattctttccggtccttttccaaataaatcttttctaagcttccgaataatatcattaaattcatgaatagattttgacataatcaacgctctcccaccgattaaaattaaattgtgcattttattcctacagcttttttatcataaatcaacacttcaaaaaataaaagcctaaaatctttgcagcgaaacttttgaagagagttgggtatttaaaaaaggtgtgcatttaaaaacgtcgcgatataattataaataaccgagatggaataataataataatgaattgttattactctatcactttttcttaacgatataaatgggccggattggcatattagtaagacctgctagtaaactattccaccatgattgcacttcccttatttaattaggcatgtgtattcctggcgggtttttgttttatataaaggaggaaaacacatgaagagtgaaatcatcactgttcatatgaatg

SEQ ID NO: 1551 - DNA, 193 bp, Myxococcus xanthus
tcgcgtgctctaaggcacgttcgattgtcggaacgtcactactgcgctctgggctgcgctccactgacgctcgtttttttggacgcccaggatatgggagacatcacagagtgggggggaatgatgaacacgagcagtgctctttccggtgagcttggccatgttgaccatcttctccactcgctgaagtcgg

SEQ ID NO: 1552 - DNA, 595 bp, Myxococcus xanthus
tgctctcaaggccctgctggacgcccgcacgaacctgctcatgcacatgctgttgcaggacccccttatccaggggggccatgggattcccgcgctcaccgggcttgactgcctccccctccaccactttcttctgcagaactaccgcgatcggggcttcaacaacaggactgtcgtccacctgatggccacgctgtgcgacgcctttgatatgagccgggtacacgtgctgtacctcctgccggtggagcgccgcctcctccagagacgcgactgccacactctggctatggccacccagtgtggactcctgctcaccagcggatagcacccgcatgacgagggctaagaggacctcatcgtctgttaccgcatgaacctgggcggttacctgacggtcctggacgcagcccgccccatcgtgtgcgactggcaccagggacttaccaagtacagtgacgacccctactccgcgcatgcacagaaccatggaagagtggtgctctttacgtacactcactgcgatgccgtgtctgccctggagtgccgacccaacgacgccggtgtgtagctcgtggcggccgacgggtgccac

SEQ ID NO: 1553 - DNA, 391 bp, Myxococcus xanthus
  unsure (1)..(391): unsure at all n locations
actaccttggggngcataatcgacgcgtagaacgcattaatagcgacaaatgcgttcgtgacggccaccacattctgcgatgtaccagtgttgccgaactatgtgtgggcgatgaacatcaaggcgaggtcagatgtgccagtgccgaaaaccgatgccaacagaaactcgttaactgacagcttactgacatgtgcgatgaatggaacgatggtcttaaatacaaactgaacctactcgaataccccaaattacaattaccacagggtgcactgctgtactatcgtattaagctacgggcaaggaggaaagaccgtttgcaccatcacaattacgagtttggcagcacacagatcatccagctcgtcgcagtgtgctgacgttggttacc

SEQ ID NO: 1554 - DNA, 512 bp, Myxococcus xanthus
tgctctaaaggctatgccttgcgcaagcgttggcccatccaatatactctgctgctgcacgagctggccaacgggctccgcaagggcatctacggcgaggacttctatcagatggtccgcaaactgcatgcctcagacgggccccccggacggatcaagaacgggctggcgcgtgaccgatgggaccgcacatcgccccgacacgcgctggagcctgctgcgatgcagtacatggataacagcagactgcatctgcacgaaagaaggcccctggataccagcgctctacacagaggacttctggcatacgttccaaaccactgtcaccttgggcccggtctgcctgcacgtgctgcagaccgtctgcctttgcccctagaaccaaggaaccgtgcccacctgctttgtctcacacgcgtgtgacatgccggacttgtacacatccctgaccgaccaactccaacagagatgccgggaactcccagcgcaaggccggtgccataccggccagg

SEQ ID NO: 1555 - DNA, 532 bp, Myxococcus xanthus
agattgcgatttcaccatggcccgggggaagcacgcgctctagatgggtgatgtgctgcccgggaccatggctgtgcaaccagaccaggtccatatgagggttgatctggcggactgctgcttcaattcgctcaggggcttgcgcagcttcttgtagaagctgtgcgctcggaaccgcacctggcctgggctgatgccccacaactactccttctgctccaatgaccagggctccatccttgtaggggctagggattcacgctgtgcccaaccgattcgtggccatgggtgacaggaggggcctgcttacagacggggggctgggaccactggaccgcgctccggatgtgcgagcgcccttctgacatgcatacggggctacgcgacgttcatgcctaccgtggctgcgcgctgctgtcacagcaatcgtcctaattcaacgaattaagccggtgccgggctgggatccaaccctcaaggggctcacacagaggacagatgtctgcagccaaccttgtgggagagctccttt

SEQ ID NO: 1556 - DNA, 728 bp, Myxococcus xanthus
ctctaaagagaggaatggtcccaagcgatttccctgcaaatatgatatctttatagctattttgaggcaaaacgtcctgcagcactaaacaaatgtctttcatcataacgtctgcaatctcatctgtagactttgtcatcagctcttttgaatatgtatagtgaatctgaaccacgtcaattccgtgttttatcatcagcatcgttacataatacaacaggggcttttcgtacgtatagcctagccctgaaaacataaagcaaatgcgaggccctcctgttttaatatatgtataggtaatcttattagtttggctgcttacacttttttgctctacttgcatgtcactcctcctttttaaatattctaacatttaattacgtaaaaaaaccccatctttttcttagaaaaatgagggttgaggaaatagctctgcaagcagttgataagacttcttttttgcttcataatcatggatatttgtaataattaaaaattcgtcgttatcgtatttttgctgcagctgcgttaatccttgttttacttcagctggatttcctacgatcatacgaggacgattggtgcttatttttttaagctcttcttctgaataagaacgattgcgcacttcttctatcgatgaaaccgttgtgtctccgcctttggctactttcaacagccaatcatctagcgttttggcgtgctcctcggcttcttctgttggttct

SEQ ID NO: 1557 - DNA, 343 bp, Myxococcus xanthus
ctctcaggggaccggctggccctatgcatccgggactgactgctgagccgtccctataggcgcaacaaagggcggcgaaggccctccagctcagatgaactaccatgcgcctggacttaggccgtgtctccttggaacgtaaccccttgatgatgagcgaggacggggacctatccttagccagtataaccagctccaccaatatgatctcgacggcgaatgccaccgccctgaggctcacggcttagggcacctcttaatgcgccttcatgacgcaactgtgcaacagaaccgagtgggtcatctagacctgcaggctatccgctctaccagtgtacctggg

SEQ ID NO: 1558 - DNA, 253 bp, Myxococcus xanthus
gtgctctaaagacgctggtgtggacgctagacattatcctcgcggacagccctgccaggagcaggggctacaccgagagcgcgctcgctttcgtgcaccaggccatgctcttagagcccaccggcgccttggcgctccaggggctgcgggaaataaagaccgcatggcgggacttacgggagcagggatgttagatagcgtcaagggtgaatctaagggaaccttcatccaccgggaccaatcaggcaatgga

SEQ ID NO: 1559 - DNA, 294 bp, Myxococcus xanthus
ctctacaattgcgcggttgggaacacgatattctaagacacttacggtatggtgaggccggaacaaggagtgcctcgggtccattgttcaaccggcgatgaacactgtgactgaccagctggacatggtgatgcagccggggcccctgggggtgcacggtgagctgcaccagggcggtgacaggccctaacaggcgctccatgggcttgcatagctaacggtcgatggctaactacacacaatcccgacagtgaaggatgagcgtctaggacccccacggccggaccgtggaag

SEQ ID NO: 1560 - DNA, 250 bp, Myxococcus xanthus
ggctccctgcccttgtgtatatgtgagaaccacggtcttatgccgctctaaaaacaccttggggttcgcgcatatgggctctgccccacagggctcccacatatcccccgcacaccgggagaacaggagacccctttttttctcttctatatgagaccccagtatttttttgggagagcgtctcccccagggggcgggggtgacaaaaaagaagatttttggggggtgcggggggaccagagaacagtgt

SEQ ID NO: 1561 - DNA, 262 bp, Myxococcus xanthus
cgaagggaagccggttccgaccgaaaccggaacgcttccaccgggcccgaatgtggggggcccgatttcctgggggttttttggcttcacctgggtcccccgaaccctacctgcgtaggggcttccccggcccccgaacccccggggggcaccattttgcgcgcattacccgaggttaagtttacccaacccttgtttgcccttcaagggcccggggacaaccgccccatttaccttgtggaaccaaggggacaggtgcccc

SEQ ID NO: 1562 - DNA, 669 bp, Myxococcus xanthus
tgtgctctaaagtcggacaagtatccaaacatttcctctatgagtgaatacagtatagagtactgcaaagaaagggtgattattataaaaaagtattatttccattacaatgataaagatgataaatattatgtagaaaaatcttatcctcacaggaagaaagcttcccttaacaataagaaagagcagcatcaagaagatgctcctgaggaggcacgcggctgggcttatggtcacgaagaagatagctctgaagaatcacaagtttggacttatggacgcgcagaggatttgtatgaggagtcacatgattgggcttctaaatgtaaagaagataaagacaaaaaaggaagtacacgggagtcagcatttagagcgctcaatttaacgatgcctcaaaatgttcctgcaaatacgtttgtaaaagccgttttcccaactgaacaatttgatttagcaaatgaatataacccgattacttctaccttccgccccaaaaaagatggcgtatattccatcattgctacaattggattctctcctaacgaccagatgctagattatagaactcgcattgaaatacgtgtaaatgggacaaccgctattgctatcgataacgatttctttggcgggaacacaccgtttgttaatgcggtatccgtttctact

SEQ ID NO: 1563 - DNA, 592 bp, Myxococcus xanthus
gtgctctaaaggccagacgatcgccgagctcatcgcgacggccaggcttcccactgacagcctgttcaaccacgtgcgcgtcggggaccgcttcgcgaaccagacgatcagcgttagcacgcacagtgagagcgagaagaaccacagcaacggcatgaaggcatccaatgtgaggacattgttgaccgatagctgcaagccattggcgctcgtgcacatcaacgaccaggttatgcttgaggacctccgggcgcggcgcacccgctcggtgcgggccgatggcttggaccacgggcttcctccggagaatgccgggcgaacgctctggatgctgaacaaacccaagacgactaacgcaccctaccctacgtaccacacggtcatttgctcctgcatgtcaagcgtcggctccaccaacatggttaaggagagtacctccgctagctcgtccactgtggacgtttcgttgagcaagaacacatcacccccccagggatgctaccttccgctgaaccaccagtgtgctactacgctccacgggcacatgccgaggaaccgcagaccacctgacagaccagacgatagctggatg

SEQ ID NO: 1564 - DNA, 470 bp, Myxococcus xanthus
aagcccttctacatgctgaagttccgctccatggtggtgaacgccgaggagctgaaggagaagctggccgcgctcaacgagcagacgggccccgtcttcaagatgaagcacgacccgcgcatcaccggcatcggccgcttcatccgcaagttctccattgatgagctgccccagttcatcaacgtgctgcgcggggagatgagcatcgtcgggccgcgcccgccggtgcccaccgaggtggccaagtacgagacgtggcagcgccgccgcctgtccgtgcgtcctggactcacctgcatctggcaggtgtcaggacggaaccagatctccttcgaggagtggatgtacctggacatgcagtacatcgaccactggagcctgacgagcgacctgcgcctgctgctgcagacggtgccggtggtgctcacgggccgcggcgccagctagcaagcctccaggcaacccaacct

SEQ ID NO: 1565 - DNA, 221 bp, Myxococcus xanthus
cacacgcacgcccaccaggaagcttcggatggagacttgaatgataggggccaggatacgcgggaacattcagttcagggagggttgcaagtggtgttcagttgcgctcgccatggggtggctcggggaacacccgtacctgtaccaccaagcctagagaagattctggatcggctgggcggacctcgactacggtgctgagcagcgctcactacatgacg

SEQ ID NO: 1566 - DNA, 546 bp, Myxococcus xanthus
ctctaaagaggcccacgagcgcatggggcgcccagcgctccacgcgtgggacatgtccttcgaacacacggacacggacgacgtgctgaaactggacgacgccattaccccgaacctggacgaaggactgacgctcctccgggccaccgggcccccaccgccagaggcccctgtcgacacccgaaaacaggccgcccctcgcaaagcggcaggcggctagaagcggactacaggccacacacgctgagcaactggtgacgctaggacagcaccttaacgggctggatgaccatcacccgaatgaacacggacagcagcttcggctccaactagctccggatgtcctaccacattaaaataagcgccaccttcggtgcgcaggcatccgggcacgggcgctagaaggcgagggccaatcacgcgtaacagatggcgacgatcttcaaggacaccacgatgcctgtcttcacgatgatcatcccgatgtttgcatggaaggcgcacacgatgataccgaaggacggctcgtgcatcaacatcaccacc

SEQ ID NO: 1567 - DNA, 201 bp, Myxococcus xanthus
tggtgcccgtttccagccaccctatgctggacttatggggcttccccgccagcgaggacgcccagcgcttgctcactactgacgggcaaacacccgtgctcctcgaggaggactggccctgcgtagacaccttcggcgtgtagcatccagatccatgagaggcctcctcggttgcccaatccacgacaagcatggggctga

SEQ ID NO: 1568 - DNA, 705 bp, Myxococcus xanthus
cgctctcagtgtcggtttgcttgggctggcactgcacattcatgggagcggacttcaccgtagcacgtgcccctgcggaaccccgtcaccgggttcacccggatcgtgacgaacggccacccctgcatggtgactccttccatgtgaccggaggacgtgtcctagcccaccctccgggggtgacgctttcattaggcggagaaccgcctcatgcacagggaggggcccggccacacgcccttcactgagtagcgcccctgtccatgcgaactggtccacacaggcgaaatgttcagaaaggtacgggtgaccggacgcgacccagcacccaccctaccgcgtcgtgcactcctgccacacgacttcccactgcactaacgcccctggcggaaattgaagattccccatgatcctgccccccggaaggaaacgcacattccagtgacagcagttggtataaccggacccccgtgcaccaccggtcctcacgcccggacacgtcgccctgaagctgaccacgcgagacgcattcctgattgctcagtcgtcggatgacctgtactcccaccccggacgcaaacaaccactccaagaggcataccctatacctcaccagtgcggcaccgctgctctgtgagacgggccacatctgaatgcactacgcccagcgatccatccttggtggtgacaggatgagccgcgtgc

SEQ ID NO: 1569 - DNA, 596 bp, Myxococcus xanthus
  unsure (1)..(596): unsure at all n locations
ccgaacgccgcacacccggaacacccggtacaagtttcaccgggcgcaagcaccgnccccgccgaggggaggaggcagacgcccacctccgtggccagcgctaccgcgcccagcaccccggccgccggcggaatcaggagccccgcgaccccaaccgccaggcggacgaggccgaggacgagcgtcacgtccaacggccaccagacacggcccggcggccacgcccgagcggcgaaggcgaccggcaacatggacagccgcccggcgcggacgaccgagcacacccccgggaagacgaacaagagagagcccgggcgccggccgagcaacggccgtccgccgccgaccaaagtgcacacgcacgcccccaccacgccccccaggaggcgccgcacccgccccacggaggaccgccccgaagacaaggagcgctagcgcagcccgaggccgaagaggaggaacgcggaaaacgcgcccaacgccgccaacctccgccgccaacgcagaccgaaggagcgaaagtcgggcccaggccggggcacgcaaaagaagatggctcacagcatggccgtccccgagaggccggacccacgcgc

SEQ ID NO: 1570 - DNA, 361 bp, Myxococcus xanthus
acgctaccaagccggcgcacacacgtggtggaccattggagcgcacttcgcgaccacccagactcacttatgccccaagccgaacgagcagctccaccggggccactgacggctctctatggcgacgttgaaccatggatttactcttgcaccggaaaccctgccgcatcatctttaacgaacggtccgtcgaaatgaccgcattcggccgaatctgcccgctgcggcatctcacatggagggcccaaagacgcgggatgctctgtcagcctgcagcggccggggccttgccgctgaaggctaactggcggccttgcgtcgggacctggcatgaccgaggcctctaaaccgaccaacctta

SEQ ID NO: 1571 - DNA, 336 bp, Myxococcus xanthus
ctccagagggggcggggggtcataaccaaggttccagaagtcctcttccacaaggaggggaccctggcccattacgattttgaagttgcggatctggccgctgatgacgacttcccggtgatggtggtgaagtccatgccccagcacgggaaggacatgctcggggacacgaaccgggcgcccagcactgtggtggagctgctggccgacatagacctgctgggccatctgctggcggttgagggcacgattctggtgctgtgccggcgcccgccgctggacgagctgtttcacctctgcaatgagtggacccgatgcccggggatataacgcacg

SEQ ID NO: 1572 - DNA, 553 bp, Myxococcus xanthus
gtgctctaaagactgatgtatccgatctgcatatacgaacagttgattgacttgactcactaccctgatggcttccttggccagtgaggataactggacttacgctgcgggccggagctgaacatgtgcattggataagaactcttatttgacgcaacaatgctgccaccacagagcgtgcacgatgataacacgaggatacataccacgtcaaccttgcgaagatgaatcctgccactggctttctcgcaatcaaagtggatgcaatatacaccgaactctgccaacacttcctactaggtgatcacgatagtatccactatatgcaacacctcctactgggaggaaagactgaaagcgatcgacattgattggctgatctagcttcactgcatattcacgaatatcgtacatggacagcggcgaaggaccctggatatggatgacaccaacggcacggtttgtgagattggtgatacaccatcttggaaggtctacacggatgattgctgagcaacgcgcgacacacactacaataaccggacctgatgcg

SEQ ID NO: 1573 - DNA, 833 bp, Myxococcus xanthus
cattgggcactctccggttttggatagggtacaacgagaccaagcatttattagctaccctcattctccagttaaagttatggttatttctacttacgaagaagttatgattgcacgtgacgttactcgtttagcgaatatttaagttcataaagtgcctcttcaatgcatgaattctcataaattgtcaggcaaactaacgaaaagctgatttccttgttaggaaatcagcttttttatatagcgtaaggagctgacggttgaaagaaggtttacaacgtatagaagaaagaaataatataggaagcaaaatgtaacggatgcattatttgttataataaaaataaaactacttatttcttgaaagggtgacatgatgatattaacgaatcgcgaagaacagcttttagaagaaatctataaatgggaagagagcttacagagcgtagaagcaactgagatggagttattgtacgaagaatggttagaaaaagggcttaacttaattcctgcttctgttcgtgagacctatttacataaaattgatgagggactctttcagttaactgcattaattcaaggtacggaaatgcaaactcaagcgacaaaacgaattattgaaaccgcccgtgtattcaaagaagatatcacagatctgtcagaaatgaattcccttcaagtagatcagctttcttatatatgcgaacagcaaatggccaagctgcggttgtatgcgctgagtcaaggagcactttcaggaaccggccaatcgctgctagtcggtattgatatacccgctgttttatgcatgaatattcaagcggtgcaacagg

SEQ ID NO: 1574 - DNA, 256 bp, Myxococcus xanthus
tcagggcaagcccctgccggctggtgcggggctgagcgagccactggctggaaatattgcagctctacgtgttggacgaatgcataccgcacgcgctctgggcgaggccataacattccatatggcgctcccgatgtctgccccctccgccagggctgctgatatggcccaagcgcttctccagagtggacggatcctgctggtgctggacgacaacgactgtccggaggttgttcaacacgtgttggaccacgag

SEQ ID NO: 1575 - DNA, 660 bp, Myxococcus xanthus
gctctacataatactgttgatgtaaaaaagcttaaagagcgtagcggaacttatgttggaaataattctaacgtggtagctatcgtaagggacttgcctggaggagaaacatttaaagaaattgatttacataataaaacgctaaaaataacgtatggtactagagggggctctctttcagaagatgaaacgttaaaatattggtttgacggtaagaatacattggagaaaaactttctttataatgctatttatttagcaatattagtgcctaatgctcaaggttacagttttaaagtagacaatcaaaaattctcagtatctagagaagaaatggaacagtttatttcggacaacattaaaatgttaccggatagtcataaattatttgataaagaaaaagcacagcaatttatagatgataataaagaaaagataaataaaacagttaaatcggcagctattcgagaacaattctttaagaaagttcctatcgtgaaagaataagaccaaataacgagccttaagtaaggctcgttatttggtgtctattcacttaaataatcttttaaattaaataaaagctccagaaagtcacgaatcaaggaaatctttcacagcagttaagaacgctgataaattctctgtatgcacctcatg

SEQ ID NO: 1576 - DNA, 257 bp, Myxococcus xanthus
ggcctcaccccaggcctgagctgcgaggcgggtcgggggacaccgacccccccgggagccacacgcagccggtccagcgtggagcacccgaccaacccgccggagtcattcccagcagcctccggtgcgcgggtcttgcacgtgcagggagaacaggggcgagcggggcccatccaccacgctaaccaggcagacgcgatcgctccggtcgccgcagggccttcggtcgggcggcacccgggggaagcgtctgcccc

SEQ ID NO: 1577 - DNA, 591 bp, Myxococcus xanthus
caagtgggagtaaaaaaactaaagttaaaagaaaagccaacttctattcgagaaaaacaagcagcagcctctgtcgggcaatgtgagcttatgcatatctacagtaaattctttggtgagtacagtcacattgttggtcaagtactgttaacaaaagatgtaatcgaagatgaacatgtgcgcaataacgttgtgaacacgtttgaaaaattaattgaagacaaagtgattcctattgtgaatgaaaacgatacagttgcaatcgatgagattgaaaacatcgtgcgttttggagataacgataatttatcggccattgtttcagttttgattcacgcagatttactcgttattttatctgatattgacggtttctttgattcagatcccacaaaaaaccctaactctaaattaatgaaagtaatagatggcatcacgccggagcttgagaattttgctggagatagtggaactgacgttggaacaggcggaatggtcacaaagcttaccgctgctaaaacagctacaagtgcaggcgtgagcttaatcttagcaaatggtaaagagccaagtattttgcgagatttattg

SEQ ID NO: 1578 - DNA, 546 bp, Myxococcus xanthus
aaattttgacaatggttcgtttttagtttgtctaaaatactttcgtcccagcctcttttttttatcgaatttgtccatctccgtaaataatatattttaatgttgttaattcctttaatcccattggtccacgcgcatgaagcttttgtgtactaattccgatttctgccccgaaaccaaactcttctccgtccgtaaatctcgttgaagcattcacataaacagcagctgaattaacgcgctgtaaaaaacgctgagcatgagcataatttgttgttacaatcgcttcagaatgatgtgaactatgaatattaatatgggaaatcgcttcatcgatatcatctacgattttaactgccatgatgaaatccagatattctttcttccaatcctcatcccctgctggaacaagatctggaacgattgtgagcgcacgttcatcaccgcgtacttctacatctttctctcgtagcgcttgaacaataatcggcaaaaattcatgagccgcccgttcatgaataatcagcttttcggctgagttgcaca

SEQ ID NO: 1579 - DNA, 438 bp, Myxococcus xanthus
gcccgtcacggacacaagcaccgtgacacacgaccggaagacgcagacgacgatctgcgcccagaggaccttcatggtgatcgtgaactgacactgccacaggacggcctgaaccacgcacgctctggctgacgctacacgctggacaccgtgctagttacacttcagcacgcgcggcatgcacacgatatcctcgaaggggacctgtacctagatggagataacgccttgagctaccgatggtggatcaggacaagacgccgatctccaagctccagccggccggctatgacgaagggagcgctttaatcacttcatacgactgtcccggggcacgcatctccgccgtggacacctacctagggagtgcgaacctatgcggatccatgggcctcgaactgtagctcaggtcgtatcacgcgccgtatcccacgacgc

SEQ ID NO: 1580 - DNA, 684 bp, Myxococcus xanthus
agtatccttaccgcgttaatacaagctttatacgcctagtgaagcccttcgtggaacctgtaagggagctgagccgaagaggcgaagggggcgaccggatgcggtaagctgaaataactgagacataaaaggcgaaaaaataaaaagaatgaaagtaggtatcagcatgagaaaaacgcattatagtacttttcaaaacttcttccataaactatcctctaaatcttcaacaaaacctcgtcccttcagggcttattcctttgttccttttagtccactagccatgcttgaccccactatcttaaccatagggggcattgtcttaggaattgcaatcattgagcgaatattagagcgatggggtgtcattgatctggtcgatcatttttcaaagataatgcgctttatattgcctgttaccttctatagcgccttgatttacttttttgcgacatttatgttttgaggaggaatgttgatgtttgaaaaactaaaactgcgtggccaactgattaaagcgtttcgtacggcagagatttaccggatggtgaaacgaggagaccgtacctcttatctatttccaaaaattcatcaaatcgatcaccatcatacgtacacccggtacgcctttttcttactaaatggcattgaccctgacctttaaacaaaaagagatgggcgtta

SEQ ID NO: 1581 - DNA, 518 bp, Myxococcus xanthus
ctctacagcttgtatacgttcatcttggcgaatacaaactaaatgacctatatcactatcccattgaattaagcattcaaacagtgaatacggcgaatcattggtttgcatcacaagctctactttctgaatagcctggcctctgctatgaccaagcgtgctctatgtgcgccgcgccccgtgagacactatacacccccgcgtagaaaactatagggagcacggcgcacaagacccgggggagagtgcacacgctctggctctcccggaaaaaatcttaaagcgccctgtggatgagaacactctacatctggggcaccccggcgtgcgcgcgcctctgcccggacacagacacccgcgcgtgtggaagcgccccagaggaggagacacactgtgcttcaagctggggggacacatctgtgggcgtgccccagatcttggggatatacacgcccccgtctcacacgctggggacacagatatcccgagcgcggagcacgtgctcatatacagagccc

SEQ ID NO: 1582 - DNA, 571 bp, Myxococcus xanthus
taactctttttcgtctcttccttctattacatcaaatctaagtaatggcatactaagtaacctccatctttttgtctaatgtattattgctttatcatatcacaactatcatttgtaaaaaaaagatacgctattcacaatgtgctctctagtgaaagagacctcaaactcttcaataaaagctgaacctaataaaaagaaatgaccaccttatcggctcatttcattagtacaaaaatatttataataagagcttaaatccctgcccatacaatggcaatgagtacgttcatcacaaggttttgcgaggatgttttagcttgttttttcatatcagcccgactcatctgttgcttttcatgatcacttttagacatcacgtagcctctcctattcatcaaaatgtcagcagtgtataaatgatttttgagaaaccttgatccagttcttttgtgtaaacagcagcacatgcaggttatcatcagttattttagcatgttttggcaaataagtggactatgtagcgcttccatttagtattcacagccaaatatatttaaattcggtgctt

SEQ ID NO: 1583 - DNA, 709 bp, Myxococcus xanthus
gctacgaaatccgcggtttgaccatattaaaggtcagatgaaaggcgttaaaagtgtgggtacagaaagcgagccaagcttagaagcaatcgctgctttaaagcctgacttgattatcggaaataaaatgcgacaagaaaaagtatacgatcagcttagtcaaattgctccgactgtattctctgaggagctgcgcggagattggaaatcaaactttaagctatatgcaaaagctgtaaacaaagaagaaaaaggtaaagaagtattagctgactatgacaatcgcgtagcagatttaaagaaacgccttggagatcagttaaaacaaaaaatctcagttgtacgctttacagctggagacgttcgtatctatcataaagattcattctcaggtgttattttagatcagcttggatttgctcgccctgagtctcaagacaaggatgattttgctgaaatgaatgcaacaaaagaacgcattccggcaatggacggcgatcagctattttacttctcttatgaaacgggagacggtgaagcaacaaagcttgaaaaagaatggataaacgatcctctctttaaaaagctaaaagtggctcaagaaaatcatgttcataaagtagatgatgctacttgggatacagcacgcggtgtgttagcagctaatatcgtacttgatgatattgaaaaaatcttcttagataaaaaa

SEQ ID NO: 1584 - DNA, 639 bp, Myxococcus xanthus
gggcagcccttcctcatccgatggttccaagaagaggaagtgaagtgcctaagaccgactcctttatctttatcggcgcaggtacaaacgatcctatttgcgcagcatcagaaacggaagaactttctgctcttttagaaaaagccggagcggacgtacaggtccattgggaatcatttggacatcagttaacacgaacagaaattgaagcagctgaaaaatggtatcggtcaaaattttaatttcaaaactttccgcactcgtgcgggaagtttttttattttcaaaaaacaaggacagttatcatacaaaagatagatataaatggtaaaaagtactttttttactgaatgaagggaaattttatgatatcattttatttccggtatatccttgcagaacagctatttttaggtaaagtatcaaattattttaaaattcctggcttctatcacaaaaaaatgaaaccaaagtctgagtaaaccgttataataaatgcaggatttaaattcaaaaggatggttaaaagcatatgactcgtttttttattgttttacttttcgttctaatggttatatgtgtatataccattatttcgcaaaccctttaccgtcgctatcattcatcagtcataataaa

SEQ ID NO: 1585 - DNA, 419 bp, Myxococcus xanthus
cgtcaggcccgctctccttatggaagacgtcgatgcccacggcataaggcgttgccaccgccgatgagcacatgcaccaccggcgtgttgagcgaccctcccacatcaccaatagcgcaccctgcctggcaggagaagggtaacgccctggacatgattgtcgcgaatgctctgccgttgttgcttgaacatgaaaaagtaggactcattgcccaagaggggcacgtaccctacaaagcgtgagcagccggacatcttgtggagcaactagaggcggctcagctcgaaaggcgaggcgtacgcgctctcggaggacatcaccaacgtcgccgagtccggctcccacataatgacgcagtcggtggacgggtacaccatcgtgcggacatgacccgaacccacgctccaggccgtcacct

SEQ ID NO: 1586 - DNA, 781 bp, Myxococcus xanthus
  unsure (1)..(781): unsure at all n locations
gaaatccatttatgtggaagtactccaaccaaaacaaagcgttcgaaatgagaaaactttgtacttcaggcttgcctaaatcgaaattagctgttccccaaacatagttttcacggtcgggttcttttttgtattcataagtaggttctccatcgaacatatacagaccatgttcatccttacaaaaatgcccgggtacccagtctaaaagaacgcctatattattttgatgacactcatctataaagttcatcaactctttgggtgtaccgtatcgactggtagcagaatagtatccagttccttgatatccccaggatcggtcgagcggatgctcaatgactggtaataactcaatatgtgtaaaaccttgttcagcaatataaggaataagctcctgtgctaattcactgtatgtataaaggctgccatcttcatgagtcctccaagaccctgcatgcagctcgtaaatacacagtggtctttcatatatattttgctgttttttctttctacgccaatattggtcgttccatttgtacccatccaatgagtaaacaatagacgcagtgtttggacgcacttcactgaagaaagcgtatggatctgcttttaattttttttgattgctttgtgtgatgatttcatatttataaatagtcccttgttctaattcagggataaatgtcatccaaataccttcttcattaactntaaccattgaatgttgaaaaccgttccatttattaaaatcacctacaacgcttacaccctttgcatg

SEQ ID NO: 1587 - DNA, 727 bp, Myxococcus xanthus
  unsure (1)..(727): unsure at all n locations
gtggttttttgtctgaagaaaagaaaaagacagattatctaggattgtttttaggtctgggcattgcaatgggggcttctcttgggatgttgatgaataatattgggtttggtattgcgattgggacctcactaggcgttgtttttggaacgacgatgaatcaaagaaacaataaggaataaatttctgaagaaaggagtagagaatgaaatattttgacgaagcaaaagaactatgggtaaactatgtcccgagaaatgggcagtcggatattgtagaaggcgaggttatccgagctattgaaaagctccgctgtgaagctcaaggaaacggaaatgccaattgggacagcgggtttgagatgctggtgttatatatattagacgtattaaatgacccggacgtattcagcgcagctatgctagccgaaataaaagccgatgttcacaccttgcttacttcagcagaagatccgtatttagaagacgacgtatacgatcgcttgacggattgcgtcattgagtggcatatagccaaaggcggacctatcaaacgagaaaaaaatcctcaattgtatagataaacgtgagaaaggagctgctaaccagctctttttttttangttcaaactctgtatttaatcacaaatattaattgcatcatgtgctacataaatcatataaaaatcggcggttacatcgcaccaggtagcataacttcttaaaaa

SEQ ID NO: 1588 - DNA, 737 bp, Myxococcus xanthus
aaaccggactgatgccagcacctccaagaagtgaaggtggatttcgtctgtacacggaagaacacgtagaattcttaaagaaaattacgaatgccaaagaagtcatgggtttttcacttcaagaattacaggaatttcttgctttaagtgatactcttgaaatacaaaagatggattataggcaagtgaaaggaacaagtcaacaaaaagaaaagttagagcgagtgttacatacggtagaagagcagctcaagctgattgaacagaaaaagaaaaacatcttaaaagtagagtctgaccttctgtcactgagagatcgtgctaaggctgcaattgtaaaattcgagcaggaagaatcataaaaagcaggcgcattcaccagaagagtgcgtctgcttttatgtgttttatagggaatttatttatgattgtgaagagttttcttctagctgtacccctaaaagaagtagaatagcctgtatcccgtcggcttttccgctgtgaaagcttcttgtttcagcatccaaagcttcatttacagattccatcatatttgattcgtataagtctaaaatcaattgttttccttccggactcaaatgcagctgcccgcgttccttcattttaaacttcaacttcttcaactccctttcccataatactatcagtatacaaaattaataacatttacgtaaacgttaatttttgtatgtggaccagaggaacgtatttaagta

SEQ ID NO: 1589 - DNA, 183 bp, Myxococcus xanthus
gcccacggtacgcagccgacaggccccatgaagctgcaagcctttcaagccttggaacggcaacttcggctacggagcgaaactgatggccaaagggcccgggcaggacttccaagcccagaccgtacttcctgaacagaagaaggaacaccggcacgcctaccaccgagccggccagcacgc

SEQ ID NO: 1590 - DNA, 408 bp, Myxococcus xanthus
gtgtctctacggacactcatatactatcgccctctgcttgggcgtaaacacccgcgtcttaatgggcgcgcggaccgccagaagctggcttatgacggacaagttcatgtagtgcctcagtgtgctggcccacgcgcacctaatgggcatttcccgcatcaacaaggcatgcgggttgcacccactgctcataattgtgcggggctggaccacgtcccatcgggagtggtcctccatgacaaacaggcctaggtagcggatagagacctttgacttaaggagcccgtgtgatgactccgtcacatgaattttgcatcgggccaccgactcccacaactggtgatagctcttccgcacgcacggcgagctcagcaggatcacgctgtagctcaggcagtgcattagctt

SEQ ID NO: 1591 - DNA, 338 bp, Myxococcus xanthus
tgctctatatacctccgtttggatgcgcaggacctccctgcgcgacgtgacgctccaaatgtgggcgctcgcgatggttgcggacataaataccgttgagcccgcgctgaggagagtgcgatcagcccgaatctgtgcgacgtgctccaacttgtgagcgtgggggttcccgccgtgtattatctgcccggaacgctggctctgcagtgcgctaccgtgctgctgctgatgaagcccgacatcatccgcttcttacgccagccgtgcgggattgtgggcgcattcgagcacgcggacctattttggctcgtgatcggctaaagtttccagggcttgtt

SEQ ID NO: 1592 - DNA, 388 bp, Myxococcus xanthus
ctctaaagacgacatggtggtgttcatccacacgcacgtggacgaccagaccgagctgctccccagagggggccacgacctgggcaccccggtgcgccggctgctcttgctgacgccgctcgttccggagccaagcgcgcaccggacaacccatgaccattcggaccgttaggtggggcagctgcaccccctggtgctgcaccctcttgctaactgccgggtgtgcttgttccaattgaccccgcccgaactcctttgtcagacgctgtccacgccagccatgcatcgcgccccgctggctagctctctcttgggtatggacgtgaagctcgccgggcttctgcgagaatccacactgttacgccctgacctgtgcaacctactggag

SEQ ID NO: 1593 - DNA, 641 bp, Myxococcus xanthus
gagcgcgggctgcgtgaacgtgtgccccaggcgtgtgagacttcgtttccgttccaggtggtggtggatgcgtcggagcagctcaatcccgacgcgcgcgggcgctcgctgcccaccgtggtgcagatcgtccagctcaaggacagcgtccggctggagcgcgcgggcttcaaggacctgtggggcaagccggaggagttcctcaaggaggacctgctccaggtggccgagctggtgattccgcccggccgccaggtgaagcgctgggtgcagcgtgatccgaaggcccgcttcgtcctggccatggggcacttccggcagccgctgggctattcgtggcgaacggtggcggcgctccccgtggtggaggaagcgcgctgcgtggagcgccccgcgggtgaccagggcgaggcgaagccgggggacgaggtcttccgctaccggctgcaaggctatcagattgacctgatgttccggcccatgacgcaggcgccggagcctcgactccaaccccaagcaggcgacggcgtgtcaccgcggagaggtgtatgaagtccgtgcaccgagtcgtctggtcggagggcatgttcatgaacccccaccacctccagcagcaggaccctttacccacagcaactggt

SEQ ID NO: 1594 - DNA, 730 bp, Myxococcus xanthus
  unsure (1)..(730): unsure at all n locations
taaaagcacgagtatgtacagggccggttcgtttgataactgtttccaattcgtgtgcacaagcaagattacaggatggataggtttgatgaaacggacatcgatagcaataaggaggtgaaactgaaggataatcttcaagcagagacgagaagcgttttcgccttccaacgtgccctgacatagacagagctcctattgtaataccgtgatagctcatccaccgtgacaaaacctttgttttggttggctttccttgctcttgaaaatgctgaattgccgttttcatagccgtttcagtcgcttcggtcccgctgttaacaaaaaaactccactggaaatgattgctacttaattcacatagtttcttagctaacgcttctgttggatcacttgtgaactgcgaccgatatacaaacgcaactttctgtgcctgatcggtcattgcatcaataatttcttttacgccgtgtccgatacttgctgtaactgcccccgacgaagcatctatgtatctttntccatcttggtcgtacaaataaattccttttccatatgaaataactggatagtcatcgtcgagcagcggctttatcacatgggtcttattcatttccgcactctcctttcaaacacatactcttattaaactgtatgctgaaaagaagagtttcttgccaataaaaaaagccctagcatatagctagagcttttacacgtattaagctga

SEQ ID NO: 1595 - DNA, 475 bp, Myxococcus xanthus
catccatgttgtcgtttatgatctctgcccgcttgaccatcattctctgttcgtaccgatacccaacccagctctccctgagcaggccgtccacctacgcctccttcgcctctgtgtgcaccaaattgtgctcacccccaaccggaccccggcggctcgccttcacgccctcttacactaacactcccgacagaccccatgatccgtctttccagttgccgcgcacgtgctcaccactctagaacacgccattggtcactttacataccctgcccacaccccacccgtagaaggtcccacccacgaccatcttcacgaaccccacgccctgccccagaatgttctacacccaaccatctccgacaatatccaataccgcacccaactcacccattacacaatagaccccctagtggaagatcaccctcctctacaaagacccccggtagacagggcacatcactttaatccaata

SEQ ID NO: 1596 - DNA, 692 bp, Myxococcus xanthus
cgatattgatctcgctacatggctggtgctgttgtaggagtgttgattaatgcttttgctccaagtgcttttgctccgctggacaagtacttgtttacgccgcttgggcaaattttcttaagcttaattaaaatgattgatgtgccgatcgtgtttttctctatcacgttaggcgtagcaggtttaggagatcctaaaaaactgggaagaatcggggcaaaaacagtttcgtacttcctagtgacaacaaccgttgctattgtaattggtttattattagcgtttgttattaaaccaggaacatttggatcttttgatacaaaaaacgcttcttttgaagctgaaaaagcaccgccggttggagagacattcttaaatatgattccagtcaatccaatccaagcgatggctgaagggaatatgcttcaacttatcgctttctctatctttatcgggtttggtattacgatgcttggaagtaaaacaaaagggctttacaatttactcgagcaaggcaatgaattgatgatgtatcttgtaaatctggtgatgaagtttgctccttacggaacatttgggcttcttgcaaccgcggttggaagtcaaggctgggaggcaattaaagcgatggggctgtacatgattgtagtcgtgctggcgctggtcatccattcaatcgtaacatatggggg

SEQ ID NO: 1597 - DNA, 431 bp, Myxococcus xanthus
atgtggagtactacttgtacggggaccagcacgtctacaaggtgtgggtcagccttgaccgaaacgaaaccggctatcgagtgatcctggtgcatggagtgcactggccggctgcccgatagagtaaccaggaatggcccgatcgactacacggattcctcggagacggaccgatattgggagggcgccttctccatctggaaaggctcaacgctggcgctgattccaaagaagttgacacccgcccggctgagggtgactacccgccattgctgtatgtccgtagggacttagaccctttaaccttaactcgcgaggagcgcattgacggactccaattgcaggcccttcgggtgggactgatgtgtgctggccatgaataccttcagcacaccggacacaccacctgaccttgtgatgttgccgatgat

SEQ ID NO: 1598 - DNA, 846 bp, Myxococcus xanthus
aaatggaatcctctttgaaggaagtacgttttgattccattacagctgaacacttcaagcaagtgaaggagcatggttttacagatgcgtatctagcaagcgtatggaacgtgccagagcttgacgtaagagcgaaacgtaaagcactacatattacgccaagctacaaaatggtagatacatgtgcagcggagttcgaatcctctacggcttatttctactctagttattatggcgagagtgagattgaaccatcaacgaataaaaaagttgcgattatcggttctggaccgattcgtatcggccaaggagtagaattcgactacagttctgtacacggtgtgttagctcttgaaaaagaaggatacgaaacaattttaattaacaacaatccagaaacggtaagtacggattttgaagtagcagaccgcttatattttgaacctgtaacagtagaagatgtgctaaacgttcttgatgctgaaaatgtgacggatgtaattgttcaatacggaggtcaaacggctatttcgcttgttaaagggctagaagaagctggcgtcaatttactagggattacaaatgatgttattgatgcacttgaagatcgcgacctgttttataagctcttagacgactgtgatattccgcatatcccaggtgaaatggcgaaagatgagcaagaacttgtacaaaaagcaaaagctatgggattcccattacttattcgtccttcttacgtcattggcggaaaaggaatgctgacaattcaaaatgaaacggagctgcaggcttgtttaccagctattaaagcgtctcatttcccaatgcttattgatgcttact

SEQ ID NO: 1599 - DNA, 738 bp, Myxococcus xanthus
  unsure (1)..(738): unsure at all n locations
tgaaaccgggattcctaagctatcgaagaagcctactgtattttcaattcccccttgccatttttgaaagccgtgtactaaaaatgtaaaacctaatactaaacgaataataagcgatccaatttcgacgtttttattcactttacttcctcctttaagtgtatttgaaaaacactacattatgtagtgtaaaagcccgtaaaaagaaatgtagcaattaaataaagtctttcttatttggataattttacaacattatgaacatcacactacacattgtagtgtgatgtttgttcccagtcaagtaaaaatataaaattagatcatttggcatacaaaaaatttctgaagggcacttgaaaaatcctttaattatgtacaatttagttccttattttcaatcttattctccaacatgctatactgatggcggaggtgttacgatgcgcttagaaaataaaagagttattgcgcttgttagtgcagactttgaagatctagaactatggtatccagtgatgcgtcttcgcgaagaaggagcagaagtacatttagttggagaaaaagcaaacgaaacgtacatggggaaatacggtgttccagccgtatcggactatgcatttaaagatgttgatccagctgaatatgacgctatnntagtacctggaggctgggcgccggataaactgcgccgctaccctgaagtaattgaaatggttcgtcatatggatgaacagc

SEQ ID NO: 1600 - DNA, 515 bp, Myxococcus xanthus
ttccccttgccggaaagtggcaagagtgaccccttgatgctctgcagaaggcggcaagaattccactccagcgctgaattgggccttttcccgggcgggaaatacctcctacaccttatcctgggcgcggcgcagtgaacggtccccatgggccgagtggacgtgttccaggtgggctgccagggcaccatcaactaggccaactgaggcgggctggggttccccaacatctacatatttccgaccaccgcctactgaacgggggcgtgcgcgtccactggcctgtgatgcaacactgcctggagaggacgctgcattggctcgttcgggaatagtacccacagcgcgctgtcccgctcctgcaaaaccaagaaggtggccccaggggtgtccatgcacagcacaccgcacttgctcgatcacgggcgtagccatcccacgcggaacatctgctgcgggcagcagaatcaactgcatcatgggatgctgcagttcatgctactgtggcatgggcc

SEQ ID NO: 1601 - DNA, 133 bp, Myxococcus xanthus
gtgctctaagtgacccgtagcccgctgcatatggatgatggggctcgcggcgtgcgccgctatctggacatgcgtcttgatgccaaccagatgactactctcggcattgacgcagaccgactcccagaacagc

SEQ ID NO: 1602 - DNA, 745 bp, Myxococcus xanthus
  unsure (1)..(745): unsure at all n locations
cttcctcctcatgaaaatactcataccttttaagtaaattccataaaaaagaaaaatgtcctgttttaaaatcaatttataagaaagtttttgcgtttgtttctaagctgtttttgtctgacaaataggtaaactgcatccaattctctagtttctttttaggctgcttatattataatgaaacaaggattaaaaaagacagggtaaaacaatcgattaaataagtataaaagaaggtaagggagtaggtctatgagtagctttaacagtcagtttttgtattccattacaattattctattaggatacatactaaaacgaacaaacctccttcagcaaaaagacggggaagctttagcaagaattatttttaatattacaatgccttgcttgattattgttacattcagcagtattaaaattgatggatcgcttattttactattagttattgggattgtctatggcttgctgttagctgcagtcggaatttttgtttttcgaaaagatgagcgaaaggtgaaaggcatgctgacgatgatgattccagggtttaatattggaatgtttgcctatccgttagtagaaggcatttggggaaaagaagggctntaatactttggtatgtttgatgtcngaaatgcttttgttatttttggtttatgctacgtaatttgcagctactactcaggggatgatattgacattgaatttaaaaagatttataccaagtattaaaatcgat

SEQ ID NO: 1603 - DNA, 687 bp, Myxococcus xanthus
  unsure (1)..(687): unsure at all n locations
ctggattcagctatatcatttccgctatcggaattggaaaattgctttcatattctctatcatgcatcttgnctgataaagtcggacgaaaacctttgattattgtttcgtctctgacgatggctattttcttaattggcattccattatcgccaaattatcaaacagcctttatctttgccattattgctggtattgcaaactctgctatggacgctggaacataccctgctttgattgaagtttttcctaaatcttcaggttcagccagtgttcttgtaaaagcatttatatcagctggagcagcgcttctgccgtttatgattgccttttttgcggatcgtgatttgttttatgggtatgcttttttccttcccgctcttatttatttactaaatatgatctttatgttcaaactgccttttcccaatcataaacgcgaacagaatacagttcaacagcaaagtacagaagagaataaatttctctctcctcctaacatgaaacaagaaggaatcgctcttattgtgattggatttacttctacagctctgtttacagtggctcaaatttggcttcctacttatggtcaacaagtattagatatggctgaaagcagctcggttcgccttttaagctactacagcatcggagctttaatctctgntttagtattagccgtattat

SEQ ID NO: 1604 - DNA, 357 bp, Myxococcus xanthus
atccagtagatgcgttgcggggcctactgtgacttctcccctgtatgtttggccacccgaggcttttggcgtgtataggagaaggcctaccagcaccttcacagaaccgaaggttcaccggggcccggagtacttgcacataatgctgtggaatctacgcccggtggacccaccagggctaccacccggctaaccactacccgcctgggccgggggcctggcgtcaccactaccgtgggagcgacggacattactggggcaactccagacgtaccaccggtccgtggggcgcgcttgatcgggggcatgggacataacgcggcctatgggggacatcggggacgaatggactgatgc

SEQ ID NO: 1605 - DNA, 271 bp, Myxococcus xanthus
ctgccgctcagcaagatgcgcaggatctactcctgttggggcgccatgaagatcaccgaggctcccacaccgaccacctggggctcgtcactgatcatgaccagggtcgcgatgggctcacacacgcccaggctgtgaatgctgatgtccaggccgagaccgctgaactgcgcccacaggacactcgactgacccacggggaccccccgctcgttgaagcaccgcgcctactgtatcacgctcaggataaggagggctatgcgccccaccg

SEQ ID NO: 1606 - DNA, 457 bp, Myxococcus xanthus
ccgctcgccgacaccatgctaccgtcacctgcgacgcgctccaccacgcgctgcacccggatcatgcccacaccctgctcagagatgtcagccatggccttggcaccaggacacgcccggaacgcaccaccacacgaaggcctaacgggacggcacgcacaccacaggctccgccgacagcaggccccgccacaccctggcatggttcagctactcggggcccatgcgcgcactcgggatcgcttcaactcacatacatgacggagcgcctggctcgctcaacacggcacgaggcccggactgctgggccactactggcggaggcccgaacctctggcgcactcaggccggagccgatgcaagctcgcacactacggaccaacctgtctgacgctccctcactgatggcccagccgacggctattgccctaccggcgacgaccacagccacctctca

SEQ ID NO: 1607 - DNA, 704 bp, Myxococcus xanthus
aggctcgcttctactcgttttccgtgtcagtcgtgacgccgtttattcctattttaatggggggaaccacatacttaatcagtcaatcgttactaggtattttagttaaaaatgtcgattttccaatctcaacgttcacgcaaacgctcttagtagctattttgtttggaataggtacggattactgcattcttttacttaaccgtttccgtgaagaattggctaacggacatgataaagtagaagccacgatcacggcttaccgtacagcaggaagaacgttattcatcagcggaattgccgtatttattggttttgcagccatcggatttgccaagtttgctattttccaatcggccgttggcgtaacattgggagttggtgtgctgctagtgattttatttaccttgctgccactttttatggttacgcttggagaaaaattattttggccgtctaaaaaagtggcttctcatagcgataataagctgtgggggtttttaggaagaaaggcagtagcgcgaccgttcgtatttttagtcattacagcgattattaccgtgccttttattgtaacgtatgactcaaaagtatcgtttgattctactgctgaaataagcagtgattataaatctataaaaggactaaatgctatcagtgacgcactgggagaaggaaaagcatttcctgtcaatgttattatt

SEQ ID NO: 1608 - DNA, 707 bp, Myxococcus xanthus
cccgtgctctaaggtacaattgcacgtgcaataagcacctgctgtttttctgatagagttagatcaacaacattttttttaacggataaagaagaaccaagtaaagaaagagcttcttccgctttcttataaatagatttccagtttacaaatgtcttacttttcttagaaacctgcacgtctaacacaatgttttcagctactgatagcgaaggaatcagcgctacatcgacttcttggtgtacaatgccgatgccgtggctcttcgcttctttaggagaagaaatagagatttctcctccgtctttgtaaatctttccttcgtactcgtcgtaagctccgcacaatattttcatcaacgtacttttaccggcaccattggctcccaataaagcatgaatttcccctttttgaacagtaaaatcaactttgttcagcgcttgaaaagaaccaaagttttttgtaatgttcttcattgaaagctcgttcgtcatgtctgtccctccacttctactcttttttaccccattcttctacgtactgactaagctggtccatattaatcgtttgattaggcaagtcagtttgtttgactaaaaccggatcaaaggaataataacgagggatctcttgacccggaatctttttaagaagcagatcaacctgcttttctcctactgaagctgggtttacagcaactgacgctt

SEQ ID NO: 1609 - DNA, 781 bp, Myxococcus xanthus
  unsure (1)..(781): unsure at all n locations
tgccttctgctacgccgcttttcacttcttcgttaaaacggtctaacaagaaaatagaatagtcaattccaagagcaactaaaataacaaaactaaagaatggcacggcccagctgattccgtcattccccattatatccacgaatagaagctctgagattcccattgctgtataatacgtaagcaacagtgaagcaatcatgtatacaggcatgatcattgaacggaataaaatggtcaaaacaataaacaatccaatcatcataataaccattgtgcgtgaaagatccgttgtagataaatcttttaaatccgcatttgagctcgatacccctccgtacacaatttctgtatgctcaaacggcgtatcaacgacttcgcttgccaccgctttttcaatattttttacggttgaaatggcttcttcagaatatggattttgatcgagcactacgctgagcttaactccttttccatctgcaaaagaatagttgtcgatggattgtttaaaccctttatctttcatcacttctgctggaagataaatacccgtatctctaactgttgagctgtcactcatgttatcaagcatacctgttgcttttgttaagccatctgagattttcgttagcccatcatttgcactatcaacaccttctgctaattgattgatactgtctgatagggttcccacttggccttgctgagctgaaaagatctcatttgcttgttgaagaccngttttgatggtagtaagctgtttgctgattgctgcaagctg

SEQ ID NO: 1610 - DNA, 231 bp, Myxococcus xanthus
ctaaagatcccactgccgacggaagagcgcagggctgctacctgagcacggaggttccagggcagacaactatgttcatgaccccctcgcacgtcctacaaaagtggatgatcgccgctcgctacaagacggttaccatctaccaggttcccctgcgggtcatgacgatgctcgggaccagcacccacgcacggggctcactggccgctaaagaaacgctgccggtgacca

SEQ ID NO: 1611 - DNA, 511 bp, Myxococcus xanthus
tgggagccgctagaccccgggacgccgatcgtgagacctatgacgacctgccaagctaaagcagaggtccacctcgccgacgccagatggacctccgactaccgctctggtgggaaaactgcgcgccctggaacgcgcctccctcaaccccactgcgggctgcaccgcggaggccatgtaggccatggggggggtcgcgcacgacaaccaccaccaaatgcccatgctgaacgcgctccacgtgcacaccttgcggctggaccaacacatgacctagattgcgaccatcacctacctggccccttaaaacgtggaggagaacctggaccgctccgacatcccaggggagacgcagccggtgctggcccacgacgtgctggacttgcaggggccccgtctactctacggccccaagatgaccgagaacgacctccagaacctgcctgagaaacaccccatcctggaccaggacacgctcgccatggtcaccgccgaccatgcgatgacctat

SEQ ID NO: 1612 - DNA, 778 bp, Myxococcus xanthus
aggctgcttgtgacgtttgtaaaatcgaagcgatctctttcagctgatagcgaaagccttcttttaagaaaaagataaccgcttgcttcggcgtaaattgactaagcagcagttcgaccgagtgtcccttactatcaaacgcatgcttatcggcttgttgttccaaagctttttcttcgactattccttcacgctttcgttttcgcagcaggtcaatccagtggtggtacgcaattttatttaacagcgcagaagacaaattgtgctcttcgcctttatatcgctgagcttttaaaaacgtttcttgcgcgatatcatctccgtaccacacattttgtgctaaaaagcggcagtactgctgcagttttgggtaatgctcgttccagcaagcctcatcaaagctttctgtttgtttttcaattttttttgaatgtgacatggttttcactccttttgcactctctatttactaaacgattaaaggaaattcaaaagatacggggaatcaaacttttttatacattatacgcttaagcagccatttttttgtattataatgaagatacttttatctaaggagtctaaaaagatatgcgaagaaaaccattatacggcaaaaagaaaacgaacaaacttcactataaagacttaacttgtgaacaccctctgcccgctttgcctatgagttatacaagtgaagctcctttttactattatgaggcggtcgaagacgaaaaacaaaacgacttttgactatattcagagatttgtatcatga

SEQ ID NO: 1613 - DNA, 59 bp, Myxococcus xanthus
gggtcgggttcttgttttccggcaagaaccttcccggcgccccccttccccccgtgttc

SEQ ID NO: 1614 - DNA, 416 bp, Myxococcus xanthus
tctaaggtgctggcgaacatgatactacccttacgacactgctctcccgtgttgggaccaagcccttgatttacaaacccaagacctggaagccggcccgactgatcgtcttgaacacctcgtacaccaagcaggggcggttacagattcctgctccataagggttcatcccctagctcacccgggggttcctgactttgtcctgcacctgcgaaccgaactacatgatgtaaggggactcctccaactgccacaatgtgaacttttacgtccacgcccacggctgttagtcggtgtccgcttggaagaggcacgtggcactgcgacatggatcactacggacgggggctccctgcactagacaatccggcgacaatgctacgatgccgtcttacatgccagcccggccgtgtgag

SEQ ID NO: 1615 - DNA, 718 bp, Myxococcus xanthus
tgtgacgacggcaaccgtaccgcttgaggcggattgttcgaattctctccgtatccaatttcttcattatttgaaataagaaagtgcgtagtgtatggcagttcgatctgctcttcttgaattgttttcacgagctgaagcaataaagctacgcttgctttatcatcgagatgacgagatttaataaaaccgctttttgttatttctacacgaggatcaaacgaaacaaagtcgccgacttcaattccaagactgcgaacatcttctgcgctatgtactttttcatccaatcgaatttctatattatcttgatttcgctcagctttacctgcatctttatacacatgaacagatgtttgatgcataaggatggtccctgtaaatacttctcctgctgacgtttcgatttcacaatattctccttcaatggaattgtagcggaaccctccaatcaagtcgattttcagacgtccactcggtttgatttcttttaccatagcacctaatgtatcgacatgagccgtcagcatgcggtgatgatctgtatctttaccgggaatagtagcgactaagcctccttttcgattgcgatacgtttgaatatttagctcttttacatagtcttcgacaaatgaaatcaccttttctgtatttccagaaggactgggaatcgcaacaagctttttaattaactgaacagttttcgtcattatgacac

SEQ ID NO: 1616 - DNA, 583 bp, Myxococcus xanthus
gaattgcagttgatatgattttacctgttttagggcataatagactggcaaaattaccgaccaacaccggtcatttattagagcgttttgctttgttaacattaatcctgttcggagaatccgttgtcagcattcttgctgtgatacagccacaaaaaggggactggaatgccattttattttcggctatttcatttgtcctgattattgccatgtggtggcagtactttgagaatgtagaaaagaaagtaaacaagtctattcaaagagccggacaaacgattatttacggacacttacttatcctcatgtctctaagcatgattgcagcatcgattaagctcatgtttgtacatgaagttcagtacacattcagcttatattttgtattcggatccgtgctgctttattttatggcaaccactcttgttggtcaccaatatagatttgaacaacatcgtttgaaagtgtatcacttgggaatgttcttatgaattatagcggtatctttgattgctaactgaatactcattgttcccagcactgtggtcataggagaattagcgatcttttttatgatcta

SEQ ID NO: 1617 - DNA, 99 bp, Myxococcus xanthus
ttgcgcgcagcgtgatgccccgcgcgtgaatgtgggagaatccgatctactgggttagggatcggagtatgactgggaacatcgcgacgtgctacctat

SEQ ID NO: 1618 - DNA, 568 bp, Myxococcus xanthus
ccgtgctctaagggtacacttgttcaataatgcttccttctaaatgcttgcgaagaagcatacaaaacataggaggctcagatggattttcatagggctcatttgtaaaatgaacgcgtgaatagttagggtgagctgagattaaaagtttgcggttttcacctttagcgcgtacttgtaaaatcaactcgtttggaaacggctgatatatttttgaaattcgtcctgaaaccaaggtctcagataattcttgtaaaatgccatatgtaaaaataccatcaaatgacacagtgctcacatccttaagtaattgaaaattgtcctatagaaaagtatagcattttttaggacgagtctgaataagcatacgatataagattgtaacaatctaataggtgcatttacaaataaaagggtgtgaaaagatgcaatgaaatggtatgaattaggtgaaaaagcaatagtagaagttacaaaaaccgacaggcagcatggtcttacacacaaagaaagtaaagcacgtcagcagcaacaaaggtttaatgaattgactgaaagaaagaaaaaa

SEQ ID NO: 1619 - DNA, 174 bp, Myxococcus xanthus
cgtctgaccgctatgtgccgctggcgccggctagacaaccggagccacttgggagaaagacgccggacgcccaagggcccgcagggcggacggaatctaaaccaacgggagaggtaactaccgaagcgactggccccgagacaccagaccatcctagatgatttggggaacgac

SEQ ID NO: 1620 - DNA, 322 bp, Myxococcus xanthus
cgctctcaaggacggcctcggacagcccacgcccgagcgaacggttgtggtccactgccttgcactgactgggactcagatcgttaaagtgacgatgcacacggcaagttgccgtgagaactacaacatctaacgcggggccatcaccttaggggcgagggacaagtccaccgactttccgggccaccgagtgagttgtacgaaccgaccggcgcggagtcgcgccacctgatacggggagacggtgactcgcgccatgtgcacccaaaactgaaggggcaagtttgccaccaggcagctcccgcgcggatggctcacattt

SEQ ID NO: 1621 - DNA, 648 bp, Myxococcus xanthus
cgctctacgttaatatcgtccgtaaattgacacatcatacggagtcccgcaatgtcctgcatctcttcctctaagcgatcgagagaaattccttttcgagtcgctttatccaaaatactggcgataggctttactcgtcccgtcacgaattcaataggtgaatgcgtagacttcatatcatactgtgaacgaattccttttaatttcaccttaagttcttcaacggcttgtttatacggtgctaaaaataaatcccaatgcctgatcattaataacaccccccttttttctctctgttacttattttctttatctaaaaaaacttcctctactcttgctaccatctcgtctccataattcacgtttccttcgatgttactgatgagataagacagctcttctttaacggctgatagctcaattacttccttattaatttctaaaaatactttcatatctttatgtaagacgtgctttaaattcgcccaaatattatcactaaggccaacatacataaattgatcattaatatctacaacatatacaaatgacatgttatctgagtcaacaagcatttgttttgtatcttccaattgttcaatttccgtctcaatagggtctgcttttaaatgtaaatcatttgatttc

SEQ ID NO: 1622 - DNA, 327 bp, Myxococcus xanthus
acccgagtggggctcgtcgttcctgcccagacccaataacaaccgcacggcctgccactgcatgcaccaccggccggcgacgctaaccgcctgcgtgtgaagcccaaggtgagacctgccggaggttctactacaggttcctcacgctgaggcacttcaggtcgatgaccatgtggaggctcacctcttcgatgcgcagtgacaccaagaccgggagcagggtatacctcagcgtcaggccctgcccaccgagattccttccggcgacactggtcgtgaactgggaaacttgctggtgcagttggaggggactgctcggtttgccca

SEQ ID NO: 1623 - DNA, 451 bp, Myxococcus xanthus
  unsure (1)..(451): unsure at all n locations
gggttatgtcctcatggggccttcatagacacagaatattcgttggaccttgaccggcactttggtaggcggctacaattgagcggtgctcttcacgattggaccctatgttaactggaacatatgccgactccggtgtggccatgatccacccgtttggagaaaaacttgatgactcgcagtgcagggccaaggcatcgggtctgttagacatggatagacgtgncttgtggggcggattgggttgatagaacacacacaaaaagacttcttccgcctgatcatcccaggtccacggccggcgtaggggagattctcggccgggtgtgggcgggtacccccgcggcgaatggagacgtgtataggataccgtcgggtagtcgcggttggacgggacaggttcgtagtggagggcgctcatctcggacagaaacatcgcccagcccagttc

SEQ ID NO: 1624 - DNA, 466 bp, Myxococcus xanthus
cgctctaaggagcgcatgctcagcgcctgcagtgccggccattgctcgccattactggacaggccctgaggctccaggaaagccatgggccccttaacgactcgctcgaacgcaaagacgatgatccgcgcctggaaccgcctcatgtgctccagaacctgcacgctggcgcccagagcctggtaaggcccgtacgcccagtgggcccaggcgaagaaggactactcctgctgccccacgaggaggcacatctccaatggccggctgcccgccgcatccccgggggagacggccaacatgtaccccaggagcccgacgacagggccccagggctacagcaaggccgggaggcagggcgctccccatggctacagcctacatgaaggaccccccggaggggcacacgaacgccggctccgactgcagctctagggcgcgcaccgatattacgcccgcgctccacagc

SEQ ID NO: 1625 - DNA, 300 bp, Myxococcus xanthus
tggatatgaagccttattcaagcggacagcttaggcggctgtgaagggggcgggagaggatgaacgcctggagtgcctgcgccgcacactagctgaagtgggtcaccccggggagactggacgacgacccgaaaggcatctcgttatcctagcacgggcagccggttgaggaccgccaccatagacactacaggttgtgcctgacgagtgttacggtaaccctggccgggccgaatgttggcttcttcacccttcgcccgtggaatggcctgaggagctgaccctaatcgctaggtgccg

SEQ ID NO: 1626 - DNA, 448 bp, Myxococcus xanthus
gcggcccgcgcctacctgagcgaaaccatgcctttctgctgtcccgcacccactgggcactgatatgcgccagatgaactcgcagagcgcggctgcaccggctgccgccatcgagctgtcagccccgtacactaactgtgcccgtggcccgtaccccctctaacctgatggtcgaccccccgaagcgcaacctcacggcgtgcatggtcatctgatgcggactgcgtgtgcagtacctaccccatgacagatacccgctaccggccatttcgtaggacccgctatggtatgacatcctccgcaccacggtgttctcgaatccactcatctgcagggtgaggcactgttgcctgcccatgacatccgagagcctgtcttccgcctgcgtggcgctcacgatgcggtagtccctgcatggcgcgcgcgccatgacttcgaatctgcagag

SEQ ID NO: 1627 - DNA, 292 bp, Myxococcus xanthus
cacgatccagcggattccctgtgtgacgaggcttctgctgcttgaaggactacatgggtttaccaacatgcttggcacggatcataaactgggcacttttgatgatgaccacacaacccgcattctcccggatggattgaggtcccaactaattgtacagcgcctatcacaaggctagacatgtccttcaagacacacaccacggcataaatgttgcacctgcccctttcgaacgaatggccatgaccttgactatggcgacgttccccgacttctttaggaagggcagcgc

SEQ ID NO: 1628 - DNA, 293 bp, Myxococcus xanthus
ctctaaagggggagagctgatcatgcccgagcaaccttgacggctctgagcgcgacgctttcgaaccacctcatctcatcgtctttgaaccaccagagggcgaagcaggttccatgccagaccgcggtggcaccttggccctctacgcatccttcggatgtactgccacgcctgccacgcgaccagagccggacgaatgactgggccgcacccggtcacttggcgcgagggtgcttgcgctccgttccactggacgtggccacaccgctgagtgatccctagctccttgggaa

SEQ ID NO: 1629 - DNA, 260 bp, Myxococcus xanthus
cacctagggcgctgtgcacgactccttacttcagaagacccacgcccccgtttgttccgaggccgccatacagctggatccgaatggcctccacttcacctcagcctcgggagacgacattacctgggtggacgacacattcacgcgggtcatgatcactgggcacacatcatgcaccttacggtatgaatgagccagacacgacaaggccatatggactatgaatgcacacaggtgccacagtaatccacacgcccaca

SEQ ID NO: 1630 - DNA, 487 bp, Myxococcus xanthus
ccgtgggcggttgtgctgccggcatgcgaatggtgagtggcggaccatcaaagatgggacggagcgaccatgacacactgggctgaccagacgagcgctcagctgccagcataccaccgtcttcgttctgcccgcctgagtcctaattccccgaccgggctggtgcgatgcctacacgtgggcgtggactatgaagaggggccgggaatgtgccatcgccaggtccagcggctctgcccggtagacgaatgggagatggcatgcaaaggacccggccactcgcggttccacttccgccacgagcaagacgcgggcgagtgcaacaccgcctggatcccggctggactgacggactcccgacgctgtcagcgcttggagaggggatacgcagagatggacctgggcggcaaccatgacgagtggacggacacccacgtacgggcccaagcctacgcactgaacggtggtgccttgctccaggaggacc

SEQ ID NO: 1631 - DNA, 232 bp, Myxococcus xanthus
ggaacagggcgtgttgcggaaccacaaccgccggaaaaatcaatatacgagtgcacatgactgacccgcgcgggtgacccatccaaacggacctcaggaccaaagtgcaagagcacggcctccacgactgccaccgggccgatgcgcccctagcgtgcccaaccctgccggggggcagactgtgggaggacggacacggcactcgggtgccggaccccgtgacggacaccgt

SEQ ID NO: 1632 - DNA, 696 bp, Myxococcus xanthus
attccatgggattatgatgcaacttggggaagagatgtaaatggaaaagtaatggaaggagactatgtccgcgcacaaggatttaatacgcttacagctcgcttactggcggtgaacagcattaaaaagcgatatattcaaaaaatgaacaatgttctaaataatcaatttacgatagaatacatgaaaccaatcatttatcaactgcatgagtatattgctccttatgtattaaaagatccttacgtaaaagataacttggagcaattttataaagaacccgaatttatgctgtcttttataaaagaacgaacagcgtatattaaaaataacattttgactttttaaaaagagatagatttataggcaatttataggcaacagtggattttgttaataataggcaaatgcaggaaatcaatagctgtacatgatacgtatatatacagtatgaatgaccaataaggataatcaataaggaggaaaaacaatgagtaactattactacgaccaaaatcaagatcaaactcaaaatgcaaatcgtagtcgcgctcgcaaagttcaacaagctgaaagcacgggctactctgcccattttaaaccactaaaagggagagtagtgactgtatatcgcgggggggcctgaatctaaaaccgggaatatttaaattggacggtttcaattcaggatttatt

SEQ ID NO: 1633 - DNA, 739 bp, Myxococcus xanthus
cagtaggatatgcgttaggtatcggctttgcacctgttcgtaaagaaggaaaattaccgcgtgaagtaattgaagtacattacggtttaaaatacggtaaagacgtattaacgattcacaaagatgcaattaagccaggtcagcgcgtgttgattacagatgatttattaggaacaggcggcacaattgaagcgacaattaagcttgttgaagaattatgctgaattgttgttggagctgcgttcttaattgaactttcttaccttgacggccgtgacaaactacacggctacgatgtattcacattaatgacgtgttaagaagaacgatcacataaaaaagagtacctgatacaggtgctcttttttcgttaaaaaacgtgaatacgtaaaatggaaatgatgtaaatttcataaattatacgcaaaggctttacattcttggattttttcaagataatagttacaatatgaattaaaaatgctagttgataaaaggtgatttcatggcaaatgagcaagtcctaacagcggaacaggtcattgacaatacgaagcgatatttaaatgaagaagacgtggtttttgtacaaaaagtatatgattgtgcgatagaagctcacaaagaacaatatctcaagtcgggtgaaccatatattatccacccgattcaagtcgcaggaactgtagttgatgtagatatggatccagcaacaattgcagctggatttctacatgat

SEQ ID NO: 1634 - DNA, 684 bp, Myxococcus xanthus
gctctcagcttttcaagttattgctccgttttatttaattattacgtcagaccaaagcaactggattttatatgaaagaacggcaatctttttatttggcctcacgtatttatatgtaggcgtgacggtattaaaaggaatgcagggaacggggctgggctattattcactttgggtatcgattatcgctttagtgtacgttacggtttctcttgttcactatcatgacgtagtgaatgccattacatggattctttggtcgtttttatggtttttattttatgtgcttaatacgagcaaaaaagatgtatctgcatatgtagggaaagtggcgattgtacagtcttgggtgaccttaacaatcccagcgctgttttcgctaacgggcgtatggggaaataaagatatgtacaatatgtggggaattgtgttggtagcttccatcatttattttgtatacgtaggatatcgactattcttttctcagccgaaaaaaatgattttgaaataaagtatttacaaaaaatagataataatggtaagatgttagaaattaaatgccgtgaagagaaaagtagacagcgcgtattcttagcagagagctccggaagctgaaaaggagcaagaaaaacgctgttgaaacaagcctctgagcagcgcattggatctaacgtgatagtgcga

SEQ ID NO: 1635 - DNA, 672 bp, Myxococcus xanthus
acctgtacttctatttaaaccggtttttcggacaggtaaagagtggggaagtagcaagcagcgttgaaatgtttcagcaaagtttttttcacaatgttaaatacttagggctcatttggatactaggaattgctattattggtttgcctgtagtgttaattctgctgtttttaaaaggaatggtgattggttttaccgtacgctttttagtcaatcaaatgggactctctgggtttgcgctatcttttgtatctgttatgccgcaaaatatctttctcataccggcatttctgattctgtctgcagcttcagttgccttttctttgaagctcgtgcggcagcagttttttaaaaaagcagcggagccaatttctgcatcctttttacgctatagcggcacgatgattgcaatgatatgcttggttgcctgtgcagctacagttgaagcttacgtatcacctactttaatgaaaagtgtaatggctctattaaataagtaagaataagtattaaataaaaagaattcttttttcttattaagaataactttattttgacaccctcgacacatctgatataatggattagtgaatggcgagggagggaataattatggaaaagtcaattgagcgaattaagcagcaattgcactccactagctataaattgaca

SEQ ID NO: 1636 - DNA, 122 bp, Myxococcus xanthus
gttgcttccttgcgggtgaggtaaggacggcgccacggtttttccatccccctccatgggacggcggaggtcattgctcccctgcctgccgggaggaagggaatgccgcgccgccttgtcag

SEQ ID NO: 1637 - DNA, 619 bp, Myxococcus xanthus
tttttctatacccctcctaaagaattgttttgtttcatttattttactatatcataccgcatttgttatagagaatgctccaattcaacgttcatttatcagttttccctacatgcctagcgtcaaacccttcctttttaagcctgcatcttgcattttcctaccattgggcgttatgattaaggatgattttatatcgcccaatagcagacggttcctgtatttcttagattttcaaacaaagaagaatgggctgatgaatagtcgacttccatcgctataaccgctgctcaacttttttcgtaaagttacatcaaaaaaggagtgaacaacaatgatcacattaaaaagtgaacgcgaaattaatttaatgcacgaagcaggtaaattattagcttcttgtcataaagaaatcgctaaaatgatcaaaccaggcataacaacaatgcaaattgataaatttgttgaagagtacttagcaaagcacggagcaacgccggaacaaaaaggatacaaaggatatcaatatgcaacgtgcgcttctttgaatgatgaaatttgccacggttttccaacaactaaaccgttaaaagacggggatatcgtaaccattgatatg

SEQ ID NO: 1638 - DNA, 432 bp, Myxococcus xanthus
tgctctacggggggttggtttgagaacacgttggccaaccgccccaaggaatccagttgccacttaggggcctccatgacttacgtgtgggaaggtcccacggggctggtggggaggcacctaatcaagcgcaggcactggccgctgtgcatgtgcataacacaactcccatggcccggagccaacacgaatggcagctgtttgtggttatgcttccggtggcgataggccttcttgaccaaggcgctgacgaaggaacaggaccattccgagagggatggatcccatcgccatacagacatgatccttgttgtggaacatggccgatccgaatatccctcgctacacgatgtagtgcaacgcggactgctactggatcactgcatgcaggcgatagaggacgacagcagggtccacctgcaaatgcatgag

SEQ ID NO: 1639 - DNA, 595 bp, Myxococcus xanthus
aagtcaacagattttaacacaacaaattcgaaatcattactttttgattcagatggctcgattatctatttcatatcatcatattataggcaaaagctaggcttaaactttgccttctctattcttgaaccctttacttttttcaatttcttcattatacgaagaaattaaaaaagagctgtccattagacagcccctgcttatttccctttaaaactaggtcttctcttctcagcaaatgcttgaagcgcctctagacgatcttctgtcggaatcgataactcatatgcttttcgttcaatttgcaaaccagactgcaaatcggccttcattccttctttgatagcaaattttgcttgctgaagtgcaattggcccattttttaataaaagcgacataaaaatatctattgtttcttctatttgatatccaggagctaccttcgttactagaccacattattttgcttctcatgccgcgaggcgctgatctgttaaaattaactccattgcttttgcttcaccaactaggcgagggagacgcatgggttcctcctgcccctggtatacatcgctaagcttggttccgataaaac

SEQ ID NO: 1640 - DNA, 450 bp, Myxococcus xanthus
tgtgctctaaagagccgtgccatgagctcaggtcggaggagcagaaagctttcgtacgtgcatgtatccaatggaggcgctgtgtgcacaatacccgttacctgaataccatgtcggacggactggacgtgcagacgccgaatatccctgggcaccagaggtaagtgcttgccgtgtgctcccgcgagagcatcctcaattgccaccgtcacgggccccatgtggcaatcgggacggacgtcctttagacccagggggacacttgcgagctcatgtgccttgggtgccactccacggacgagctaccacctctccctcacctgggagggagtgacctccagggcctccatgctatggcccaggatggcactcgcgtcagaccgcatgtccccccgctgtagtgtggaggccacgattgcattcggctgatgagaggccggagaagactcc

SEQ ID NO: 1641 - DNA, 495 bp, Myxococcus xanthus
cgcgcaatctggcgtgcgctcggcagagcaccaacaccatgtgcctgccacggggtcattgtgtgcaggcggatacacatcattggactgggcagcctgggatggctctgctagatgcctgtccccgtggatatgcaaacggatgagcactggaagcaggacacactcagtacgtcccctgtgacggatgccggaatattgctcgaacacctcgtcgaggtgccgaatttgctcgagctgctcgaagggttgatcacccattaaccgctgtcctacgccctcttaagctaggacggccactgtatggtaaccaaccccgcctttctggctatgtacagttctgcacctccacccgattacaccctcttcgaggacgaactggtcacgcacatagactacgcgaatatgatacaccgggtcgtgtctggtgagagcgtacatacaccagagtgatggtgccacgtgaaggatttgtcacacgatcgagcgcccgca

SEQ ID NO: 1642 - DNA, 457 bp, Myxococcus xanthus
ctctaaggggagtacgctgaggtctagctcaggaattgaacctacctttacttttagaatgtgaaatccgtacgctgcacttttttgtgcgtcttcagccatttcttgaagtgtatcaacacttatggagatacacgtagagataggctgcttatcgtccagagagcatattaaggaaggttgagaaactctgtataagcatcatgcaaagcgatatcagcggccgctatagcacttgaatggtgaatacagcggctgtgaatattttttacgagttcttgaaactgacgtatattctcccctattagcgctagtttaatatgtccttgaggtgcagcttgaatgccttctaaagaatcgcctgtgataacatatgttggtgaagccgctccttttccttttattgcgttcggtaactgaatcgctacacttatgctgcctatctctgttgctgctg

SEQ ID NO: 1643 - DNA, 710 bp, Myxococcus xanthus
tcgactatctaaaacggttcgatttagcggtaatattcgttcggtcgtagaaggcgaaatgatttttgctaatgaaccgatgctgcaaattgacgctcctttagcagaagcgcagcttattgaaacgccgcttttaaatattttaaatttccatccgctgattgccacaaaagcatcgcgtattcgcttagccgcgggagaagataatttatatgaacatacgggtacaaatcagcttatggaatttggttcaagaagagcacatgagctggatgctgctttttacggggcaagagctgcttatattggaggctttgacgcaaccagtaatgtaagagcgggaaaagtgtttggaattcccgtgtccggcactcacgcccacgcgcttgttcaagtctatcgtgatgaatatagtgcgtttaaaaaatatgccgaatcacaccgtaactgtatctttttagtagatacatataatacgttaaaatcaggtattccaaatgctattaaagtagcaaaagaaatgggagaacaaattaattttatcggtattcgattagacagcggaagacttccatatctttctcaagaggcaagacaaatgcttgatgaagcgggctatcatgatgtgaaaattttcgcttcgaatgaccttgatgagtacagcattctagatttgaaagcccaaggtgcccaaaattgatgggatgggg

SEQ ID NO: 1644 - DNA, 442 bp, Myxococcus xanthus
cgagaggatcaataaatttttattggacgtaagataagagctcctccccttatcgacgacatgaacaggcgccacttcggggccacccaaaaagcgctggtggcagcgactcacgatgcacagaaaaaatatcagcaaataacagctgttctgcatacatagacctagacgaaaggcaagctgacgtgtacaaacgctgggctggactgtgtttacgcataaaaacattttcggggagatgaagggggaagaataaatgaaccaacagggatagatgtctgtgagtgcgctaaccctctaccgtgagcccatggtagggaacgaaaaaggagaggatgccgacgcatactccccccatgacccaggtatactgctatgccacacgagaggcggctctgatgcaaccagaccgaccacacggggacaacctgtaaaaggccgg

SEQ ID NO: 1645 - DNA, 196 bp, Myxococcus xanthus
gttaccaactggtcccaaaacctaccagcatgctcctctatgctcatggtggacacagcaagcgcccatcttatgtgctacaacgggaaactacgggagcacttcgcagcgaagccaaacgaagtcggatattggaacaggctccaccagctgatcgactcctggcacacgctgtccgaaaaagtatatggaaaca

SEQ ID NO: 1646 - DNA, 100 bp, Myxococcus xanthus
tggctggaggcgggattgccgcctccccatgccctgcgttggggaccggaacgccaccctgtggcaccggcggccaggctggcggggctgctggcctacc

SEQ ID NO: 1647 - DNA, 270 bp, Myxococcus xanthus
ccccttgcggggggggacaaatgaagggggccagcacgacccacagggacacaccccgtctgacgttgtccccgacacggagtacctcatactgggtgaagacggagaggacctgcgcctacagctcccactggagcagctggtggggctcgggaacctccaggggaatgaccatggacgccatgcgcacggccatcgacttcacgcggacggacaggattaaggtctccacgccccgagcgggctcccccaggagagcctgaaacggat

SEQ ID NO: 1648 - DNA, 160 bp, Myxococcus xanthus
tgctctaaagagggggagagctgaagtgcggactcctagcacgactgacacttcgcaaaggctagcatggcgatgaattacatcctaagcgccaccggacaagccctgatgacccacgtacgacaggaagtgaaccctccctacagggttgtgaccacgc

SEQ ID NO: 1649 - DNA, 164 bp, Myxococcus xanthus
attttttaaaggcgtgccgataactcaggagtcggggagcgatgggcggcgagggcatgtccgaacattctgcaagggcggcgccagggaaggaaacaccagggtctgacaccactcatgcacgggcgcggccgcggggacacccgtctggagtatcccccgcc

SEQ ID NO: 1650 - DNA, 235 bp, Myxococcus xanthus
ccttccgggagctcgggcgcctccggagcccgcgcggaactgctccccgctctctgctgtcctcaaaaaccgagggcgcccgctatccggatggatgctcgcgggtcgagctacctgaccagtcgccgctcccggggcgagagagtttccgggccagctgcgggcagccgcgagtaacctgcacggtgggagcagtggctgcggtttcacggacgggcgcgtcccgcgtctggac

SEQ ID NO: 1651 - DNA, 582 bp, Myxococcus xanthus
cactccaagtgccgtttatggcagatgtggtcacgatggtggatccgaatagtccatacacgttcttaggagatctgcatgagcatgagcgcttgtatcagttttatttctttgaaaagtttcatattccgagaaatgaatacaatcactattgccgctgggtagcgagccagctgagtgggcttgaatttaacagcacagtaaaagaagtaaaaatgcatgaagacgctaagccttactacgaagtaacagttgaaaaagaaggaaagctttatacctattacagctatcatcttgttactggagtaggtacgcagcccgtagtgccaagagactttcaaacagtggcaagcgatacgttttatcactccgctcattacaaaatgaagcgtcagcaaacgctgcaggctaaaagcataaccgtaattggctctggtcaaagtgcagctgaaattgtctatgatttacttcaacagcagcctgagtttgagtataagctgaattggtatacgcgctcaaaaggtttttatccaatggaatattcaaagcttggccttgaacatttttcaccggattataccc

SEQ ID NO: 1652 - DNA, 90 bp, Myxococcus xanthus
ttccccttaaaggggtcaagggggggttcacacttccgaaagcggtttttcaaggccgggaacttctttttccgggcgcgaaatttttct

SEQ ID NO: 1653 - DNA, 214 bp, Myxococcus xanthus
gtgttcgcctacgacaaccggaccagtcttcctggatcatggcgcgagttacacaacgactcccgctatggagtccaggcgtgtgggcgctgctctgcaattccgcacctacgccaacatattgggcacactgctgatgacccatgctgggacgggcggggcatatgcactgatagactcagaggggctggtacactcatgggcacgacctgct

SEQ ID NO: 1654 - DNA, 132 bp, Myxococcus xanthus
agcccgacgaatgtttggcgctccagatgtcgtagcatgcaatggaccacaccgtgcttgacgcggggctgcccacgcttatggcgaaggcccaatcggaccgtgctgtcaaggctgccacaaccctcctct

SEQ ID NO: 1655 - DNA, 682 bp, Myxococcus xanthus
gcacttctcgctgcactgccaaaagcaccgaattcctattctcctattttacatccagaaaaaagtatagaacgtagaaatgttgtgttaaacgccatgcaaaaagcaggttatttatcagctgaaaaaaatgtccgtttgcaaggaagaacgctggggttgaacataaaggagcaggctaaaaatccagcgtatttaacctatatcgatatggttatccaagaagcagagaagaaatacagcatttcgggcaatgagcttctgcgcggaggttatacggtcaaagtaccgatgaatataaaagtacaagaagccgcctacgagctgatgaaagaaaatcgttattttccaggtacagataacagtgcccaaggtgcttttgtattagtcgataacaaaagcggaggagttttatctgttatgggaggacgagattatgtacaaaaatcgctcaaccgcgtaaatgtcaaaagacagccaggttctacgatgaaacctattgcggtatatggccctgcgttagaagaaggtcaattcaagccttattcgttgctgcaagacaagcttagaagctacgggggatacacacctaaaaacgtagacggccaatatgctaaaaaggtaacgatgtacgatgccttaaaagattctaaaaacgcagctgccgtctggacattgaatc

SEQ ID NO: 1656 - DNA, 283 bp, Myxococcus xanthus
gggtatccgccccgatatgattctggggacacagtgtgggagagtacgtcgccgcctgcctcgcgggcgtgttctccctcgaggatgcgctggccgccgtcgcagaccggggccggttcgtccagcagctgcctccaggctcgatgctcagcgttccctccccgcgacaccttgagccgctgtggcggcggctgcttggcgcataacgccctcgtggcgtggggccgtcctcgcaaaggtcaacggtggacagaccctgagacggggcaccaccttgcacgtg

SEQ ID NO: 1657 - DNA, 214 bp, Myxococcus xanthus
tgccccgggccacgaatatctgcggctgcaacggcttgtagccgagccccttctgctcttcgagcagggctgacgtcaccgcgaggccgtcggtgaaccggtgtgacacgaggtgggcccggacctgcgccagcttgtgccgcgccgcatgcacgcgggagcggaggttgtcgggcggctgggggcggctggtgagtcctggggtatcgcggca

SEQ ID NO: 1658 - DNA, 590 bp, Myxococcus xanthus
taaagcggtgttattgacgatcaaatttggagtaatgcgcgctttaaagtagcgttaaaagtccaagatgccgctgatagtaaagaaatcttaaaaaatgcagacgctgcttctattacggtgacgggtcgaggctatctgcaggttggaaataatgaagtgtatgaactgtttcagtcagcttggagcggcgcgccgtacatggaagatacgtatggggctgaagatgaagtagccattatcacagatctcgggttgattcctttatctgatgtatctactcagcagacgtcatccaaacaagcggaagcagaaattgatgttgtggtgcaaaaaatcgaacaaacgcagcaggaattaagtatcaaaaaattaaatagtccatggctgccgcctcttaaagagagattgcttcgcagtgagtacaaagagaagcgagacggcgtattcccaattggcttaattgatgaacctgaaaagcaaagtcaaacggtatataactatcagctgatggacgatggaaacattggtatatttgggtcgtcaggatacggtaaatcgtttacaggcatgatgttgcttcttagtct

SEQ ID NO: 1659 - DNA, 123 bp, Myxococcus xanthus
gaccggcaaacgcgtgaaggcctccaccggaaagccttccccgactcggtccgggaacttccccaataaggtttagaccaccgaggaccacgaccagtgggcgtgcgtgttgctcaaaatgaa

SEQ ID NO: 1660 - DNA, 709 bp, Myxococcus xanthus
cgccgcgtccccccgaaacgcgtggatgccccggaaggcggagaacagcgtctcctggaggacctccatggcgtcctcctcggagccgcacatgcgcaggccaaatcggtacacctgcttctcatggcgggcgaggacctcgtccagggccttgtcgtcgccagcgcgcgcggcctccatcaactgctcatcggttcgcgtcgacatccgcccttcgcctcctcatcggaagaacgcccagtcaccaggatgccttcctggatggcgccaggaggttacatcgcgcaagacctagcgccggtgctgaagcgacaggccgagatgccccccggacgcggcgtgcccgggaggccgccagctcccgcccagcgtggctcgaagcgcctgccgacggagataccaactgagcccggcatccagccgcgccccgcccggggcgtccgccagggcgccgcccgtgactcgcgccaccagcgcccacggctcgagcaccgtggcccccggccccggcaggttgaggcccgcgcggacgtgagcgagcagcgcgtgtccctggggggatgctacctggtggagctcggccgagagcaccagcgggcgcaggcgcaggagcgcgtccacgccccaggagcgtgcgtcgcccccgggctccgtgctcccttgcagggccagggtgaggcccggcccgaagccgaagtcattcatgggc

SEQ ID NO: 1661 - DNA, 73 bp, Myxococcus xanthus
agtgctctaaagcacacaccctggccccgagcggaccagcgaggctcctcaccaacaaaaggaactgcgtgca

SEQ ID NO: 1662 - DNA, 444 bp, Myxococcus xanthus
  unsure (1)..(444): unsure at all n locations
gctgtaaagaggcgggggcaacacggcggggccagctcgctgaggccagtgatgctggccgctcctccagccgaggacggacatggctagtcagctctgctggcatctgggcacattgggtgacacgggcgccctggtcatctggacacgttggccnggagaccatacgctggaagagcctcaggagccgatcgtggtgtcccacgctatccatgacctgcgccagctcatcgctaaggtgccggacggagaagagcgcctgcccgttcaggagaaggaggtggtcgaccaggtggaaggcgccacactagtgttgcaatacgccggagtgaaaggtctgcgccccatccagggggagcgcccccgggacaacatcgagggggtgctcagcaataccagcacggtgctgctggagcagctaaccgctgactacgagctggggaa

SEQ ID NO: 1663 - DNA, 273 bp, Myxococcus xanthus
ctctacagcggagtggtggtacggcaggctgcgccggcaggcataccagagggtccgcgagccagagagcagctcgctccacgccgcgtccaccaggtctgtcacgggcgcttctggcacgggctggacctgccagcggcgcgtgaggtccagcagggcatgcgcgggcagtcgccgcgccacctgtcccaccgccgcggcccgcagcttgagcggtgcggcgcgcagcacctcgcggaggccctccagccgctgcgccatgccatggcgcgc

SEQ ID NO: 1664 - DNA, 677 bp, Myxococcus xanthus
gttctctaaagcgcgagtccgacctcgacttcgtgtcccgcctcttggaggaagaaggcatcttctactttttcgagcacggcgaggacgcccacatgatggtgattggcgacggcgcctccgccaatcccgagatgcagggcgagtccaagcttgtcttccgcgagcgcagccagatggtcgcctcgcaggagtacgtccacgagctggtctcccgcatggaggtgcagcccggcgcggtggccctgcgcgactacaacttcctgcgtcccgcccaggacctgggtgccagctccgaggcagaggacggcgaggccgcgctcgaaatctacgactaccccggccgctatgaagagcccgcgcccggccgcagcctggcgaaggtgcgcctggaggagctgcgcgcgcgggcggagacggtgacgggcgccagctacagccgccgcatctgcgtgggccactccttcgaactggcggagcacccggacgagtccgccaaccgcaagtacctgcccgtctccgtgcggcacctgggccaccagtcggaggcgctgagcatcgagcagggctcgctgcgcagccgggaggactaccgcaacgaattcctctgccagcccgcggaggtgcccttccgcccgccgcgcgtgacgccgcggccggtgattccgggcgcgcag

SEQ ID NO: 1665 - DNA, 245 bp, Myxococcus xanthus
aagtcggcccccggcccggcaagcctcctaatttccttgttatttaaaggggttgggaagggcttgccgtttaaattccccgggcattgcggaaccccttcttcccaatcttgttgtttttggtgcccttaccaacggggggggggggggggttaaccctttttaacacaaccccgaagggcaaaggccccaattttcgggggaacgccaagcccaattttattaaagcccaccccggggggggg

SEQ ID NO: 1666 - DNA, 539 bp, Myxococcus xanthus
ggttggcgtgtgcgctcagccacgacggcggatgcgccagggcgacaactccccagcgggcggcaccatcgcctggggcccgatggagtgcttgcgggggaactgattgtagacaaacttgttgaagggcacgcataataagagctcccgggcctgtgaggccttcggatgctgctacgagagaatctgctgcacattctccggaggccgctgctggaaggcgggttggccatgcacgcgcgcttgaaggaaggtcagagcctgcatcgtacaccccggtagcgcgctcgtgctaaaaccgtcagagatactattctgccgcgcgtacggcgataaaatgtttcggcaggaatgtgtcccgtgatctgatccgcacgcacggatgcagatcactgatggcagagtgctgagtgctgacacaagagtacagcacccccacacgcatcgtggcgagaaactgatcgcctgacggactgaagcatcttgcggctgaagagagacgcggagtccggacgacatgacggcctctgacggccttc

SEQ ID NO: 1667 - DNA, 263 bp, Myxococcus xanthus
acaacctgttatttggggggaagacttaccgcttggggtatttaacaacgccggacccaatggaaaagggggccgcttactttgcccgaaattggaaggaaaagggttaccccaccgggggggaaggggaattccagaacaagggcttgtgttcgggcttttcaacccccaaggggttccaccccgggtttttgtttgcaaagaccctgggaaaaaaggggggtttaacccccttggggaactttgggggggttccccccaaa

SEQ ID NO: 1668 - DNA, 474 bp, Myxococcus xanthus
ctctacagagcactgacaccaacgatgacgggcgcggctggggcattgacatggtgcgctcgtgtgagaccaggatgtacggacatccacacagtgaccacgcttgtcatggtgccagtgacactggaggagagaagcacaatcggatttctgacctgctagataatagatatatggctttgcactggctgtaccaccgcaccactgttccgtgcctttcgagacatgttctgcgaccaatggtccattgactacctcatctctatccagaggatacactggttgggcagcgtcctgatcgctccacgcggacagatgtcgattatatccagacacaactggcccaccatgagggtgaaggctccatacttctctgcgaacttctcctgtgcaccagagcacatccttgctatgtacttatggacggaccgtgaggatggcgacctactgtgggtatgggaccaccttcccaag

SEQ ID NO: 1669 - DNA, 478 bp, Myxococcus xanthus
tgtgctctacaggcatttctagcactttacgttaaattgatttttattccaccagaagaagctgatggccttaaccttgcttctttcgtttgtttcgaagaacttttatatttttccatcaattcatgaatgctgcctacttgtataatgcggatgtggtcagaagacaccccataccgaacaggcgtaatcaagatgacggaagggaagaggggtgatcggtcctctcgctgccaatgcacagccttccactcatctgaaaagaaaaactcctcataaaggtttatcttcgcttgcattttctgttcggaatactgatttctctgaatttcaatccaaaagggagatcccttaaaaatacaaaacagatccggttcaacccctccttttcgcccggtgggcttatcttcaacaatgacctgtttaggtgtgctatacgtatacatttgtttatagacatctaaaatagaaaggaaat

SEQ ID NO: 1670 - DNA, 66 bp, Myxococcus xanthus
atggaacgcggtttccgttccatgcgcagggaaagacctgccttccatgcattgacctgatcgtcc

SEQ ID NO: 1671 - DNA, 269 bp, Myxococcus xanthus
ctctacttatgaacacctcgctgctttttaaggacgggatgcccaggaccagtttcttcattctgtccactttctttttcaaactttatcaaaccttgattggatcgtatttcggctaattcttcttgagaaactcttttattttcttccggctgattagtaaatactttaatccaaatcgtaatccatacaagaccaatacacccaaggataataaacatcgttttccaatctgtaaaagacagcagggctactgcaattggagcagt

SEQ ID NO: 1672 - DNA, 713 bp, Myxococcus xanthus
aatgaccttcatttcataaattgtattaacaatatcgcagcttccccgatcaaaagatagctgaatcatttggttttgttccacgttctgcaacgcttcttttgcagaaggagtgacgcgtatattcataatgatatcctcctttttctatcctcaaattaaattgtgtgaaatgtatttaggaatactttagttgatttttatgtcacgggcaagaaaaaagctttcttactattagtatttccctttcaaaacggaataaaacgctgatgtttttatcatgttttcataaagacgtacatagatatcacctgtatgtgatgaaaggaaagaggaaaaaactgcgctttgtaattcttaggtgtaaatacttaattataggaatatattgtaaaaatacaagaagataagtcatttacctattttgatagttattgagatagctttgaataattggttttattttcaatatattgggtacttaagtagagtactttgcacacgatattgcaccgaaagacatcggtttatcggactaattattgtcttattttgccgaagtagtagaatttatggaaaccattccttatcatgtacaaagtgactaacaaaatacataggaagctctggtgtagatgagtgagaaagatcaaaacagaacaacagacgaaacagcggcttcgctagaaacagcggccgctcccaaaaaagcg

SEQ ID NO: 1673 - DNA, 614 bp, Myxococcus xanthus
  unsure (1)..(614): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1674 - DNA, 557 bp, Myxococcus xanthus
gatgagcgctgttgcgcgggccttgtcttgactgcagatgtcgacgacactctaagccgagcaggcgcggccgggcgacttgcacaacgataagggccggagctgggtgcagcgcagagctgcagcgcatcttcggcgcgcggctgctcgaacacttgctcaccctggcggtcaatctgtgcgcacatggtgtgaccgcagttggcttcgtcatgcaccacctggacctgcgcctggccaagatgctgagcggcgaagcgacgggacgttgagcaggcccgagtgtaagcaatggtgcgacagtggttaatccacccagcgcggagagccctacatgtccttcaagctgccggacacggtcatcacgggcaacttgggcgtgcccttcatctcgctcaggccccggacccacatcagcgcgtgcccttacggaaggcgaatgtccaccatcatcgcgacctgcaagggcgcgtgcgatgcgtacgcgctctattagggtggacgctggcaccacgcgggagccttcgtgcgctaggagccatcccagcaacgaccat

SEQ ID NO: 1675 - DNA, 659 bp, Myxococcus xanthus
tgacgacgctgatcatataataagagccatctcgctgactttcacttgcaagccacgtgctaaaagcaacgcatgtgatcacatagatacacatatacagcagcacaccgtaagactctgctccatacagccatttaaatagagcaaagctgatgagagcttgaagcacgtatagcacagcataagcggcgctgacgcttcgaatataaccataaagtcctttttgcatcgtcttcattcgtttaaaaagatgactccgctctttaatcatccaatctgatgtgatgcagcaaagtaaaagcgtaaaaaatccccatagcggcacgtatccggtcatttgaacgctcccttgcttcttatgcttcttcgttccttgcgcctcgtaatcaattgtcatcagcggctttggtttccactggttatcggtatagtgatacgcttctttccataaatccggtcctgcatgaatgtgatagactttatataaaaaaagcacttcatttgcggctttaacatttgtcgttaaccgtgtcacttcactggccacgacttctcgaaccgcttctgtcgcaacggaagaagggcacgtaagcaaatcaatgactccttgataattgcccgcttctacttcttgcttgaaatccgtaggaaacacaaaa

SEQ ID NO: 1676 - DNA, 709 bp, Myxococcus xanthus
atgatctcacattcgtcgaagatatttggctcctccaaatacattttgcttggagtcatactgatcttctacaccaagagctttagcggttgctggcattagctgcataagcccagccgctccgacagaacttttggcagagggattaaaatttgactcttgtttaataacagaacgaataagtttaggatccagctggtagcgtgcagctgcttcattaattatcgtttgtacatcatgagaactggcctttgccatttcgtttttttgtgcaggtaaggcagcagttgaagcggctgccttatctgaagaagaaacagatggctgggattgcgtttgaaccgctgtagctggaaacatctgcgctgcctgcaagtaaagattggtactcatttgaggctcttgattgacgtagtcttgaaaaagctgagcaaatacagagagtaaagttgtaccaagcatcacgttagctgttggcagctggttgttaactgaaaatggctgagttccaggaaattgaacggaagacatgtaatggttaatattcatgctcatgaatttactctccatccatcaacgtatactttcgcttgtaaaaccgtcgaattttgttttccgttggtttctttttaatatcaagctccgtaagcaattgctcaaaatattttgccccttcattggcatcggttacttcgtattcgagttcata

SEQ ID NO: 1677 - DNA, 668 bp, Myxococcus xanthus
  unsure (1)..(668): unsure at all n locations
gtgctctcaagaacactccggatgaacaataatattcatctcaggctgcttctcgcgtaaataatcaatatttttaaccgtgaaattttcgtgcacagaacagtgacctttccatagaatcaccttgatgttgtttatatcgccttcatattcgagcatttcttcaataggattccaaatggccatttcatctagtccaacacctaaatcataagctgtgtttctgcccaaatgctgatctggtaaaaagagaatgcgctcttttttagaaaatgcccactccaccatattttttgcatttgaagatgttactgttgcaccatcatgttcgcctacaaaagatttaattgcagctgtagaatttacatacgtaagcggaataatcgtatctccgaaaagatcctgcaagacaggccatgccttttctgtttgctgaatagtagccatatcagccattgaacagccagctcgcatatcgggtaaaatgactttttggttttcatctgttaaaatatcagctgtttctgccatgaagtgaacgccgcaaaacacaatatgctcagcttctctattttcagccgctatttgagccagctgttaggagtctcctaccgcatctgcaaactcgtacacttcgtcttttntgaattatgggggcccgagcaaga

SEQ ID NO: 1678 - DNA, 750 bp, Myxococcus xanthus
ttcatcctttatgaaatctaatgccgacgaaacagtggtaatagccaatccagaatctgttacggctttagttaataaaaagcatcagcttcctgaatcttaccagccttccgatttagtctatgccgacgttccgtttatctttaacgaaaaaatagaaaaacgaatgcttagaaagcctgcggcacaagcgcttgaagaactttttcgagacgcggaaaaagaggggatcagcttacttggtgtatctggttatcgatctcacgagcggcaaaaagagctttttgcattttacgcaaagcgagacggtgaagaacaagcacgcacttatagcgcctacccaggaacgagtgaacacgaaacgggactagcaatcgatgtcacaggaggaaagggaatatgtgctgcggcagactgctttgctgatacactagaagctcattggctttcaaaacatgcgtatcaatacggattcgttattcgatatcctcaagatgaagaagaagttaccggttataaatacgaaccatggcaccttagatatgtaggaaaaaaagcagccgcatccatttttaatcaatatataacgttagaaacctatgcaagtaagacaaaagcttaatcaaaagttctatagttggaaaacgaaggaaagaaaaatgaccagtcaggtttatcactctcacatatgatacaaactgatactataacatgcttgctatagaggaagggtatcgatgtataaagata

SEQ ID NO: 1679 - DNA, 125 bp, Myxococcus xanthus
cgggagcacgggggctccatgcgcacgcatgccgtgcgcactgtacattacgcgcgattcgagacgctccctgttctcatagatgcgcgccattgcctgaaggacttgaccatgcggaggtcctg

SEQ ID NO: 1680 - DNA, 720 bp, Myxococcus xanthus
cttgtgccgaaccaacatctgcagatccaaaacacaagccagctaagagacttccttccagcatatcttgacgagccgcttcatttttaccatcgcggaaaacgataggcaatgccgaaacaatcgttctcattgcttgagccccaagcgcttgtgaaataggatttgttactttacacgtataaccttcaatcgcatgaacgagggcatcaatgccagtcgcagccgtaacagaaggcggaagacttaatgttagttcagcatcaagaatcgccaagacaggtcttaatgtactatgtttgagcgtcattttccgatgtgtagatgcctcggtaataacggcagaacgagtaacctctgagcccgtacctgaagtagttggaatacaaataactggtgcgatgtttgaatacaggagtcggccgtctgcatagtcagatggttctccgccgtttgggccgcacagcgcaatagcttttcccgtgtccatcgcactcccgccaccaatggccacaactgcctccgcactaaagtcacgaaataacttagcaccttccaagcagttcgtatctcgagggttttgttcaattgaatcaaataccagcactcggtaaccagaagcctccaaggcagttacaatgggtgaaactaatcccgcacgaaccacaccagggtcactcacgactaaaatgatgaaccatatttaagatgtagcatttc

SEQ ID NO: 1681 - DNA, 388 bp, Myxococcus xanthus
acatgcgaccgcgtcgatgacgtggcccgaattggtgtttgttcacaccgactggttcacccgggacttacaccccgctgagccggggcgcccgacaaacgttcgccgtaccgatgcagcagcacgagggcaggccgtacttaccacttggaccacacgggacttgctttttgttggccatgaaccccggaagaggggtcgccgtaccggtgtcgcaatctggtcgcgccgcttaaatgaacttaacgaccgagcccccccggggggcgcccccttcgcgacgtggtggccgagggccttgcgagcgcccagccaggcaagaccagcgaccacaggaccgaacgggtcgcgtaaaaatgcatgcgccccggggcaccttctgagtgca

SEQ ID NO: 1682 - DNA, 463 bp, Myxococcus xanthus
gctctacagctccacgcgcaggcgaggctgctcggcggggagggcgggcttttcggctgcgggggggacggtggggggcttcttctcctcggggcgcttgcggaagaacagcttccgggcggccagcaccatcagcaggacgaagagggcggcggcgccaatgcccacgacgtcgcccgcggggaagctgtccgaggggggcgtgccggtgcccggctgtgtggaacccccgcccggggtaggagcgggagagggggcgggcggcacctgagcggtcagggcgtcgagggcgttgggcgtcttcatgtgcgcgggttcgcatacaccaacgcgccggtggatgcagcgcccgtggccgggtagaacccggtcgtgatgcgtctcaagccctcttgtgtcctgctcccgtcgctcctgctgctcggcagcgcctgcatcgtggaggcgcccggcggcgcgagcg

SEQ ID NO: 1683 - DNA, 291 bp, Myxococcus xanthus
tgaattccgggtggagtagtccagtatgccttaggccgggtcctctatgatttcctctccccgtttttcgttgttggtctcctctcgggcgatgggattctgcccgtcggatgactcatgacaagccactgctatatagcttactccgcaatgaccgactaccacacatgctccggcatgcccagacataccattctgatgcgtaaattacggatcctgtacgcaatccgcggatcataacaacactccttcatttcaaccatctgccagttttatagaatctcccccatt

SEQ ID NO: 1684 - DNA, 430 bp, Myxococcus xanthus
gtgcgtgatgaccacttcgtatattccatcgtgcaggtttttttgtgttaagcgccggaggctgatcggaaactcttgagttattacgccgtccgtaaggatgctcatttgctaccgatctaactatgcgcaatattgaccgaactaaactgctttcaccctctcaccgaatgcgccctgccggtgaagtggctcttataacggcataaggaacgccaaagacttcattggtgaagatgactcacggagcctattattgaattgcccagccgatccagcgcctcgccctgtgcaaagacatgcagacagtccttcagacttgagcggtactggcagacaaacagtcgtttactgctatagtcgtggagatcatcacatgtgggggcggcttcatggaggcacctgcctcagccttacgctctgtgatgaa

SEQ ID NO: 1685 - DNA, 486 bp, Myxococcus xanthus
ttgctttcagcggcgggcccacgccgccaaatgccacgtagctcaatggcaccgttacgacaacgcgctgggcgccttgaggtgcgctaccaggagctgcggacccggctaggcctcaaaatagtgacgaaccacctctggtcgggcgaaggtctcttaattggcaccggctgaaacaaatagctcatgtcagctgccgcgcaccgcttgctggtaaacaacttgaccgcggataccatcctccagttggccgggaattaatcggaaacggaatgatgcggcgcccggctgatgggggctgtactttttccggcgctgggcgttaacattgatcctcaacgccagttagaagtcgtaccggtacctctgatgcatgccggactggcccagcaggtactacaacagaggaccgggactctcgtgatggatgcgcacgccgttcaaggggtcatggagagcgccgacctgccacgtgaggcattgcaa

SEQ ID NO: 1686 - DNA, 886 bp, Myxococcus xanthus
gggtgacattattcgagtcgttaatatttcaaaagatattacggaacagaaccagtctttacaaaatgaaaaaaaaattgctccatttgaacatcttcctcagggtcagatggaaaggttgaataacaaaaaggtaaagcagatgtacattttgagcgaaaacgaagaaatgaaaacagcggtttctagagctgagagagcagctttagtagaatctagtgtgttaatccatggagaaagtggagttggtaaagaaaccatggcatatttcattcacgagcgtagtccacggaacaaagggccgtttgtaacagttcgttgtggtgcaattttattatctaatatagaaaaggagatttttgggcaaggggaggaaataggagcaattgaaaaagcgggcggcggtacggtttttttagatgaaattgatttattgcctttgccactacagctgaagttatcttacctcgtagaacagcaactaacatcctcatatactagtgctcggtttattacggggacttcaactaatttaacggaaagtataaaaataggggaatttagaaaagagctgtattatcagctaagtattatccctattcaaatacctccgcttcgaaacagaaaagaagatattattccattgacgttacattttttagagaaaattaatttcttgtatgaaagtaagaaaaagctacatcctaggctgttgaaaaaactacaaaactactacagctggccaggaaatgttcgagagcttaaagcgttagtagagcgattatttgtattaacagaaggagagtggattcaagaagaacagttaatgagtgacatactagtaagtgcaaaaaatgaaaagaaaattgaaattcatgagctaatg

SEQ ID NO: 1687 - DNA, 143 bp, Myxococcus xanthus
accggagcatttttgcacgggagcggcgtcgagcgggccaaggcgggggggcaccccccgcacctcacccaccgcacgcaccacccgcccaacaagcctccccgccaggacaaccccccacacatctcgcccctctgcccccc

SEQ ID NO: 1688 - DNA, 288 bp, Myxococcus xanthus
ctctaaaggagaaggagggcgcggtgaccctcaacgccgacctgatagcatgggtggtgggcctctgccgggtgccattggacacttggcgcggcgatctccgaaaatctgactccgacggatgggtgtgtgtgctgccaccgtatgagcaccctgagccagctggatcatcctccctgccgggacagaccgacgtgctgctcccatgcttcgattgcatccgcgctggctgaggagaggcagacttccgctgagcgggctgccatgcggaccttcctgcacccccgg

SEQ ID NO: 1689 - DNA, 318 bp, Myxococcus xanthus
gggtgaaggacacggcgttcctcaactagcaagcatacatgcaaccggaaagtgcgagagaggtggactccacggccaaagggacctctggagacaccgtgacgggaagggacgacgggatgatggactaccgtacgatgccccacaacatgaccatcaccgcggatgggggaaggaacctgaacgccaccggacatggaccaagatgcgtatgccaccgacgaacgcgatgcgcggcaccaggaggagctcaatttgagagctggcctgccggggagcgcccgtgaaactgctcaatcagtagcccgacgctgagcg

SEQ ID NO: 1690 - DNA, 739 bp, Myxococcus xanthus
acggggttttttgataatgtgttagctaataccatcggcgtgccgttaaaaggagagggtaacaagctttaagcgctgtttattcgccctgatattcagctgcagttcggggaaatgcgcatttttttctcggtcattttactgctgatgattgtattaagcattttgtttgtacttattagcacgcgttatttagtaaaaccaatcgtcaagctaacggaagcaacaaagcaagtggcgaaaggaaaatacaacgttgagctgtacgtaaagcgccgagacgaaatcggcgcgcttgcttcacatttttccgaaatggctaaaagtttagagcagcttgaagagatgcgccaggaatttgtatcgaacgtgtcacatgaaattcagtctccgctggcgtccattcaagggttttcgaaaacgctccgttctgctgacctttcagatgaacaaagaaatgagtatctgtctattattgaagaagaaagccggcgcatgtcgtccctcagcaaacagctgcttacgcttgcttcacttgataaagaaagtgagcatatcgaaaaaagcacgtttgacgttgcaactcaaatcaagcaagtgctgttcatgacggagtggagctggcgtgaaaaagaattggccattgaaatggatcttccttcaacgatgatttcaggcgatcaaaaactgcttcatcaagtgtggacaaaatttgattactaacagcgtaaagttcacg

SEQ ID NO: 1691 - DNA, 827 bp, Myxococcus xanthus
atacatacggagcatcttcttccggggtaatttctcctagcttttctacatcgcttaaagattgaattggattagaaatgacaggaccaattcctgacttgatttcaacatccactccaattgaaggaagcggtgacattatatctttatataaaatagctgcatccactccgtactgttcaacgggcaggcgtgttacgtatgccccaagctccggctgatgagtgatttcaaatagagagtacttctcttttagctttcggtattccggctgtgaacgccctgcttggcgcatataccaaaccggaacatgatccgttttttcccctctacaggcttttaaaaaagtatcgttaaacgttccttgactcataatttccacctttctcgattgtcttccatccgtattttcttcgattagacagacaataatcagcaaaggaacataccggttcctctactgattaaagtttcacgttatattctctacttgtcactatacccatttctttacgacttgtatagccacctgctaaaaatgtcaaaaaatcgccctactcttcctttttttattgaaaaagagcaggtgttacttcgttggatttttttcctttttgttgtgtttgggaattgtaaggaactacataataagtaggactgtcgagcagattcacacgctctttttcaaatgctccttttcccttcactttgccaatcaattcggctatatccccttttttctcataaacataataaacagctcttttatcaggtgaaagtgtccacgataaacttaccgttatcaaaccaaatggatggaatgttaa

SEQ ID NO: 1692 - DNA, 209 bp, Myxococcus xanthus
atgcctccagtgaagtgatctttccggggcgaaggggccttctgccggtgatcttttttcccttcctggacgcgggggactcgaactatgacgtgtacttttatcctgaacgcgttcggttcgatcctgacgatctccgtcccctcagggagctcgccgcgcaggccctggtcttggagcgtgacatccttcgacaggacctgatcagc

SEQ ID NO: 1693 - DNA, 663 bp, Myxococcus xanthus
atgccgtattccgccggtatttctactgtacaagggaaaggtcacacgcgcgaatgaacgtacattatgttttctttttaagaaacgtgacgtaatttccctggaaacttcacgtttcgctaggaaatatgcgaagtatacgtgtatttgtagagattttacgtacgaaaggtcccctattccaatttctactaatctataattatttctatatctattatcgatgtagcaactctaccatcacggaagagcagtgatggtagagttgctagacctatccggatgagtccctgtcttgcgggctggcctcaaccggataggtggacctttgagggtagattcacaggagctactaattttaagttcttctttatgaaagcaagtcgctgaggttgaaagaagaacttgtaaaggggagattgaatgaaggcgatggttggggtaaatgtggcggcggctgttttgtgcggggcagttatatatggagggacgcatcactggcaggagagagcggaggcgcaggttcaagcaagtgaaacgaaagcgaatgttgtacataaagaaaaacagttttctgatgtgtctgcttatacaagaaatcttccaaactttattacaaggcaaattgagtcggcgattgcaactaaaaaacctttgactctt

SEQ ID NO: 1694 - DNA, 679 bp, Myxococcus xanthus
gtaagccatacaggcgtcataacagaaccaacaatcgtcgcaccgtgtagccccgtactccacataagagtaattaagataaaaatcagaatcgtaccgactaagcttgtaccaatatgagttaaaggctgctgcagtaaaaccgtcacgacattatgtaaattcccgaagtctccgacgttttctacaagcaaacgtagcatccatataaccattacagcgccaaaccctggtattaaagctgaaaatgaacgggcgacagctggcggaacagtttctggaagcttaatcacaatatttttttgaataatcttccggtaaacttctgtggcgataaccgctatgaccatccccacaaaaagacctttactcgtgaacatcgccgtttgataagctgtttcgaccatagccgttccatctgcgttttctccaatcgtatacgaaacaaaaggtgtaccgacaaagaaagcagctaaagacactgcacctgaagcaagtgcatccactttatacgattctgctaagcgataggcaatcccgaacgtagctactaaagccataatttccaacgttcctctgtacggatataaaatgcttgcttttagcttaggatgttctgttaaaaaatctgtgtaggcttgaaaaggtaaattggctaaaattaagaaaagtgaaccga

SEQ ID NO: 1695 - DNA, 810 bp, Myxococcus xanthus
tgtaatacttcttctgtatcttcttgttttcgttgctctacaaactgctgaaatgcttcttctgaatgtacaacttccgtcattagctgaaggttcggaaagccataggacgcatactgatcagcaattaactgactgtactttttacgtaaagccgttccttctgcatcatgtcgtgcgttcacaatcaatttggcaccgttcaatctcggcatttgatcttgtaaaagcgactgtaaaagcggggatattccctgcatttctccaatacaatgcttccaatatgactgtacatgctcttccgtacattctttattaacggtttgaatagaaaaagaaacactcgcaatatgagaaaaagctgaagacatgcgagcatggaataactcatagatctcaaaaggtaataacccttctaaagaaaaatgaaaatgccattttttttgttctttctgaatgacgagcttttcaatcgctgcgttttcaaaataaggaacaatttgatcactcgtcagctctaactgctgcagcagcaacttaaaacgctctttttttcctagcgtttgtgcttccaagttttctgcctccttttataaatgagtgcaatctattttaacataaatgacttctattctgtcatatgttctgtttataaacataaaaacagcagggatacaaatccccgctgcttcattacttcgctagcagttctttcactgttgaaacaagattgtcaactgacacttctagtgactccccagtttccgtacttttactttacaattcttcagagcacgttaccactgtact

SEQ ID NO: 1696 - DNA, 772 bp, Myxococcus xanthus
gcgtgctccaagatgttttaataggtcattttgctaatcccgaaatgaataaatccattatattggtgggactagattatattgtagctggttttgctcttacatatatcgcggttaaaacaaaaagcttagaaattaccattggcgcacacgcagccaacaacatgtttctcgctctgttccttacaacggacgattctgttttcgggtctataccgagtttgtttaaggtagctaacactgagccaggagctaaccttatttggtcgattgttatgttcagtgttttctatatcttatgtagagggaagataaaaaaggaagaagcagctgacaaagatcagcttattgcttaaattggcagaaccaatacctaaacaggataggagatgtaacagagtgagtggaaatcacgatgaaaataaaccattgactcgtgcagaaatgaagcggggccacttagctactcaacatcgtattttaaatgtgcttatcgttcttgcatcgattgctgcagtatatctagtaataaaaaccatactttaaaagagcagccttaaaggctgctctttttattttgtaaaaacacgcgcacgcaactaccaattgaaaaaagcttttaacgaaatcattgtagccgcgtagacaagagatgagattaaaaaggttggcaaatgcgcatgtttttcaaaagggagctctttactgatgacgttaaataacattgcacctgaactaaaagcaatcatcgactcaataagcaagcctgatg

SEQ ID NO: 1697 - DNA, 318 bp, Myxococcus xanthus
gcgcgggtttaacgttgggggggccaacgagccctccgccccggagacggaggagatcctccgggagacactgggtcggtaccaggagcaccggagtgtgcgctacacggccgacgagctggacgagcgcacatgcctgaccagacaggttccagacggaccggttgaagccggacaatgccctccacgtgggggacctggaggacaatcattaccaccgtgaggaccgccacgaggcggagcccgccgacggagagcgcgaggtgggcaatgtgcatggcgaacaccaggagcagctgcttgagaaccactggcagc

SEQ ID NO: 1698 - DNA, 262 bp, Myxococcus xanthus
actcccccaccgcgataggggcgacgctcctgaggatgagctggaccatgtgggagcgtccggacaccaggacgagagctcgaacatgttcacgaacccctcgcgataaaccttgcgctccagggcgacgagaatattttgcttgctttaggcgctcttgacccactaaggaggcgtcctcaccggggtgtatgaccacctcaagggggtcgctcactggctccagcaacgctcgcgtaacgtatagacgactccctatatc

SEQ ID NO: 1699 - DNA, 714 bp, Myxococcus xanthus
tttctcgaggagatggatatttttctccctatacgattgtaacggttattatcttttatggttattttgttttaatgaccaagtattttggacaaacgcttggaaagatggtgtttgggcttaaagtagtatcgctgaaagactccaccttaacttggcctgttgtgctgtttcgtgaaggagttgaacacattatgcgtaaaacggggcatttactggactatctatcagatgcacttctacctaagaagcagggagcgcatgattactacgcagatacaactgtcatacatgaaggtacaataagcagataataaaaagaggctggggcaaaagtatttagacgaattgaaaaccgaaccactgatcaagatttttgattagtggttcggtttttttgttagggtaaacgtaggtttcatttatgtagatctttctagcagctgattggattcatttcgttatgtctcaacctctttttattgttttcataaggtttaatattctctgttttggagataatgtgaagctaagaaggagtgaaggatgtgctatggctcttatggatattgctagcactcttaattgttattgtacttattgtatggacaaaaatcaccctttttgtagagcttcatcatgtccgagaatacgattattacagagtgagactcagagcttggttcggtcttatttcctatacatatgaaattc

SEQ ID NO: 1700 - DNA, 334 bp, Myxococcus xanthus
taatacgctatctggaacaatagataacctaaaaaatcgacctactcatatacgtactgtaatcgattggtttttaaaagaaaattccttttctccatccattcattcaaataatatttctcttattggccattcaatgggaggatatacggctcttgccgtagcaggtggagttcccacttcttttccttctgaatctcctgatcaaaagccttattgtttatctgttgatcatgataagcgggttcaatcacttattcttttagcgccagccgccggatggttcagagaaagaggagctcttgaagacgtgaatatacctattttaatgatt

SEQ ID NO: 1701 - DNA, 744 bp, Myxococcus xanthus
ctctcaaggattaaaagaagtttaaacaaccgtacttaccacactttctgtttttatactcattttatagtaatatccttttatttaccatatatgttagtagattcataggggttctttttaaaatgtaaaaaatagcactggctgagcatagtttataaacatacgctgaactctaagaaaaaaaggagagctgttatgaaagcaatggtatgtacaaagtatggaaaaccatacgtttttcagcttaaagaagtagaaaagcctactccaaaagagaatgaaatactcgtaaagatttatgcaactacagtgacatcgggtgactgcagagtgaggagctttaatagtccactattattgtggcttcctatgcgaatagttttgggattacggaagcctagaaaaccgatactaggagtagaataggcgtggataagtagaggaagtagggaaaaacgtaacaaagttcaaaaaaggagatcagctatctgccatgacaggtatgaagttcggaggatatgcggaatatatatggttaccacataaagggacaatagctataatgccggagaatataacctatgaagaagcggcttctatttcttttggtggcacagcggctctgcattcttttagaaaaggaaacattctcgccggactaaaagtgcttatctacggtgcttcaggtgcggtcggaactgccgctgtacagcttgctcactattactgagctgaagtgac

SEQ ID NO: 1702 - DNA, 97 bp, Myxococcus xanthus
cacccctccgctccacaacttcctccctgcccggaaagaaagcaccgcccccccccgtgtatttttttttcggacgcccccacgcccccccaaacca

SEQ ID NO: 1703 - DNA, 551 bp, Myxococcus xanthus
tgctctacagtaccattgttcgggagcggcgtgaaatccctggggttgttggtcagtatcactgggcgccaggggaccaatgacacatggcggggggctgggccctggggttgcagctcagcacgcgcatgcgctggtgttccactggacttagttggtgcaccatgcgtgcggggtggccttcttttgtgggtcggcggtgttcgatgatgacgcggaatgcaccctcaagtgcgcgcgcggctgggtccatcaaggatcctacacgggagacagggaactcagcttcccttaatcgtctagaaggcagaagcatcttgttcatgcgcatgagcacgacgtgcggaaccttggtgcggacagtcgacagccgacgttgtgtataagagaaaatataagtggctgggaggctaagcgacttcaggtatcgggtgaaccagttggcatgcgacccgctggggacctgccctactggagagatgtgcggaccgtctagtgaatgctcgcgcgaacatgtgcccagcgcagccgtgggcgctggcgcatgggac

SEQ ID NO: 1704 - DNA, 340 bp, Myxococcus xanthus
gctctacggggacctgccgattggccttgttcatgcacctgaggcacatggtgtgcttcgagcagaccatgttcccgtgggagacctggaggcacaagtcgcagttgccaccttggatggcccaggtgttcatgctcgcttcccgcggcaagaagctcttactgaacggaccccaggagggcatggcgaacgtgtccgttacattcccgggctaacatgtacaatgcacgccgacggccccccgggcggaataaccgaccttgctgcgataggtgaccggcgccggcgggcctagcgtcaaaatgtcattggacgtgacgtcctaatccccccggtcttg

SEQ ID NO: 1705 - DNA, 393 bp, Myxococcus xanthus
gtgctctaaagaccgggcacaggtgaacccatttgcgacgcgctgtgtaaacgcgtcgaggttacagaatcacgagagaggggatatcccactggctgagacagacacgcttacggacctgctaaaacaggcgcggggctgacaaatctaccttctgctcacacccgggaacccgctaaatgttccacgggctgactcactgccctatgtggtacctaacgctctggtggcgggggtggaccctgtcgggtacacactgccagactatgaacttaaccagggatttgggccgacctgggaacaccgacttactatagaaccctaccacgacactgtccatgaccgacatggacacttacttcggcctgttcgacactggtgcggatcaccagc

SEQ ID NO: 1706 - DNA, 414 bp, Myxococcus xanthus
cccccaacacatgattccatgcgtcacagtggttcaccgcctactgcccatggacccgagacgacacggtccacggggggtgctagggcaatcccttctggacactccagacgttggaggcccactaaccgcacctcttattggggccgagctgacaatagtgtgcgtctctcgagagtatgtcctaaggaccctccctgctattcaccagaacttcttgcatggggaaaggctctctgtgcttgccacacctgttctgccctgggtccgaaagacgactggaatacagctgtcgttgaagcagctggtcgatggtggcaccccggacacccttgcggagcctattcacggcgctagcccctgccctgaagacggcacacgagacctttccccaaaccacaggggcgcacccct

SEQ ID NO: 1707 - DNA, 436 bp, Myxococcus xanthus
gggatttgtgtcagtagaagtcatgttaagcctcctttgaaacgtttaactattttaaaaaagggtaagggactttttgggacctttataacatttcgtgcgtgtaaagggtaacaaatgttaagaaaagaggttttctttatgttcagaaaaatatttgaatcattaactggatctaaacatcgccgctacagcagcagtgatcgacactaccgacgtccacgccactacagcagcagtgatcatcatcacagacgtccgcgtcaccatagcagcagtagcgattataaacgaagcaaatattatgacagccacagtcattcaaaatatggtcatcaccattacaagcgtaaacgcaaaagcggaagcttcttctcaagctttttctcaagttgatttggaatgaaaaatcgaatgttcaaaccactttcatcgc

SEQ ID NO: 1708 - DNA, 736 bp, Myxococcus xanthus
tgctctacagagagaagtcgaaagcttataaaaagaaagttggaagagagctagaactttctgataaagtgttatacggtgatttattacgatttaataaattagatgactttaaaccggtcgatccatcaaaatacatgtatggaaaagaccaagaaacagaaaaataatgtaagctttcacaccatacaatccaaacaagcaagtagaggagctttttaaaagcttagctacttgcttgttttatgagaacttcattgaaaaagaaagctggtgacagaaacgtggagcgaacaagacgcaaaagaagaagaagagttcgatggggcagagtgttctttgctttgttgttcctttttattatcgttgggggcatatacagctatttccaatataagcaagggctatcgatagcaagcgatggtaaatttgcggatgacggcacgacatttgaacagtttcaaggcagtctcccaaataacggagaagtaaatatgctgctgttaggaagtgactcgcgcggggaaaagcattctcgtacagactctattttaattgctcactacgattctaaaagcaaacacccgaaaattgtttctcttatgagggatatgtacgtggatattccaggacacggcaagcaaaagctgaatgctgcttacgcgttcggaggtcctgagctgctgcgtcaaacgatcaaacaaaattttgatattgatattaactattatgcagt

SEQ ID NO: 1709 - DNA, 731 bp, Myxococcus xanthus
  unsure (1)..(731): unsure at all n locations
tgtttcattcacttgaggacgctcaacaggaacatttaacacatcactttggaactgcattaagaaattntnnttaactgctcctccgtctacacgcaatgtttttaatgtaattccagagtctgcttccatcgcgcttaatacgtctcttgtttgataagctagtgattcaagcgttgcacgaataaagtgttctttttttgtaccgcgagtcaatccaaacatcgctccacgtacatcgctatcccaatatggcgttccaagtcctacgaaagctggcacaatatatacgccgtctgtagactctactcgtgttgcatagttttcagtttcagccgcatttttaaacattcttaaaccgtcgcgaagccactgaatagcagatcctgctacaaaaatactgccttcaagcgcatattctacttttccgttaatcccccatgctaatgtagttaataagccgtgatcggacttaactgctttttcacccgtattcatgagcataaagcagcctgttccataggtgttttttgccattcctttttcatagcaagcttgtccaaataaagcggcttgctgatcccctgctgctccagcaattggaatgtttttaccaaagaaatgataatctactgtatgagcgtatacttcagaagaaggctttacttctggaagcattgatttcggtacccctaagatatctagcagttcatcatcccattttaaatcgt

SEQ ID NO: 1710 - DNA, 579 bp, Myxococcus xanthus
agcttaacccttaccatgcatgacctcctgcctgggcgcgcccattaacaatgaggacaatgcccggtcggtgcgggggtatcccgtgccaagccccacaccgctgccacccgcacacgtatgttggccctgcttaacgggaccaggacagtgcttttcatcagccattcctggtgacaccagctctgctggaacggacttgccatgtaaaggttgcagctgatcgaccacaccacccgtttcgagcaccgggtcttcactaggaactacctgagtgttggcttcccacgcaactgccggaggaggaaagggattgctattctataacccggcgacaacaccactggcaaggacctgaacgcccgaccacgcctcgtctgaatgacgaggacagagaaggaacccctcacaagtgcccctatagaactgactcgatcgtgctactctacacacacgtgccaaacagtgacacgccagacgaatgaccctcacccgtaggcactgtccacaatcacacatagcatgcgtttgcccatcagggaagggacccaccacgctagctatgtggccaagtgagcc

SEQ ID NO: 1711 - DNA, 384 bp, Myxococcus xanthus
gcaggatcaaactccggccagcactgcacaacaggaaagtctttggtggcataaggttgctggatttaatgcatgatgtgcggaatgaacagacatagaacaaccgccagaaaccgtactgacttcgatatggtggtattatacgttgacgaatgaggggttcacagatcctagagcgcgtcgaagtctaaaatgatgcaacttatggccgggttgaaggacatgtgcttgaggggctggcctaatcaatatagggacctgctggccggacgcactaactctagcgccatgtgatgctggggacggctagtggtggcaccgacccgtccgcgcatgccgcgtgggagacagctcacagacccgctctaggaaaatggacatgct

SEQ ID NO: 1712 - DNA, 653 bp, Myxococcus xanthus
ttggatcaacataaaacgatatatagcgactcatgcctacgcgaccttaaccaacgaaagccactgaacgtagttcagctgaattcatctaagctcatagacgctcttaatatctgtaaagatgaggacagatgaagtcacatatatttgcacgggatccgaagggatccacactgaattacgattggttttgaatggttcgcaaactgagctaccttcagcaaacctcaagaaacatccatgacaatccatgagactttgcgagcctgtgcttgcctgtcattggcagctactgactcattgacagtaaccattagcaactatttgactctatctacctctgcccaattgtcctccattattgtcccacatggcaacacatcggaaccatccgtgaacgtcagtgaaagtcgatctgcatactcgtacactcttgtacggtactccaaggaacacgatacaggacgatacaggggtacacaggggtacacaatatttactaacatttaacacacacttacacacactccggcaacttctgcatagctttcaatgggtacaagaggacactgctccattctggtaccttactgcaaggaactggttacaggaggcttcgatagctctgcattgctgacgactacgaacgtgta

SEQ ID NO: 1713 - DNA, 689 bp, Myxococcus xanthus
aacaaaatcgtacttctctgctacagtaaaagttagccaatactatataataataccaaacgctaacttaaaaggagtttgagaacatgaaagatacaattggttctaataaaaatatcgcgctttatcttcaagtgaaagatgtcttaattaaacgtatacaagagaaagtttggaagcccaatacgttaattccaacagaacgcagcgcaagagatgtagaaaatatgtctaaaaaaattatccgttctaacgaaaaatcgtttgatgaagtcacttctttgattgaagattattcaacaattgcggaagaaaaaacagaggatatgcgtctgttcatgaaagatgtcatggagaatgcggatgaatcctctaaagaaatgcagtatttattagaccgattctcaagcaattctaccgttgcgatgaatcaagtgaaatttatggttgaaaaactaaacaattcttcaactaatacgacagaagagcttcgtgatttaattgattcgatgaatgaagaacgagtctattatttgaaagaaatggagaaagagcgtaagcttcatcgtcaaagcgtagctgaacgcgaagaaatgtttagtgattttgtccaaaccttcagacaaaccgccgctgctgatatgaagcgaaaacggaagtggtggaagctgtttctctcctgaaaacac

SEQ ID NO: 1714 - DNA, 685 bp, Myxococcus xanthus
ctctaaagattgccagcgtcgtcatcaagatgggacgcacgcgcagcgatacgccttcgagcgcggcgaggggcgcgttcgcgcccgccttccggcgctgctcggcgctcgccaccagcaacacgccgttggcgatggagacaccgacggccatgatgatgcccatgtaggactggaggttgagcgtggagccggtgagtcgcagggagatgaccgctcccagtacgacggccggaaccgccgtcaggaccacggtggccaaccggaacgactggaagctggccgcgagcagcaggaagacgaccaggaccgcgaccaccagcccgttcgcgaggctgcgcatggtgtcgtcgaggacgacggagagtcccgccagttgcacgttgacgcccttgggcagctcgcccatggatgcaatcgccgtctgcacgtcgcgccgggcctgcgccaggtccttgccgtggatattcgcggtcaccgaggcgaacgccatggtccccaggttgtgcgtctccccgtgcgcgatgccaggggtgatggtcgccacgtccccgaggacggggcggctcgcgttcttcaacagcggcacctgcgcaaggtcctgctcgctgttcagctcgctcgcgggcgtctggacctgcacgtcgtatgcgatgcccatcatgccctcgaccccacatggttc

SEQ ID NO: 1715 - DNA, 727 bp, Myxococcus xanthus
tcccactggaaagaaacaaaagatgctggtacaaaactaggcgtatttgcaacggggccagcaattgcgaacccatttgcaaacgttttaagtgaggcgattggaacatttgtattagtagtaggaattttagcaattggagcaaataaatttacagatggattaaatcctttagtagtaggatttttaatcgtaagtattggtttatcattaggaggaacaacaggctatgccataaaccctgctcgtgatttaggaccacgtatcgctcatgctatcttgccgatacctggcaaaggcagctcgaactggaaatacgcttgggtgccagtagtgggtcctttattaggcggatcaattggcgcagtattttatcaagcggcattcttaaataaaacgtctagcagcttatggattgtcttaagcattgcggtgattgttttagctgttatttacgctgtttctaaacaaaaagcagcacaaattcaatcagcagtagtaccaaaaaaatgaatgcgctttaccatctaactatgtacaataaagaaacgacactatacagagaataggggatattgatatggaaaaatttattttatctttagaccaaggaacaacaagctcacgagcaatgttatttaataaaaaaggtgaagttgtacatgtagctcaaaaagagtttacgcagtacttcccaaaacccagttgggtagagcataatgctagt

SEQ ID NO: 1716 - DNA, 104 bp, Myxococcus xanthus
cgcccttctgcagtttggggttgagtccctcctcggtcttgaagttgaaggcgtaggtgaccatgatcaggttctttccctttttccgcaccaagtccaccaac

SEQ ID NO: 1717 - DNA, 376 bp, Myxococcus xanthus
gagcggggcggcgaactcatctacgaaagcgtccaactaaaacatcaatggctaaaccaccataatgaggacatagcttgccacaacgaggaacttatgctagggcctaaatgcttgactgggatatgcgcactagcccggatctaccatacacactccacttggtagagcctattaaaaatgctgcgcccccaagcccccaaccgcacctacccgttggagcgctccaaagcactctaccatgcagcagccatgtgtaaggagcaactgcttgggccccaactaggcataaactcatatcaagaagtgctggaactgatgccatggcatacagaaacccttcgaacgctgtaccaggatggcctgggggctgaca

SEQ ID NO: 1718 - DNA, 603 bp, Myxococcus xanthus
gtgctctaacgagactacctcgacatggtgctggtgaactgcgaccggcggggcaccgtgaccacctgcgactgacggacgtgcggtctgttctccgagcatgacatgctcaccccgtaccccgtggtgcttatcagccgggagatccaccccacactacgtggacctggacccccagtgactgcacgacgtgcaccacctgttcgcccatggtgtatgcctacgcacccgcgtcgggctgtacctcaaccgtcacctgctgatcgtgcatgacgacgtggccttctcaacgccggggacacctagcgagccagcgctccacctctaccgcgctgagcggagtcccttgcttctccacgaggcgctgactcagtcatgtctcgtggacgctacgactcagtggacgatgaacttttcagatcatgcagaaagacggcgtgcgcggacaccgactcggacctgatgtctgcctcgccacatggctcgcatccatcctgggactgcggtctggaataactctgctaccgtatgttcagatccagcgctaccaggcgtacaccgggcttgtgcgtactgcaccaggcataatctcttgtaactctt

SEQ ID NO: 1719 - DNA, 498 bp, Myxococcus xanthus
ctctaaagagcctcggcaagtacacgcgtgcactgataccgagacggctcgttgtgcctaccgcacgtacactgggcatgggcggaactcgcccgtggcgccttaagccgccacccttatgaccgactctaaacgcaccggtgcgggatctggagcacctgcacgacatgagactggacctgctcaatgacctgcacatgtgtgacatgcatgatgacctctgaagccggatgggccggcacctgcacgcgcgcatgtcccacttccacggggccgtgaccacccatgggaccgacacgctcatgtacatcgacagctccctctgcttgatgatgcgcaccccgacgtgccccgtggggttgacagagtgccacagggcgggggacatgagtcagtcagacccccggttcactctgatctaggcggtgctgtccgagatgcacgggacccatgaggtcacctatatggttctagtcacgcctgtacaccatgcacacc

SEQ ID NO: 1720 - DNA, 754 bp, Myxococcus xanthus
ctctaccggcttgaactctctgcgatcgcccgccttaaaggaaaaatccggccaattttttaaattaaacgtatctatttggaataatatcaaatataatagatgaaatttttaatgtctagagattaactcactcattaatctgtttaaagcaatgtgtaatatatcatgttctgtatactcttgttcaaaggctagacttcttttttcttttttcctcaacaactttctaatttcctcacataagtaaatttgagaatccaaaagctttatttcttttctatcttttgtttgtttagacatgaaatcaactcctttatgattctttaaggaactattctatcttaaaaagtaaaaatccttcttctattacatcggattaacgtaatggggtttattagaaggaccaaccttagattagagaaaattgatttaatagctcaaaccgatgaattaaccctaattaaagacaaagattaactatacgtaaaatgtaagagagggtttttttattgattccagaattatatacaaaagtgttctatttaaacagattaatggcttcattcaattatgcacctacttattttaatttggctgttgtatatcgtaagtagaaatacacatttacctttgtcagcgatatttatggaatcaagtatggaatgaattgtaatttgtggttgcatttctttagaaggagaagattaatcaatgagtacaaaaagaatacatcttacgccatttgaaacta

SEQ ID NO: 1721 - DNA, 548 bp, Myxococcus xanthus
  unsure (1)..(548): unsure at all n locations
tttttgatagccagtcttttttcagctcaggcgcttgcgctattaaaacgcccgcgatgggaaaagaatgtcatgaaagttgagcgaacaattcaagaatatggatctcacgccatcatcgcaagctactttttaccaggaatgcgacatgtgatgcctttttttctcggggcaagcggaatgaatcatcgtcattacattaaagtctcattttcttttggtttcatttggacgctggctttatttattttcggttccttttttaatacgacatcttcttatactgatgtgattgagatcactttagctttttgtgcgatcagtttgattatctatgccgtccaaagaagaaaaatacgaaaaaaacagcagtagtttgtgtaaaaaagttctttttcacaaactgctgctgtttcatttatattaaatgacttcattatatcccttcacaaagtatttgcgcgcgcggtaaagagctgattntaacgtagtcatctgcatatttaataactcggcaatttcttcatatataaatcctaatccatatt

SEQ ID NO: 1722 - DNA, 120 bp, Myxococcus xanthus
gctctaaaggacccggggacgggggctacctgattccgataggcagccgtcaggattccagaatcctccaggctcaggaacgtccagatccaaagactgggcaaaaaaaaacttaaacct

SEQ ID NO: 1723 - DNA, 79 bp, Myxococcus xanthus
cgctcgtgtgctctaagaacccgcgccgatctccccgcggagatctcgaactcgcccgtgaggtcggtgcgatagccgg

SEQ ID NO: 1724 - DNA, 367 bp, Myxococcus xanthus
ctctacagcggacctccctcaaccagacgctctccggcccagaggcggagcagtacctccgcgtctccagcaacgtcacgccgctcttcggtgacgcctccaagcgcctgctgacgccctacgcccccgaggacgtacggctcctcgacgattcgaagggcgcccccatcaacccgggcgccgtggagcgcgtgctccccgccgggacgaagctgcgcatcacccgcgtggagttccccacctcctgggtcatcaccgagcgcgtgctctacagcccgcgcgcctggccctgggtgtacctcacggaagccggggcacccgccaacgcgcacgccgtcatgctggggaatgccgccaacctggaccg

SEQ ID NO: 1725 - DNA, 475 bp, Myxococcus xanthus
gttctctaaagggcctgacgggcccgcctggggaacgccttgaagccgtgcgtatgggcgagcgatgatcctcctcctgggaggccctgcatagataccatgtgactcacgcactaggaggacatcctatcgtactgggcgtggagatctattgcgaatgcttcctgctttgattattgtggcatatggcctgactgctggacgctcgtctggatgacctgtcctgaggactcttgcactttgctcggcgcgtgacatgtaaaacactgtctacgtcatgtgccggttgcgatggactgtctgcctacgcgctatgtgtacaccttgaatgcgggattctcgcatgtgggaagtctcctcaatagcaagggatgacggttgatgaacctagtcgcagtcactcctggctgctggactgcaagtggcttgagtgcaggttcagcctgtcgtgcgagagctgtgctttacgctcgcg

SEQ ID NO: 1726 - DNA, 500 bp, Myxococcus xanthus
tgtgctctaaaggccacctgcgaggccaacaccctgactgatactgccgccacctcgctggttgcctgaggcaccctggttggcataaacggcttccctatcaccaccatcgtgcccacctccatatcgcgcgatacctgctttgattggatttagcacgtggtgatcattatggggccatgcccagtggattccttgattcacagtgcggcgaacgcggtgggcccatacatgcacggcgtccttgctggcaccaacattaggtccggcttttctgtgcgcgccttctgcgaagactatgccataaacaccaccagcaccatctgtcattgcccgccctggatgacgctccgattggccctggcgctgctgtgatcttcctatggacatatctccacattgcgaagggaagccctgactggtgttgaactctatgaccgcacgtgcctgctgaagccgccccacgggactacggaattgcacggtcaccggataacctt

SEQ ID NO: 1727 - DNA, 453 bp, Myxococcus xanthus
tgccggggcaagagtcggctacggagacgggcctcgggagtgacgcgagggagaccgatccctctgggtggaggaggcgcgcccgagacctcgggaccgtcccgtacacgccccgaaatccggacaacctcgcgagtgcccacgcgggccccgcgtcagcagcgtcccgtgcaaaaccccgcgtgcctgacgcccggtgccgccgcccgcgggggggcccgacactgtcacacggaaacccccctatgacgggcagagtcggcccgctgaaagggagaggcgtttttttggggttattacacgcctcctagcgatgaaccctgacctggcaaattggtcctgtggtctacggactgtgtgtgagcggctcccgacggtcaccgcgaagtctgcaaagtctgcgctggcgcgagacgcatcacttctttcgagcctgctaggcgtcatgctgct

SEQ ID NO: 1728 - DNA, 743 bp, Myxococcus xanthus
tgagctctaactgccttatgcgattctgggcatttttgtactgcttttgcttgtgtttgtaatggggcatacgagtaacaatgcgcaaagttggctgcagcttggcggagcaaacatgcagccggctgagtatgccaagcttgttgtcattttatacttatcgtatgttttgtctaaaaggcaagagtatattgacaacatcaaaaaagctttttttggacctatgggtcttgtatttctaatattaggttttgtagcgattcagcctgaccttggaacgggatcaattatttttgcgatttccgttaccattatgctatgttcgggaatctctaaaaaaacctttttccgcatgttagcactaggtattattttgcttacggtcattattacgattggtttttttacaggtcagtttactgccaatcgaatcggccgttttaccggtgcgtcagatccgtttgctaatgctcaaggaaccggttatcagctggttaattcatatttagcaataggtacaggaggcttaaaaggccttggtttaggagaaagtgtacaaaagtatggttatcttcccgagccccataccgatttcattatggccattattgcagaagaattaggattctttggagttatgctcgtgctgggccttttaggcttcttaattttcaggattttaatgctggctaaaaaatctcaggatccgttgctagcatgatttgatttgagtagccagtatg

SEQ ID NO: 1729 - DNA, 491 bp, Myxococcus xanthus
ccttcacgggagaacgtgaagaatggctgcgcggccatgacgatggcgctcttcaattctgctgacaagagggcgtggcacctggacgtgattatgctatattggaacttcgtgaactgctaacgacaagcgcccatgtactgcatgacgtacttaaggacggtgcccaatgccttggttgcaacgacgatgatcgtgttgctgctcgtgtgggcgaacaccatgaaggccatcccggccgtgagttaattgccggaccgctggacgaagtcccacatggattgctcgcccacctgccaaggcacgctcttgtactacccgaagctcctgatgaacgacaccagcagctccatcttgagcgtgttcatcgtcagagaccaatgcgtggcctgcctagatgagcgctgacctaggtgacgctagagaggagcgcgatgggctatccccctgccccggaattaagacatatgggtgcgtcactagactaactc

SEQ ID NO: 1730 - DNA, 80 bp, Myxococcus xanthus
cgcggcgagcccccaggtcggtcttggcggcccgggggctgcctgccacgtccagcgctgcggtgcatccagggtcgcat

SEQ ID NO: 1731 - DNA, 559 bp, Myxococcus xanthus
cccagactggactgcccactacgtgtgaggcgcttgcagcgctgacacacctagccgctctagacggggtcttggcgcaccgatggccggatgttctcactgccgaccttgcgcgaggcggtcctccggacaggaagccgacactcgcctgctgaataggcaaaaagtgtcccgccgcgcacacagcttgcaggtgctcctgcgggcggttgctgtccacgagggacttctacaggactggcgggagactcttttccagtggctctaccacggcctgctctggctgtaccaccgagacacgactggccacttcgcggcgacggacacctggtcctgtgagggcgagtaacaccacctgggcaagctcgtggagcgctgaaggggactgcgcaccgtgcatgacggcgcgcactgggtcgaacacctggctgacctgggacaagggctgctacgcattgagccagtgctgccggtccgcggcgatgaagtgtgcgcggatgtcagtgctttggacgactggctcatgcaagctcctggacgactagctgacgtccggtct

SEQ ID NO: 1732 - DNA, 213 bp, Myxococcus xanthus
gccgacaactttcgccgggcttctccatggccgaagggaagacaaaaggcgctgggcttatcaaattagcgcgctatgtgacctcaaagtgctcacggcgtgaccaacgaaagtactagatccctacccgcatctggttcatctcataagcctgtctcgatacgcactgtgaataacaggatgccagtcctatttcacagactactgctggaa

SEQ ID NO: 1733 - DNA, 353 bp, Myxococcus xanthus
ggatcaacgccgacctggtgcactccaacgactttctgttgttgcagggctcccgggactaggcccagcggcgccagcatcggggacaacttcatgccgctgcatggcccgcaccccctggcaccaaggcgagccgctgctcccatggctgtagcccatgccccaccacgggccgccggacaaaccgcccttgcggttgccggacctggacgtgctactatcccaccacgactaccgagggctgccggtacaaaacgactacgggaccgtctgcgaccgcgattaaatccacgggcatcccttcgggcggggcacgcccgtggggggcatgaacaccttctacggaccgttgg

SEQ ID NO: 1734 - DNA, 658 bp, Myxococcus xanthus
ctacagattgttggaaacctggcaaaacgaatggtcgaaaaagcaggagtcccaattgatattcatcttacgttggatcgaagaaaagcgttaaaagatgctgactttgtcactacacaatttcgcgtaggattgttagacgccagaatgaaagatgaacgaattccgttaaaatacggcgtgattgggcaagaaacaaatggaccgggcggcttatttaaagggctgcgcacaattcctgtgattttaagtattgtgaaagatatagaagaactatgtccaaatgcgtggcttgtaaactttacgaatccagctggtatggtgacagaagccattttacgctatagcaatcataaaaaagtagtgggcttatgcaacgtgccaatcggtattcgcatggggattgctaaagcgctagaagtagacgaaagccgcgtacaggttagctttgccgggttaaatcatatggtctttggattagatgtctttttagacggagtgagcgtgaaagatcaagtgattgacgccatggcagacccgacgaatgcgatgtctatgcgaaatatcaaaggagtttcatgggatcctgactttattaaaggcctaggagttattccatgcggctaccaccgctattactataaaacaaacgagatgc

SEQ ID NO: 1735 - DNA, 645 bp, Myxococcus xanthus
  unsure (1)..(645): unsure at all n locations
atttctctacttttgccgaactttcaagcacaaaagtgacctctcaaactggacaggaagttacattaaatgaagttgtcgatattaaaaaaggtaaaacgtcgaatacggtaacgcgccgtgataataaaatttatgcagaggtaagtgccgatattaagagtgacgatgtaggcggcgtttcttctaacgttcaaaaagaagtgaagaaaattgatttgccaagtgatatggacattaactttggcggatcatnagagcaaattaatgactcatttagtcaattaggaattgccatgctcgcagccattggtatcgtgtacttcgtacttgtactgacatttggtggaggtttagcgccatttgctatcttattctcacttccatttacactcattggtgcgctagtggcacttttaatctctggggaaacgattagtatttcttcgatgattggagctcttatgttgattggaattgtggtaaccaatgcgattgttctgattgaccgcgtgattcataaagagcaagagggtctttcaacgcgtgaagctttactaaaagctggaatgacncntnttcgcccgatcttaatgacagctattgcaacgattggtgcactgcttccattagcttttggatttg

SEQ ID NO: 1736 - DNA, 114 bp, Myxococcus xanthus
ctctaaagaggcttagcgcttaatgtggctgaggagctgcatcccgcgggaagaacgggtgtcgcgcacgcacgaatcctacaaccggcaggaggcctcggtggggcctggcac

SEQ ID NO: 1737 - DNA, 201 bp, Myxococcus xanthus
tgtgctctaaggcgctatccggtgtgaggatggatgttaaacgaagcgcacggagaggtatgagatgacaaggctagaggcctcggactgctatgaacggcagggcattcaaacatccaactggagcagatgggaaatgcgtaaggaatctcatggactggagaagaggccggatatcaattcagacacgtccttttgacc

SEQ ID NO: 1738 - DNA, 642 bp, Myxococcus xanthus
gataccgttttggacgaataagacgactgcaaggacatattaaaagcaacattattaaagtctgataacagcaaattcatagagcgataatcgtcgcgctgccactctaacgtttgcttttgttttttcatcttatcaataggcattcgttcagccttcattaaatcactgacgatttgatcaatatccatcccacttgctaatccacttactcttaccacttaccatcaccaccgtttatttattcatctatccatcaactgctagccataaaatataggtatattttttcgaatctccctattcgatcatagggtcaccacttgtctattttgtatcggtaaaacgaacatttttttcataggccaaagggtgcacgatagaaaaagctcacttatttttttacgataagtgagctttttattattggccaaacaagttcagtttctgggataaaatcctttgaatatccttaggaataaggtatggcgctagatttataatatctccgaacgaatcaatgggtacagaggcagataaatttatatattcatcccgtgtatctgcttgctcaaacgaaatggaatctggcaaattattgagcagagtgatttcattcatttctttatcgaccgggacatc

SEQ ID NO: 1739 - DNA, 588 bp, Myxococcus xanthus
ttggggtgaatccatgccggtgctgtcgcctatgccagtgtacttgactccgtggacgccggcgacgtcttcggtaaggcgttgggcggcgggggtgaggattgcggcaggcctggacttatggttgatgatctttgactggtgatgaacccggccttagatgctgtgcacaccgaacgggtgtcaaaggacctctggttacatgtgatgttggtcttcttcgctggtgtgcatgtcagtggacagatggcgatcgagctgttccgacatgtactcctcatttatggacagtggcatcttgtgattcgcgaccagagatgagatgcgccatgtgctgtatccactggtggctggtgtacagtatgcctgtatcctgcggatacaatcggacggagtgctgtgctagacaccaaatctgcgtgggcgactccgttaatcccttgatgcgcactgacaaccacgtctgatggatagccgttttaccggcccatgcacgactggtgcgccaggtcctgtaccggctcggtgacggttgatagttgacgacgctggtcttgcaatccacacctgagcccaggattatgcatg

SEQ ID NO: 1740 - DNA, 238 bp, Myxococcus xanthus
aagcggcctttttttgggcgtcatacaccagcacgatgagcatcaagggctacacaagggccacgccctgcgggatcaccccagggctgggggaatcaacgtcccgcttgatacggtccaacgagagctactccttgaacgactccatcacaagcatgggcaccgggacgcgtagcccatgcgtcaacatggctgcgggcctactagggatccctgtcttgatccaacgggggcagtc

SEQ ID NO: 1741 - DNA, 193 bp, Myxococcus xanthus
ggggtctataccgccaataccttagccttgcaggggattacggaaagcctccggctgaaaattgatgtcttcgtgatttaggccactctgctctagctcgtggatgtcctcactctcttacatgagtacccgctacgcgcccggtactccggggcgattttcgcctaccatgacggattgccgcgcctcatga

SEQ ID NO: 1742 - DNA, 272 bp, Myxococcus xanthus
tgctctacggtgtacacctgcgcggacgtgcggcccggacgggaggcgcgcagcatcagcgcgtcctggagttcgatggtgttggccagcgcccgcttgaggccctccggcgcgtccgtctccccctcgttgagcacgtaggccatcttctgccagtcggagttcagccccatgtaggtgatgccgaagtccacgtgcagcaggtcaccgcggaggatgacgacgtcctccttcgcgggcgccaggaagcctcgcgagctggcgccgtccgc

SEQ ID NO: 1743 - DNA, 309 bp, Myxococcus xanthus
acagaaccgcccgagcgaccggctggatgagtctctccagcctgaatgaagagcgactctctgaaaatcttattgcaccctgcactgtacgcacctgggtgcaattgctttggagcggacgcaccttgtaggcacgctgccaagtgacttggacgttacgggggcgacacacggtgctctgatgcctgcatgtcattgcttggggggcagaacggcggatgggttcatgcccacgggtgcatcaacggagggattcatgctacccaggtcctgatgcgacagcgaccgctggtcgagtccttccgtcga

SEQ ID NO: 1744 - DNA, 602 bp, Myxococcus xanthus
gtgctctaaaggccccacacgcgctgggccaggcacagtacggtggtgtcattgagggcccgagccatccggtgctcgaactccgtggtgcacaggggcagtccggatgcaccttgctgcttgttggcgacgatgctcatgccaatgccggtgcctcacaccagcacgcccagggtggcctccccggacgactccgcgcgggacacccgcgccgggaactccatgaagtccaccgagaccggcgtgacgggacccacgtggttcctgggccacgcccccggcggcgagcgcggccaccagctgctggcggagctccagtcccgcgtgcactgaacggaggatgactttcacgctgatctgtgatgagacaggtctaatcgcttgaacaccatgactgtgttcgtgccgccgaacccaatcgagtagctcatcacaggcgttcacacggggactgacgcccttgtgtgcgcacagctgtccaggtatcaggccggatcacgcctgggacgggtgatggaggtcggccagatgctgcatgccaatgacacggacttggacatgctgctagtacagcgccccgcgctgagcatgcagccgggact

SEQ ID NO: 1745 - DNA, 154 bp, Myxococcus xanthus
tcttaccggaattcgaatccaattggcccgctctctctttttcgaaaaaaagcatgacttcgagaacaggttggaaaacccccccttccaggaggaggtcaaactcatccagaacccaatgctgaattgagggaaaaaaagaggattcctacaa

SEQ ID NO: 1746 - DNA, 733 bp, Myxococcus xanthus
gaccagaatctgctggaattgggaatgccgatcgtattcatagtgcgatgatgcttgaagggttatctgaagaagaagcgtatgatcgtttttgggcatatgattacagaggtctgttaaccgaagacatggaagatttagctccttttcaacagccttacgttcgccaaaatgaagagattaaagaatgggaaaaagacgatgaaaataaaatttcactgttggagcttgtgaaacaagtgaaacctaccattttaattggaacgtcaggcgtcacggatgcttttaccgaagaaatcattaaagaaatggccaaacatgtagagcgccccgttatcatgccgctttccaacccaactaaacttgctgaagctgttccggaaaatattataaaatggacggaaggaaaagcgcttattgcaacgggaagtccatttgaacccgttgaatataacgggaacacttatgaaatcggacaggctaataatgcgtttgtgtttccgggtcttggtttaggtgccattgtggttcgcgctcaaaagtttactgaatctatgtttgcagaagcagccaatgcagtagcgcgtatagcagaaacagatacaaaaggagatacgcttcttcccaacattaaagatcttcaaaaagtatcaaaagcggttgctgtagcagttgccgatgctgctgtaaaagataacgtagcgactgttaccgaaaaaaatgtaactgaact

SEQ ID NO: 1747 - DNA, 482 bp, Myxococcus xanthus
gctctacggcagcgccggtagaagtgcagaaagcatgtgacgactcgtgcaaaacggatcgagctacacatcgggtttgacctgaatctatgatggtccatgagctatgaggtggtactgaaatcgatgagaaactgataatgcccattcaggttctatgagatgacgatgatacagagctaagtgcgaatgctatgaggtcttctaaaaacgggcgggacaccatcggggaagtgtagacgaagagcactgtgactgagaccgaaacagtcatgcaacccgtgtgggatatgagtggtggacttgaagtattgcgaaccgactgggacatttgcggaactgaagacgcccggcagccagaacgggccacgggtgcaatcgaatccacgacctgggaaggtgctcaacctgaggggactacctctgagacataagaactcaagttggaaatggtcacgcctgagatggacaacgtcacatat

SEQ ID NO: 1748 - DNA, 582 bp, Myxococcus xanthus
tctaaaggacgctctgaatacggtggggatgatgctgtggagcctctaccaatttcttagttactccatacaactgccacatcaagcgaaggatcactaacgatgggcatgggacgagtgcttgtctgcatgtccctggcaccgctcaccggtgcaagcgggagctccaaccccggtgaccacgacgcgcaccaagccgatcacgcgcatgaggacgacggcgtccacctggctgtcgacgacgtgagggaccatgaaggcaaactgaacctcaaggaccacgacggccgccagcgcttctacctcacacacacggacaacagggaccaactggtgcatggtgaggatcctgagctgcctccctacatgtggaagcggttcgtctcatcaaggtctcggggcccgatgaccgtgcgctgcgatatatgtagtgctccgccatcagggcgctaactgtgctggacggtaagcactggcccgtgctgctcaccctcatgcagctggggccggtctgccgcctcaacaagatgaagggcaccctcctgtactgcatgtggacgaaggatgacatgacttccatcc

SEQ ID NO: 1749 - DNA, 621 bp, Myxococcus xanthus
tgctctcagggtgcggacgcgcgccggtgtggagcgggaaatgcggctggaggcgctccggcccacgcccaaggaggacatcgtggtcctcgagggcgtggagtcgcggaacgacgcggaggcgctcgtgggcgccaaggtgttcgtcttccgcgaggatctggagccgcccgcggagggcgagttcttccagggtgacttggtggggctcgatgccgtggacgccaacgggaacgcgttgggccgggtggaggagatctggaccaccggcgaggtgcccaacctggtcattcgcgcttccgggcgcgaggagctggtggttcccttcgccgacgagttcgtccccaccgtggacctcgaggcgcggcgcatcgtcatccatccgcccgagtacgtggaggcgggacgcaagggcgccgagtcaggaggaggcccggaggacgcggaatgagcccaccgtatccggtggagatcctcacgttgttccccggcatggtgaccggttacctgggggccagcatcctcgggaaggctcaggagaagggcctgctggccaccaccatcaccgatatccgcgagtacgccgagggcaagcaccgcgttaccgacgacgcaccctac

SEQ ID NO: 1750 - DNA, 581 bp, Myxococcus xanthus
gaggcaagccttactgagagctctcagtcacttaaagaataaagggctaactcattactattaagggcaagccatttcaaacagacgctaagaaacaaagacacccttatatactggagaataaaacacaagataatcatccagcacgcttgtaatatagccatgcaatgatttccctcctgctacataaatctcaacaaatctcccttttgcctgccgtaaaatactacgacaagaaatccgccgacttccttatactaagctctcttctatggctcataaaggagtataatcttctcccgaaacctcccacaagcgacgtacgcgtaaaagaggaacatacaaataatcacgtccattatacaaaaccattacatctaacccgagatcaacaaactttcctataaacgttagcttccctgatatatcgactccaacaatttcatcaatataacgattgatactcattctgattgtgctgctttttactatatgacagaaaaggagcctcataagcaccttttacgttccagttcgtcatgctttccaacgataatccctcggtggaataaccttttcac

SEQ ID NO: 1751 - DNA, 398 bp, Myxococcus xanthus
tgcatgttggccctcagcgagaccctgtgcgacacgctgactggccggcggatgcgctagggggtcttgaacgggggctcgctgatccccgtgaccatcaggtcccttgcgtcttcgggccgcatgactgcgaacgtgcccgagaacctcaatacccccgcggagtgagctatgaacacataccccgcactgcggttggagaccgccaggatgctccagccctccatgaacgagcgcgtgctgtcctatgctaggcgcttggtctacacggacctcttggtggtgatggtcagcttgatgatgaccaggctcggaacagctatttccaccgtgcacgacccccaaacgtcatggaacgtgactcgccagatgcggcacaggcgttcaccatgacgggc

SEQ ID NO: 1752 - DNA, 332 bp, Myxococcus xanthus
tctacagttatggtggaaaccacgctgcgcgccatgcggaacgcagtgaacgaaccctgcggcgccctgtgctggcaccttgaggatggggagagcactcgaccgcatgcaccaccatgtcctgttggtgtagagggccaacgaaggacacaccctgaacgccgaccacgtgcacctgctccagccactgacccacggccacggcggaggcagcgtgctccatgccttgtggccccaccactgtgctaactggaccctgcaggaccagggggcccaccccattgactcgcttcaccggtcaggggagaacacccggcactgccacgacgtgc

SEQ ID NO: 1753 - DNA, 316 bp, Myxococcus xanthus
tgctccgggatccgagcccagacctcccggcgagagttccttcagcatctttcgagcacttcggtgctatcattgcgtttatgcaagatggtggccatgcactctattattcacctggaggtacggcgtacttcctaactgcaggaaggagcctgggtactagcccggggcttctgagtacacgtgcagtaactgatgcggactcggatgcacgcccgaacttattcagtgctgatggccagacacgccatgcgtggagtacaatatgaggacctctgtgccgacggtgaatgcctgacgatgggagtgcgcccat

SEQ ID NO: 1754 - DNA, 64 bp, Myxococcus xanthus
caatgggtgagaccccatgagttgcggccatgctcctgaacgagctggaagaggcaagctgcgc

SEQ ID NO: 1755 - DNA, 149 bp, Myxococcus xanthus
  unsure (1)..(149): unsure at all n locations
tcgtccgttttccgtcattgggcgtgcgctggtgccagggacctgtggagtggggagaacggcttatctttgacgccataaggaggagatttcgccgcgncaccagcattccatgatcagtactctggcgccccgtgagcctcggaccg

SEQ ID NO: 1756 - DNA, 627 bp, Myxococcus xanthus
gtaaatctaatttatatctctatgcgagtttgattgaaaccagtatgttatttcatcgtaatgtgctacttattactggtcaaaatgagaaacgaggaggcgttcacgtgactcttccttaggggattgctcttatggttactatattttttgatttgtttattaaacagcttaatggaagtagtagaataaatcatgcaccaaatagacttaggaaagctataaaacgtgcgcaaataagggttattgagtaacagtgtggcacttttaaatatgtatacttttttttaaaaaaatacagggcctgttggtccatttctgggcttttcgcaccgtacatacatttgaagtctttacagatttcagctcattaggatacacaaactttataggtaattgtacatgaaagatgaatgcatcatgtttgataagaagaagctggacccacagagaaaatactgtctcagatgacatgtaatatgttggaaataaataacaggatctcttctactcccagagatttgttggcttctaaaaatttcttgctgacaaagaaggattccttaaaaggcattgtataacccattacttcttttaaatcggcttcatgaatgccaactgtaatat

SEQ ID NO: 1757 - DNA, 299 bp, Myxococcus xanthus
gaacgctcggcgatcacacggccctggggcccgctggtcaggacacggggaaggcctgccgtgccgaagcgttacgtcgcgagtccggcattgacaccaccagagccgacgccataccctggccccggaccgcgtcggcgaacgttcgtcacgccacaaggttctctgggtgtcccgaaggaccgcccctcggaaggaaagcccaccgcagaccggtagggactgcccgagtaataccccgaggcgccatgccgtgtgacagcagacaagagacagtcgccaccgatcacgaccttcgg

SEQ ID NO: 1758 - DNA, 444 bp, Myxococcus xanthus
tggaggcccacttcttggaacttctggccctcaccatcacagactgacgccccgggacaccaaccacgccgccggctgcatcaactttcgaactgggccgacgctgggggaggctctggtgaagggttgcttgcatgcagggccaccacggtggggtctcgcagcgtcggtcagtttcaacttcgggagaggctgagaggctgtttgtctgcgtgggaccaggatcacggcccacagcgaggggatcttgcccggccacttgggcctcaactgggcaccacctggtcattctggaatgggaaccaccaccgggttgcagagccagatgtgtcacctttggtcacccgcgagctgttgatctcacggcgcgagtgagtgaacaatgcgacgcctggacaccaggcagacgccacgccaccacatcccacgccccgtaggagcgcg

SEQ ID NO: 1759 - DNA, 687 bp, Myxococcus xanthus
  unsure (1)..(687): unsure at all n locations
aagctgtgcaattttcccacgctcattaatagcggataattccaaggtacaatcaatccgcacacgccgattggttcttttataaccattgcttgcataggtgcaggaacgctgtacgtttgaccgtctggctttgtaattaacccagcgtaatacctaaaacaagcagctgcatcttccacatcagcctcagcttcacgatagggctttccgttatccattgtttctaatgttgctagttcttctttcgcttcctcaagcttatcggcaatcttgaataagatggctgctctgtcagatgcagaagtctcagaccaaattccgttgtcaaaggcttctcgtgctgcttcaattgctgctttcatatcttctgcgctgccttctgcagcatatccaatcacttcacctgtcgctggattaacagtagagcgctgcttctctgcttttctccattctccgtttatgtacatattcaaggttaaagttttaacggctgtacgatccataaaatacctccttatcgaataacgactgattgtcagtcatttcaaaccttaaaaaacttataattctgataattaattgtatattttgaatgaatgtcagtcattttaatgtatgtaatattagcatcgctaatattacaatggcacaagagaacgctttaagaatngaaaaagttctttc

SEQ ID NO: 1760 - DNA, 555 bp, Myxococcus xanthus
agctcacagcgtgcagtcgttgacttacggttctgaaacgagcattttaacagtaaatgctgagacgaaaaaaaacaatcagaagatgaaaatagatgggtttgctacaattgaagcaaacattcctcttggattaactagctatcaatacggggtaacacttagagtatatagaaattctcagcttttgttttcacagaatttacagcaaggagctgcagccgttctaacactatcatttactcagcaaaatgctctttcttttacatgggtagatacagtagcatcaattggtacatacacgtactcagtcagaatggaattttttgtccggtcttcaactggggtgaccgttcaaacgactacccgtgcaattgcgattactacataaaaacagcgccagaattctggcgctgtttttttactgatgcaacactttatttatataacgtttacgaagagtaaatccgggaaactccttaatataagtcaaaatggtagctaaaccagtagtcgtcctgcacattctttgtgtttgaaacgaccatatgctca

SEQ ID NO: 1761 - DNA, 180 bp, Myxococcus xanthus
tgccccgcaacggggaggttctccaatgggggggacgagaggtccacctgcccatgcccatggcgacaccagaacgcgttggtaccaccccgctggaccctgggaccccaggcgagggtcacctcgcggacgagccgcgacacagagcctgcgtgcccacccctgacaccgggggggacc

SEQ ID NO: 1762 - DNA, 612 bp, Myxococcus xanthus
tcttgatgcttgcattaggaggaatcactacccttttagtttttgtacttgtattcggacatacggcaggaaacgcaacaagttggcttgtacttggtccagttaggatacagccattagaattaacaaaactcgtcattattgtctatttagcagctgtttttacaaataaacaggaatatataaatgacttaaagcgtgcaattattccacctattattatcgcctttttcctttgcattttaattgccatgcaacctgattatggtggaattctgcttattttaggcatcgttgcagcgattgtcttatgttctggtatttctagaaaatcaatgctgaaaattgcgatgctaggggtagtaggcatagggattatgcttgtcgttttattagtaactggccatattgatacagtcttctctcctgtacgtatctctcgttttacaggatacctacgtgcatttgaaaatcagcaaggccatggatatcaacttgttaattcttatttggctataggaaccggggggttacaaggtttaggtctaggacagggtgtccaaaaagctggttatctacctgaatctcatacacattttattatggctgtta

SEQ ID NO: 1763 - DNA, 134 bp, Myxococcus xanthus
gccaagcgggtgaaattatgggccaattttacactgtggctggctgcgagctccctgatatggtgcccgggccggccgccgcgtgatgacaccacactttctggcactccacatgggatgctccgggcatccta

SEQ ID NO: 1764 - DNA, 601 bp, Myxococcus xanthus
cgaattctgtgcaacttcctctaagatttgataaaatttaatcctacgtcttaattccttctaatgaatccctcaactactatttctacttattttaaaggaggacgctattttgcagtttgaacaagctttaacacatttacagtcctattttggttatgattcgtttcgaaaaggacaggaagagtcgattcgttatgttttagaagggcacaataccgcttgtattatgccaacaggaggagggaaatcactttgttatcaaattccttcattattattagaaggtacaacactggtgatttctccgttgatttccttgatgaaagaccaagtggacacgctgaatgcagctggtattccggccacgtatattaacagctcgctgactcacacggaggtacagcagcgcttagaagaagtagcgcttggtgaatataagttactttatgtagcgccggaacgactggagtctccgcagtttttagaacagcttcaaatgcttcctatcccgcttgtagcgggagatgaagcccactgtatttcacagtgggggcatgatttcagaccaagttatttgcgtatcaatgaactcatcaac

SEQ ID NO: 1765 - DNA, 608 bp, Myxococcus xanthus
gctctcaagattccgtctataaccgcaatgagctttatttgattattcagcacatctacattcgcagcataagcattgtttgcctgttcatccgaacggaatactagcgctcctgctcctgtagaatttgaaacagaatcgtctaacacctttatctttgcttcatatgtgaaattttttgcttcttttgatgataaggtaaaggaatcttctttgcttcgtccttgttttccgttaatcgtatcggcccatagtccgctaatattcttccatccagataagcctgtatcaacaggacttttattccaaatagattttaacggatacatcttaagagaatttaattttacagagcctgctttgctataaagctttattttattacttgaaagcgttggaaagagctggtctgttattactgcagtgccgtcattgccaaatacttctacagacgaatggtctacaaacatatggagcttaacctttccctcttttggaagcatgggagcagagtgcttgcctttcacatttttaccaaaattaaaacttgcagagtgtgctcgatcaacagataattgctgcttggttatgccatagcttacttttgg

SEQ ID NO: 1766 - DNA, 225 bp, Myxococcus xanthus
acgagctctatagggccgaggcgtgagcggcacccgaggagggctgggctcctccggcaccgggcgctcgtgggccctcatactgcgccaacctgtcctgtgcggcgaacgacaccgagtccaactccttgagcatgatcgcgagccgcagcaggtggtccgggtcctgcgcgaagtccgtcagcatctgcgcgaccgagcgctcgccgtctacgtccgtgagcg

SEQ ID NO: 1767 - DNA, 341 bp, Myxococcus xanthus
tcatgggcggccggggcaccttcctcgccaccgcgggcggcagcctcatcggctggggcggcgcgctggtcggctccgccctgctgggcatcggagacaacgaacccggcggcgcggtgttcctgctgctgctccccgtggtgggcgccgtggcgggctacgagctgtcatcgccgggggaggaacaccccacgctcacgcgcaaggccccgagcacgttccaagtggtccccgtcgccgggatgggcgaacgcgggcctcgcctgggcctcgccggaagcttctgattctgaggcgaagcccccaggacatctgcacacctcgggagcttgcttgtcgaa

SEQ ID NO: 1768 - DNA, 283 bp, Myxococcus xanthus
ccggaggataccgtcctccaagagagggcgagcacgaactcgacgacactctcgtatcgcggcgtcttcatacttattgtcagggtgacttggatgagcatacagccatgcgcaagtccgtgtccaaggcactcagggcaggacatggaggaatcacacctgaagctcgcgatttgattgatgaagttgggcccggatgtccatgtcccgcactagaaagctgccctcgtagagggtgcggacattgttacccaccgccaggagctgaggctctgtgtcaagg

SEQ ID NO: 1769 - DNA, 194 bp, Myxococcus xanthus
tgagcaatggcactcacgcgccgactgcaagcaaagccgaacgcccttcgcacccgaatacatacacactttttcatttccatacagctgcaccgggtccttccaagggggcgggggctgcacacgtgctggaggagacatctcgacaaagcgaacttccgatcgctcctgtgcgagaaggcgctcgcggcccc

SEQ ID NO: 1770 - DNA, 585 bp, Myxococcus xanthus
aacagatttggcattaatccaggtaaaacaatgcttttgacagatgtgttgattgtaggctctgcaacagtggtattcggcgtagttcaagttctttattcgttaattggtatttttatcatgacaggactgcttggacgctatcacaaacgctcgccaatcgaacgaactggtgaacatattgaagaagaagccaagcaacaaacggcttcaactatgtaaaaaaaccgtgcggaaatgatcccgcacggtttttttacgcttattctgctacttttacaagctgttttcctaagtttgctccttcaaataaaccaaagaacgcttcaagtacattttcaaaaccttctacaacgttttcgctgtacttgattttcccttgctgcacccattcgcctaactgcttaatgccttcagggaatttgtcagcatagtcggctacgataaaccctttcattagcgcactgttaattaataaaaggtgtttgaacacgagtgcaacatcttagttttctaagctatacagtgaaatttggccgcaaagtggaatgcgcgcaaatttatttaataaagctaaacaactgc

SEQ ID NO: 1771 - DNA, 76 bp, Myxococcus xanthus
cccttttattgatcgtgctgagaggactgtgtttttcctgatctcgaacaccgacccatcgttgatcgcctgcttt

SEQ ID NO: 1772 - DNA, 635 bp, Myxococcus xanthus
acgttaacggatgaagggtttccttctgttacaaatattgatgaaaaactgttaaatgatgaggttgtagctgtagctatcccatctgcttttcagcaaatgaaagaagtctctccttctcttgcattggactggcggatgcgtacaagatacgtatttcaagcatgttttgcaaaaggatttgaagtaacaggttttatgaagcatccagaaagcagcgcacccgttcatttttatattttaacgaaaaaagaggtgcaaaaatgaagataaaacacgtcattttacggcatttaaaaatggatttacttcatccgtttacgacaagtcttggaaaagaagtggatcgagattttattttagtagaaattcaagacgaagacggacaatccggctgggctgaatccgtagcgtgcgcggatcctttttataaagaagaaacgcttaaaacaaactggcacattatggaggattttttaattcctttgcttcaacagaaagaaattcagcatcctgatgaagtatcccaacgctttgctcatattcgaggcaattacatggcaaaagcggcgttagaaggcgcagtttgggatttgtatgcgcggaggcaaaacctctctctatctaaagcgtta

SEQ ID NO: 1773 - DNA, 209 bp, Myxococcus xanthus
gtgctctaaaggcaagagcggagatctcgcggcatgctaatgactataccgtgatggacatagaggacgtggtgctgaacacgcttgacatgcatgccacggacgacacccacaccctgatggtactgaactgccgagtccgggagctggaatgggtcaccaccagccaccagcctgcagtgaagcaactcgcccgtgaagctgacgtc

SEQ ID NO: 1774 - DNA, 791 bp, Myxococcus xanthus
  unsure (1)..(791): unsure at all n locations
gcccaaacaatcaattttttgacaaataacgtgggaaaaacgttccatgatggcatccataacggcgtctgctacttggtgatgaccagatggcatctgaaaaagcggcaagaacagaaccttcctcattgaccatccctcctctcaagacgttttcggtttctttttctttttataagtaaataaataacaaaaaaagctacagctcccataatgatatacgaaatatgaatccggtctcctacatagtaacctagaacgagaaaagaaaggacccatactagactgcctaccaacgataacagcaaataaagcaaaaacggatagcgacttattcctgccatatatgggctaatttgacgtaagcctggaatatataaaccaaataaaatggtccatatcccatatttatggtagctgccgcttgccgcttcaattttctctttggttaaccctacgtattttccgtatttatcaaaaaatggggttcccgcataccttcctagcccgtaagcagtaagcattccagttataacacctaaaaaagcaaaaagagatgattcgtataagttcagctgatgtttggcaataaacatgcctaataatattaaaaatgattcttcaggcgctggaattccaacgatcccacaaaaaagtacaagtaaaataacaatattaccataggaatgtatatactgagaaatatngttaagtccactgctcgctcctctatttacgattggatcatcaattgctgcatggttatactttcatacccttgctgttttaag

SEQ ID NO: 1775 - DNA, 238 bp, Myxococcus xanthus
ctaagcgcgcacgagccgcacccgtcccgacggccaccgtcccagtgctgagggtgacacagcgattcccgcgccgttgaagcgcacggtggacgctggggccagaactgctcgcgtgagccacaatacggccttggatgtgctcaccacccggaggctggtgagccctcaagctgcaacggccacaccgacaacgctgcaatcacctgatgtgggcgtaccgaacgacgaacagcgg

SEQ ID NO: 1776 - DNA, 316 bp, Myxococcus xanthus
tacctccctcttaagtataaaaagccgtcatacattcctttttcttttggctctgcaagcattcctttaatcttaagcccttgacatgcatatgtaatcacccacagcgtcacgcgaggatttgatgatgggaaacgctgtttatgaagaattgttccattctttcattttttttcctccattctttatataactagcctactttcttccgctaaggtttactttcagtcgttgactactacttctttgattttccacatagttatataggcactcaccttcttccacttctttacatacattatcataaaatatt

SEQ ID NO: 1777 - DNA, 281 bp, Myxococcus xanthus
agcctgcttgcatggcatacgcttgctacacgaggattgtcaatcaggcacttacaaatctcgcagcccgagcgggacgaggcgacctggcttaccctatgctcacgttagcaggtacgcacaatccgaacggggtgttggtgcaaaagcacccggcacctggactggtgaccggcggcggatgggctgacttactgccatatgcagcgttgctctaaatggcacccactgcatgtgacttcctgacgacacaggtatcacgcgacctgctgcacggagga

SEQ ID NO: 1778 - DNA, 433 bp, Myxococcus xanthus
tgactctgagctataccctataaggaggatatcaccaccgcgattatagatgcccgctatgtccgcgcggactttgacccgatgatccctgatgattgggacagccaccttcaccccactgttgccacgcaccccgcatgcattgtgggagaagaacccgttgatccgagccgtgacccagcacagcggacggaaggatacaccactttccagtctgtgcaccattgcttgggaaatgacttgcccgacctcgtgagatttcacgccggaaacccccccggtgagaatcagatcaccctacctatcaaagtacccgagcttttactctggacgccagaggcagataccccctatctaggaggcaaatgcaacaaacatgcgcacgatcctgtggtacagctgattgattcttacaaacgccaactatgccatt

SEQ ID NO: 1779 - DNA, 170 bp, Myxococcus xanthus
gccgcgaccagggcgcggtcgaccttggccaagccctccagcgtgagcagggtttctttccccacacgcgctgaagtgcgcacagtgcacgggtgcgtcttgtgcctgccgcggaccaccactggctacacgagcgagtctgacttcgagatttgcgctcgggcctggga

SEQ ID NO: 1780 - DNA, 93 bp, Myxococcus xanthus
aaaggccaccgcggcgttaaatgcaatgagcgccccgaccgactgggtatctactttcaggaggcaggtggggacgattgtctagttgctggc

SEQ ID NO: 1781 - DNA, 471 bp, Myxococcus xanthus
gttctacgtgctctaaagctcagcgccaattgcgcgggcagatccgggggagcaccctaacccctgttgctagacgcaaccagcccgttgctccaacccatcagataggcgactgacggacgctacccgcgagaccgtcaccccgtcggccacctttggatgtagaaccagcaagcatgacctgagaaccacagctgcctttacatctggtccataccgagcacactaagcacggcggggggagacttgagtgcatcctacgtccgaagtgcggtccacaagctgaaggcccatgacaccatcagtgcccgcgggggccttggccacacgaggaccgggtgcgcctgatacgggttcggcagggtgctcaatcgctcttcatccacacgtggcagaggcggaaccggcgccttcttcaccagatggaggttgaccgcttgctgctcgatgaccactgtcgacatgatgaag

SEQ ID NO: 1782 - DNA, 91 bp, Myxococcus xanthus
ctaaagaaccgcggtaaacacaagacgcctgtaatcatggtcggggatggtgccctgctacaaaacgcactagtaccaggaactgtggacg

SEQ ID NO: 1783 - DNA, 181 bp, Myxococcus xanthus
gcacacctcgcgccgccagagctgacgccctccccggtcagatccgggctcctccatcatgcggaatccgatgacgtggttgacgccctcgggcagtaacgccaattctaacagtgccatggcccgcatgtgggccagaatgccagtgtgacactccccaaggagactgacttacaggcac

SEQ ID NO: 1784 - DNA, 598 bp, Myxococcus xanthus
  unsure (1)..(598): unsure at all n locations
agggggatgattacagatgctgtatacagacttaacgtggtttctagccggaacatattccactccttaaccctaaacctgtcgggacaggtaacggatatttgatctttggagaaatgaacagaggtcgcattccaacaaaataaacttagtcaaaaccacagtgaccaagctggctgaaatactgaaacttcaaatgacgattcatcatacagtttataatcatataccgcatagataagttgaaagataatataaggaagtaatactttcttcgccatcttccacatatatactttctttcggtatccttttgcagaatatccgcttattaaaataaacgctggcatatgaaaagtatggataaatatgtggagtgttcgtaaccactgttcatcattaatgaagggaggtaacaaatggccaaacactaccagtacaattaagataaatttacgttatcaaaatacgcatcccgcttagccatttgacttcctcctttcttttacgttctatggatttgtacgacgtgctgctgcgaatatctcttctttacatcccttactatacatagngaaaatgaaacaacagtgaaaac

SEQ ID NO: 1785 - DNA, 655 bp, Myxococcus xanthus
gtactgaccgactctagtgtttgccgtgtttttttatttgttaactgttcattgaatgcgccttagtgaatggacgaacgatattaatggaaccaaaattcagcctcttctatatttgaattaatttgaatcgcaagcgactatttttgctggcgctccgacaatgtataattttttacttcagcatgacaaagggaaaaaagagcactttcacactgtaaggatatgtatatcatgcggggcatcaatgccaggggaactacttacccattctgaacgtaagtttggggtcatggtagcagaaggctatggattatctgaggcttctcctgtgacgtgtttcaatccgattgatcgagagagaaaagcaggttctataggcacatctattatgaatgttgaaaataaagctgcaagacacctgcctaacagaagtagaagtaggacaagttggcgaacttatcgtgaaaggccctaatgtgatgaaagggtcttataagcttcctgaagatacagcatttgctctccgagatggttggctgtatacaggtgacttaccaagaatggataaggaaaggttatttttatatccctgacccgaaaaaaagatttaattatttgtcggaaggattttaaagtttattccccccccaaa

SEQ ID NO: 1786 - DNA, 348 bp, Myxococcus xanthus
acaccttggtctttatgggcctggggccctaccgggggacgccccacattattggcctttttccgggcattaccccggttaagggcgcccaggagaggcttggcccctccgaagggaagtttcccacccttattggcaagcctgccgacatgggggcccgttttgacacccaattggggcgggggttaaacaaacttaaagggggcccgggccttgggctccaaaagggcaaccaacttgttgggaaacactttttcggaaatcttcccaagggaggatttatcaagggccatcgcccccatgaccaaagccttccgacccggccggggggggaaccagaagcggggg

SEQ ID NO: 1787 - DNA, 74 bp, Myxococcus xanthus
gcttggccgccggggtcgactcggtgatgttttaagcgggggagatgttgtccgtggggacggagtcacccacc

SEQ ID NO: 1788 - DNA, 779 bp, Myxococcus xanthus
catattcattcatttaattaagatgattgtcgtaccgatcgtgatttcagcattaatcgtagcggtcgcaggagtaggcgatatcaaaaaattaggtaagcttggcggaaaaacaattctttattttgaaattgttacaaccattgcgattgtagtggggattattgccgcgaacttattccatcctggtgcaggggttgatatgggacatattgaaaaaagcgatatttctcaatatgaggcaacggcaaaaacgtctgaaagtacagggattgctcaggagcttcttcatattgttccgacaaacgtctttcagtcggtagcagaaggcgatcttttaccaatcattttattttccgtactgtttggtgtaggcgtagcttcgattggagagagaggaaaacctgttttagccttttttgaaggcgtcttggatgcaatgttttgggtaactaatttggtgatgaaatttgctccagtaggtgtatttgcacttattggtgttaatattataaagtttggtgtcggatcacttattccattaggaaaattagtgttcgccgtttacttcaccatgattttctttgtgcttgtggttcttggaattatcgctaaaatggctggaacaagcatgtttacgctgataaagtgttaaagacgactgctcttgtttacacggcagttagagccgttacattctatcaaaaatgaactcgtgtctaatcgtacatgtgtatcacagtccttactaatgtacattatagcctgctgtgtatgta

SEQ ID NO: 1789 - DNA, 515 bp, Myxococcus xanthus
cctgcagacgaaccggtgacatctaacctaagttgcgagagtctcaaagacaggtaaggggaggaaattcatctccaataaccgacaattacgtggggtatataccgatacaagctacacccacttcaatctcaccacggatgctatccagcgcgcgccctggtatgcacttaggggacgtgcgatgcctactggagagaacggtcagactcaggcacagaacccctgagcaacgcaggaggttataagtccgctatctgcacaactacaacggccgataccacccccatgagatagaagagcgctttcaccgggtcccgctgcaggggctgcatgacgaactcatgctcaacggacacctgacggggcgcaccacacagatggaaggactccatcccaagagctggcacgccgcgttgcttgaaaatgtcccacaggctcagggagtaccttatgcttcagctggaaagcgacacgcacaatgacgaactcaagggaccccctgagttgatgga

SEQ ID NO: 1790 - DNA, 690 bp, Myxococcus xanthus
ctctcaagtgtgaccagcttttcaacctaggctctaacgggaggatcgctgatactgctacttttgttttctagagatttttgtttaagaaactcttcaaactgattcttcggtatatttgaatccattgcttccttaacaagggccatccattctggaggaagcaacatatcatttttttcattaatatccattttatcccttctttcaacctttctaattataaatcaaattctgttgcaatataaccctcatacctatttttttacgttaatttaataaaattatcctaaactccctaaactattatgtcagtaaaacagacattattctagagaaaaaacgcatttttgtttctgataaagaacatttttttattttgttcgttattaaggtttaccaaccgaggatttttttgtataattaactcaaattttgtaatattaatccattttattcaggaggaccataatgcccttatcttattctttaaaacgaattaaaacacctttgcagttttttggtattacgctttataaatgcccaagcaccggctcttattactataaaagcagagcaaacaggcacttaaaaaaagtaaaataacacaataacgtgaatgaagttttctagttttatcatagaaagcttcgttcaactatttttacctagcaacaaatcatcgccttc

SEQ ID NO: 1791 - DNA, 330 bp, Myxococcus xanthus
gcatactcgcgctacatgaaggtgaactccccggggagaaggtggtgcacttcggaaatggcgaactgctgcacctctagccttctcagggagggcttaccatggtcggacggctgctgggcacctgacacgccatggcgccccaacagatccgcctagtacccattgggccagacacaagacatgtacgctctgggagtgctgcttcatcatctaagaagcggacgttatcctttccagtgcacaggaccgaattgagctggagcgcgtgcacttggagggactcgagcaccagcccagagccatcgaccacttgactggtgcggatga

SEQ ID NO: 1792 - DNA, 478 bp, Myxococcus xanthus
gtgctctcaggatacgattgccacgaacatgtcggtggacagcgccagcatgacgagctcccgctagtgggttctcctgaaggcacccgtgggcacagccgagtgggtctagtcgcacggcctgagggaagggctgccgatcaccggggacatccctacgcgcatggcctacaaccccagcttgctggccctggtggagggagtcctgttcacgctccgagacgaccagcatatgggctacaacctgggccagtacacatgctatgccgtctaatagacatcgctggaggtgacggtaaccctctacaacacggagaacatggacatgctgctcactgcttgacctgatggaaccgctgatgcaggagatcaccgtagacgagcacctctacctgctgtgcatgacggtcgtgggatgaaatcacacaattcagatacaccagacgtcctggtgattgacttaggcttttgcgaactg

SEQ ID NO: 1793 - DNA, 93 bp, Myxococcus xanthus
aggggggccgggcgccgccgcgcagaggcgggggccaccggttaggggaccgccggcgcggacgggggggagccggagggggggagccgggcc

SEQ ID NO: 1794 - DNA, 250 bp, Myxococcus xanthus
gacgagaggatggggctctggacgtccaccgcccaccagctgttgatgacgtgctaacagagacactacgtctccctgatgaccagttacgcggcggccaagaagaggtccaccaagctcggattgtgaaccatgaaggacttcatctcaactatcaggacgattagcatcgcgagctcacccatcacgatgagctcgtctctcaggtgcatgcattgttattgcacgtgctaagcgcctgtgttcacct

SEQ ID NO: 1795 - DNA, 742 bp, Myxococcus xanthus
agctctcaagatgaaagcaaccattgctacaattttaatgattgcaaaccaatattcagattctccaaatgatttgactgagaataagtttgttaaggttaatgcaaaggttaagattaagcttaaaagccaaattggtacggaagggagccattcatgaacaattgctcctcctgcattggcttcgattgcaattacaattagccagaaaaaccagtaaagccatccaacagcataacctgcccacggtccaattccttgctgagcatatgtcgagaatgaacctttatctggatttaccatagccatttcaccgagcatacgcattaatagaacgactaacagtccggttgctgcatatgaaactactgctgctgggcctgttgcgttaataacggatccgcttcctacaaacaagccggccccgataatacctgcaatggaaatcatggaaacgcgacggtgctttaactttccgcgtgattctgatttgattcccatcgtattcactcctttaagattatcgatagactattagaaaataaagtaaattctgaaaatataaatagaaattcctccccttacctttataataagcaagaagtgtgccaattatcaaattcctataaaaatcgactttaagttactaaaatcgacgcattttaagtcgaacaagactcgttttattgactatagacttattcgccatttgggatgtccagtatatacgtacattttatac

SEQ ID NO: 1796 - DNA, 627 bp, Myxococcus xanthus
ttctgatctagcttatgacttaattttaagatctcaccgtgagaatagctgcttgttttcttagctaattggtcaatatctgattgtaaggctcgaatttctttttctaactgtggttgcttcattgaaatcctctccaagtcagaatacttctatcttctatcttttatctaatagcatgaaattccttcatatttgtaaaatgttttttgttttgaaaaatatgaaataggtaaagagctgctgacaagctttgtcgaacactttttttacctattttcaacaaatatgatatactaaggctaggaaaaatgacaatccggagcgcacgttcagttattcttaacaagcgaatgaattcttagctttgacaagtttaacttgtaaggtgaagaaattcatcacataatcttattagatctgaaccttgttagccccgatgaggatttgtcgaaaacgattcactagaaaaaaccttcgagaccgccaagctcgaggctcttttatttttgtgtatgggaagtaaaaaaaacacatagactaatcaagaaaaaggtcctgcacccataatcggccgcagttgattacaccttgtccatttctgcaaggaaagctgtctttttacta

SEQ ID NO: 1797 - DNA, 336 bp, Myxococcus xanthus
gcttcaccgacggatagtcctgaaccagaatgcagaagtgactcatggatgacttcttatcttttggccggacggctgccagagaaatgaggctgctcaacgccggcctgtcctcctcctccttcagcatctgtctgatgcacgtgtactgatcatggagaaacgaatcactctccttactaatattgcgcctccatgagccaggtacacacgcctgcatggcatagcggatggcccggtgcaccacccacttggacaccccagtattagtgaaggcgcggttaaaaacctgcacgaagcccacctgaaacggcccattgtccaattcacgaggtt

SEQ ID NO: 1798 - DNA, 518 bp, Myxococcus xanthus
gtgctctcaagaagcgctgctccgcgtccgccgcatccgcggtcagaccgaagccctggagcgtgcgttggagtccggagccgaatgcggaacggtcctccagcaactggctgccatccggggcgccatcaacggactgatgtccgaggtgctggagtcacacatccgggaggagttcggcccggcgtccgacgaggatccgcgccacgcccagcgggtgcgggacatgacgacgctggtccgcacctatctcaagtgagcgggagtccctgccttcatcccctagccccaggagcatcctcatgaagtcccgtgccgctgttgccttcgaagccggaaagcccttgagcatcgtcgaactcgacgtcgcgcctccgcagaagggcgaggtcctggtccgcatcacccacacgggcgtctgtcacaccgacgcgttcaccctctccggggatgatccggaaggtctcttccctgtggtgctcggccacaaaggggccggcgtggtggaggcggtgggc

SEQ ID NO: 1799 - DNA, 392 bp, Myxococcus xanthus
  unsure (1)..(392): unsure at all n locations
ccatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1800 - DNA, 74 bp, Myxococcus xanthus
ctctcaagagcccctgcaggacgggccttgctgaccctcccagtgggcagaccgacgtctgagctactaaactg

SEQ ID NO: 1801 - DNA, 742 bp, Myxococcus xanthus
ttcctgtcggagcgacgcttggaatgggatttgagcgcggagggatacatgagcgaatcagcacatacctgggcctagaaattgaaaagatttctcttgagaaaatcatgaaagttcatcttccacatcgtacactaatttattatcaagaccggtatcagcatatttcgtatattcaaaaacaatttcctcataaagcgaagaatattaggagcttctatgaaagtgtttttagagttgcaaaagaaattcgcaagctcatgcggccgctgccggttcttcctcctctcacaatcggtgagtggagtaggctggtaagttcgttaaatcttgggtctgtgaagttattaccttattttcatcgatcgtttagtcatttactaaaaaaacacaggttgctagacgaaacggactttattcattttattgatggtcaattaatagacagcatgcagacaacgagtgagaactgttcaatgcttatcggatgtctagcgttggatatttatcacgaaggagctttctatgtgaacggtggcttatacaaagtcgcagaagccctgcaaaaatctattaaagccaacggaggaaaaacgactctaggaaggaaagtagtaaagatagagcgtgataacgacgagtggatcgtgcatgatcatagaggtaaccgctaccgcgcttcagacgttgtatgcaacgcgccaattcaaagcttaaagtctttactgcatgatgaagatta

SEQ ID NO: 1802 - DNA, 86 bp, Myxococcus xanthus
  unsure (1)..(86): unsure at all n locations
acccccctccgcctccgcaacccaccgccaccagagtnctgcggaccgggggcgaaatatcttttaggaaagattgtccacaaaaa

SEQ ID NO: 1803 - DNA, 137 bp, Myxococcus xanthus
gggcctgcgccgagaactactactgcgtccaccggggggcgcacctggaacccaacgggagcttgaacacctgccggcggaccacgacaacaaacacgcgcgagggcaagaacaccaactggaacgagacgcacccc

SEQ ID NO: 1804 - DNA, 488 bp, Myxococcus xanthus
tgtggacaatctggtccagctagagggggcctcggtgggcaacctcctgatggtggtgacaggccatcgacctgttcgatcaaggcggccttctggacctccccacgctggtaggcgaaaacgccttgcgtagcaccagcgagcacatgggcacgaacgactactccttccgcgtgggggcttgatgccatgaccgaacgatgacgctcttggccttggacttctttccggatatgatgcccgggctgctggttggcacgatgctcccggtctgcgactggagcgcccacatggtggcggtgccacccatccaggggatgaccgaccagccgatgatgcccaaccactgccccaagaacctgtaggggtctcaccggtgctacaacatgcggtaccggaccatcctgaagtcgttcaatcccacctggtaccagaggaactacttggagccttgcttgactgcctggacggacaggtggatggatcca

SEQ ID NO: 1805 - DNA, 178 bp, Myxococcus xanthus
acacgtggtctaaagagcttgaactgctatgagtgcctgcgcctagggggctcatgcgcgcggacgccttcctgatcttgctgcaccatccgcgcggaagccgtacccttgagcagacaccgccgcgaagccccacttcataagaaacagcagcccccgaccgaccagatggaacacc

SEQ ID NO: 1806 - DNA, 793 bp, Myxococcus xanthus
cgctctaaagctttagaccatgtaaaacagggaagcgagctctccaaataccgaagagagcatagcgccagccgcggcgtactcaattccataaggtaaaaatgcttttgtacagacagcaattaacgtaattcgcaccacttgttcaataatttgagaataagcagcgggcttcatttgctgctttccttgaaaatatccgcgaatgacagacgacacggcgatgatcggaataacaggaataatcgcaagcagcggatagatcgtacgtgaatctgtaaagaaggtttttgctacaacgggagcgaataatattagtccgagcgtaaataaaacgctcagcgtacacgtaatacttaaagagacgacaagtattttttttattttatgcctgtcacctaaagcttctgcttctgccactaacttggatatggcaaccggtagcccaagctgtgttaaggtgattactaataccagcgtggggaccgccatcatataaagtcccacaccttcgtctccaatcattcgagccaccacaattcgattgacaaacccgagtacacgtgtaattaagccagcaattattaaaataatagttccctgtaaaaatttagacatatactcactgctttcttgaggtttatacagtgaatatatgcgccgtcggtgtccaagcatgacaagtattcctcatacgagaaagaaattttacgcaaaatgtcaaacggaaaggaggatcaatatgacacatccatttatttcagcttcgaaagaacttatacagcctgtcgta

SEQ ID NO: 1807 - DNA, 117 bp, Myxococcus xanthus
gaacgttgagggaagattcctctcactaaataggagaatgaacctcacgacacacttgcagaattctgtcagtccttgtccaatactgagtcagtgacctacatgatgtacacggac

SEQ ID NO: 1808 - DNA, 493 bp, Myxococcus xanthus
gaagcccgccccggtgtgacttcagcggcggtaggggcctctgcaggcgggcctggacgcccaaccgcacgcacttagggtagggaccgccagcacgctactctaatctcttgagcggcatgagccgggtcacccggaagagaacggcggccggacctttgagccgacttagaatgttcatgtggacgctgtctccggagactgggtccgacaggataaaaaggggtcgcgcaagcacttattcgtaaccctgtacaggatgctaagtgtatggaaagtctgatacaccgattatcacatacgcgaatgtagccatcagagaaaggttgtgccttcccaccaccagcgggtccgccaacgggaagccttctgacaaccaggctctggtgatcatgtgcacgacgatggccagcgtgcaggtcaggtgcatcaaccgcatgccgagcggtgaagggataccatcctattagaggaccagcctacgggggtcggt

SEQ ID NO: 1809 - DNA, 516 bp, Myxococcus xanthus
ataactgaacaaaatcaggtacagtaaatgtactaacaagctgatttaaaagcgtcattttttcttttgtattttcactgtcacccattaattctttaatgggagaagtatctacgttgtgcagcgcattgtaaagcgatgcgcctaaaaagcctacaacggctgaaacagcagcagtggcgacaaacacaacggcgatacctagcataattttaccaagacgtttcattccgttcatgtttgcgagcgccgaagccacactaaaaaagacaaggggaacgataatcatgaacattaaattaagaaacaaatcaccaaagggctttacgactgccacatcgggcccgatagcatatcctgctatccccccaattaaaatagcgagaagcagaataagcgatgatctgtacgttttaaatacacttaaaaccatatagatttcctcccaacaacaataagcttctttactacgcaagaacagctatcatttgctcattgcatacgtagtaacgactg

SEQ ID NO: 1810 - DNA, 613 bp, Myxococcus xanthus
accagttactcgaactgagcgcgctcagttataataaagaaaagccgttattttctagaataacggcttttttcattttttgttccgccaagcatatttttgggatacacgcataaacagatagatatggaaaactttagttctgaatggtacaatcaacactgttatatctctatgaaaaacctaaattgatagtcttaccgttaagaaggtgttcatccattatgatcaataaaaaaataaagcgtgaaattcttacatacacaagcgtcatcctcggcaccgttttgctttctgttgtcgttcagcactattggtttcagccctacactgtaaaaggcgattctatgaagcctattttgcacgaaggcaatcgaattattattaacaaacacagcaagctggagcgctttgatattgtcgtgttacaagctccctatagcagtgattttctagtaaagcggattgtgggcttaccaggagaaacggtcgaatacaaagatgatgttctgtatataaataacaaagtcaaaaaagagccgcatcttcataaatatttatccaaagtgcccgtttacgagcgatttactgaaaacttttccacgtacgaact

SEQ ID NO: 1811 - DNA, 657 bp, Myxococcus xanthus
cctttttcaccgttgtccgcgacaagaagcaaacgtgtaccttcgtaatctttaaatgctaatgtatcacgattagctcgtttagctatttcttcatattccactccgtgctgctcgaagcgttctttccaaaagtgtagagaatccgtacttttaacgcgaagcgacacagtcgaaatgtcagatgcaccttcatgtgttcttgcaagccctggaatatcaaaaaacgttacttccgttcctggggtcccttctccatctgcataaaataagtggtaagactgagtgttatcttgattcaccgttttttttactaatcgcatgcctaaaactttagtgaaaaactgatagtttttctcagctttccccgtcagaatagatacatgatgcaaccctaacaattccatctgatccgcctcttttcataatatataaattttttaacttcctttaaaattatctttaatttaattatctttaattaaagataattttaaaggatatacagcctgtttgtcaataacaagaaaagtactgtggacataaaaaaagaaactaaaaacatattcagtttctttttggatttaagctaccgaatagatcattcttttaactagcccttactttttaagcgcgcgctgcacattttgtttcatc

SEQ ID NO: 1812 - DNA, 345 bp, Myxococcus xanthus
  unsure (1)..(345): unsure at all n locations
cgtgctctaaaggcgcacacagcaaagggagcccagatgcacgtcgtcggggcctgccacctgcacgaccggggcgaggcggaagatcaagcctgggtccatgattacgaccgcgcgcccagttcgggacaggcccggacttaaatgcgctaggtctgtcaccacaggagcctgaacgtgaggaagggctggccgncaccgcctgtgagacggggacgctcgactcaaagcatctgaagaaccttgcctgggactgacaacgcgaggacattagctccacccgcactgggcagggacggcccaacccgggggacagctgtgccgacatcaccacgaggacgactc

SEQ ID NO: 1813 - DNA, 112 bp, Myxococcus xanthus
cgccgctagatcctgcccttccccacacctgtggagagcgagcttttgtcacgcggggcttaccggcgccgcactcaacccgtcgctttagctggccgagagggcaccctct

SEQ ID NO: 1814 - DNA, 431 bp, Myxococcus xanthus
aacccccccctgctccggatgacagagaccctacgatggctgttacactggtcggcggagggacacgccaccaccggagctgggggccacccgcattctggcagagggtaaacctgtcagcggcctggggtcgaccggcccacggggtcgactgccgcccggcatgagcttcgtgcactgcaccggctaggcgtcgcctccgagggggtcccctcggggccctggactatcgctgcaggcgggcctgcgcctatacacccattagagcctgggggtgactgcgactatgccccccccggtgcaacgcctgggcctgggacaccttccgggcttccggcgtggcccccctccgttcggaaggatcgtatgacaccaaacctcagaactgacgcgccgccgatgcgggcttgcccattgaacgacctttcccc

SEQ ID NO: 1815 - DNA, 490 bp, Myxococcus xanthus
cgcatgagatccctgacgattcacacgccaaagacgtgattagggcagggctattaatacagatcacatgcgcatatccagtgtgatagctgacatcaagtgctggttggaagagcctgcccacgttgctttcagagtggaggtgaatactaatataacaatctagcgactactatacttatctggatgaccacacctattttaagccgacggtcattggatggatcccccaagaaatgatgtataagaaacgaatgtgtgcacttctattctattagacgaccattacgctagaactgcaagtctgacagaccgtttcgaataccgttggggacactgtaataacgaaggcgaatacgtcaattcgatttcctttaattgcgccacccgtatctgccgctacagcttgaccataaccttcaacgtatacttttgaacctaatggaataacgctaggatcaaccgcaattactcgttgatttggatttga

SEQ ID NO: 1816 - DNA, 290 bp, Myxococcus xanthus
  unsure (1)..(290): unsure at all n locations
ctctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1817 - DNA, 584 bp, Myxococcus xanthus
ggatgcgattcttgcgcagatggacggagacggctcccacggccacctggctgatgacggtgcccaggtgcgtgagcgtggcgaaggccgccgcgtcctccggcgaggccccgaggctgcgggccgcccagctcgtcacgaagtagtagatgcccatgcccgcggggacacccgggagcgactgccccagggagatggcccccagcaccaccgccccggcgaagagtccgccggagatgccgatgccgtggagtgccaggccgtaggccagcgcggaggccagcactggcgccaccgagaagacgaacaccttcgccatgcccgtgaaggagcgcgcggtgcccaggccctcgctgacgtggtggaggaagccctccaccctcgggagcttgtggcgacggtggagggcgaaggcgagcggaccggaccagtgcgctagaaacaccaccagcgcaacaagccccacacagagtaacacgggaactttcagctccccctcgaagcgggacagcgtacggcccgaggggcccagcaacgacagcatgacaagcagcatcagcgctgcgaactccatcagcttgcag

SEQ ID NO: 1818 - DNA, 517 bp, Myxococcus xanthus
gcgctctcaaggagtccagggggaacggaggctgaggcaactagcctgagtactaccgacctggagcatcaacagccttgtgcggtgcacgaaccagttgtattgccgcgacaacttccacctggtgattctccccaaggtgatcgatggtacaccctataatgcgcaccaagggcagcacaaccacctaatgatgcgatgcttatactgtctttggcatcagctgtacccgccaaggcggcaatctgctgatacgatagtcgatgctcatataatccaccaacagtttcttccaatgctttacggacttggaacaccaacgctcattctttatgacgatcgagtctatccaaataacgaaacagcccttcatgaagtaggttataaacaggtaccacaaagctgccctccatgcacttcaatttagcgcaggctgtctatgacacctcgaccgcaaagggcaatggcatctgctttccgatatgctctacggggaataacaccggcacccgaatgc

SEQ ID NO: 1819 - DNA, 779 bp, Myxococcus xanthus
cgttctcatttacacagagttttgacaactttttgaaggattttgtcaacaaattttaataatccagaagaaatcacttctcattcagctgcccgaagactgccggaagtgcagaaataacgtcacttgctaacatatctatcattgtatgcccctgatcgagcagcacatccgctgcttttccatgaacatataccgcattgctgattgcttcttgaagagaatcattctgcataataaaagcgaggatgattccggttaacgtgtcacccgttccaccttttgcaagtcctgcgtttccagtggtatttacgtattgttttccatccggcgttgtaacgatcgtgtttgggccttttaatacaagatacacaccattttccactgcgtattggctagatatcgaaaatcgatttgcttctacttctgcgattgttgtatccacgagtctagccatttctccgggatgaggtgttaaaatcgttgcgtgttctctttcttttacttctttcatcaaatccggcagatgaaaaagagcatctgcgtcgattacaacagaaacgggctgttgaagtacttgttcgacaactttctttgtttcttccgttctcccaagccctggtccaactgcaattgcatcgtactttgcttcttctaaaagaatctcccctgcaaaaaagccatctttgcttgggcatggcttatacatcacttctaacatgtgagcagctgcaatcgcatgaatatcattcggaagcgcaaagcgtaagagccctgct

SEQ ID NO: 1820 - DNA, 746 bp, Myxococcus xanthus
  unsure (1)..(746): unsure at all n locations
cctttgacaaaatatcggatcatgacctttgatggagggggtactttaggtgctttaagtttacaacttttgaatagattggcttatcaaaatcccaagttaattagtgaaactaatgttttttcgggaaattccattggttcattcactgctcttgcactagcaagcggaagatcaccagaggagacgtttcagtttttcaaagatcaaatcttaccagcgttcagcgtttcccgaccgggcggacctgtttttaatcaacaattaccctattctggttttattaaagccatacgaacgtttttcccccgagaccttcgtcttagagacttaaagaaacgaattgttgtgccatccttccacttattttcaccagagctgaatcgttggaatcctgtgttatttcataacttcccaggttctccttatcttaatgaaaaagcgagtgacgtaatacttaggagcagcggtgctcccgcgacgcaaagagcttatcaaaactacgtagatggttatacagtagcaactaacaccagtacagctagtatcgcatttgcagtgggaaaagcaaagcagccgctggatcaaattgccgtattatccatcggcacaggtgaacagccaactcaattaagaagagatacgaagggatggggaatgggtagtgccgantacatacgaccagaagatatggaggacctgccgccanantgnggtgtacttttagaccggtctcctaatgaacc

SEQ ID NO: 1821 - DNA, 433 bp, Myxococcus xanthus
gctgggcggaaggatatttaacagctttctttcattcgatgcacacgccagaatggctgcacggaattcttgtactaggactgtttcgcggtacggcagggcttattagcctcatgctgcctcctgtggctatatctatcccggggtttgcccttctagaaaactacggttacttgcctggcgtcgggtttaatatggatcgtttgttcaagcgagcaggcgcacacggcaagcagtccctgaccatggcgatggggtttggatgtaacgccccaccgattatgtcaacacgtattattgaatcgccgcgtgaacgtatgatggcgattttaacaaataactttgttccctgtaaccggcagatggcctaccctgattttgttagcttctttattaatggcaacaggctttacagggagtgctaaaacattcg

SEQ ID NO: 1822 - DNA, 162 bp, Myxococcus xanthus
ataccatcctcatgtgctctaaggggatagcgacgaccttctgagacccggatgactaccccgttttgacacttttgcctggccctttctcccgggggggcaccccgcatgtgatggcccaggcacttcatcctctgaacaactgtttcttatacggctcat

SEQ ID NO: 1823 - DNA, 511 bp, Myxococcus xanthus
cgtgctctaaggagtgggactttacagtggtgctcaagctgtggttgcacctgcgcgagggcacagagccaggggacgatccatccgccgcacgtaggccaggacatcctgccgtgctttgtgccgcagcgcaaaaggcgttacgtgcagggcctgctcgagcagaccgtgcgggaactgcgcgtgacactcacagggcagagaccgacatggccaggagacaccctgaaccaggggcttgacccgggctcatttgacgtatcgccatgaacctgcggagcatcccttttttactgggggtaatgagacgccctttattgttgacccttccaggggaatcgcaaaacacccacctgagggcgtgatcgcgttacatgtgcatgacactcgccagctgatccggcccacccaacggaatctccaaccggaacggctcgcaggtgggccacaccaccttcttaagcgctgacaccccgaacccgactggccggggaagtgcgcgcacgccatg

SEQ ID NO: 1824 - DNA, 263 bp, Myxococcus xanthus
agccaaggtggggtccagctggcggtgatcgcgctcacgaagagctctaccgcgtcgagaggctcgtgccaggcgcgggggcgcagactgcggcttgaagggatgggttgctgaccgtgtatgacctggacctctgactggccgccttggcaggcctgctgaacgtggattcctcttccagcgctacggacctgctctgggtggtcacggcgctgttagccagggcgctctgcccccttaccacggtcgagggtacgaactgg

SEQ ID NO: 1825 - DNA, 58 bp, Myxococcus xanthus
aaaggcacgcccggggacacccacggtgtgttcgtgttcagccacaccgtgagcatct

SEQ ID NO: 1826 - DNA, 397 bp, Myxococcus xanthus
accttgccagcttcaacttaagattcgccaaggggcggttttgcttattcttatgggacgtaacattgccgaaaaggtttgggaacaacttccggaataccctcccccggccaaaaaaggtacccccaaacttggcctttttttccacattttccaagggggacttgaccgaaaaaacaaagggttcggggggggccggttccttcttaaaaaggggggggttcaaaccctgcttcggcggggcaatggttttaattggcccccccgccttaagaatcccccccgccgggccccccccggttggggcccccgcgggggggccaacccccccgccggttcctccggcccttgcccccgcgggaacggggggcctaaaacccgcgccaaccacgggggg

SEQ ID NO: 1827 - DNA, 765 bp, Myxococcus xanthus
  unsure (1)..(765): unsure at all n locations
tcaaattactaacattgatccattaacagatgagcagaagtcggtggaagagtgaacggtttctgagaggttatgaataaccgctagttcctttggagctagcggttgttgtggttggagcgacttttccttttttttgtagagtggtagcggctatttgtgagtctttcattgattatgttcatgcttcttccagtagaagtatggtagtatcgaacatgtataaaatataggttgtaacataagtaaaaggaggtgctatgatgaaaaaacgcacaaaaatagttagtgcagtcattgctggagctactattttaataggaggtatatggatgataaatgaaacccgttatccaaacgtccccgcttttaatgatcactttacacgagaattcttaaataaaggcaaaaaagcagataacgagttttacgagtttaagtcaaagacagggcagtatacgatgtggtttccagaggagtatcagttagttcatgaaaacaaagaagattatgctataaacggtcagttttatgagcgatgggtggcttcttccgaaaatttctttaacaataaaaatgaaatttcatacatgaacgtagaactggcagagaaggtaaaagaaaatgaggaggtaaatgtagagagtctgttcaaaaagaacctacatgtgaatcaaccaaaaaagatagaaacagcgcatatcagtatatattacgattcagcatatacatattntaaaggaactgaagaaaaagtttaaagaa

SEQ ID NO: 1828 - DNA, 126 bp, Myxococcus xanthus
ctgatttacgccgccgccaccactgaaggttccggtccggactggagccggaggtgtctcctgaagaaggcagactgacgagcaagagctccgctggcacctggcccagggcgcggggcttccgcc

SEQ ID NO: 1829 - DNA, 735 bp, Myxococcus xanthus
  unsure (1)..(735): unsure at all n locations
tcgcgctaaataggtggtgtttgctcctatcgattttagcacgccaaactgattcattttttgaagcgtcatcacatagaagaaaacggctaagacaaaagctccaatgataaacagaaacgcgaccatcattaaaagtgagccctgttcttcttgataacccggaattccttttaacgcttcatccttactgattacatcgatttcagcttcttttttttgaagagtctgtgcttgctggctgttcatattcaatacgactgcattaaaagcacctgtgctttcaattgtcttccactctgtaagattgatatgaataacaggcgcgtgactaaacgactgattttttgtaaaaccaacaattgtaaagctttttcctgaagccgtatcttttatcgtatcacctagctttactccttcttcttttagcgaagagtccgccacggcttcatgtttcgcatcgtccgtaatcatcttcccttccgttatgttcggagctaaaaagccgcttgtgcttatggcaaaaaacgaggcgtctatttttttcgcttttccttcatttataacggctgtcatcatcacaccaagcggctcagcttttttctttccgcttagttgntgaatatcttctgttttggttggtgataaaacagagcgcgtcaggcgctgatccgcttctttttgaagcgcaacgtaatttcctttcatttcttgaacagctgaagcattgtcaga

SEQ ID NO: 1830 - DNA, 298 bp, Myxococcus xanthus
ggcggaaggggggctggatacaccgcccagagcaacctgctggatgtggtgcaatgactgctgggcttgcaacatcctgccttggctatactctcaggctctctccctgtacatggacagaccatggccaatagaggacccctgctggcggcggatgattccctcatatgtcgacagcccatatgataacccctcatgaagcaccctcatattgaaggatgggaagactgctccgacggacaacatggcgctgacaataccactgagctgcgtgaccacgctctctcactggaccttg

SEQ ID NO: 1831 - DNA, 184 bp, Myxococcus xanthus
attgcctcgaatctcgcaacgttcctggcaagcccgcaacgcagctggtcgcccgacccgactacacctgtccatcgcctagggactattgcaaacccactgatacggcctccagccccttagtaccctggggcaaggcagagtcttcacatttaacctgcctttccttgaaggctaagaggtc

SEQ ID NO: 1832 - DNA, 96 bp, Myxococcus xanthus
agacacaacgttgggggtccagggccatgcccggggttgccaggacgagtcccacgacgaagaaccacccgatgaacccccgcccgagagcgcggg

SEQ ID NO: 1833 - DNA, 661 bp, Myxococcus xanthus
ctactcaaacaaatccagtatttattggtaaaccagaaagtattattatggagcaagcccttgaagtcatcggtacgccaaaagaagaaacaatcatgattggtgattactatgatacagatattttagcagggatgaatgcaggcttagatacattattagtccatacaggggtaacaacaagagagttactagaaggatatgagaaaaagccaacttatacggtagattcactaaaagagtggatggagcgaatttaaaaagctgtcaattgacagctttttttgtttttaaaacctattcttgactggcagcccgatgcgctaaccggctagaagcagcggcagcaattgcgcctactaaatcatctaagaaagtgtggcactctccagtagatttatcgtttaatctttctaaaatacccggcttttgtttatcaatatacccgtaattggtaaagccgattgatccgtacacatttacaatcgataatgctaaaatttcgtcgataccgtataaaccttcatctttctcaagaatatccaacagaggcggctcaatcacttttttttccgtgaggacatctagttgaatacccgttaaaatagcattttgaacttctcgtttagaaatgacgcgctcaacgttatataaacagtct

SEQ ID NO: 1834 - DNA, 462 bp, Myxococcus xanthus
atctgcggtgacgtaaccgagggccctggaggatggccatgggtggagagcgttttcccgacattctgaacaacggtttgggggtgccctccggacggaaggcgatggagaccggcgcgccgatcatctcctcgatttgccacttcgcggctaaaccctggagggaacgcgggcacggtatggcgctaggcgaggaaccctggctgcgaatgcactggtcgtccggcggtccaatggcgagtaaggggggacaccttgcttcgaggggaagtggggaccaaggacatgagcctgcctggcggtgaactatcccggtggatcaggccctaccgaggccgtggccttaccaaccctcctgctgacggtggtttaaggcatgggctggcagctgggggtgatcagcgtccaggaaccgttaagcggactgggccccgtctaaggggaagaggtgaacagccccga

SEQ ID NO: 1835 - DNA, 85 bp, Myxococcus xanthus
ccccccaagaccaataacggggtatacctgggcccccggttgaaggaacggaacggcccccgcttcggcggccggattaaggcca

SEQ ID NO: 1836 - DNA, 299 bp, Myxococcus xanthus
gtccaccggctctggctgggaccgcgtgacggagatcagccttcactggtaccatacccaaagctaccaaacggggctgtggctggcccaacggcttgacctacccgccgaagggtgaaccgagtattatcgcttgcaagtggtccggacgacatgggataacacgctcatctacatggatgagcggagtcgctaaaagctggaagccctggcgatagagccactcgtcgcaaatgaatctgacactggaggaaattggcctaatcccgcgggaccatgtcctgaagagcgcatgctag

SEQ ID NO: 1837 - DNA, 222 bp, Myxococcus xanthus
ccctttagcttggagatgaccaccttgaagccctgggtattgagcatggtcatgtaaatcttgaacccccggacgctggagaagcccttcctggccttcaagtgggcaacggcccaaggggctacccttccggccgccaatgaagggaaccacaacaaccggccattcaagtcctttggccttgtgattgttgagaagttcacccccccaagggtggttgca

SEQ ID NO: 1838 - DNA, 594 bp, Myxococcus xanthus
gagccgatgggcttgctgaactagcggggaccaatgacgtgacgatcacgatgcctcttgctggacagcctgctaatagagtgggcctcgtgaccagggtcctatatcggcagaacacgaggcgtatcatcgatatgagttccatttcacacgatagcatcaaaagagattgccgctgaacttgcacaaaaaggaattctcatgctagaccctccggttagcggtggagagccaaaagcaattgacggcacgcttgcgattatggttgggggaaatgaacatatctttgaaagcgtttcatccattcttcatgcgatgggagcagaagtaacgcttgttggagacaatggaagcggcgtaacggcgaagcttgcgaaccaagtgattgtaaacttaaatatcgcagcaatgtctgaagcacttgtattagcagctaaagcaggcattgacgttgaaaaaatgtatcaagcgattcggggcggattagcaggaagcgctgtattagatgcaaaagtaccgcttattttagaccgcaactttgtagcaggcggacgtattgatattaacctaaaagatatgacaaacgtgatggaa

SEQ ID NO: 1839 - DNA, 680 bp, Myxococcus xanthus
  unsure (1)..(680): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1840 - DNA, 416 bp, Myxococcus xanthus
ctctcaaggaacgtcgctaatgaagaacatggttgctgtaggcgcttcaagtgctgtgcttcatattgacacagaagtatttgaagaagtagtgcttgaaatcttcggtaaaaagggccaaaaagttgtacaaaaaaacatggaagctattaaaaaaggtgcagattacattcgtgaacagctaggcgaacaattagaaacaatgaaactagatccagcggatggtaaaaaacgtatgtttatgattggaaacgatgcgattgcactaggtgctttagccggtggggctcgttttatgccagcatatccaattacccctgcttcagaaatcatggaatacttaattaaaaagcttcctcaattcggtggaactgttattcaaacacttctgctccttcagcttaagatcagcgcag

SEQ ID NO: 1841 - DNA, 356 bp, Myxococcus xanthus
ctctcaagtcacctacatctttgccttctaaataatcgtcgatttgctcatacgttacgccaagcgcttcttcatctggaagctgtggacgatcttcttccaaatcagccgttggttttttcatatatagatgctcgggacagcctaattcttttagcatttgttttccttgtcgcttgtttagacggaagataggcactaagtcagctcctccgtcaccaaattttgtataaaatcctgtaacagcttcagcggagtgatccgttccaagtacgactccactgtacatgcctgctaccgtatattgcgcaatcattcgttcacgtgcttttacatttcgatggaacaccccggga

SEQ ID NO: 1842 - DNA, 128 bp, Myxococcus xanthus
aattctagtgtgctctaaagacagtcccgcgcaacagcacaccccctgagggcgtccactatcttcatggacagcttcttggccatcatggcactttatttcagcacgttcgaaagcctgatgatcaa

SEQ ID NO: 1843 - DNA, 652 bp, Myxococcus xanthus
  unsure (1)..(652): unsure at all n locations
gtgctctaagttggattatccaacacctatttttctattttatcatattctatagtaatcgctttttaatgaatccatgttaattcaggaatgtgataacgagacgttgaaatgcctaccgactggtaaaagcgcttcagaaaagcttcgtagtgagaagaatgagctaatactccttcaagcttctcataatacttttgtttttcccgctcatcttgtacactgtagtatccttcaatgacctcaaaataatgaacgggaaaaagaagtctagcatataacagtctccatgaaaaagaagaaagtggatttaccttttcgtattcacttaaaaactgatgcatgtgcctttcatcgacagcgtatgttaataaatattgttcccttatatattcagctatatctctgctagggtgatcgaaaacccagtctgccgggagcttgtaaacgtggtcttccccccatgttttttggccgaaccgatgatgacaaatcgtcgcagcgtcaactgaccggggcaaatcgtcaatttccgtgtctactaggtattgaatagcattttccgttaatcctaggtaataaggaaaagtttctaaaaaacgtttttccatctcttgattangtaaagcacgtaatcttccataccaaaatt

SEQ ID NO: 1844 - DNA, 154 bp, Myxococcus xanthus
cagtgtgctctaaaggacatggacgtgttctatgacgtgaggaagatgctgactcccatggtgtgcgccagctcttgggtcaacgcgggaaactggttcatccacttgtacatggacgtgacggacgacttcgagaacgtaagtctgaaggaca

SEQ ID NO: 1845 - DNA, 107 bp, Myxococcus xanthus
tggaacgcttccttgaaccatttccagcccgcgggcggaagtttctggatgctgcccaagggcaaccgttcccccgccgtaaccgaggcctgcaaaaacacgggggt

SEQ ID NO: 1846 - DNA, 55 bp, Myxococcus xanthus
ctctaaaggcgctcgaggtcatgtacagcctgttccgcaaggacctcctgtccga

SEQ ID NO: 1847 - DNA, 658 bp, Myxococcus xanthus
  unsure (1)..(658): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1848 - DNA, 267 bp, Myxococcus xanthus
tttggtggacgaaactccccaggtgaaagggcaggggctgtgcgcgcaccctggactaccaaggtagcgtggggcttctggtcttcaagagcgtggcagtcctgccggtggagctccgagacgccatcatgattacctccaccacctcccagactccctcctggagcatggacacgtccaaggtgatgacgggcgagatgatgcgcctgaccaggggctcggactcagcgaagaacagctcgtagacggcgaacctctggtacagct

SEQ ID NO: 1849 - DNA, 59 bp, Myxococcus xanthus
ccttgcgctcgaccttggtgggtaccttctacaccgtattgacgtgatgggtgaggccc

SEQ ID NO: 1850 - DNA, 1023 bp, Myxococcus xanthus
cgtgaggagaagctaaaacgcacagctgacgtatggattacatcttacccaacgctgcgtcaagatatcgatttgtatcagcatcttcattttcatgctttaattctagatgaggctcagagtattaaaaatcatacaacgaagacagcagtagctgttaggactatttcagctaaaaaacgttttgcgcttagcggtacgcctattgaaaactcacttgatgagctttggtcaattttccagaccattcttcctggcttatttccagggcttcgccagtttaaaaacatgtcatcggagcaggtcagccgaattgtaagaccatttttactgcgacgagtaaaaaaggatgtgttaaaagaactgcctgataaaattgaaaccactcatttatctgagctgactaaagaacaaaaagagttgtatgtaggctatttagagcagttaaaatcatctttagccggtgaagattttaataaaaaccgaatgaagatcttggcgggattaacaagacttcgccagatttgctgtcatccgtccctattcgttgaaaattacgaaggggattcaagcaaattagagcagctgctggagattacaagaaatgcggttgccaatggaaaacgcttgttaatcttttctcagtttacaagcatgcttcatattattcgagaagagcttcaaaaagaaaatctctcgtacttttatttagacggtcaaacgccatcaaaagaacgagtggaaatggcggatcggtttaataatggagaacaagacattttcttaatttcattaaaagccggaggcacgggtttaaatttaacgggagccgatacggttattttatatgacttatggtggaaccccgcgattgaagaacaagcggcaggccgtgcacaccgcattggacaaaaaaatgtggtgcaggtcatcaagcttatttctcaaggaaccatcgaagaaaaaatttacgccttgcagcaaaagaaaaaagaactcattgaacaggttattcagccggga

SEQ ID NO: 1851 - DNA, 447 bp, Myxococcus xanthus
ccgttcgcgtccatcgacatcgacgatgcgacggttccgtcggcggcgcctgggctgcctcggcccgtggggagcgacccgttcgcgtccatcgacatccatgcggcggtgcccgcgaagtccccgagggctgcctcaccttcggtaggaagcgatcctctcgcggcggcagacatccatgcctccgggcctgcgaagtccacgaaggccgcggcaccttcagtaggaagcagtcctctcgctgcggccgacattcatgccgccgggcctgcgaagtccacgtcgccttcatcggggaatggtcctctcgccgcgttcgacctacatgcgtcgtcgccagccgctgcgggcagtaacgaccccttcgccgccatcgacttgcgggcacctgccgcgtcgacccggaaggcagcgccgccgcctgccggaagcaacccgtttgcatcc

SEQ ID NO: 1852 - DNA, 828 bp, Myxococcus xanthus
ctcaccgtggacgccgacaaggcgggccagcgggtggacctcttcattggtgaagcgctgggcctgtctcgcgcgcggctcaagcgcctcttcgaggcgggcgcggtgaaggtgaatggccgccccgcgaagaagggcctcacgctcaccgccgggcagcacatcgccgtcgaggtggaagaagagtcccgcgaggccgtgcccgacgcggacttcccgctcaccgtgctgcacgaggacgactcgctcgtgttcgtggacaagcccgcgggccggccgtcccaccccctgcagtccggagaaacgggcacggtggccaacgcgctggtggcccgctatcccgaatgcgctctggcctcgctggacgcgcgcgagggcggcctgtgccaccggctggacgtggagacctctggcgtcgtcgtggccgcgcggacgcgggacgcgtggaacgccgtgcgcgaggcctttggcagccgcgccgtggacaagcgctacctggcgctggtgacagggccactgacggacgagggcgacatcgacctgcccctgcgtcaccacccccggcatccggaccgcgtggagcccgcgccctacggggccgaggacgcccgggacgcggtgtcgaagttcaccgtgctatcgcgctcgggtgagttcagcgtggtggaggtgaagattctcaccggcgtgctgcaccaggtgcgcgcgcacctcgcgggcattggcgcccccatcgtcggcgacagcctctacggcggacgagaggccccagaactgggccgcttcttcctgcacgcccgctccctgggcctgacgcacccacagacg

SEQ ID NO: 1853 - DNA, 456 bp, Myxococcus xanthus
tacttcctctggctgggggccttcgcgccgtacaagcgattggacgtggcgttggaggcgttccgaagcctggatgcgcagctctgggtggtgggagcgggccaggaggccgcgcgcctgagcgccggaagcctgcccgaaaatattcgcttccttggcaatgtcttggatgcgtcgcttccggcgctataccgagacgctcgcgcgctcatcttcacgcccgaggaggatttcggcatcaccccgctggaatcccaggcggcgggccggcccgtcatcgcctacgggaagggcggcgcgctcgagacggtgacggcgcggacgggaatgttcttctcagaacagacgccggaatcgctcgccgccgccgtgcgccggttcgacgaatgggaagcaggctttcggcctgaagccgctcgcgcgcaggccgagcgcttcggtcgcgcgcattttcaa

SEQ ID NO: 1854 - DNA, 477 bp, Myxococcus xanthus
atcaatccgaacgatctggacctcaccgaccgcgtggtgaatatcaaccgcgtggcaaaggtcgtgaagggcggccgccgtttctcgttcgccgccctggtggtggtgggggacggcgccggacacgtgggcgtcggcctgggtaaggccaacgaagtccccgaggccatccgcaagggtggtgagaacgcgaagaagaacctgttccgcgtcccgctcgtgggtcacaccattccgcacgaggtgctcgggcacttcggcgctggctgggtgctgttgaagccggccacccagggtacgggcgtcatcgccggcggcgcggttcgcgcggtgctggaggcggcgggcatccggaacatcctgaccaagagccaggggtcgcggaacccgcacaacgtgctgaaggccactgtcgctggcctgaagctgctgcgcagcgcggagcaggtttcgcgtctccgtggcaaggacgtcgag

SEQ ID NO: 1855 - DNA, 714 bp, Myxococcus xanthus
  unsure (1)..(714): unsure at all n locations
cgcaaggagcggttggacgtgctggtggtggagcgcggactggccgagtcgcgcaccaaggcccaggcgctcatcctggccggccaggtggtggtgggcgaccagcgcgtggacaagcccggaacgctgattccgcaggaggcggagctgcgcctgaagggcgaggtgcttccctacgtgtcgcgcggcggcctgaaactgaagggcgccatcgaccgcttcgggctcgacgttcgaggcaaggtggccgcggacatcggcgcgagcaccggcggcttcacggattgcctgctccagcacggcgccacgcgcgtccacgcgattgacgtgggctacgggcagctccacgagaagctgcgcacggacccgcgggtgcgctcgcgcgagcgcgtcaatgcgcgctacctcacggaagaagacctgccggagacagtcggcgtggtcgtcatcgacgtgagcttcatctccctcacgcaggtgctgccgtcggtgctgacgtacctggcgccgggcgggctcttggtcgcgctggtgaagccccagttcgaggtggggccggaccgggtagggaaggcgggcgtggtgcgggatgtcnctgccaggcaggacgccatcgacacggtgacggcgttcgtccgcgagcagggcctggaggtactcgggttgatggactccacggtgcccgggcccgctggcaacgtggaggcactcctc

SEQ ID NO: 1856 - DNA, 483 bp, Myxococcus xanthus
gtggtgaacgcggacgacctggggctccatgcctcgctggacgcgggcatcctccgcgcgcaccgcgacggcatcgtcaccagcgccacgctgctggccacgggccccaccgcgcccgaggccgccgcccgcgcgaaggaggcacggctcgcggtgggcctccacctggcgctctccacgcggctgcctcccgcggcgcccgcgcacgaggtgcccacggtggcaccggagggccggctgcgtggcagctgggccgacttcgcccgcgcctggctcaccggacaggttcgccgggacgagctggcgcgcgagctctccgctcagcttcagcgggcccgcgccctgggcgtgacggtggaccacctggacgggcaccagcacctgcacctgctgcccggggtacgtcccctggtggagtccctggccgcgcgcgaggggctgcccctgcgctggccggacgccctgcctcgccctcgctggctg

SEQ ID NO: 1857 - DNA, 489 bp, Myxococcus xanthus
gaaaaaaaccagaatgcagaagaactaaaagaaacacttgatgatttagagtttcagctatttcgcatgcaggataatttaaaagaaattgctaaaaagtacgaagttatcggtgtcgatcagcctgaagataatcagttagttattgtatcggcacaaaatgacggaaacgcatgtaaaattatgctaaatgaatgcacaaaagcctatagaggggcttgggattttgccatcgatggcgtatatgaagataatcacacgatttttattggtgatattaaaggtcccgctaataagggatatggctctgtatgtatgaattatttaaaagaagtagcgggtgatcaaaatgttcatgtcattaaaggagatattgctgagcgcgactgtgatcatctcgaaagattaattcatttttatgaaaaacataactttgaagtgaatattgcttatacgaatacgtgcgtagaaaatgaatggactccagct

SEQ ID NO: 1858 - DNA, 1209 bp, Myxococcus xanthus
cacttcgggcgtccggcggccgtcgccgaacagctccacccgcacccacaggtaccgtccggagagcgcacgcaccttcgcgtgggcgcgctggatgaggacggtgaacaggccactctcgcccggggccggcggcgcgggcagcattcccggttggaacggcacctccgacggaagaggcacccagctcccgtgcgggacgtctggatgaacaggggcttccgggatgaggcccaggcgatgctcgtgccagtgcggcgagtcgctcggcggagccaggggctcgtcggtggcggcaagccagacgcgcaccccggtgcgtgggggcagcagcgcctccacgtacaggcggtgccacaccgtgcgcccgtcgcccgagtcgaagggccggttcggcgggttggcggcgctgccccgctcggcgcaccggggcagcgacagggcttgaagcggcactggcgccatgtcggccagccccgggttgacggcgtggtgcggaggcttcgctccctggagaaagggacccccgtcatggccgggcaggggaaagtagtctccctggggaatcgcctccgacgcaccagccgggagcgcgtaggccaccgcctccaccttgccgtcgtcgagcagcgacagcaccgcggcgcggccgtccggaaggatggcgagactgaagggccccagcacgcccgggagcgcgacgggcgtggagaaccggcccgagtagaagcgcagtcgcgcgtgccccgcgtttgggggcacacccgcgagcgccgggtccatgacccagctcagcaccgccagccgtccctcggtgtcacaggcgagcgccaccggcacttcgccaggccacgcgagcgtctccagcacccgggtccgaggcgggtccgggttctcttccatcgggcggaacaaaccagcgccggagggaatggacaggacgtccagaagcggctgcccgtccatccggccgagtacggcgggaggcgcgttgggcgcgaaggaaggcggaccgctcaggacgtaggcgccaccccgcgggtccgcggcgatacggtgcgcggcgagcccctcggccgggaacaccacggcggaccacaccttacgcaggtggagcgccactacgcgctgggccaccgcgacgtagaggatgccgccagctccaggcgacaggtccgtcaccgcgccggacagccctacctgggcggg

SEQ ID NO: 1859 - DNA, 876 bp, Myxococcus xanthus
aacgcgcctcccgccccggtgagcaccaccgcccggacatcgtcacgccccttcagctcggcgacgcgcgcgcacagcgcgtctcccagctcgggcgtcatcacgttgcgtcgggcggtatcgttgagggtgagcgtggcgacggcaccctccacctcgagaaggacctctgcggctggagcggacatggccgcgcactgtagcggccccggccgctacggcaccacgagcctgaggaaggcgtcctgattccaggtgtcgcccgccccgtcgcgctgccagccggtgacggcgagcccgcggcccggcaccgtggccacacccgcggtggtcagcgagcacaccccgctggcgcagggctgcgcctccagcgtctgctcccccagccacgcccccgaagccgcgtagcgcgtcagcacgctgccacacgtcaccgcgacgccgcccgcatcctccaccgcgacggacgcgcccagctccgtcaccggcccgcacaggggctggcgcacccaacccacgctgccatccgcgcccgccgtcagcacgaaggccccggaggaaccgagcgacgcatccccccacaccagcagaccgatgaagtcacccgccgccacgagcgtgccatccgcgcccaccgtcaccgaggtgatgcggcccttcacgcccggcagctccttgccccacagcaagcgcccggacgcatcgaacgtcagcaccacgaagccgcgcacaccgggcgcgccgaacgtctggccgtccacctccagcgcgtccacgagctgtccggccagaatcgactgtcccgaaggcgccagcgccgccgcgtgcagcgcggtgtccatgttggcgccgtggaagcgccgcgaccacagcacg

SEQ ID NO: 1860 - DNA, 336 bp, Myxococcus xanthus
gtggacctcctcttcttcgacatcggcgccacgctctacggcacggatgcatcccaggtgctgcgcatcgaccgcgcgctgccggaggacctcacgctggcggagctgggcctgcctcaccgaggcaaccgcgccatcgtcttcgacaccccggagggtgaagcccacctcaaggtggacgccgtgcacggcgtgcgctccatccccgtcaattccttgcgccggatgcctcccacggccggcgccgcagcctacgcagtcggtgtgtgcctggaagaggcccgcaccgtgttgctcatcgatctggtcgaaaccgcaaggactcaaggaaggcac

SEQ ID NO: 1861 - DNA, 201 bp, Myxococcus xanthus
tctgtcgacatgccactgccgccggtcgccgtaccgccgacattggagctggagcctgtcgacatgccactgccgccggtcgccgtaccgccgacatcggagctggagtctgtcgacatgccactgccgccagtcgccgtaccgccgacatcggagctggagtccgtcgacatgccactgccgcccgtcgccgtatcgccg

SEQ ID NO: 1862 - DNA, 525 bp, Myxococcus xanthus
tgggaccggctcttcgacatcgtcgcggggcaatcgggcctgttcacggcgcagcaggcactggaggcggggtattcgccgcaggtgctcgcccaccatgtgggggccgggaggttccaccgtgtgcgccgtggcatctaccggctggtgcattttccggccggtgagcatgaggacttggtcgccgtctggctctggtccgagcagcaaggtgtgttctcccaccagacggccctggcgctccacaacctgtcggacgtcctgccttcacggatgcacctgacgctgccagccgcgtggagacaacgccggttccgcgcccccgcgggcaccgtgctccaccatgccgacgttggcgaaacggagcgcgtctggttcggtcccatcccagggacttcgccgcgcagaacgctgctggactgcgcagcggcgcaggtctcacccgacctgctgaatcaggccatcgcgcaggccctgtcacgcgggctcattctcacgtcagacctggcgggtattcagagtgcg

SEQ ID NO: 1863 - DNA, 3003 bp, Myxococcus xanthus
gatgatgcacgcattgggcctgccctcgctctgacgagtactgtataatatgacgcattcagtcgggtggctgcccgagtcgatgcgctggggcgacgcactgaaacggtgcacgatgcgctaggccggcaggtggcggtgcatcaccccatgggtgtttccacaagcaaggtttacgatggcgaaggaaatctcatccagtctgtggacggtcgcggaatcactagacggttcacctacgatgcattgggacggccgcgcaatgaagtgttggtggaaagtctgtcccagggaggacagtcacttgtcgtgggacagcgtgcgtacattgacgtcccggatgcagaagcgctgacacgtgaggaagtgttggatgcgcgtgggaacctcacgacgctctatcgggatgggcttggccgtgaggttcgtcgcatcgatgcgcttggttatgtgacaaaattcaggttcgacgcgctccataagcggcagactcaagatgctaaggggtacattgctcgcttctcatatgatggtgctgggcgagtccttggtcagtcggattatgcttcggccggcagttcgccgacatattcacagacatgggagtatgcggatgcggtccgcgagcagacgcacctgaacaggcgcggagttcctaccgtattgctccatgatggactggggcggaagacccgcagcgttcgtgggcaaggcgcagacgttgcggaggagtcctgggagtacaatgcttcgggacaccccattcgtttcgttgatgcgaatggccatgcggccgagcgactctatgatggtgctggacgtctcattgaagagctcttggccgctggctcactcgacgaggcaaagacgacgtttcagtatgacgctgccggtcagttgacgcagacgaaggggccccgagtcacaggaagcgtattcgatttccgctacacctatgatgatctgggccggcgtgtgcgtgaagagaacgcactgaatcaggtcacggcctgggcgtacgatgccgtaggaaacaaggtttgtgctaagcaaccactgggacagccttcgcttgcgcacggagcggcaagtggaatgtcactggcccagttggaggcgaatgcctgtggggggacgtacgtaacgagattcggatacgaggaggaaggtaggctcgtatccgttacggatgctgcgaatgggctctattcgtacgtctacgatgccgcccgtaacatggtggcgaagcaggatgcgaacgaaaatcttacgacgtatgagtacgacgtccggaatttgcgttcggctgagcaccagcatctcgatgctcactcgcggctgacttcggcacagcgggatagtgtcccactatttgaaagtggtgcgacgcccaccagcaacacgggcactttgacctggcgccatacgtatgatggcaacaggaacgaagcctcgcgtgtagatccgaaggggcagcgagttgagttcgcccatggtctccttgaccggttggcaagccgtacgtattcgcaacatgcgaccccgcgtgagttcccttctgttgattcggaggtccttacttatgatccgaatgggaatctgactggcgagtcacagtcgaagcagaccaccaatggtgtccgacaggaggttgttacctctacgttcgacgctctcgaccgactgaagacgcgcttgcgcgagtatgacgggaagcaagtgtcatacaggtacgacgcattggggagccgtacacgtgtcgaagactcagatgctgttgcgactacgtacatgtacgatgcgttgggtcgacttacacatgcgacactgcctgaaggcgtagtggagtatcgatactggcccgattcgctccttaagggtgtcacgtggcccaatgggatatccgaaggtcgctgctacgacgcggcaggacgcctctcgcagattgttgtcggcaagggaggcgtgaacgacttgtgccagagcatcgtggccatggtcagtcgccatgcgtattcgtatgatggtaatggaaatcgcttggtgcagatcgcggtgcgcacgagcccttcgactcaggaacttgggagcccggagtttaccgagtatggatatgatgttctgaaccgtctcaccggcgttaaggccccagatgggcaggcgtcgctctatcggtgggacgctgtggggaatagaacaggtgagcggcgtgcgccgagtcttgctgtctcggggctcggtcccgactcatacaatacggttctggcccacgaagttacgtacgacgttgtcggcattttcaatcgcgtggattggcttcggaatcttcgcgatctcaaggatgctacgaagcatgtttctctgggctacgatctggcgggaaacattacgcagaagacggtgcaggcttctacccgcgcctttgtctgggatgttcgtaatacgttgacggccgtttacgacaacggcgtggaggtgggtcgttacgactacgatgccaacctccagcggacgatgaggcacacggccgcagggaacgtggagtatgtcctcgacggtgctttcgtcttgcaagaggcggatggaagccaaatccatcgaccgacgcagcgccgttatcattatggtgaagggccgattgcggtcagtgaagccccctcggcaagcttgagttttctggggatggatgcgctagggagcgtgacagatgttctgaatgtaattggccaagtcactgctgctcgagagtatgacgcatgggggaattaccgcagtggctcggcgccaagcgtcagtgacttcaaactgggcttcacggggcatcagtatgacgtggagacaggcctcacgtacgcacgtgctcggtactacgattcggacctggggcgcttcatcagtcgggactcgtatgagggcaaatcggacgacgcgcccagcctgcatcggtacgcctatgcctatgccaatccgctgaggtactcggacccgacaggccattgcgtc

SEQ ID NO: 1864 - DNA, 864 bp, Myxococcus xanthus
gaagacaccgtgctggcccttttcggacgactgactcgggagttccagatcccccgagataccctcactgaggtgctggctcgcttctcgctgcaaaacctcggcatgatcgagttctcacgccgcttcttgggagacgttcccgagcctccagtattcctggtgccgggcacgcgtcactattcgttcccgaaggccgcggcggtgctggggatcggcgcctcgaatatgatcgatgtgcccgtggacctcgatgcgcgcatggatctcaccgccgtgcgtcgaatcctggaggactgcctcacgcggcgaaggccggtttacgccgtcgttgcggtcattggcagtaccgaagagagcgccattgatccattgaaggagctcctggctttgcgtgacgagtaccgaagccgaggactcgacttccacgttcatgcggacgcagcctgggggggatatcatgcgtcctgtatccgcgaggatttcgcaatgctggagcccttgacgcgtggcttcgccgccgctccacctcccgccatgccactgagccggtatgcgacggagcagctccgcgcactagagggcgcggactccattaccgtggacccacacaagtcgggctacatcccttatccagctggcgcgctctgctaccgcaactcggccatgcgcgatctggtcaccttcagcgcccccgtggtctttcacggagacgcagagcccacagttggcatctacgggctcgagggctcaaagccgggcgctgccgctgcggccgtgtatttgagccaccgggtcattcgtcccacccgaagtggatacgggaagatcattgggcaggcgctcttcagttgcaaacgcctc

SEQ ID NO: 1865 - DNA, 210 bp, Myxococcus xanthus
gtctacatcctgcggtgccgtgacggcacgctgtacaccggcgccaccaacgacctggagcgccggctggccacccatggccgggggcgcggggcggcgtacacgcgggcgcggctgcccgtcaccctggtgtggagcgaggccgcgggggaccgcggcgcggcgctccggcgggaggccgccatcaagcggctgtcgcgcgctgagaag

SEQ ID NO: 1866 - DNA, 249 bp, Myxococcus xanthus
tccaaggactttctgtttcagcgtgtgtagatcgattatggtgggtcgaccatccctgagtggttgcaggcatgacttttatggccgttccatggagtgctgcgcgagcgtggtcagccgaaacggaagtatcagggcctggggttatggttgtacgtcgtgtagcaaatagtcacgtcgccctcaggctgggtgatcatgcggtagccgccatcctcgtggacatgtaccagcagaagggcaccgcgc

SEQ ID NO: 1867 - DNA, 2481 bp, Myxococcus xanthus
gccaccagcgacacgcccagccccgagcactgcgccgggagctgcaactccacctcgccgcgtcccggtgcaatgggggcggaggcgaacagcgcctggtcgttgcaacccgagccgccccgcatgctgacgcgcacctggccttcgccgccggaacccgtgcccagccggaagccggagacgctcacccgcaccgcgctgcctcgggccagccgctgcccgtccgcctccggatggcgccacgtcacctccggccggcccacgctcagcgtggcgacggcatccgtcaggtccgcgagccgctccgcgcccaggccctctgaagccaccaggcgggacgggccctgccccacacgccggtccaggccccgcacgcgcagcgcctccacctggagcttcgcccgcgtcgcctgcaacacgccgtcgaagtcgaaggtgcggtcctcgaaccctggcggcggccggggaacgacgacgccgtcgtccgtatcgtccggatccatcaacaccgtccagcggcggccggcgcggttggtgaactcggcgcgcaccacgctggcccgcccgtccacctgggcctggaactcgcggccgacgagctcgccgcggggggccccatcgaagttgtagcgaacggactccggtagggagaggaagctcagccccgcgtccacgggctgcacgccgtccgggtcgaactccggcctgggcaggttcgccacgagcgtgctggtcgccaccgtgccgtcctcggcctggtcacctgatgtggcggacaccaccagccggtacggcaggccctccaggccccggtgcgtgggcgccatgcgcacgggcaccagcccgggccggcccagccgcgcatcggcgtccgtgttcggatcggccggcgccacgttggccgcggcgcccagccccagcggaaccatgcctcggccggggaccgccacggtggccagcacgtaggcgcggtccaggtgcgcgccccggtactgaggcagcggcggtacgcgcacggcgaaggggaacgacagccgcacgcccggcgtttcccgctcgaaaggcagcgcctgcgcgtactccgccgcacgggtgtccggctcgccggtgaggatgccgggcgtgggcgccagggtgaagcgggcgtcacgcgacagcgccgagaagaagcgcgtcgagccgggcaacaactgccccaattgcagcaacggatccgtccccggcgccatgaggttgagggggagttccttcagggggagctcgcccgtcagcgcccaggccgtccgcgtcccacaggcgcccgtgcgaatggccagctccgcatccaacacacccggaagcgagctgtcacacacacccgccacgcccggggccgcgacgtctggagccgtgctgcccgtcaaccacagtgcgctgcccgacggcagcgacaggcggtcctggcccgtgcccacggggagcgccacctcgtgctccgggcccaggaaggactcgggagccaggtcggtggggagcccgggcacggacaaccccatcagccccacgcgcagcgaaaccgccgtcgagaaggtctccgtcaacgtggggaatgggcccttcacgccgccgaagcggtccaaggggttgcggcgcagggccatccgcacgtcgcggaactggctcgcgtcgtggcgcgccagcgtcaggtagccgtagtcggagtggaaggcggagagcgccacctcgccttccgcgggcacccagacggctccgtcggcgttcgtcaccatcgccgcttccaggccgccgtcatcggcggacaccgcgacgacggccagcggcaccgggcgcccggtcagcgcatccaccaccagcacgcgcaccccacccggggctacttcggcgggcagcacggtgacgcgcgcatggcaggagacattgcccactcggaccgccagcgcctggtgctccgaggcgggctcgctcagcacgacagaggcctggtggccgcccccgcctccgaccacggagggagacagcacctcccatgccacgccgtcacgcaacaccaacggagcgcccgtcgattcgcgcacccacacgcggaagtccaccgtcatgcccggggtgcccacgacgacatccggcgtcacctcgcacgcgaccgcgcgggattcggacggcggcgagccacacgcgccgtctcggcacaccgtgcctgagtcacagtccgtgtcggcggcacagacaacgggcacgcaccggttcatgtcgcattggcagccagcgccgcctacctcgtcacacgcggccagtgcatgagggccccgccgcgccacgccgcaatcctcgcgcgtcaggcaggcgggctcgcagcgcgaggtggccgagtcacagaagaagagcgaggggtccgggcagtcctgatcgacggagcagtaagtcacctgtgggaacggacccacggggttgtcaggccccatgtccatgtcgccgcagccg

SEQ ID NO: 1868 - DNA, 3024 bp, Myxococcus xanthus
atgagtgacagggattggggctcctggcggcccaggcatgggcggcgagcgagcccccgcgggctggctggcgggcgggcagggggcaacgctccaggggccacggcgtggcacggcggatgctcatgtgttgggcgcccggcgccgccccgtcccgaagcgagggaggggcccaggtgcggggcgtgcccaccacaccacaaggagcagccattgatggggccagacgaattcacggcggtcagcgacgaggtgcgggagtggccgctgtcgacgcgtgagtgggtgtcgcgccgcagcgctccgcgcatcctcctgggggaggaccaacccgagatgcgcagcctgctgcgtcgggcgctgtcccggcgcgggtatgacgtcgtggaggccccggacggtccgggactggtcaaggcgctggtggacggattgctcgcgcagcagacgcaggtccccgacctcatcgtcaccgacgtgcgcatgcccggcttttcgggcatcgaggtgctggcccgcctgcgccgcgagggctggacgacgcctgtcatcctcatcaccgccttcggcgatgcgcagctccaccaggaagcggagctgctcggcgcggcgcgcgtgctcaacaagcccttcgccatggaggatttgtgcgaggcggtggagatgctggtaccgccgccgcgctgagccttcacggcgcgcgtgccccgactgtccgcccggtgtcgtgggcccggcgagaaatccgatggacgcggtggggtgggtgcttgcaccctggcgggcctgggtccaggctcgcgcggggcggtgggcgtcgcacgagccgcttcactcgaggcgtctcatgcggattccatcctcgctgctgtccttgctcgcgctgggcgcggcgtgccattgcagccccacgaaccggccggtgccggatgcgggaggcagcgtgcaggaacccgtgcggcgcgtggcgcacatcatccgtgagtatccccacgcgacgaatgccttcacccagggactggtattccaccaggggcacctcttcgagagcaccgggcaccaggggacgctgcggcaactgtcgctggagagcgcgcagccggtgtggatggagcgtctggggaacatcttcgcggagggcctggccagcgacggcgagcgcctgtaccagctcacctggaccgaaggcctgctcttcacctggagcggcatgccgccgcagcgcgagcggaccacgcgctactcgggggagggctggggcctctgctactggaacgggaagctggtgcgcagcgatggcggcaccatgctcaccttccacgagcccgacggcttcgccctggtgggcgcggtgcaggtgaagctgcgcggccagcccgtggagctcatcaacgagctggagtgcgccaacggcgtcatctacgccaacatctggcacagctcggacgtactggaaatcgaccccgccacgggcacggtggtgggcgtcatcgacgcgtcggcgctgacgcgcgcggtggcggggcaggtgaccaatcccgaggcggtgctcaacggcatcgccgtggagccgggctcgggccgcatcttcatgacgggcaagctgtggccccgcctcttcgaggtgcgtctggacgtggtggactgacgtcagcccttgcgcgtgtcgtcgtcgcgctccagcttgcggtacagcgtcttgcggtccaccccgaggatgcgcgccgccagcgtgcggcttccgcccaccgcctccagaacgcggtggatgtagcgccgctccaactgctccagcgtcaccagctccgaggcgtcttgcgtctccggcaccacgcgcggctggctgtagttgcggacgcgctcgggcaggtcgtccacggtgatttcctcgaaggaggtgagcgccaccgcgcgctccaggcagttctgcagctcgcgcacgttgcccggccagccgtaggcgagcagccgctgggccgccgcgggggacaggcccagcacccgcttcccggtgcgcgaggcgaactgctcgatgaagcgctgggacagggccagcacgtcgttgccgcgcgcgcgcagcggcggcagctccacgccgatgacgttgagccggtagtagaggtcctcgcggaagcggtcctcctccacggccagctccaggtcgcggttggtggcggcgacgatgcgcgcgtcgaagggcagctccgtgtctccgcccaccgggcgcaccgtgcgctcctgcagggcgcgcagcagcttgtgctggagcgtgaggggcagctcgcccacctcgtccaggaagagggtgccgccgttggcctggacgaacaggccggtgcgggcggccttggcgtcggtgaaggcgcccttggcgtggccgaacagctcgctctgcaacagggtctccggcatggccgcgcagttgatggcgacgaagggcccgtccttgcggcgcccgcgcgtgtggacggcgcgggccgccacctccttgccggtgccgctctcgccggtaatcagcaccgtggagtccaggtccgccacgcggtcgatgagcgcgtaggcctgcttcatggcggggctctcacccaccacagtgccactgtcctcgcgccggcccagctcctggcgcagcctgcgcacctcttcacgcagggcgcggtgctgcacggcgcgctccagcaccagcaccagcgcgtccacgtcgatgggcttggtgacgaagtcgtacgcgccggcgcggatggcggccaccgccgtctccaggctgccgaaggccgtcaccaccaccacggggatgtccgggcggttgagggcgatgcgctcgcacagcgccagcccgtccatgccgggcatgcgcaggtcggtgagcaccacgtcgaagtcctcggcggccagccgcaccagggcctcgtccgcagacgggagcgccacgggcgtgaagccccggcgcgtgagccccttctccaacatcgcgcgcatctcgcgctcgtcctcgacgactaggacgcggcctggcatgtgtct

SEQ ID NO: 1869 - DNA, 129 bp, Myxococcus xanthus
atggcctgctcgctcccctcccgccgcttcctcagtgcgctggtccttcttcccgccgccacgcttggcgcttgtggccaagccattggcaccgcgtccgcggcatcgcccgctcccaccgcccaggtc

SEQ ID NO: 1870 - DNA, 575 bp, Myxococcus xanthus
ctgcgtcgaccgcgcaccggccctgccgggcgtgcaaattccgcccgtcgcgggccggcggacttccatgagccgccgtgcggcgacgccggactgcccgctcgccttcgtcacgccccgggagcccgccccgcccacctgcgaccggtccccgcctggccgactgctgggcgggcatcatcctgagggacaggaagtcaccacgaggcgcgaagccgtctagaatccccgccggccatgcccgcctgccccccgcacccatcccctctcacaccgtcattggcgcacggactcaaggggaacggctctccgcccagctcttccacctcgtcctgctggacaccgagcgcgccggcaccgtcttccccctggccaatgaagccctccgcgtgggcaaggccccggacaatgacgtcgtcatcgaccaccccaccgtgagccgcaaccacctggtggtgcgccgccagggggaccgcttcctcgtgcaggacctgggctccaccaacggcaccttcctggacggtgcccaggtgcgcgaggccttcctccgccccggcgccctgctggaggtcggc

SEQ ID NO: 1871 - DNA, 366 bp, Myxococcus xanthus
atgctttcagcacttatcccgtccacacatagctacccagcgatgcctttggcaagacaactggtacaccagcggtgtgtccatcccggtcctctcgtactaaggacagctcctctcaaatttcctacgcccacgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttattcccggggtagcttttattcgttgagcgatgggccttccatgcggaaccaccggatcac

SEQ ID NO: 1872 - DNA, 684 bp, Myxococcus xanthus
agcgcgggcaccagcccgaacagcagtgtggtcagcacggccagtcccgcggtgaaggccagcaccgggccatccagcgacacctcttcgatgcggggaatgtcctgaggcccccacgtggccagcgcatccagcgcccacatcgccaccagcaaccccacagccgcgcccagacccgcgagcacgccgcactccaccaacagctcgcgcgcgatgcggccacggctcgcgcccagggcgatgcgcacggagacttccccctcacgcgaggctgcccgcgccaggagcaggtgcgtgaggttcgcgcacgcgatgagcaacaccaaccccaccgcgcccagcatcaacaggagcgacggacggacgttgcccaccagcacgtcgcgcagcggctccacgcgcgcatccttgccctcgttcgtctgggggtactgccccgcgagacggtgggcgatggcggagagctcggtgcgcgcggactccagcgccacgtccgggcccaggcggccatacacctccagccagtgcgccccgcgcccctcgggcttcgtcatgccctcttcccagagcagcgggctccacagctccgagcgtgcggggaagtcgaagcccggcgccatcacccccaccacggtccacggctccggagcgcccaggtccaccgagcgccccagcacggcggcg

SEQ ID NO: 1873 - DNA, 597 bp, Myxococcus xanthus
gccgcgccgcggaaagtcctccgcggcgcccggccgcctaaaggcgtgaagcccgccgccccggcaacgaactccgccgccacgctcagccggtccagcagcgcgggcccgaagtactggcgcttggactcccccagtccaccctgcacgttcgccgccgtctccacgtagcccacgtagccatccgccaggctcagcacgcccgtggcgccggtccgctgcagcaactccatgcccgcggccacgctgggctcacccggcaccgccaccagcttcagcggccccagcaccagcgcgcccacctccgccagacgcggcgcggattcacacagcaggttgtcccccgccgcccgcgtcagcgccggcaccagccgcgaagcgtccggacgtggcatggccgcatcagcgcgcgccagggacagccgcacggtctcccccacgggtgacaagggcgcatcgccggccaactccgccagggcatgcgcgaagcccgacacccgctccagcccctgcccttccgagtacgccaccgtcgcattaccccccgcgccctgcagcaacagcgtcacgccgctgcccgcctcctcgcgcagcgcg

SEQ ID NO: 1874 - DNA, 411 bp, Myxococcus xanthus
atcgtcggaatcgcggggagcgttcgcaagggctcgtacaacgcggcgttgctccgggcggcgatagagctctcgccgccgggagccagaatcgaatcggtgtcgatccgcggagtcccgctctacgacggcgacgtggaggcggagcgcgggatccccgaggccgtgcgggagctgaaagacaagatcgccgagtcggccgggctcatcattgtgacacccgaatacaacaactcgattccaggcgttctcaagaacgccatcgactggctgtcgcgcccggcttcggacatccctcgcgtatttggaggtcgtgctgtctcgctgatgggcgcaagcccagggcgcttcggcaccgtgatgtcgcagaccgcgtggctcccggtgctccgggccctcgggatgcgaccg

SEQ ID NO: 1875 - DNA, 750 bp, Myxococcus xanthus
aagaaccaagtcgtcgtcgtcaccggcgcgtccagtggcattggccgcgccaccgcgctggccctggcgaacaagggggcccacgtcgtcctggccgcccggcgcgaggagccgctggaggacctggctcgcgagtgccgggggctcggcgtccaggcccacgtcgtgcccacggacgtgtccgacgtggccgccgtgcagcacctagcggacgaggcgcgcaacgtcttcggccacttcgatgcgtggatcaacaacgcgggcgtctacctcatgggccgtctcgaagagacaccggatgacgccttccgacaggtgatggagacgaacttcttcggcactgtcagcggcgctcgcgccgccgtggcccagttccgccggcagggctacggcactctggtcaacgtctcctcgacctttggggcggtcgccgcgccgtatgtcagcgcctacgtggcctcgaagcacgccgtgcgcggcttctcggcgtctgtccgccaggaactgctcggcaccggcatcgacgtgtgtaccgtgctccccgcggccatcgacacgccgctgtggcaacacaccgccaactacaccggctggcgcatccgtcccgtggagcccgtctacacgccggagcgcgtcgcgcgcgccatcctccgggtcctccgcagccccaagcacgaggtcttcgtcggccccgccgctcggagcttcgccgccatgcacggcctgctgccccgcaccttcgagcgcacc

SEQ ID NO: 1876 - DNA, 276 bp, Myxococcus xanthus
gccgaccagtcccagctctcacaggtaatggtcatcctgttggagaatgccttgctcgccctgagagacgtgcccgcaccgcggttgaggacatccattgagcaggcgagcggccggttgctcgtccgggtggaggacagcgggcctggcattccaccggaactgctgccccggctcttccagcctttcgtgacgggccgcaagcgcgagggacctcggccggggacaggcttggggctggccatcgcacgaggcatcgtcgaacggcatggcgga

SEQ ID NO: 1877 - DNA, 432 bp, Myxococcus xanthus
aggacgcggcttacttggcgcgaggttctcttcggcgtcgacaacgaactcttgtcctccgaggtgccggtcgaaatggctgtcgagcaactcggcatcgaggattggcctgtgcgggcgctcgccgaactggcggacctggagccgtggaagtcgcctcgtagttgcgtggaggcactcgcgggaaccgaagcaagtcaggacgcagaggcgataaaaagcaagtggctctacctcgtgttggcctgggtgttcatcaacagggagcacttctccgatccacttgagatgggtgagaagatttatgccgattttgggtacccagagcgtgtcgcccggttcatccgatacatgccttctgacgagcccgatcttggtagtcgcgagatgaatgagcggaggctctacagccagtggaagagctacttggac

SEQ ID NO: 1878 - DNA, 201 bp, Myxococcus xanthus
ttgtcttatagcatgaaagaaatgaatgaaaaaaccgggctttccgcaccgactttgcgctattatgaaaaagaaggaatccttccttttgtagaacgtgatgaaaatggaaagcgcctttataacgatacgaatattgagtggatccgttttatcttagctctgcgctcaactggcatgccgcttgcagaaatcaagcgc

SEQ ID NO: 1879 - DNA, 1014 bp, Myxococcus xanthus
cccacgttcgtcacctcgcgggcgttgacgttgaactccaccgtcccaagagaggtgcgcagcacgtgtcgacccggcttcagccccggcacgaagatgcggccgtccaacaacgtgtagtgcgacgcaccgacccactcatggttgacggtgatttcctcgcggtagccccagaggtggtcgtccccgaaatccatcatcccggcgacggcgcccgtctcctccaggtggatgtcgacggacacacgctcccccttcccgcctcggacgacggcgctgcccgcgcggccatccggcagccacgcgaagattcgccccgcgcccacccggggcgtcaccacgaattcggggccatcgaagcggacctgcgcgtggtcctcggccgagttgccacacctccgcccccgtggaccgggcttctgcgacccaatccaggcccccttcaccggcgtgccgtccgggaggaagacgcgaccggagacctcgaactcgccagggtcgctggagtacagctgccacacccttccgccctcctcgagcgcggagaaggggaacgcgatgaccgccggagcaccgggcgccagcgtcacgtccttccgtgccgacaccgcccgcccgttccggcggccccacacggagacggagtggcgccccgactcagtgatgcccgtgaaggtgccgtcctgctggggctggagctggacattcacgtgaacggactccaccgagtccgtcccacgccggcgccccatcaccggcttgacggtgaccgggacgaacgcgccaagctggaagtcgaaccgccgcacctcgccggcggccagctccgcgcccacggaccggtggagcccctctccctcgggggagaaaggcgtcatgccgacggggtagcccggcgtcacgccatccagcgtgtagcgcccctgtgcatccgtcgtggcccagacaggcgtcatctccagcaacatcgggtcaccggacgcgaccagccgaacaccctccgccggcgtcccg

SEQ ID NO: 1880 - DNA, 774 bp, Myxococcus xanthus
gcgctgaacagtgccgaaatctacgatgcggaagcgaatgagtgggctcctgccaatcccatcccactcggagcacgcgccagccatgccgccgtcctgcttccctcggggaaggtgctggtggcgggtggcgggaactcgcatctcgacgggctgaacaccgccgcgctctatcacccggacaccgactcctggacagatgctgggagcttgaatgtcaaacgcaacgtactgacactcaccctcctggaagcgggcgtggtggtggccattggtggcttcaatgctgctggagcggagacgacggccgaggtctacgactcgaatcaaccagaggcgggatggcgactcctcctggcacagatggaacatgggcgccacgggcacgcctccacgcggctgccttctggaagaatcctggtgaccggctccctcgagggctcaccaggacgggtcctcagggcagcggaactctttcaattgagcagcacttcgtggacgccccaggcggaaatgatggaagcccgcttctttcacacggcgaccgcattgccctcaggcgaggtgctgattgcgggcgggtattccagcccctacgcaatgccacgtgcctccgcggagatattccggcgagatggctcttcggagttcatcgctcccatgtcatcggcgcgcgtcaatcacacggccacatggctggaatcagggagtgtgctcatcatcgggggtatcgacggcggtgccgtactgaacaccgccgagcggtatgtcccc

SEQ ID NO: 1881 - DNA, 144 bp, Myxococcus xanthus
cgttccattatttcgctcgagtgcactgtgtgcaaggagcggaactacacgaccacgaagaacaagcggaagagccaggataagctcgagctgagcaagttctgtcctcgttgccgcaagcatcaggaccacaaggaaggtaag

SEQ ID NO: 1882 - DNA, 309 bp, Myxococcus xanthus
ggccgagtggagcgcgtcacggacgcggaggcggacgcgtacttccagagccgcgcccgcggcagccaggtgggcgcgtgggccagcctgcagagccagccgctggcgactcgcgaggagctggaggcccgcgtggcggaggtggagcagaagtacgccggccagcccgtgccgcgcccgccgcactggtccggcttccgcgtggtgccggaccgcatcgagttctggcacgcccaggagagccggctccacgaccggcacgtctacctgcgcgaggacggcggctggcgcacgcagatgctctaccca

SEQ ID NO: 1883 - DNA, 957 bp, Myxococcus xanthus
caaaggcggggggatatgcttcaggttcgcaacgagactcccttctcacccagcatgttcatgttccccgatgtccgggggatggacacgctatacgtggtggtgaaggcgacgttcacctttcgcaaggggcggctgttcattgcggaaaatcagcaaccggtcgtcatggcggacacattccggggagagcccgggcaatcgagcatccgagctgcgagcgaggcacacttgctcaagccaggcacagacgtgttgctggagggcgaggcacacgcgccccggggcaagccggtggcctcctgccccgtcctggtgcgggtggggcctgtgaagcaggtgatccaagtcttcggcgacagaaaatggcggggaggggttctgtctccgggtatctcttcgcccgagcccttcgtgaagatgccactcgtatgggaacgggcctacggtggcgtgcatgaggtgacgaaggaacgcgtgttggggaaggcaagcaatcctgtgggacagggcttctgcggcaagcgtggtggttcggaaatggtgggacgcgcgttgcccaacctggaggatccaaggcaactcattcgctccatttcagacgacccggttccgatgggcgtggggcctgtggcgccatcgtgggagccgcgaaaatcgtatgccggcacctatgatgaggcctggaggacccggcgcgcgccctacctgcccctcgacttccaagcggagttctttcaggtcgcgcccgcggggatgtgtgcccgggagagactgaagggcggcgaaccggtcgaattaatcaatgtgtcactcgaaggcgtgcagcgctacacgcttccccgctgtgggctgagcgtgacagtgaagattgccggattgttcgagcgccctccacttcatctggagacagtgggcctggagccgggctccggacgggtgtgcatgacctggcga

SEQ ID NO: 1884 - DNA, 474 bp, Myxococcus xanthus
cgaatctgggggagtaggctcgggtggctcacgggtgtggatgacaatggtcgattcctggtggacttcgggggaaacaccgaggggccgctacctgcgaagaggactatcaatctgacatcagaggtagtgcgggccgcagtggccacacgccagttcgcggtgcttctctttgaagatggggatccccggctgccgctggttatcgggctggagcagggccacagttccacgcctctgctcgatgtcatgctggacacggcgggcattgagcccgaaccggttccagctcccaccgaggcccgggtcgacggacagcgggtcgaaatagagggcaaggacgagatcgtcctgcggtgtggccaagccagtatcacgatgcgtagcaacggcaaggtcgtcatccggggcgtgtacgtggaaacgcagtcctcgggggtcaaccgcatcaagggtggctcggtccaggtgaat

SEQ ID NO: 1885 - DNA, 234 bp, Myxococcus xanthus
ctggccctcggggccttgggcatcgtctacggcgatatcggcacgagcccgctgtacgcgttgcgggagtgcttcacgggggcgcatgggattccgccgacgcccgcgaacgtgctgggggtgctgtcgctcatcttctggtcgctcatcatcgtcgtgtcggtgaagtacctgctgctggtgatgaaggcggacaaccggggcgaaggcggcatcctggcgatgatggcgctg

SEQ ID NO: 1886 - DNA, 219 bp, Myxococcus xanthus
cgcgtcgaggcacaggcacgtgaggcggacgtggtgcgcaccgccgtccgccaattgcacagcgcccccgtcctcgcgcaactgcgtacctggctggaggcgcaggccccgcgccacccgcccaagagtccgctcggccaggccatttcctacgcactgacgcagtgggaggccctcacccgcttcgtcgagaatgagcgccttcctctcgacagcaac

SEQ ID NO: 1887 - DNA, 945 bp, Myxococcus xanthus
gccagcacctccaacggcggcacggcgccctccagcaacggcgcgatgaggggctgcaggatggtggcggtgccatccaccgcgcgcccgtcctcccatgcctcgaatggatgcgtggagggcacggaccaggacacccgcgcggtggtttcgtcgtcatggcgcgcgcagtacacggcgtcctccaccctgcccaggacctccccgagcggaaggtccgtgggcgcgcggtagacggggttccacgcggtgatgagcagcgtgtccaccgcgcccgcctggatgtccgccacgagcgctggcagggccgctgcatccggcgcgggcgccaggagcgactccacgcaccgcaccttccccccgtgcaacgtcgcgttgagcaggtgcgccagcgcatggaccgcggcgggttgggactcccccaccacgatgaacgcccggcgcccctgctccatcaggtcccgcgcggctcccaccacccagcggcgctccgagtcctccagcgccgacgctccacgtccgagcgccgtccattcctcgcgtcccagcatccgccccagctccaccgcgagcgcctgggccacccacggcacgcgggacgggcgcgcccggagccgttcgtccgcgaaggcccccgtgaggctcaagcgggtctccaccacccacaggcggttgagcgccggaggcatgcgcgcggagacgaactcacgcggggcgcgaagacctcctgtcagcgtggacaggaagtcgtcatccagcgacaccacggcgcgcgcggcgccccagtcgggcatggcgcacagcggccggccccacgcgagccgggcgcccgcgagtgcgttccccgtctgcgtggagctgaagggcaccacccgggccttcgggaagcgtgcctggatgcgctcgaaggtccgggtccagagcggtgacgcggtgggctctacc

SEQ ID NO: 1888 - DNA, 390 bp, Myxococcus xanthus
atgaagaagtggatactcgctttaagtttggttctggcagtggctggagcagctttaactggatgttcaaatgtacaagaagtttccggggaaaatgatcaagtcgaaattgtattagccggctggggaggcaacccaacagagacgaagctgcttaatcaaactattcaagactttgaaaaactccatccatcaattcatgtgaagcatgaagtaatcactgatcaatacatggatattttaaaaacgcgtttaataggtggaaatggtccagatgttttttatcttgatgcacttgaagcgccgggtcttattaatacaggggttttagaacctttaaattcttatgtaaaatctgattttgatgttcaggattttgagaaaccatta

SEQ ID NO: 1889 - DNA, 285 bp, Myxococcus xanthus
ttgaccgtgctgatttgttacgacgtgcgggtgtcggacccacaggggcctcggcgcctgcgcaagattgcgcgggcttgcagagaccatggcgtgcgagtgcaatactccgtcttcgagtgtgtcctggagcccaaggactgggtcgtcctgcgcgcccgcctgctcggcgcattcgattcggaatgcgacagcctgcgcttctacttcctgtcggaggacgatgcccggaagacggagcatcatggcgccagagcacccttggacgtcgaggggccgctggtc

SEQ ID NO: 1890 - DNA, 663 bp, Myxococcus xanthus
gcgttcacgaggagcgacgccctccggagcaccagcgcagacggccgcgctggtttcaacccacgctccccgcgttcacgaggagcgactcccgcgttcgggagttggagtcccagctcgctgtttcaacccacgctccccgcgttcacgaggagcgacctggtggtggggaggatgggacaggaggggatgtttcaacccacgctccccgcgttcacgaggagcgacaatgccccgtggttctccaggcgggcccggacgcgtttcaacccacgctcccctcgttcacgaggagcgacgtcagacttcagggccctgcgcagcccctcctcgtttcaacccacgctcccctcgttcacgaggagcgacttgaccgtgccatccatgttcccgaggtagttgttgtttcaacccacgctcccctcgttcacgaggagcgacagaatccgctgtcacaccgctgtcacagcttggtttcaacccacgctcccctcgttcacgaggagcgactcgacagccaccaacgcggtccacagcacctgcccggtttcaacccacgctcccctcgttcacgaggagcgaccgcgatctgcgcatggagctgcgcttgggcctgcgtggtttcaacccacgctcccctcgttcacgaggagcgacgatggc

SEQ ID NO: 1891 - DNA, 618 bp, Myxococcus xanthus
ccctcatcgaagacgagtgagcgggtgccgtgttcgtccttcaccacctggatgaaggcatagggggactcggccacgtccacggccttgggggcgcggggcagggcgtgggcgcccagggccagcgccaccatgggcacgcccacggcgggcagccgccaccgccatcccaggcgccaggatgccgtgagccccagcaccgccgcgaagagcgccatggtgcgcgcggtgcccagcagcggcagtacgacgaaggcagccagcagcgttccggtgatgctgcccaccgtggatgcggaggacagccgtccggcgtgcgcgcccgctgactccactcccgccagccccacgcgcagcacgtacggccccaccgcgcccagcaccagcaggggcggcattgccaccaccatcagcaatgccacgcggcccagcccctcgatggggcgtccccccagcaccgcggccgtggcgccgggcagcagcacgcgcgcgaggaagggcaacatggccagggcgagcgcggagaggcagagcgcgctcagtagcagtgtcaggcgaccccgagcggtccgccacgcggcctcccagatgcgcgcccaacgcgagcccacccaggac

SEQ ID NO: 1892 - DNA, 361 bp, Myxococcus xanthus
ccgcctacacgcgctttacgcccaataattccgaacaacgcttgcaccctctgtattaccgcggctgctggcacagagttagccggtgcttcttctcccggtaccgtcaagccgttggatgttagccaacgggttttcttcccggtcgaaagtgctttacaatccaaagaccttcatcacacacgcggcgttgctgcgtcaggctttcgcccattgcgcaaaattccccactgctgcctcccgtaggagtctggaccgtgtctcagttccagtgtggctgatcgtcctctcagaccagctacccgtcgttgccttggtgggccattaccccgccaactagctgatgggccgcggactcatc

SEQ ID NO: 1893 - DNA, 171 bp, Myxococcus xanthus
atgacgtcaagtcctcatggcctttatgaccagggctacacacgtgctacaatggccggtacagagcgttgccaacccgcgagggggagctaatcgcataaaaccggtctcagttcagattggagtctgcaactcgactccatgaaggaggaatcgctagtaatcgcagat

SEQ ID NO: 1894 - DNA, 1965 bp, Myxococcus xanthus
tcgaagaagagcgtcgcgtggccgaagaggcccggctggcggaagaggcccgtctcgcagaggtcgctcggcttgaggcggagcgccttgctgaagaggaacggcgtctcgcggaggaggcgcgtattgccgaagaggctcggcttgaggcggagcgcctagctgaagaggcgcggctcgccgaagaagctcgcctcgcggaagaggcccgtctcgccgaagaagctcgcctcgcggaagaggcccgcttggcggaagaggagcggctcgaagaggagcgccgactggcggaagaggctcggctcgccgaagaagctcgtctcgaagaagagcgtcgactggcggaagaggctcgactggcggaagaggctcgtctggcggaagaggctcgtctggcggaagaggctcgtctggcggaagaggctcgtctcgaagaagagcgtcgactggctgaagaggctcgactggcggaagaggctcgtctcgcggaagaggctcgactcgcggaagaggctcgtctcgaagaagagcgtcgcctggcggaagaggcacgtctcgctgaagaggcacgtctcgaagaagagcgccgtctggcggaagaggcacgtctcgcagaagaggctcgcgtagccgaagaggcgcgtctcgctgaagaggctcggctggcggaagaagcgcggctcgaagaagagcatcgcgtggccgaagaggctcggctcgcagaagaggcgcggcttgaagaggagcgccgcctagcggaagaggcgcgtcttgaagaagaacgccgccttgaagaagagcgtcgtctggcggaggaggttcgtctcgcggaagaggcgcggctggcagaggaagcgcgccttgaagaggagcgtcggctcgcggaagaggttcgtctcgcagaggtcgctcggcttgaggcggagcgccttgctgaagaggaacggcgtctcgcggaggaggcgcgtattgccgaagaggctcggcttgaggcggagcgcctagctgaagaggcgcggctcgccgaagaagctcgcctcgcggaagaggcccgtctcgccgaagaagctcgcctcgcggaagaggcccgcttggcggaagaggagcggctcgaagaggagcgccgactggcggaagaggctcggctcgccgaagaagctcgtctcgaagaagagcgtcgactggcggaagaggctcgactggcggaagaggctcgtctggcggaagaggctcgtctggcggaagaggctcgtctggcggaagaggctcgtctcgaagaagagcgtcgactggcggaagaggctcgtctcgcggaagaggctcgactcgcggaagaggctcgactcgcggaagaggctcgtctcgaagaagagcgtcgtctggcggaagaggcacgtctcgctgaagaggcacgtctcgaagaagagcgccgtctggcggaagaggcacgtctcgcagaagaggctcgcgtagccgaagaggcgcgtctcgctgaagaggctcggctggcggaagaagcgcggctcgaagaagagcatcgcgtggccgaagaggctcggctcgcagaagaggcgcggcttgaagaggagcaccgcctagcggaagaggcgcgtcttgaagaagaacgccgccttgaagaagagcgtcgtctggcggaggaggttcgtctcgcggaagaggcgcggctggcagaggaagcgcgccttgaagaggagcgtcggctcgcggaagaggcccggctagaggcggagcgtctggcggaggaagctcgtctggcagaagcggctctacttgaggcggcgcgcctcgccgaagaagctcgcctggctgaagaggctcggctggcggaagaagcgcggctcgaagaagagcgtcgtctggccgaagaggctcgggctgaagaagaacgccgccttgcagaagaggctcggctcgcagaagagcgtcgtctggcggaagaggagc

SEQ ID NO: 1895 - DNA, 180 bp, Myxococcus xanthus
ctcacgccgcgggagcgcgaggtgctcgggttgctcgcggaggggctgtccaacaaggccatcgcggaccggctggacatcagcgagcacaccgccaagttccatgtaaatgccgtgctcgccaagctgggcgtccagcggcgcacggagaccgtggtccgcgcggcgaagctgggcctg

SEQ ID NO: 1896 - DNA, 402 bp, Myxococcus xanthus
gagcaacacttctggcgcgtcgccatcaagccgggaaagccgctggtggtgggccgtcgtggcgccacgctgttctttggacttccgggtaaccccacctcctccctggtgacgttcgagctcttcgtgcgcccagccctccgcaagctgctggggcatgcgcaggtggggcctgggcgcgtagccggacgcctggaaggcaagctttccaagccctccggcctggcgcatttcgtccgcgtcacggctgcttggagagaaggcaacctgtgggcccgtccgctggcgacacaaacgtctggtgccctgcgttctgcggcggcggccacccacctgctgcatttccctcgggaagccagcagtttgacggagggggacgcggtagaactgcttccgctctca

SEQ ID NO: 1897 - DNA, 234 bp, Myxococcus xanthus
accgtcgtgcgtgccagcgacaagagccccatcccggaggtgcgcgtcaccgcgacctcacccgcgctgacagagcctcgctccacggtgacggacgcgcagggcggcttccgctttccccaactggcggatggcgtctactcactccgcttcgagaaggagtccttccaggcgctcagccggacggacatcacggtgaaggccgggcatgagccccgcgtggacgtggcgctc

SEQ ID NO: 1898 - DNA, 192 bp, Myxococcus xanthus
cggctccacgtccccatcaccacgcaccccgacgtggccttcttcctcggcggcgagcgagtcgtcctccagcccggtgagtgctggtacctggacttcaaccgtccccaccgggtggacaaccccagcgacaccgaccgcgtccaccgggtgctggactgcgacgtgaatgactggctgcgagacgtcttc

SEQ ID NO: 1899 - DNA, 906 bp, Myxococcus xanthus
ttcccgcagtccgtgtgctcgggtgacccgcgtccggacagcgtggtgttgtgggtgcgggcggtggacccggacaacgcgggggcgaacacgcaggtgcggctggaggtgtccaccagcgagtcgttcagcagcgtggtgctggaccagcagttcaccgcgcaggcgcagttcgaccatgcgttgaaggtgaaggtcaccaacctgtcggcgcgcacgacgtactactaccgcttcaccatcgacgcgaacggtcagaagtactccacggtgacgggccgcacccgcaccgcgccggccgcgggcgacgacgtgccggtgaagttcgtcttcgccagctgccaggactacatcggtcgttactacaacgcgtggcagcacctgctgcagctcaacgaggacctcgacttcgtcgtgttcctggccttctacgtctacgagacgacgggcgacgcgtcgttccagtccgtggacggacgcggcatcgtcttcagcgagcccgagaaggcgctccgccagggcacgggcctgacggcgttctacgcggccaactcgctgtccaactaccgcgacctctacaagaccctgcgcacggataaggtcatccagcaggtgcacgagcgctacccgttcgtcatcacgtgggatgaccacgagttctccgacgactgctggggcgacgtcgccacgtacacagacgagcgcaccaacgagaagcagaccgagcgccgccgcaacgcggagcaggccttcttcgagtacatccccatggaccacggcgcgagcgacgcgggcgccatcgacatcaacgccgtggtggcccagccgacgcgcatctaccgcgacttcgagttcggccggaacctgaagctgctggtgacggacacgcgcacgtaccgcccggac

SEQ ID NO: 1900 - DNA, 280 bp, Myxococcus xanthus
gcccacagcctcgttccctcgcagaagaactctcccggcgtgcagatctccggcgactcccccacagggcccatggggcccgccggcccggtgtcgccccggggcccctgggggccctgcgcccccgtcgcgccaggcaggccctgctcgcccgtgtcgcccttgggcccctgcgagccctgggggcccatgacgccgcgcgggccttccacgcccatcgggcctcgtgggcccgtcaggccctgctctccacgcggacccgcgaggccctgcggccccg

SEQ ID NO: 1901 - DNA, 576 bp, Myxococcus xanthus
agccggccttccgtggccgcgctggcggagtcattggggttgctgcgatctcgagacctggaggcacatggcgctgcacgcagccagctcaacctgctgtgcaatgtcggagccctgcgagaagtcgcgcccggcgtctgggctcgctcgagcgcgatggtgacagccgcggccattgccgtgaagcgcgtcccccggggcgtgctctgcttgaagtccgcgctgtggttccacggcttgctgcctgaatcccccaccgaggtctggatggccattggagcgcatgcgcgtaaaccgcgctgggaccagccaccgctccaggtggttcgcttctcggggcgagcacagacggagggcatcgagcaccgcctgctctgggggttgcccatcaccgtctacggcgtcgcgaagacggtcgcggacctattcaagtatcgaaacaagctgggattccccatcgccgtgcgtgcactccacgacgccctcctctcagggctcaccacctcggatgaggttcgacacttcgcggaaatctgccgcgtcaggaagagtgtcggcccctatctcgaggtcctc

SEQ ID NO: 1902 - DNA, 504 bp, Myxococcus xanthus
caactctataccgttggccactcgacgcgaacgctcgacgagctcatcgcgctccttcgaccgttcggcgtctccacggtggttgatatcaggacgatcccgcgctcgcgccacaatccgcaattcgaaagcgaggcgcttcgctccgcgcttcgccggcatcacctccgttacgtccatctccccgcgctcggagggctgcggcacgcgcggggtgactcaccgaacacggggtggcgcaatgcgagcttccgcgggtacgcggactacatgctgacggacgcgttcgagtctgggctggccgagctgcgtgagctggtcgcggaaggcacggtagcgttgatgtgcgccgaagccgtgccctggcgttgccatcgctccctggtcgcagacgccctgacagttcgcggcgcgcaggtcgagcacatcaccagccgaacccggtcgacgccgcaccggatgaccgacttcgctcatgtcgatggcacgcggctcacgtatccg

SEQ ID NO: 1903 - DNA, 321 bp, Myxococcus xanthus
caggacgagaaagtgcagggagcgcgcggtctggatgctgagccgcttgctgatgccgtggaaccgggtcgaaagcgctggcgacatgccgagcccggtcatgagcgcgagcggcgccgcgatgaagaccgtgatgaagtaggcgatgatctggaggccgttgtacgcgacccagccatcgttctgaggccagcgcagggagaggtactggagcagagcagacgcggcgtcggggaacacctgccagttcgtcgggacgatgcggcgccactctccggtcgcgaagagcagcacgtagaagacgagtccgttcgccagcca

SEQ ID NO: 1904 - DNA, 552 bp, Myxococcus xanthus
ggtggggttgcctcgttgtacggcttggacgcggtggaggatacgggcggtggtgcgagcgctgtgtgtggcgatggccgtatcaacaatggggagcagtgtgacgacggcaaccgggtttcgtcggatggctgtagcagcacctgccgggtggagcccgggtacacctgcaatggcatgcagcccagtgtctgcacggacgtcaatgaatgcacgaatggcactgcgcagtgttcggtgaatgcgatttgcacgaacacgccgggaagttacacctgcacctgcagaccgggctactggggaaatggttggacgtgcagtgacatcgacgagtgctcgaacgggactgccgcgtgcaatcccagccaggtgtgtgtcaacacgccgggtggctatgagtgcgtgggtggctcctgtccggctccccgggtgcagtgtggcgcgcagtgcgtggatgtgtcgtcggacgtgaacaactgcggcgcctgcggcgttgtctgtccggcggcgaagacctgctcgtcgggcgtctgtgtcatgaggtagccggga

SEQ ID NO: 1905 - DNA, 744 bp, Myxococcus xanthus
gtcgtcgtgctcgaggcgcgctctcgagtcggtggccgggtcctgaccctgcggcagccgttcctggacggaatgtacgccgaggcgggcgcgaagtatgtcctcggtgggcactcgacggtcctcggctttgcgaggaggctcggcctggatctcgacccgctgccagttccgcacacgtcggccttgcggcccttccatcttcggggacgtcgcatcctggcccccattggtgatgatacgagcctcccgcatgtcctgagggcggatgagcagcagctcggcctttcaggtctctatcggaggtacgtggcgcccctcgtggaggctgtcggcgaccccttccatgagtcctggcccggtccaggcgcggcccacctcgatggcctgacccttcgtgaggccctcgcggaacggggcgcttcttcagcggccatcgacgcggtgagcctggggcggtttgacctcgtgggtgatggcatcgacgcaagctcggcgcttggtgttctgcgacgggagttgttgacggtcggcagaggaggctcgagcgcctacaccttgaggggcggcagtgaccggcttcccgtcgccctggcgaaagcgctcggtggaaggattcagttcggatgggcagcgaagcgcatcgagcaggaacaggggaccgttcgcgtgtcctcccgcgagcagcacgggagagcacagaacgttcacagcggagcggctagtgagccccattccgttctc

SEQ ID NO: 1906 - DNA, 1149 bp, Myxococcus xanthus
gtggcaatggtgaaatacgcaagtaaaaaattcccggttgttcaatggtctgctgaagatgcatgtcgcacagatttaccgtttttagctagaattgtagaagctgttatcgatgctggtgcaaaagtcgttaatattccagatacggtaggatttatcacgcctggtgactatcaatccgtatttaattacttaaaagaacatgtatcaaatattcataaggtcgatttgtcagctcactgccacgatgacttagggctagctgttgctaattcaatggctgctattgaagcaggagctactcaaattgaaggaacgattaacggaatcggagaacgtgccggtaacgctgctcttgaagaagtagcacttgcgcttcatgtccgtcaagacttctatcaagcgagcacaggtttgatcttgcccgaaatcaagcgtacgagtgacattatcagtaagcttaccggaatgaatattgcgccaaataaagcaattgtcggaaaaaatgcttttgctcatgaatcaggtattcaccaagatggcgtcttaaaaaatccgttaacatatgagattatttccccagaacttgtgggtgttaaacaaaatccgattgtgctgggtaaacactcaggccgtcatgcgttccgtacacgcttagtagagcttgggttcacattggaagatacagaagcaaacgtgctttttgagaagtttaaagacttagcagataagaaaaaagacattaccgacgatgatttattggcattagtcattcaaaagcaagttagcaaagacagtgaatataagcttgaaagtctgcaagttcagtatggtacgaacaatattcctacggctacgattacgcttcgcaaagaaaacggcgaagagattcaagaagcagctacgggatctggaagcgtggaagctatctataatacgctgcagcgctgtgttgagcaagatgtcaaactattagactatcgtattcagtctattaacggcggtccggatgcactggctgaagtatttgtgaaggttgaaagcgaaggaactgaagcaagcggacgcggagtagcatttgacgtattagaatcgtcagcgaaagcctatttaaatgccattaatcgattaatcgctattcagcagcat

SEQ ID NO: 1907 - DNA, 780 bp, Myxococcus xanthus
atgaacgcatccgtaccgactgaaatcacgcaccaggtttcaagcgcctgctcagtgattggccgtcacctggccagttcgctgcaggccatacacctcttcggctcggcagttgatggagggctgaaaccacacagcgacatcgatttgctggtaaccgtcagcgccccattgaccgaagccgttcgacacgcgctgctcaaggagctgttgtcggtctcgacatggccaatgacgcgtgaatcgctccgccctctcgaagtgaccgttgtcgtccgggatgcggtcgtcccttggcgctacccgccgtcacgcgaacttcaattcggggaatggttgcgcggagaaatggaagccggccacgtccagcccgccatcgtggaccccgacctgacaatcttgctggcgaaggcaaggagacacagcatctgcctgttgggcgagccagcaaccgacctcttcgaccccgtaccccggaccgatctggcgagagcgttctacgacaccgctctccaatggaacgaacctgcggactggcgtggggacgaaaggaccgtggtgcttgcgctggctcgcatctggttcagcctgtcgacggggggaatcgcccccaaagacgttgcggcccagtgggtcattgaacgcctgccggatgaacatcaaagtatcatgcgcagtgcgcgggcgtcttaccttggagagacgcaggacgatttggcacggagaggcccggaagtcgccgcgttcgtgcactgtgccaggacggccatcgaacgaatg

SEQ ID NO: 1908 - DNA, 849 bp, Myxococcus xanthus
ccctcgtggagcaagccggtccacccgccaccccgggggctgtccggttcaccccacccgtgtgatgtcattgacgcggtacgcctccctcggaggcgggcgcgtcagtccttgtagacgaccttggagccgccgctggcgcgcacgtcgctctggctcgggcgggacacgagctggaggacgctgcccccggaggcctcgccgctgacgcggtcggatgcatccacctccacgcgcgagccgccgctcgcttccgcgtccagcgtcttgacgcccttcacgtccagggcacgcacgatggagcccccgctggcctcgacgtcgaagtccgttgcccgtcccgccagcgtcaccttcgagccaccactggcctcggcctccacctggcgtgcatccacgccgcggacgttgacgatggcgccgccgctggcctcgacgtcgaactcgtccgtgcgcgtggcgtccgcgtccacgtggctgccgccgctggcgtggatgccttcgacgcgcgggctggagacgtacaggcggacgctgccgcctttgaatccgctgaagagcttcttgtccacgcgggtgcgcagcgtcccgtcatgcacatccatttcgattcgggacacgagttcggccggtccctccaggcgcacggacttggggcccaccttcacctcggcccggatgccgtggctcaccgatacctcatcgaagtcgggcacctctcggacatcgcctcgctgctgttgtgcggaagcggacgcaccggcttgagaatcctgggcatgggcacaggcaccgaagaggaggaaggcggcgacgattgagacgcgggcgggggacatgggcacgctc

SEQ ID NO: 1909 - DNA, 1236 bp, Myxococcus xanthus
atcgcgcagtgggtgccggaggtggctgcggctccggcgatgacgccgtcgcagggaggcagcaagggagcggtggcgtcgcaggcgaaggcggatgcccggagcgcgtccatggtgtcgccgccggtggattcgacgtcgccgacgacgccgatgccccggtcgctcgttgcacccgtggaggtgccggcggattcgacgtcgccgacgacgcccatgccggttgccatcggtggcgtggttcaggcgttggagccgcgctcctccccgcagcaggacacgcttcagtcgtacccggtggtcgtgaagacgcccgcgcttcgggcggatgcgtcagcgcgtggagcgtcccggcccagggcgcagtcccgggcctcgggggtgaaggtacaggcgccgcaggcgcgtgacgaagacgtggtggcgatggcggctgcttcgtcgccgccatcaggaggcgcttcaccggcgcctacgactcccgaggatgcggacgacgccgtgcatacgcggagcacggagtacgccgcgacggtgccgtcagggcggccaggagggcggattgccggcatcgtcggggccgtggttgcgctgttggtgggcggcgctgtcaccgtgatgcggggtgatgattcagaggtctcgcccgttcgtgtgaatccaccgccgctcacgcacttgccgcgcgagcctgcggtgccgagccaaggcggcaggaacgtgccgcaggagaaaccggccgcgaacgtgaatgcaggtgctcgggattcgaatgatggggcacaagcgaagccgcaggtttcgacggacgtctccgtggtgccgcaggaaccgcacgtcgcacgggatgccaccacgcccgaagcagggcttcccactgtgaaggatgctccgcctgagaacggcggagcggcttcgaaggaggggagcgctgtcgtggcgaagcgtgagcccgcgaaggcgtctggggatccagagccgaatccatcgcgggtccgtgaaagggcaccgactcagaaggtggcggctgttgcaaaggggcgcctggagttccgcatccgtccgtatgccgtggtgtcgttggacgggaaggtactggggcagacgccgttcgccgcagttgaggtacccgagggacgacacaccgtccggctcgtcaacaaggaactgggcaaggacgtgacccggaccgttgatgtgaaggcaggccaggccactgtgttcaagctcaatctc

SEQ ID NO: 1910 - DNA, 708 bp, Myxococcus xanthus
gccaggagccaggagaaaggcctcgcctcgccctccagttccaagccccacacgcgcgcggtgtcgaagttgtacggacgcgccatcagcggcgggtacagctcataggcgatgagattctcatacagcgccgcgaagccgcccagcgtgaggccccagcgtggcgccgcttcctcggagtcttccggaccggagcgccacgtcaccgccgcgtccgcgtacaaggcgcgctcgggcttcagcccggggttgggcagcagcgtcccctgccggatgtacagctccaggaaggacggcgcgcggtgggactgcccggcgttggcgcgcagcccgaagccgcgccccagctcgacggatgcacccagcttcggcgacagcaaccagtacggccccacccgctccagccgcatcgaaggcaccacgtccagcgtgcctccgaagagccgcacctcatccatggccatgacgctggcgcgccaccacgaggaggcctgtgcgccctcctcctgcgtcaccgtctcacccgaggtcgccaccgtgacagtcagcgcttggtactctcccagcggcctgcggccctccagctccacgccgcccaccgagtgccgctgcgcgccgcccgcgccgggaatgtgccccgtcacctccaggccatcacgccggaagaagcctcgcgcgctcccctgccccaacccgtcgagcacgccc

SEQ ID NO: 1911 - DNA, 1710 bp, Myxococcus xanthus
tcgcgggcaatgcccaccaccgcctcgcgaagctgcacgggcgtggcatccgggtgcgcgtacatccagtgccacaccgacatgtccaccagcgcgatgcccgcgcgctcccacgtctgccacagctcgccgagcacccgctcccgctcgctcgccgcgtccggcttgcccagtccgagcaactccaggtcgcgagactggaacacgaaggccagcgcctccgtgaaggcgttgttgggcacccccgcgagcagcgtgtggtccacgccgtagaggctgaacacctgctccacgttgtgccccagctcgtgcaccgcgatgttgtagcccttgtagtccatgccccccttctccacgcgcgtgcgcagccgggggaagtcgcctcgccgaagcgccggctgtgcgtgccccgctccgcgcgacgcgtccacgcgaattcgctccgccagccacgcggccttcgccttcgtgaagcccatgccctggaggatgcgcggcaggtccttcgcgaacgcctccgccgtggggtagcgcttgcgcgtcagcgcatccagttcggactccttccgcttgccgcccggattgaagcccgagtaccagaggtcctgcggctccagcttccggcccaggcgcgcttcaatctccttcgccacgcgcggcaccagcggtgactccagcacctgtgtcagcaaggcccggacgcgcgcctcaggcagctcgcggcccagctcgaagctccgggcgattcgcgtgggtgccaccggcacgtaggggtccgcctgacgcgccgcatggaaggtggccagcaggtgcgtgtagcgcgtgtccggctccggcgacgcatccggcttcgtcgtgcgcgcgggagcatccgcctccaccgtctgcggcggcgccaccgtgacggtgttggtgaaggggtcccaatccaaccgcgggttgtcgatgacggccgcgggaatcgtctgcgtgatgatgcgctccatcacctggacgatcatccgctgcttcagcgcgcccgtcgccgcgtcggagtagtcacccttcagctcgtcacgcaggttccagtggctgatgagccgcagcccctttgggaaggggcgccgtccctgcgcatccaccaggtgatgcatccagatgttgtattcggcgatgtacaggttggccgcggcgatggcgcgcgaggacgcctgttcaatctccgcggggacgcgctggttgaagcgcccggccagccgcgtctcggcccactgccgccgcgtccatgacggcccctgctccacgcgctccgccaacgtggtgagcgggaagttgagcaacaccacgaaccccacgcgtgcgcggaacaggtccgtggtgacgtgggcggccggatcatacgccgccaccaggggctccaccggcagcaatggccccaggtccaaatccgtgtaccactgaagctcgcgcccgatttcgtacaggtgcccgtcgagctgctcgaacaaccgctccagccgctggaaggtcgcgtcgagcgcgttcggatcggacaggaactgttcacgtgcgaacgccgcgaggtctccgtcctccggccgccacatcgccgccacctgctccacgccccgctcaatgcgggcccgctgcgcctcgccgtgccgcgtcacgagctccgccttcagggccgccgcgtcgaacgtggacgtcatggcggtgggctccttctcc

SEQ ID NO: 1912 - DNA, 198 bp, Myxococcus xanthus
atgccgaagttgaagacccgcagcagcgcgaagaagcgctttgacgtgaagaagagcggcaaggtcaagcacggcaaggccttcgcgaagcacctcttcacgttctcgaagacgccgaagtccaagcgcagcaaccgcgggaccggccaccttcgcgacatggacgcgaagaaggtcatcaaggagatgttcccctac

SEQ ID NO: 1913 - DNA, 312 bp, Myxococcus xanthus
atccagctcgggcgggacgcccagaaggaccctgtcttcacgccgaacgacgacgcgtacgactggctcgccgcgaaaatctacctccggtgcagcgagggcaactcgcaccagatggtgtcgcacgcgctgcgcacacacttcgtggcggagccgttcgtcatggcgacgatgcgcaacctgccggacccgcaccccgtctacaaactgctgcgggggcacttccgatacacgctcgccatcaacgagggcgcacgcaagggcctgctcgacgcaggcggggtgttcgacgacttcatcgcgacaggcggc

SEQ ID NO: 1914 - DNA, 507 bp, Myxococcus xanthus
cccgcgcaactccacaagctcgaccgagaactctccgggtacctggacacgatggcagtaggaactaggcgcaccgaacgacggcgcgccctgggcggctacgtcacgggcctcctcctggacggagagagcaagatcatcgagcccatggcggaacgactgacccatgcaccagaccagacggaagctctgctcctgcgattgcagcagtatgtttccggcgcggcctgggatgatgccgaggtgcactgccacctcactcagaagttggagcgagagctgccgggcctggaagccctcctcatcggcgacacgggattcccgaagaaaggcatgcattccgtgcggagcgcacgccagtactcggggaccttgggccgcacggacaattgccaagtagcagtgagtctacacgtgacgggtgagaagggcagcggctgcattggaatgcgcttgtacctccccaggaatggatggcggacaggcgctgcgtgcgtgcagcgggcg

SEQ ID NO: 1915 - DNA, 312 bp, Myxococcus xanthus
atgcaacttgacgtcttccaggtgctcgccgacccgacgcgccgccgcatcgtcgagacccttcggtacggtgagcagcaggtcagtgacgtcgtcgagaaggccggaatccatcagtcaggtgtctcgcggcatctgcgcatcctgtcggagtcgggcttcgtctcgatgcggccggatgggcagcgtcgcctctacgccttgaagccggagccgtttcaggaactcgatgggtggctcaccgggtaccggcagctatgggaggcgcgcctcgatcgcttcggagccgcactggagaagaagcagcaacaa

SEQ ID NO: 1916 - DNA, 999 bp, Myxococcus xanthus
ctgcatgcccgggacgaacgcttcgcgcgcgaggccgagctgctgtcccgcatccaccaccccgccgttccccggttgcgagcgagcgggcgttggcaacccgccaagggaccgccccacccctacctcgcgatggactgggtggagggcacaccactctacgattgggccagcgagcaccgtcccacgtcgcggcaggtgatggccctgctcgcgaggctggcgcgggcgctcgaagccacccacgcggccggggggctgcaccgggacgtcaaaggacacaacgtattggtacgcgaggccgacgggcaggcgttcctcatggacttcggttccagtcactacgtgggtgccgcgacgcagacgagctcgccgtttccaccagggacgccggcctatcgttcccctgaagcatggcgcttcgcggcgggtaactccgcgcctccgtatgcgccgggacaggcggatgacgtcttcgccctgggcgtcaccgcgttccggatgatcacggggcggtatccaccgtcgacgcatcctgacgtggcggagtccaggttctggcacaccgagcgagcccaggccccatccccgcgagacacgaatgggcactgctgcccggagttgagcgcgttggtgtcgcagatgctcgccccaagcctccatgcgcgaggcagcgcacgcgagctggcggaggctctggattccgcggtggcacgggcgggctcggagtcgaatgtgccactcatggtgggaggtgcccttcactcccgagcatcggcgcagtggaaggaacgttccgtccgccatcgggcccaacgaccccggtggccatgggtggccatcatcggacttggaggccccctggtactgagtctcggctggcggcctcgcgcgggagccgcagtcgaagtcgctcccatgccgactgcgatgtccgtggaggcaactgacggcggcacggtggcggtgggagacagtgtgttcgcggctccggcatct

SEQ ID NO: 1917 - DNA, 1449 bp, Myxococcus xanthus
gcgagctcggcctgaaccactgagcccgagcgcagggctcgggccggcgtgcatgcgccggcccgggcctctggggaacaccgtctcgcacgcgcggcgaggccctctccttcaacgactcagtgctggcgcgtgagcggcagggcgggcacgtccttcacgtgcgcctggtgcgtcacccgcgtgcccaggatgaagtgcggttcgaggggatcgaacgtctcctggcccgagtagacaacgaagaacttgccgcccccgtaggcgacatccggcaggtactcctgtggttggtccccggtggagatagggaaacccgaggggtcccacacgtccccgttctcgccccaccgcgcaccccacacggcatgcggaccgtcacgcctgtcgtcccagacgaccagggacttgtcgttgtggtgggcgatgcgcggctcggcctgcgcgccctctgcggtggagatggggatgccttcggggtccttcaccatgcctgtcttgctcacgcgcgcgccgaagatgtccgcgttcccattccggtcatcggtccagaccacctggtaattcttgtgcgtccactccacgtcaggcgtcgtctgggcgccctcggcctgggagatggggaagccgtcgccgtcgaggatggtgccgtcctccttcaccctgttgccgtagatgtccgcattctccgggccttggccgtgctcgtcggaccagacgaccaggaactccttcgttttgttgttccaggtcgatgacgcgtcattcgcgaagttggggacggcgctgagggactcgtcgtccgtatcaaggacgacgccatccttcgtcacccgcgtgaagaagatgaccgtctcttcgtcaccggagacggtgtacgtcaccaggcagatcttcggggagcaggccacacgcaccgggccgacggtttcacccgtctggatggcgcggaacaccggccccaccacggtgccgtccggcttcacccgcaccccgtcgacaccatcgcggctctcccagacgacgaagaagtacttcccgttgaaggcgatggcgggccgctccccattctcgtcactgatgttgatgcggatgccccccgggtcgagcacggtgccgtccggcttcacccgggtgccgtagatgccgccggtccgcacatcggtccagacggcgaagaacttgccgtcaccgtacgcgaccgcggggccgaaacgcgccaccgcggcgggcatcgaggagccacggtgttcatcgagcccggcctcggcgctcgatgtcgcctccgccgtcatctcctccacttcgttctgcgcttcctgttccggcgccaccccgcagccgaccagcatggacccgaacaccagcccggcaatgccggccttcacttcccgcttcatgtgcagcctccccttcgcgaacaacggcgaaagagtggggggctccgcg

SEQ ID NO: 1918 - DNA, 558 bp, Myxococcus xanthus
aacatgacaaagtttattgatacagatgaaaaagaaattaaaaataaaagttttgaaataggagatctcaccggctggaaaacgataaagggaaatgcattcacaaacgatcatgtaacggatgcaatcgcaaattggagcggtctttttgaacaaaaaggaaagtatcatttatggggtttttctgataagcaagatggcgataatgccactggagaattacattcgtcttattttaaattgagcgggtcaggtgaaattaatttgttaatgggaggcggaaacgaccccacaaaccgttatgtagccttagtccgggcatccgacgataaagaattgattcgtcaagcgaatacaaagtttgcagatgaaaagtaccagcgctacgtatgggatgcttctaagtatataggagaagtactgtacattaaagccgttgatcaagctgtaggcggatgggggcatattaatctagatgatgtaaatgtatttaatacagaaaaaatgccggacaatgtacacagtgtatcaaaagaaccagaggaagctaaacaaaga

SEQ ID NO: 1919 - DNA, 1863 bp, Myxococcus xanthus
acgcacctgcccggtgcgctcgcgagccgcggcgaaatagaggacggtgatgcgcacgttcctggcgtccgccatgcccccgctcaacgcgaagcctcctgctccgcgcgcaaggacaggcgtcccttgagccggcccccgccctccaccgggctgaagtcgaggaagcccgagtccagcggcgtaatccgatccagcagcgcccccgaaagcgccttcgtcgccccgagcagcatattgggcactccgggcaccttctccgccgcgcgcaggtccgcgcgcagccggcccaggtccaccatcaccgacacatggcccgagctgaaggcctcaccaccgaagcgctcccgcagctcggcgcccacgtctccgcgaggacggccctgcagcagctcccccgccagcaggctggcgcgctcgggcgtgatgcgcagctccaccggatgctcccgaatccgcgtccggaagagcgtgccattcgcctcctgctgcgtcgtgtagcgcagcacggagtcctccagttgcttctgcacgagcgcccgcacgggctccgactccatcagccccgcttcgaatacgatggagcccttgatgtcgggccgcttgttccggatgaagttgcggaagaaggccgggatgtcgaagtacgcgcgcagcaccacgtcgccgcgcagcgccttgagcaacgcctccacatccagtccttcacgacgccaggacgccaccatgcgctcgcggcgctcggagcccggcgcaccgaacgccagccgagccagctcctcgggcggcacggaaatctgcgccgcggcgatgggccccagttccgcgtctttcagcaacgccgacgcgggcgcgcgggcgccctggaacaacggtgtcgaggaggacaggaagccatccaggtccatccgctccggcttcaccgccagcgacgcggcgaagccccgaatcggctgggtgccttcttcatcaggcgccactccgggctgcagcccggagaagagatacacgctgccgctcgccaccttccctcgaagctcggtcaggagcacgtcctcggagatgcccggccccgtgaggcttcgcaccgcctggcgggccacttccgcgtcgggaatggccagcacctgcgcctgctgagactcgccctcgtcgggctcctccagcccctccggtacggcgagatagaggtagcctcggtcctcgaagagcaacatcgggggcccgcctgacgcgggctccacggtggcggagccgtccggctgcggcatcacgccgtgccccgcccgctccagctcatcggcaacggccttcagggccgcctctggctccgtgatgcccagcagcgtcacgacgccgtcgaactccgggagcaggaagaagccgaagccctcgtcggggtccacgaccgagccggtgccgttctccaggtccgcgaagagcagcggcagcagcggagatgactccacggcccgccgcgcattctccggccccacgagccgcgcgtagaagtccatcagcggctccacgtggccgcgcagctcgggcagccacatgacggtgcgcgcgctggagggcaccgcgcgcagcacgggccgaggcaccaccgtcaactggacgcggccaacctccgcgccctcgtgcagggcgcgcacggtataggcgcctgcccgagtgaacgcgtgagacacccacggcgccgtctgggcgtcgctgccgtcaccgaagtcccaggtgacggcggtggcgtcctcgcgctgcgagccgaggtcgaccggcacgcccgcttccaccgtccggtcctgccccaggtccggccgcaccgcgcgacggcagccggaggcccaggggcccacggcgacc

SEQ ID NO: 1920 - DNA, 1731 bp, Myxococcus xanthus
cggacactcaaagggcatgatggtccggtcaatggctgcacggtgacacccagtgggtgggtggtgtcggcctcggacgacaagacgcttcgggtgtgggagttggaaacggggaaggaactggcacgaatggaaggccatgaaggttgggtgcgaagctgcgcagtaataccggatgggcgggtggtgtcggcttcggatgacaagacgcttcgggtgtgggagttggaaacggggaaggaactggcacggatggaaggccataagggcccagtctggggatgctcggtgactccggatggacggttggtgtcggcttcattcgacgagatgctcagggtgtgggaactaaagacgggaatcaaactggcgcagctggtgggccataaaggggcagtcaatggctgcgcggtgactgtggatgggcgggtggtgtcagcttcgtccgacgggacgcttcgggtgtgggagttggaaacagggaaggaactggcgcggatggagggccatgaagggccggtcaatggctgcgcggtgactgtggatgggcgggtcgtgtcagcttcgtccgacgggacgcttcgggtgtgggagttggaaacggcgaaagaactggcgcggatggagggtcatgaacagccggttaatggctgcgcggcggcagcacatggctgtgtcttgtccgcctgcaacgataagactcttagggtatgggagctggatacagggagagaggtagcacagctggaaggccatgagggcccagtcaagagctgtgctgtaacggaagatggatgggtggtatcggcatcggacgataaaacactaagagtatgggagttggagacggctagacagtcagctcggcgacaagatcataaaggcccggtgtggggatgcacagcaacatcagatgggcggctagtgtcggcctcttccgacaagacgttgaaggtatgggagctgaaaacgaaaaaggagttggcgcggctagaaggccatgatggatgggtgaggggctgcgcagtgacagcgaatgggcggctagtgtcggcctcttccgacaggacacttcgggtctggaatttggaggcagggaaggaactgatgcggctggaaggccatgccgggccggttaatgactgtgcagtaacggcacgtgggcaggtggtgtcggcctcttccgataggacacttcgggtctgggatttggagacagggaaggagctgatgcggctggaaggccatgacgggccagtgtgggactgtgcagtaacggcacgtggacaggtggtgtcggcctcttccgataggacacttcgggtctgggatttggagacagggaaggaactggtgcgactggagggccatgacgggccagtgttgggctgcgtaatgactgcggacggtcgattggtgtcggcctcatctgacaaaactctgagaatatgggaaccaacaacaggcaaggaactcgctcgactagaaggccatagagggccagtatgggattgcgcgatgacggcagatggaatggtgatatcagcttcagacgacaagacgctgggcgtgtgggatatcgcttctggtcaacgcattcatacatttcatgggatgagtggatttcgttcagttgccgtcactagggataccgtttgcgcaggagataccctaggaaacatctggatgacggaaatagaaccggcacgagtcaaccaagagcgaagcccc

SEQ ID NO: 1921 - DNA, 632 bp, Myxococcus xanthus
cccttcgagctgggccggggcgaggaggtgtgcctgctcctgcacggcttcacggggagcccctgggacgtgcgccccctgggcgaggccctggcggtccgtgggctgcgcgtggtggcgccgcgcctgcccggccatggcaccaccccacaggccctgctcgacgtcacctggcgtgactggttggcggcggcggagcacgccctgcacgcgctccggggccaccggagtgtgttcgtggcgggcctgtccatgggcgcgctgctggcgctcgagctggccgcgcggcatccggaggagatacgcgcgctgacgctgatggcgcccgccgtgtgcttccggggtccgcgcatgttcctggtccggcaactggcgcgcacgcccgtcctggagtggaagcgtccgtgggtggagaagacgggcaccgacatctcaggacccggaggcgctggcgcaagcgcccgtgctgccctgcctttcccttggcccggttacgggacctgtgcacgttgcagacgctgtccatccggcacgcggcccgcgtgcgctgccccactctggtggcggtggcggagcaggaccacgtagtggccccggagggaggtcggtgtctcgcagggcgcctctccgcg

SEQ ID NO: 1922 - DNA, 339 bp, Myxococcus xanthus
accgttgagttgacccaggagaacttcgagcgcatcacccaggaggccggggtgtgcgtggtggacttctgggcggagtggtgtggtccctgccgcggcttcgcgccgaccttcgaggccgccgcgaaggagttcccgaacatcaccttcggcaagctcgatacggaggcgcaggaagaggtctccggccggatggagattcgctccattcccacgctggtggccttcaaggatggcgtcgaggtccggcgcgcctcgggcgcgatgtcggcctcggcgttcgcgacctggctgagcaagctggactccgtggacctggccgtcgagcagcagcgggcg

SEQ ID NO: 1923 - DNA, 405 bp, Myxococcus xanthus
cttcctggtgaccatcaacacccgatgaagggcgctacgctcttggccaccttgcagtggctgggcgtcaccccatccttcagccggccccgcgtttcggacgacaatgcgttctccgaggccctcctccgcacgctgaaataccgccccaccttcccgcagcgccccttcgcgtccgtcgaggacgcgcgtgcatgggtgatgcgcttcatggcttggtacaacagcgagcaccggcactccgccatccgcttcgtcacgccggacgacagacattccggccgcgaggcaacgctcctcgcccggcgcgaccaagtgtatctgcgtgcccgagtccgtcaccccgagcgctggagaggtggcacacgcaactggacgccagcgggccccgtccgtctccggccc

SEQ ID NO: 1924 - DNA, 1953 bp, Myxococcus xanthus
cagggctcggcccgacttcgcgtcgaagcgccgcagcttcgccgcgtcataccgcagccacaccggagcgcccgttggcacacggaagtccccggcggcgcgcgccaccatgcgctccccggccacgtccaccgtcacccagctctccgcccccatggactccaccaggtacacgtggccctccagcgcctccggtggcggcgtgccctgccccacctccaggtgctcgggacgaagccccaacaccacgtccgcgtccggcagccccagcgtccggggcttcaccaggttgatgcgtggcgcgccgaagaagcccgccacgaacaggttcgccggcgcgtcgtacagctcgcgcggcggggccacctgctgcacctcgccctggttcatcaccaccacgcggtccgacagcgtcatcgcctccgcctggtcgtgggtgacgtagacgaaggtggccttgagctgctcgtgcagcttcttgatttccccccgcatctgcgtgcgcaacgccgcgtccaggttggacagcggctcgtcgaagagaaacaccttgggacggcggaccagggcacgccccaatgccacgcgctgccgctggcctcccgaaagctccttcggcttgcgcgacagcaggccctccagccccagcagcgacgccacctcgcgcacgcgcgcgtcgatgtccgccttcgccacccccgccaccttcagcgggaaggcgaggttccgtgccacgtccaggtgcgggtagagcgcgtagctctggaacaccatggcgatgtcccgctcccgcggtgacatgtcgttcaccaccgcgccatcgatgcgaagcgtgccgcccgacatctcctccagcccggcgatgaggttcagcgtcgtggacttgccgcagcccgacggacccaccagcgagatgaactcgccgtccgcgatgtccaggctcacgcccttcaccgcggccacgccgccccggtacaccttgcgcacgtcctccagggacaccgtcgccaaacgccttgcctcccaggcgcccggcctctggacgccccatgtgtcattccgtctcacccacggacctcgaagcatcgcgccctccgctcccagggcaagccccgtggcgagggtccgccccgcctctgaccgccattccacaccgggatggaagccgggcggccgggcgccccttccccacgccaggcagccgcttcttggaggcggaaggcggcggacgcgcactatgttcgcgcggccatgagtccctcgagcccaccgtcctcccgccagctggccatcgaagtgcgggacctccacaagtccttcggagaccagcaggcgctgcggggggtgaacctggaagtgccagagggcaccacctgcgtgctgatgggcgtgtccgggtcgggcaagacggtgctgatgaagcacatcatggccctcttgcagccggaccggggcaccgtcctggtggatggcgaggacatcgcgcggatgaacgaggccgcgctcgaccagatgcgccgcaagcagggcatcctcttccaggcgaacgccctcttcgactcgctcaccgtgttcgacaacgtggccttccccctgcgcgagcgcacccgcatgcccgaggcggaaatcgccgagacggtgaacaagacgctggagcgcgtgggcctgtcgcacgcgacgcagcgcttccccggcgagctgtccggcggcatgcagaagcgcgtgggcttcgcgcgcgccaccatcctccagccgaagattctcctctacgacgaccccaccgccggactggatccactcaccaccgcggcggtgaatgaaatcatcaccaccggcaagcagcagctcggcgccacctcgctggtgattacgccggacgtggcctccgcctttggcatggcggaccacctggccctgatgcacgaaggccgcatcgtggagtacggcccgcca

SEQ ID NO: 1925 - DNA, 420 bp, Myxococcus xanthus
gaccccaaggacctcgtgcaggaaaccttgttgcgcttcatcgagcattacgaagccgcgccgagcgagcccaaggacgggccagccgaaggctggctcatcaaggtcatgacgcatcacttctatgacctgattcgaggggccatgggtcggaagaaggcagagggcgatccgacgattactcgctggaccttggcacagcaaggggcgagcggcgcgacctacgaacggattaccgaggagcgtttcgattgggccatcggaaagctccctcagcagcagcgccttaccttcctgcttcgatctcaggggctgcgcaaccaggagattgccttgaagctaggcgtctctcccggcaccgtggccaagcgactgtttgacgcgcgtcagcggctcagcgaactgctcaagccttacgtt

SEQ ID NO: 1926 - DNA, 576 bp, Myxococcus xanthus
tggctctcgcttcgagatcacttcgtcgcgacggtgggcccaagggcaggagaagggcgacgcatgggacccgttctcgtgctcgctgacgcgacgttcgcgccgcactcgcgcttcccaatccacccacatcgcgagatggatattctcagcgtcgtagtcgacgggtcattgtcgcaccacggtgaccaggcgcacggcgtgaccctcggaccaaggtccgctcagttgatctctgcacgcagcggaatcgtccacgccgaaggcaacgacaccgaccagccgacgcgaatgctgcagatttggtttcagccgaacacgttcggcggggcgcccgcgtacttcactcgcgagctcgcgggccaaggtcgccagttgctggcgggcgatcccgagatgccgctccgagccgatgcgcgattgtggtgggtggatctcgttccgggtagcgaggagactcttatcgtcgaccgggcgcgccaaggctatctgctcgcgatgacgtcacgactgcggatcgcggcggttggaagtgagcccaccctcgaactcgccatcggggaaggcctggaggtt

SEQ ID NO: 1927 - DNA, 318 bp, Myxococcus xanthus
gacagcgacatgcgccagtgcatcgaggcctgcctggcctgtcaccgcatctgcatggagacgctgacgtattgtctgggaatgggtggcaagtatgcggaggccagacacctgcgcttgctgatggactgcgcggaaatctgccagacgagcgcgaacttcatgctgcggggctcggagctacacagccgcacctgcttcgcctgctcggaagtttgcgggcgctgcgcggagtcctgcgcccaaatgggcgaggacgtggtgatgaatgcctgcgcggacatgtgcacccagtgctcggatttgtgctggaagatg

SEQ ID NO: 1928 - DNA, 194 bp, Myxococcus xanthus
atgccccacgttgccccacacacttcgcgatggcgtgacgcgctgggctcgctctccgcgcgactactggtggcgttcctcgtgcccaccctgctcttcgtcgcggtggcggaaaaaagccgtctcaccagctcccgcgcgtcatcctggaagaagagctgggcaccagcctcagcggcatcgccgccgccacc

SEQ ID NO: 1929 - DNA, 636 bp, Myxococcus xanthus
aagtacgccttcgttttcgccatggctgccgtgttgattgccttcctggccctgcgactgggcggcgtcgcgtggcttctgttgtggcctggggtgagcttcatcctggtggcactcgcctacgctggactgggcgaacacgctttcggcaagcgcgtggacgggcggatgcagccctgggcaatcatcttgctcctgccttatctcttgctgacatggggcgcctggcatctggttcgatggctgtcgcgagagcgtgcgttcgacgaagtggtgccaggcgttttcattggaagacgcttgttggcgggagagcttcccgacggcatcgtgaccgtgctcgatctgacgtctgagttcgtcgaaccggaaggaattcgtcgcgcgggccggtatgtctccctgcccatccttgatgcttcgattctgcccgtagcgagagtgacccctgtcctgcgtgagctggctgtcggacctgatgcgctctacatccactgtgcgcaagggcatggacgcaccgggatgattgcggccgcgctcctcattgcccgaggtgatgcgttggatgcgtcgaccgcgctctcgatggtgcagcgcgcgcggcccgcggtgcgactctctgcgacgcaatcgcgg

SEQ ID NO: 1930 - DNA, 696 bp, Myxococcus xanthus
gggccgaatcgggtccgcagcttcgcccttgagcgccagccacttcgggggcaagtgcgcgtcatcgtcgtcctcgtcgacttcgaagacaggcccatgaatcgaagccggcaggaattcgaggacctgttcttctcacaagggaagatccagacaggaagtgtgcgggaatatttcgaggaggccagtcatgggctcgtcgacatcgtggggcaggtcgtcggtccgtatcgcatgccttgcaagctggcccagtacgctgggaacggttcgggcactgacaatccggagcccaacgcgcggaccatggcgaggcatgccgccgaagccgcggccagcgtggacttcgcgccctacgacaacgatggaaacggcttcgtcgacgcgttcatcgtggtccactcaggcggtggcgcggagcagaccggcagcgctggtgacatctggtcgcacaagtgggttcttgtcggcggggaacacaatgcgcagggggcgaagatcttcgggtatttgaccatcccggaggatgcgaagattggcgtctgttgccatgaaatcgggcacctcgtgttcggctggccggacctgtacgacgcggatggctcctcggaagggctcgggaactggtgcttgatggcgggtggaagctggaacaacaaaggcgatgtcccggcccatccatccgcttggtgcaag

SEQ ID NO: 1931 - DNA, 1296 bp, Myxococcus xanthus
gcctcggtggcgccgctggtcaccgtcaccatggtgtccgggtccaccgtctggccgtagaagcgcgccgagtgctcggcgatggccacgcgcagctcccgggcgcccgcgcccatggcgtactggttgcccccgtcgcggatggcgcgctgcgccgcttccttgatggccgccgggccgtcgaagtcagggaacccctgccccaggttcaccgcgccgtggcgggcggccagggcgctgaactcggagaagacagtagtggcgaaccgggtgactcgctgcgcggctacgggcctggacatggacgtcggctcctcgcgccgccaacgtccgggcgctcagggcctgacgatagcgtccaccggcacggaacgcgcgtccttcgccacttcgcgctgccgggccgcccgggaaacgcccagcgccagccccgtcaccaccatgaccatgggcaccgcgcagagcaggtccgtggcgtagtggaaacggcccaccagcgtggcagcgatgagccccaggcccggcagcaacatcacccagaagacgcggcgggagaaccgccaagcataatacagcaccaacatcgtggcgccggtgtgtcccgacggaaagcagtcacgcgcgaacagcggcttgcgcatgagtgaatccagcagcggcgccagcgtgccctggagtggcccatcgaacgcgtcgaccaggaagtagcgaggccccaccgcgggcaccagcgcataggccgcgtagttgaggaagaaaagcagccccaacgcggtgaggtactcgtcgtactccgcgccgcccgggcgccggtagagcaccagccccatcaccagcgcccagatgaagtggccgtagtagcagaccagcaggatgtcgttgagccacgccgggacgacgcgtgacagcaccaccgccgcctgcatgccgaagagccgctggtcggccgccaccaactgcgcgtccttgaggagggggttcaccgtgtccaccacgggagacagccagccgtgcgtcatcaccgccgtgggcagcagccaccaatccgcgaggacatggatccaccggtgccccgggaacgacgcggccagcgtccggaggacgagcggccccacgcccaccaccgcgaacaatcccgcgcagcgcagcgcatccggcgcccaccggcccggccccagcaggagcagcgaagccaacgcgcaggacacgacgatgatgaggtccacggtggtgagctggacgcgcaccgcctcaccgcgaacgctttgggaaacccaggaactcacgccgacttac

SEQ ID NO: 1932 - DNA, 1005 bp, Myxococcus xanthus
tcccgcggctcggagcagggcagccacagccggcacgccgagcccgccttcacacagggatgctcaccctgcgcgccggtgcaggcaggcccgaagtggcccgcctcgagccccgccaccgcgcaactccgggtgccgtccgcccgcgcgacacacgccatgcccacggggcagtccgcatgcgcacggcaccactgcgcgcaggcgtccacatccgggtccaccagcgtccggacgggcgcgcctcgcgaggcgtcctcgatggcgacctggatgaagtccgcgtgcacgtcgacgcggctgttcgtccccgtggtgcaggagaggtcaccaaacgaagtcacaccgaccaggcgctcgacgccgtcctgttcgatgaacaccgggccaccgctgtccccgccgcacgacatcgctggcgccgcttcgatggagaacgcgtccgcttcaaccgacgtgattcgggacaggccgccacggcgcaggcccgagccgccctccccgtccgcgccaaagcccaccacccgcgccagccgccccacgccgtcagcgggaaacgcccgcgccgcccaggccagcggagcgaccggcgcatcgctggcgagaatcaacacgcccaggtcactcacgcccgggcgccacgcgggatggagccggccctccaccacgcggatgcgctgcgcggcggaggcacgggctgtctccgcggcgaacaccaccgagaacacccgtggagcatccgcgttctccacgcagtgcgccgccgtcagcaccacccgaggcgccaccagcgtgcccgtgcagagcacgcgagccgcctcgtcaggctccccacagaagggcgggacgggaacgatggcggccaccgtggggaagcccggctcgggcgctccgcccaccacggcccgccgcgccggggtgagcgtctccggggagacgggaacgacagaaggaccgcacgctcccgccgccagcaggagtcccacggcggcggacgtgacgtca

SEQ ID NO: 1933 - DNA, 225 bp, Myxococcus xanthus
gagcagcttctcaactatctggcgcgggccctggtcgatcatcctgaccaggtcagcctgcgcatttccgaggcggaaggggcccggctcttcgagctgaaggtctccgccgaggacgtcggcaaggtcatcggccgtgacgggcgcaccgtgaatgccctccggacgctgctcaatgccgccgcacagaagtccgggcagaaggtccgcctggagattctcgac

SEQ ID NO: 1934 - DNA, 417 bp, Myxococcus xanthus
ggggcgcgcttggatggatgcatcctggacaggacgaagctcgcccacgccaaccttgcgtccgcatctttcatcggcgccagcctctccagagcgcagctttcaaaggccaacctggactatgcgctccttcgaggggccattctgacgcaggtgaacgcgctccgagccagcttcggcgaagcagaccttcaaggcgcggaccttcaaggcgcggaccttcaaggcgcctacctggtcagtgccaacctcgcgtccgcgaatctccgagatgcgcatctggaaggcgcggtccttcatggagcgaggctttctggggcagatctccgcggcgcctccggattacaggcgacccaggcctcctggattgatctgggtcacgagaacgcgcccgtccgggttgaaggcgaggcgctg

SEQ ID NO: 1935 - DNA, 2855 bp, Myxococcus xanthus
acgggcgcgcagcaccaggtcatccagctccaccggcttggacaggtagtcgcgcgcgcccgcctggatggcctccaccgcgctggcgatgtcgccgtgcgccgtcaccatcaacacgggcgtgttcggaagctgggcgcgcagctccggcaggaagtcgatgccgtccccgtccggcaggcgccggtccaacaccaccaggtccggcgcctcgcgggacatggccccacgtgcgtcgtggagtgaatgcgccagcgtgacgcggaagccctcgtgtcgcagcacggaggccgccagcgaggcgaaggtccggtcgtcatcgaccagcaacagataggtgctcatcgggccacctccaacggaaggcgcagcgtgaagcggcttcccagcggactccggacatagttcagactgccaccatgggcctccacggaggcacgcgccatgggcagtcccagccccacgcccttcgcccgcccggtggcgaaaggttcccacaacctgggctcgagacgcggatccacgccgcccgcattgtcctccaccacgagcacggcgtcatgttcgtcccgcgtcagactcacgctgacccacggtgccaactgcatccctgtgtccttcgccaccgcgcctgcctccaccgcgttgcgcaacacgttgtcgatggcggacaccagcagcgccgcatccccctggacccacagggactcctccagggacgtagtcagtgccacggcctctgactccggcagcagcttcacgccctggagcgcgtccttcaccagcaggtgcacctcgcagcggcggcgcagcgcggcacgaggcgccccgaaggacagcagcgagcgcgccagatggctcaagcgctccacctgcgagcgcagcgcgcccacgggcagctcgctgcccgcgggggtatgccggagcacggacagcgcggcctggatgccgttgagggcgttcttcacctcatgcgcgatgagcgaggccgcggtccccagcgccgccatggtctcctggcgtcgcagccgctcctcggccgccagcagcgaacggtaggagtgccgcagcaggaggatgaagatgatgagcgtgctgctcagcagggcgatgtggaacgccagctgccgcaggaagcgcgcccggaggcccgcggtggccgtctcctcctccaggacgaccaacagcaggtcgctcttccccacccacgcgcccgcgcccatcatgtgcttgtcatccagcgtcagcggccccggcatgttcgccagcgcgcgcagcccccccgtgatgtccccggcgcccagattgaaccccactggcatcaggatctgaccctggtcatccatcagcaccagtgacgtctgcgcggtgggccgcgtgggcagcgcgctggcgcggagctctcccagcagcacacccttgaagcggccctcctggaacatggggacggcgaccacgatgggccccccctccccttccagcaggtcgatttccggctggcggccctccaccatccggcggaaccagggccgcagcgtcagcggcgagcgccccagcggcatgtccggagggtcgctccagacgcgctcgcccgcgggcgtcagcagggccacgccctccgagaagagggacgaatggtagaaggcgctctccagcagggccagctccgccggggaggcgccgtcctcaggagacagcgcggggtgcccggccacgcgggccagctccgcctccaacagccccaggtggacgcccagcgcctccgactgcacctgcgcctggttgagcagccggctcagcagctcctcgcgcgcgttgcgcacgtcctccacgtagcccagcacggggctcgtcagcgccaccagccccaccagccccagaccgacgagcgcggagcgccccccgcgccgctgcgcgtgggccagctcacccggcgtgggggtcagcgtcggcagtggcggtggtgttggcggcaggtgggcggaagtcatgacagagctccctggggtttacctcggcgcggaagcaccttcacgcgcaatcaggccacctggccaggggcccgcccgctggagggccggccatcgccccgggtcgcccgctcccgcgcgtgttcacgccatgacgaagttgttgcacatgcgtcacacgttcggaaaagggggcgcgcagagtgacggcccgccatgccccatgtcctcatcatcgacgacgaacgcgacctcgcggagctcattgatttcaacctgcggggttccggcctcaccacgcacgtgtcccacactggcgaagaagcgctggtggcagcgcgggagcagaaccccgacctcgtgctgctggacctgatgctgccggacatgtccggcatcgatgtctgccggcagctgcgggccagcccccagtcccggggcgtcctcatcgtcatgctcaccgccaagggcgaggagtccgaccgcatccgcggcttcgaggtgggcgcggacgactacgtggtgaagcccttcagcgtgcgggagctggtgctgcggctgaaggccatcctccgccgcggcgcgcccacggctgggggcacggcgccgctggcgctggggcccctgcgcctggacgtggcgtcccaccgcttcttcgtggaggaccgcgaggtggccctcaccgcgctggagttccggctcctggagcacctgctcgcccgcctgggccgggtgcagacacgtgagcagttgctggaagaggtgtggggcctgtcatcctccctggagacgcgcaccatcgacacccacgtcatgcgcctgcgcgacaagctgggcccggcgcgcgcgctgctggagacggtccgcggtgtcggctaccggatg

SEQ ID NO: 1936 - DNA, 618 bp, Myxococcus xanthus
atggcggcccgggcaggcagagtggaggccatgacgaatgccggcctccatctcctgtacggggatggtgttccccaggatgtgcggcacgcattccgatggatgcggaaggccgcaggcctgggggacggggttgccgctttcaatctggctttgtcctacgagaagggaccatgcatccggccgaatcggaggcttgccgagtattggtacaggcgtgctgtatccctgggattccctccggctcgaatgaacctggcggcactgctcgtccagagctccgataaggagaagctgaaggagtccgttgcgctttaccgggaaagtgcacggttagggaatgtgaaggccttgctctacgtcgcatttgcctacgagcagggccgaggcgtccggaagaatctaggacgagccattcaaatctacaagaaggccgctgacgcgggaaatgccgatgcccaatgcgtcctgggttggatgtgtctcaatggtgtcgggggctctacagacatactgggggctctcaggtggtaccaacagtccgcagaacaaggtaacgccagtgccctctttagcctgggacagatgtacggggaaggcaatggcgtgcccaaatcc

SEQ ID NO: 1937 - DNA, 357 bp, Myxococcus xanthus
ctgctccaggagccggggacttcacgggcggcacgccagcgaggcgggctctcccccgccgcacttcgccgcgtgcagctttacgtggaggcgcaccttgcggagccaatccgtgtaggggcgctcgcccagcgctccggattgagcgtctttcatttcacccgcgctttccgccagtccacaggcatgacaccgcacgtctgggtgcagcaacgacgcgtggaacgagcgcgcgacctgttgagcaactcatcactgccattgggggacatcgcgctcgcggttggcttcagctcacaaagccacttcaccacggtgttccacaaactcaccgggctgactccggcagtcatccga

SEQ ID NO: 1938 - DNA, 621 bp, Myxococcus xanthus
gagccgaactggctgaactggacgcgggagctccaagcaatcgcccagacagggctcgcattcgcgcgcgacccttatgaccgcgagcgctacgaaatgctgcgcgctctcgcatcccaaatcatggcggaacatacgaccgcgcctgccgagcgaatcgagtctctattcgaaggtgaaagcggatacgccaccccgaaggtcgatgtccgcgcagcggtgttcgacgaacaaggccgtgtgctcatggtgcgggagatctccgatggcggggcttggacgctgcccggcggctgggctgacgtgaacctgacgccagcggagaacgtcatcaaagaagtacgggaggagagcggattcgaagtgcgtgtgcgcaagctcgcggctgtctgggatcgcaaccgtcaggggcatccgcctgcggtattctcgtgctgcaaattcttctttatctgtgagttggtggggggaacggcggcgacgagcgtggaaacgtcggaggtgggatggttccgcgaagacgagctgcccgatgacatgtctctcgcccgggtgcttcccggtcaggtccggcgcatgttcatgcacgcgcgcgacgccgcgcttccgactgacttcgat

SEQ ID NO: 1939 - DNA, 601 bp, Myxococcus xanthus
atcggccgactcaaccctgccggcttcgacggcaacccccactgccaactcgacattgtcttcgggctgcacccaccggcgcggctcggggattgatatccaccttcacgacggcggcgaggtcggcacccaacaactgcgcgccattgccgaacgcacgaaggcgttggggctcagcggtaaggtcgcggtcagccatgcttacgcgctcgggcagatcgacgagcacgagctcgcacgaacggccgccgctctcggcgcagccggggtcgccatcatgacgaacggccccagccgctcgatgccaccgctgcgggctctacgcgagcatggcgtccgggtgttttccggctcagataacatccgagacgcctggtggccgtatggaaccgcggacatgctcgaacgagcgaccatcatcgggctccaagccgagctgatgtccgacgacgacttgaagtacgcttcttcgctcattaccgactccgcagcggaggtgctcggaatcaccgattacggactgcatcccggctgccgcgcagacctggtcgtgattgctgcaagcagcgtccccgaggccgtcgccgcccaccctgagcgc

SEQ ID NO: 1940 - DNA, 1263 bp, Myxococcus xanthus
cccacgacaccgggcaccttgcggacggactccatgaccttggcgtactcgggcaggtcgcccgcgtacttggacaccacggcgtgcgcgttggtgcccaggattttctgctgcaggtccgcctcgaagccgctcatcaccgacaggacgatgatgagcgccatcacccccacgcccacgccgcccaccgacagggccgtcatcatcatggtgggggactgctcgtgctgcttgaggcggttgaggtcggaggcggccgccagcgggtccttcagccccagcttgcggatgcgggtgcgctccaccgcggcttccgccgagcggatgatgaagtagatgagcagcggaggaatgatgccgagcatcagtaccgccagcgtccccagcagcagcgaggggcggaacaccgccacgtgccggcgcgcgacgaagagctcgaagcccatcttcaggtcgacgcggccactgccggcggcgatgaagccggtgttgacgcccagcaccagcgccagcaccaggaacatgaagacgagccagtaccccagctccgggcggccgataagccccgcgacgtacgtcacctcgcgcagccggtagcccagcgcgagctggagcccaggcagccgctccatcagcgtgaggacgatggggatgggcaggcccaggtacagcacgccgatggtggcctcgggcagcgacagccgctgcgcccgcgaggcgccgatgaagccggagatgaacgccaccatcccgccggccatcaacgcgatggcgaaggcgccggtgggcgccagcgacaggccgccgccccccttcgccgtgcccgccagttcgttggtcgcccccccgctggacagcaccgtctgcaggaggatgaggacgacctccgacagcaggatgccgccgccgtaggcacccagggtgctccagtagaagtcccggtagcgcgccagccgcgggtacagcgtggcgcccgcggccgggctggggccttccgtggacgccggcgcgcggcggatgcccgcagcgatgagcccccaccccacgagccagacggccgtccccgccagcagcacgccggtgttgggcagcggcgcgacggcctgccgggacaccagcagcgccgcgttcagggcctggaccaggccgccccagcccagcagggagagccccagcgcggggctggcctcctcccaagcatgggcggacgtgagcgccaccccgagcaaggcgaagcccgcgagggcgaccagggcccccatc

SEQ ID NO: 1941 - DNA, 796 bp, Myxococcus xanthus
attgtgggaggaatcgaggctcggcctcactccttcccgtggattgtcagcttgcagcagggcaccagccacttctgtggtggcgccctcgtgcgggtcggcgccaaggaagagagcgatatcgtcctcaccgctgcccattgtttctacgacggtacgtccaacgtcaccgcggtcgcaggggctcatgacctgtaccgccccaccgcgggacaagccacagcccgggtggtgagggcggtccttcacccgcaatacaatccggacacgacgatgaacgacatcgccgttctcaagctcgaccggcccatcaagttcgaccaggccgttgccggtgcctgcggtcagtcatccaccatgcgccccaatctggccgcgccagtacgcatctggaggcacccgcgcacctgtctgtctccctgccagcggggatcgggttgcagacaacacgatggcgaccgtcgcgggctggggcctgacacgggagggcgggtatgacacgtcctccctcttgctgcaggtgggggtccccaccctgaatcaccgggacgtggccaatagctatcgcccccatggaatcaccatcaacgagcaggcgatgttcggggctggttacaaggaaggaggcaaggacgcatgccaaggggacagcggaggacctctcatcgtaccggggccccaagggtacgtgctccagggaatcgtgagcttcggcgtgggctgcgcgagggcggggttgcccggcatctatacgcgggtctccaattacatcccgtggatcaacacgcagatccgg

SEQ ID NO: 1942 - DNA, 528 bp, Myxococcus xanthus
aaggagaccatgaccgttcatcttcatgtcatcacaggcggccccggttccggcaagagcagtctcatcgaggcgctggcggtggagggactcgcgcacatgcctgaagcgggccgtgccatcattcagcagcaggtcgcaataggcggccatgccctcccttgggctgatcggacggccttcgccgagctgatgcttggatgggagatgcgaacccacaaggaggcctgcgaactacgccgtcctgtcatcctggatcgcggcgttcccgacgtcatcggataccttcgggtatgtggtcttccagtgcctccacacctctggaaggccgcggagctgtttcgctacaatcgacgtgtcttcatcgcgccgcattggcccgaaatcttcgcgcaagatgccgagcgcaaacaggcccccgacgaagcgaaggcgacctatcgctcgatggtcgaggtctacaccagccttggctacgagctgctcccccttcccctggcatcgctcccggagcgggtgcgttttgtg

SEQ ID NO: 1943 - DNA, 303 bp, Myxococcus xanthus
gagaccttcacggcgctcgccgacccgaaccgctttcgcatcgtggaatacctgctggggggcgctcgctcggtgggtgccatcggagaagcgctgaacctgaaccagccgcaagtgtcgaagcacctgcgcgtgctgaaggaggcccggctggtggacgtggaggcgcgcgcccagcagcgtctctatggcctgcggcccgagccgctgcgcgagctgaacgcgtggttggagcgctaccgcgacatctgggacgagcggctgggacagctcgactcgctcatcgaagaactcaagacgcag

SEQ ID NO: 1944 - DNA, 1740 bp, Myxococcus xanthus
ccgtctttcaaagtgagcatcaccgtctgacctgctgcgcgatatcgccaacgcgcgagttccgtgcccgcgtaatcggggccaatgggcttgccatcaatggcaatgatttcgtccccctccttccaacccgagccggcggcggggctcccaggggccaccaacttcaccacgagccgcccctccgcggggagggcaatcaggccggaccggtccttgcggaagggctgacgcagcgcgcgggcatcagggaccagcatcagcgtgtccgtcgcatagtccgttatcatccggaagcgtccgaggacggcgagccccaggttgccgaggagccggtccgaggcggagatactcttgcccgcgtcgtcgaacaccgtgggcacgtccttcagggtgatgcccgccagttgaatgtccttcagcgtcgctacatcgcgctcccggagtccgcccacggctccggacagcgtcctggagctgcgcctttccgtgagcagcccggcttgctgccagtaggcggggaagagcgaaagtgctccgccattgcccacgtcgaagagcaccggaatggggggacggccctcaatggagatctggacggcgcgctgcccgcccgcggattcgaccagcgggagccgaaccgctcgcggcggagccttgaagcgggacgcatcatggaaggcgacgcgccggttggggaagtccacgtccacgacgagttggttgaaggactccttgcccaggacgacgggcagcgggtggcctatcaaccgcgcgacctcggacaggttgatgacggcgaccgtcagccccgtcagtcgcaggttgcccaaggtgatgtccacgccgcccgcgagctgggcctgtgcatgtcctccgctgccgaccgccgcgagctgcccctgcgtcttcagccccagttcacgcgcataggccgtgtcgaccaccgtcatctcggcgccgctgtccagaagcacctgcgtcgcctggccattcacccgcgctgggatgtagacgcggttctcgtcgaagaactcgaaggggatgaagccggtgctgtggtgacctttcgcgaagatcgccttgcggacgtcctgggggcgttcgaagaccgcggatggaatggggacgttcagctccagcgcctccaccaccgttcgtgagtcggagtccgggttgtcggtgagcacctcctccaggaaggggattcgcacgccctggacctgacgccagtctcccagtcgcacgaagcgggtgacgttgtcctcgcggatgcgcagaccgtggagggctccgtcggcctcattgaggaacaagtcgtagaggtcttcatcgccaaaggtgacgcgcaccaccttccaggcgcggccgtcgcgctccgcgtcgggctgcagcgcgagcgtcgcgccggcgctcccccgcagcgccgccccgaagtcgagcgccacctggtgccggacatcgcgcgcgtcggtgggcgatgcatcttcgacctgtccgctggcgttcagcttccatccaccatccggggtgatggtcatcgactgacgcatcactccgtagtccacatcccggcgtgccctcccgtcccggtggctccagtactccatcgggccctggagtccacctgtcacggacttccctgtcgcatggatgctctccaactgcgtgaaggcgtccccgccacgccacgcgaggtggcgtgcgaggagcggttgcagcgcctctgccccggcttca

SEQ ID NO: 1945 - DNA, 1336 bp, Myxococcus xanthus
  unsure (1)..(1336): unsure at all n locations
tcaacggcgcggccttggactcggtgcggttccacaccgtcagctcgtgccccgcggccgctaggctcgccgccatgggcagtcccatgttgcccaggccaatgaatcccaccttcatgcgcgtctcctcccggaaacggcccggataatccgcgcccaggagccccaccaccgcaaagcacgcgcacgtccaggagcgaacgggacgacctattctggccggtcctcggagacatccagacgctcgaaggcgtggcccagcgccatgacgcccagncacacctttcccaccaacacccccgccgtgacgaagcccgccacgggcagggcccaggggcccaacagcgtcgacacagggaggcccaccacgagcgccaccagccccgcgggaatcaaccccaccagcatcaccaccagcgtgcccacgacggccagcaggcgctggcccatcgcctcgatgccgcgtgcccgctcgcctgtgtctgccggtacccacgagggaaagaggaccaccgccgcgttctgcacgaagaggcccgacagcgacacggccggaagcaggaacgccagcgccagccctccgggccaccaccagccgcccaggcgcgaggcctccacgccgggccccaggacgagcgccacggccaacagcgcgagctggaacgaggccagtgccagcgaggatgccgccaactgagcgcgcaccacctgccgccctgtcagtggcatggcgcgcagcaggtccagcttgggcaggtccatccgcaggtccatgcggaacgcgctcggccccaccaccgtcagcatcaccgacaacgccagcgccaccggcccgagcacccgccgcgtgtccgtgaacagacgcgtgtcgcccatcatcgccgcgatggcaccgcccaggatgatgaaggcgaggaacaccgcgaacccgccccccatccgcttgcgcgcaatcaggttcttccagatgagtgccacctccggtcggcctcgaggcagcagccggaatggagggcggctcaacgtgagcgagcccacccgcgtcatccgccccgaggcccgcagcatgcgctcccgtgagcgggactccgcgcgcaccaccgccgtctcctcgaacggaacttcggcccagagcacccagccgtagtgcgccgccatcagcgccaacgccggtggcagggcccacaggaagtcgcccacgctctgcgccagcgcgggcgccaccagcagccggcccggccacaacacggccgccacgccgggtgacaccgtcagcgcctgcaaccacccgcgaagcgcgcggcctgacgacaggtcctcgggtaccgggtgctct

SEQ ID NO: 1946 - DNA, 372 bp, Myxococcus xanthus
gacgcgcgccgtcactccacctccatcatccggttggaccaggtggaggcggatcggccgcgcaaggtgctggacgtgcctgccgaggacgctccccgcctgctcgtgctgtctccggacgagctcaagggccaggagttcgcctgcatccgcacggagctgcggatcggccgcaccgacgacaacgacatcaccttggatcatcggtcgctgtcgcgcacccacgccaagctcgtccgcgaggacgcaggcgagtggcgcgtcatcgacatgcagtccgccaacgggatgacggtcaacggtgagagctacgcacaggccacgctcgccaccggtgacatcatcgaactggggcacgtgaagctgcgcttc

SEQ ID NO: 1947 - DNA, 192 bp, Myxococcus xanthus
gcgccagtctacctggcggagcgggtctggacgttggatgcggcgcggccacgggcccaagcgctggcggtgcgggatgggcggctgctggccgtggggactcgcgaagaagcggaggccgccgcgggcccgactgcgcgccgggtggacctgggggccgccaccgtggtgccgggcctcgtggacgcgcac

SEQ ID NO: 1948 - DNA, 291 bp, Myxococcus xanthus
gctggaaaagacagacacgcccaacccccgctgcccgggacagtgcacacggtagcgcaggccatccaggacgcggggggccaggcgctcgcggcggtgggagacgtgtgggaggatgcggacgggcggcgcgccgtggacgaggccgcggcgcgctttggcggcatcgatttctgcgcgaacaacgctagcgccccggcgtcgcatccgtacatcctgccgctgtccccaccggtcaacctctcgctgcgctggctggcgccgcccccggcgtacaggatggcggagtat

SEQ ID NO: 1949 - DNA, 396 bp, Myxococcus xanthus
atggtcaccatcaccctggacgacggctgggccacgcagttctcgctggcccgccccgaactcaacgcgcggaacatccccgccacctacggtctcgtcaccctggccatccacgaaggatggggcggctacatgtcgctggcgcaagcccagacgctcgtcaccgacggcaatgacatcgccagccacacgctgacacacccagacctgacgtcgctgtccccgacgcagctcgcggccgagctccaggactctcgtgcctggctggagagcgcgctgggcctgcccgccgtccccaatctcgtcgtgccgtatggcctgcagaacggcccggtgctcgacgccatccgccagcattacgccagcagccgcacggtgaacgcgggccgcaacttc

SEQ ID NO: 1950 - DNA, 285 bp, Myxococcus xanthus
gtgccgcgatgccagacatgcggacggcgctgggaaggctctcatgcgccgtgcccgccaggaccgcctccgcagggagacacgccctcgccgtcccctgtgcccgctgttccgggctaccaggtggacggcgtcttcgcgcgaggaggcttcggcgtgctgctgggcgcccagcgcgaagcggacggcctgcgcgtggccatcaaggtggcccgtgggagcaactggttgggccgcgcccaactcgcccgtgagtcggaggccctgcgcgtgctcgggccgccc

SEQ ID NO: 1951 - DNA, 519 bp, Myxococcus xanthus
ccccagcgagctcggaaggacgaggacaaggaagcgcggcggcaactcatcctggatgaggccctggccctgtatcaggcgacgtcctatgccgaggtgaagatggcggacgtggccggccgggcgatgctggccaagggcacggtgttcctctacttccccaccaaggaggcgctgttcctggcgctgctggaggacctgctcttcgcgtggttcgcccggctggacgggctgctcgtggaggactcgtcggcctggacggggccccggctggcgcgcacggtggccgagtcgctggagggcgaggaggccctgacgcggctgctcgcgcggctgcagacggtgctggagcagaacgtgacggccgagcagctccgcccgttcaaggagcggctgctggcggcgctgctccgcgcgggcacgctggtggagcagcggctgcccttccttcatgccggagaaggcccgcgcttcttcatccacctgcacgcgctggtgacgggcctgcggcagatggcg

SEQ ID NO: 1952 - DNA, 421 bp, Myxococcus xanthus
cgtgacgtggtgtaggcgctggagaagcccgaagacgacgcgcgcgagaagtccctgctggtgcgcatcgaccatccggggacgccggccgccacgcagaagctgcgcaacgcggtgaaggccttccgcgccaagggcaagaaggcggtggcgtactccgactccttcggcgagctgggcaacagcacgctgggatactacctggcgtccgccttcgacgaaatctacatccagccgtcgggcgacgtgaacatcaacgggctcgccttcgagctgcccttcgcgcgcgaggccttcaccaggctgggcgtggaggccgaggttcttcgcccgctacgagggcaagaacgccatcaactcctacacggagcaggacttcaccgcgccgcaccgagaggccaccgagggcttcacgaacagt

SEQ ID NO: 1953 - DNA, 612 bp, Myxococcus xanthus
cgcggcggcgccacacagggccatgcccgtcacggccgtgaagccgtcaccggcagtcaggcccatgaggaaccccaccgtggccaccacgcccacgacagcgcccagcaacccgcgtgtgcgcgcggtgcacagcatgctcaccgcggcgagcacgagggccagcgcccccgacgcgaccgcgccgccggacgcccccaggacggcgtaggcctggaagggaaggaacagcgacagccccgcccccaccaccgtcaggaagaaacgctccaccagcaggcccaggacgagacacagcaccgccagcgccagcgcgctccagaaggagggccgagcgtccggtcccgacaggccaaagaagacgaagagcgggctcgccaccgcggtggcgcgcagcagcacctccgccagcgcgaggtcccgtgcattgcccgtacgctgacctcgccacagccgcgacacggcgaacaacgcgcccgcgaggatgaagggcaacgcggacagcgctccgaactgaaggggcagcggctcggtggtgtaaccgaaccaggccttcaccgcattgatgatgcgccgcaccggcccggggatgagctggcagaagcaggcata

SEQ ID NO: 1954 - DNA, 279 bp, Myxococcus xanthus
ctcacgctcgagcaggtgcgccatgtggccacactggcgcggctgtcgctgactccggaagaggagcagcgcttcaccacccagctgtccgcggtgctggacgcggtggagcagctccagtcgctcgacgtggaggccgtggagcccacttcccacgccacgctcacgtcctcacggttgcgtgaggacgtgacgcggccgtccctgccgccagagaagtccctggccaacgcgccggcgaagtcggacacgtccttcgccgtgccgaaaatcatcgag

SEQ ID NO: 1955 - DNA, 171 bp, Myxococcus xanthus
ctgctgggctacctcgccggctccattcccttcggtgtgttgctgacgcggtggctgcgcggggtggacgtgcgcaccggcggtagcgggaacatcggcgccaccaacgtcacgcgcgtggcgggcaagaagctgggcgcggtggtgttgctgctggatgccatcaagggc

SEQ ID NO: 1956 - DNA, 426 bp, Myxococcus xanthus
gcgtcccagtcgttggtggagccgtcgtccgagtccgccgaccggcgcatcatcgtgtaccagacgacctcgcttcagctcattcgcatggacaaccagggcgattcgcacctggtggcggagcgcaccggtgcgcccgaggtgtccctggatggcagccgcgtggcgtatgtgaagctgccggatggataccgcgagggcgacgtggtgcggagctcggagctgtacgtgctcaacgcgaactcgggtaggtcggtccgggtgacgcagggcttcgatgacagcgagcccgtgtggacgccggatgggcgcaacgtgctgttccagtccacgcggcgctcgggcgtgccctcgctgtggctcgtgaaggagaacggcaaggacctgaaaaaaatgacgaacgcgggcacctcgcagttcagctcg

SEQ ID NO: 1957 - DNA, 348 bp, Myxococcus xanthus
acccgcgcgctataccgctcagtcggcctcaaggaggcggagctcttcctcgtcagtggatgctcggcgttcctcgccccgactgcccgaccagcccatcttctacccggtgatgaacgccgagtacgcacggcaaattgccgggactggaacacgccggacgcgggctctgggcacgcgggcttcgtcacggccttcgacgtgggggcggactacgcctcacgcttccccgtgcggaccgtgggcaacagtcgccaccaagagctgtgggttcccgccgaggagctggccaccttcaatcagcacatccaaggccccgtgcgcttcacggaggcctggtacggcccc

SEQ ID NO: 1958 - DNA, 963 bp, Myxococcus xanthus
ttggccgcgactgtcggcgcggacggtcacgaggagcaggtgacggaatatgacatgtatgggcagttgcgctcgaagacactgcaggtaagtgacacgtctgtaatcacggtacagtccacctttgatgcacgggggcgactggaagttgagcaagatggtcttggccggcatcggactctgcaatgggatgcgctagatcggctgacgcaggaggaccagtggaactttggggagcccggggtgtcgcggacagtgcagtattacgcgggcgggcaactcaagcgtgaagagcagggagtggatttcgtccgagactattatctggacgcagctggacgattggcgcgcatcgtagagtcaggaggcgggctcgctgctccattggagacccgttacggctatgacgaggcgggtaatcgcacgacggtcattgaccgccgcggcgtacttaccaccacagcctacgatttcgcggatcggcccgtggaggtgaaggtgtctgtggcggacggcccccgcttcatttcacaggggggaagtcccgatgaagtagggaggagctacgtcctctcgacgaccaggtatgacgatgctggtaataaggtctggcatgcggatttgtctgggtttgatcggacatatcgattggactcgttttaccgagtcgtggaagagcatagccctgaggtgccgggagcgtccgatactgcccagccgctgcgttacattcaggagtctaggtacgatttggtcgggcggaaggtgcgcgaggtggatgggagcgggcacgcgagcaccactgcgtatgatttgcttggacgagccgttgtcctgactgacccgctcggccgggtggaacgtcgaagctatgacgggagaggtaatgtcacggaggtacgtcgggaggctggaggtgtgctgcagcggacgatgagtacgacatatgatggccttggtcga

SEQ ID NO: 1959 - DNA, 393 bp, Myxococcus xanthus
atgagacgcgacagtcggctctccgtcgccttgcatgtcctccttcacatggaggacatgggccccgtggtgacgtcagaggcgatggggcggctgctgaaggccaatcccgtggtggtccggcggacaatggccggacttcgggaggcaggcatcctcacctcggtgaaggggcacgggggaggatggtcgctggcgcgcacgctcgacaccgtgacgttgggggacgtgtacgaagcgctcggaacaccggggctcttcagtatcggtccccatgatgaaagtccgggctgtctcgtggagcaggccgtcaatgatgcgctgggaaaggcgctggaccaggccgcggcgctgctcatgcaacaccttcgaagcacgtccgtggcggacctg

SEQ ID NO: 1960 - DNA, 510 bp, Myxococcus xanthus
cagacagcacgaaccctgctccgctgctggtcacccgctgacgccgcgcgtgcgctccgcgccatcgacgccagcctcgaccacctgcgcccctggttggactgggcgcggcactaccccatcagcgtggagcagcaggccgccgtcctgcggcgctttcgcgggagcttcgacctgggacaggacttcacctatgccgtgttcgaccggggtgggacggaggtcctgggcggctgcgggctgcatcctcgtgtgggcgaggggggccgggagatagggtattggattgcggcccagcacgccggtcaggggctcgcgaccgaagtggcggcggcgctcgtccgggtcgcgttcgaactggatggcctgcgccgggtggagattcactgcgacccgctcaacgtgccgagcgccgcggtggcccgcaagctgggctttacccacgaaggcaccttgcgacagcgcctccaggccgctgacggctcgtggcgcgacgtcatgctctggacc

SEQ ID NO: 1961 - DNA, 2574 bp, Myxococcus xanthus
accccgtcgcctcgaacccgtacctccagggctcctgactgttccgcgcggaaatagaacaccgcttcctgctgcggtccctccaggtccatggcgccgctgccattcagaggcaccagggcctgcgtacacgccgcgtcccggaagaaggtcaccccgccaacattcccctgtgcctccaccaccagcagggacgaagccagggcggacagattgcccatggcgtcctgactctgcaccaccaacgcctcggagcacgcgcccgccgccacgtcttgctggggtgtcaggaaggccacctgcgccgccgcagccgccaccacgtccacgtcgaacgtggagcccggcagggtctccctggcatagcccgcgccactgatgcggttgcggctgatgacgttggccccgcccaggtccgagatggccgcctggtacggcacgccgttcgccaccacgccgtggctcaacgtgttctccaccacgagcaaccgtgaggattgcgccagcggcccgccgtccgcctccgcttgcgacaggtcgatgccaatgtcgttcgcctccagcgtgttgccctggatgaggacgtcctcgcacaccgggccgccgtagtaggccccacccgcgacgaggatgccggccgccacatagccggtccccgtatagacgttgccggtgacgcggttgcccagcacctgtcccgtggcgccgaagctcaactggatgccattcctggcgatgacggccgacggaccgccgccctccaccacgttgccctccacggccacgtccacccggcccgaggccacgatgccccccttctggtagcccacggcgtggttgcgcaggacctccacctgaaccacgcgggacgcgtcctgggcgtttcgtacctcgatggccacgccctcctggcaaccgctctcgcccgcgccctggtgcagcgcgcgcacttcgctatcggtgatggaaccgctcgccccgatgaatcggatgccactcaagccggcctcgcccgcatcacacgccaggtccgacaggccgcgcgccgccaccgtcacgtcgtggacgtgggccgtgtctccccggttgcgaagcacggcaccctggaagcggccgccttcggggtccaccgcagtcaccacgtgcccggcgccgtcgaaggtgactccgtccgggatgtacagcgtgccctccgtcgtgcagtccgccgtcaacgtcacgcggtcgttctcccaccgggcggagcagggaggaaacgccccacagcgccggtcatcccaccgaatccggaacacgtgcgtcgcgctcatccccgagacattcgtgacggtgagccgcacggagggctccacacccgccgggatacaggacagcgcggaccagggcacctcgctccgcgtcccgtcctgggtggcggttcccaggaggccggtgttcgcggaccactggaaggtgagagcctcgccgcgcgggtcctccgccaccgcctggagcaggacgggctccgcgctcacggcctccgtccgagattgggccgtggagacgatgatgggcggcagccgctgcaccacacatacgtccaccaagccgacgtgctcaccgcctcggccatcccgcatcgtgacgtggaactggcacgcgccacaggctcccgagggcggcgtggacggcgtgaagcgaggcgaccgcgcgctcgcgtcatcgaaggtgccttcgcaactggccgtccatgcgtaggtgagcgtgtctccgtcttcgtcccggccttccgcctggagttgcagggagtcgccatactggacctcgccagaagggagggagcccagctccaccatcaacggccagcgattgaaggcggccacgctgtccgctccgaagccatggtcccgggccactcgcacggggaagtccagcgtggccccctggcccaccgcgttcgtcaccaggagcgtcaaggtcacgaagccggacgcctctggcgccgtccagacgggcgccacggcgctggcgtcgctgaagcttccagccgaggcccgccaggcatacgtgagcgccccatccccggacgcggcctccgccaccgcgcgcagcgccacctgcccttcgggccggacctccgccaacgagcccactaccgcgtcaatgaacggcgctccgggaacgccggagacgggggctcgcgggaccaggacgaccagcgccgtccggtgcgcacctatcaccacgttcgggacgtcgatgtgcgccagcacctcaccgccatcacctcggacggtcgcgctcgcctcagccgctcgtccagaggcaatccgccgcaccagcccctgccacaggccgtcgccgccagagagcaccgcgcccgcttcttctcctcccacgggtctgagcgtggcacggacctccgtgacgggcccgggcgtcagcgtgcgtggcagcaccaccaccacccgcgccgacgcggagggctccagttggatgggctgcgggtcatccaggtgacaccccgccgtgacgagtagcaacaacacgcccgcgaggcgccaggggttctgcgtgtccaagaacgtcatgacg

SEQ ID NO: 1962 - DNA, 285 bp, Myxococcus xanthus
gtggccagccatgcccacctgctgatgctggagcgaatctcccatctccaggcggaggtcagcgtactcctgagaacgccgcgaggcgggagctccacgggggctcgcaggcggttccttgcctggcgcggggcgctcacggcccgccagaccgaggtcctggaattggtcgctcagggaatctcgaaccgggaaatcgcgaaccgcctccggtgcgccgagcgcacggtggaggtgcacatcacggacatcctcaagaagtctggcaatcagagccgagcccag

SEQ ID NO: 1963 - DNA, 9080 bp, Myxococcus xanthus
  unsure (1)..(9080): unsure at all n locations
caccttctgagccagcgtcgttgtacctggcgcgcgggtggcgtgcagccgctcgctgccggtgaaggacaaatcctcgggctggatttcgcgccgctcccccgccagcacggtggcgcgctgcatctcatggcgcagctcgcgcagattccccggccacgcatgggccagcagggcctccgccgcggcgtccgacaacagccgggcgcgcccgtccgggcacaggtgggcgcactgattgaggaagtgcttggccagcagcggaaggtccgcggagcgctcgcgcaggggcggcaggcgaatttcaacgcccttcacgcgccagtagaggtcctcgcggaaggcgccttcctgaagcatgcgccccaggtcctggtgggtggcggagatgagccgcacgtccacctggacgggccggtccgcgcccaccggaaggatgtcgcccgtctccaacgcacggagcaccttcacctggagggacggcgacatgtcgcccagttcgtccaggaagagcgtgcctccgtccgcctccgcgaagaggccacggtggtccttggtcgccccggtgaagctgcccttcacgtggccgaacagggcgctctccagcagcgactccggcagtgcgccgcagttgatggggacgaagggcccgtcgtggcggcggctcttgaggtggacggtgcgcgcgagcagctccttccccgtcccattctcgccagtgacgagcaccggcagctcactggccgccacgcgctccgccagggacgtggccgccaggaaggacgcgctctgccccaccagggagacaccgcccgccgcgcgcgtgagcgagctgcgcagcgtctccacctgccgctccagtgtcacccgcgcgagcgcccgttgcaccaccaccagcagcacatccgggtccactggcttggtgaggaagtcgtacgcgcccaggcgcaccgcttccagcgtgtgccgcgtgtcccctgccccggacacgacgatgaccttcgtcccgggcttcgcgctcagcaacgccgcgagcccctccagccccgcggagacgctcccgtcgggaggcagcatcaggtcgagcagcaccagggggaagtcgcgtgcatcgaaggccgcgcgagcggaaggccggtccgcagcttccactacctcgtaacccgcatcgcgcagcagcccgccatagactttgcggaacgcggcgtcgtcatccacgagcagcaacgggtgcggtgcggacatacgtgtggcctccgcctcagtccggaagcggcgtctggcgtggcgtgcccatcaactccagggtgcgcagggccacctggatgagcgtctgggcgcacggctcacacccgccgccacagcaccgcggccagcggccttccgggttgcgcagcaacggacgcacacaggactggtagtagctggggaagccgagctcctcgctggcgcggaccagcgcggcttcaaacggaggtgacgcggggggtgtgacgtcggacacggggctgtcataacagccaccgtgtccgctgcccactcgcccgcgcccccctctcgggctcagggtgtcacgaccatccgagcacccacttgaccatcgttggcggacaccaggtccgggaggctacccacactcacgtccgcggccacgtaccagacgtccccgctgctgacggtggcccgcgacgacaccgacactgtccggcactgcccccgggcaagcgtcacgctcatctgcccgacccgcacatccaccgccgggtccaggtgctcgtcacgagacaagtaggccctcacggaggccgacgcctgaccaaagcctcgattgcagacggagacctccgtcgaatacgcgtcacctgcttggacgaccaccggggcactcacggccgtcacggcgaagtcgctccagccccccacggcgatgggcacggagaacaagagggcgcgccactgctcgggggcatacacgtcccatgggtctccgagataagccaccagcctgtaggcgccctcctgcggcacgttggaccagccccgcagcgtcgcctgtgcgcacgcacccggaacgagcgccggaaccacgacatactcggagagcgcggagacgggaaagtcatcctccgtgcgcagcgcgagcccgaccgcagtgccaggctgagccaccgggctccggttgcacaccgtcgcggtggcattgatggtggcgttcgtgttgatcgccgtcggcgcttgaaggtccgtgacgaccaatccactgagctgggtcacctggatgatgtcccccagggcgtcgttgttggactccaccaactccgtgatggcgttgtcgatgtcggctctcgccgccaatcgaaacgcccccgtgtagtagggcaccctcgcctccgcgtccaacgtgatgcaggcccctggcgccaacgactcgacagacagcttcgccccctggatgcccgccgagatctccgggagcacctccggcacgaagagcgtctggacggccgctcgcggcgtccgcacattgccctgattacagaccgtcaccgagacaggcagcttcccttcgggccacgccgcacgcccctgggcgacgatccgcgtcacgaccaggtcaggcccggtccccagccccaccacggggcctgtcagcgcattgttctccaggtgtgcctctcccccgacaggcgcaacgagctccaccgaggccttcacatggacagtggcgggcaacccctgcgtgggaaccgtccccaccacgggaagcaccgcgcaacccttgcctagcgcgccaaaggcccgggtccccacgcgaatgcctgcccgagggtccgggccatccgacagcgccacatgaaccgccagcgccgacgcggagagcgttcccgtattgcagaccgtgacttccgtggtgaaggaggcccccggaacgagcgcgtgcgtcagcggctcgatgcgtgtgacggagaggtccgccgaggagcccagcaggacgttcacggacctgtcgttgttgcccgaatgagcctctgtctgcgcaccaaccggattcaccgtggccaccagccgccagcttcgcgccgcgttcgccatggagcccagcgactcctcccactcgatgcactggttggcctccaaggccgggatgttccgcgatgagacacgcaacacgccttcagcggagggctcactggcacgaagctggaattgcacctgcgtggcggacgcgggagccgtgccctggttgcacactgtcgcgcgcacaggaaggctcccgttgatcgactccatggccggcgccctcagcgccgcgacgacgtagtcgggaatcgagcccacctcgagaggactgacgacactgaggttgttggtctcgtcagcctcgggccgctcattcagcggatccaccatgaacgcgaggtacgaagtgcccggttcgccgagcaccccgacgaacacgacgcgttcgcatcgtccggcatcgagaaagagccacgactggtcgcgcatgacgacgtcgtcggtgtcgatatgtgcgtcggacgaccgatagagatataccgtcgcctgctcagacccttggcctctgttgcacacacgggcagccacataaaaaggccactccgggcgaacgaccgagggcacagccaccgactccacggtgaagtcgggaagcgcgtcgaacgtcacggagtcgccagcgtgcgcgttgttctcctccgagacctcgtccacacgcgcgtgcggatccaccaaggccccgatgaaccacatccccgactgggacgcctccttgttggcgacgattgaacgtgacgcacacttcccggcccccacccatcccgaggaaacggccccgagcaacgcgtcctccttggcgatgcacacgtcccgggacacgaacacctcgacgtccgcgctccccgcgcggcggcccatgttgcagaccgtgacgacaacctcgaaggggtcccgcccgtagacgcgcgatggcgcacgaacatcggtgatgacgaagtcgggcagctcatccccacgcaccgcacgcgtcgtcgttcgcgccgccggaggcggacccttgcagtcttcgaatctcacgggaaggtcgtgggtgacctccccggaaacgcgcggcgacgcggcgagcgccatcggcattcccaacacacacggcgccagttgcaacacaagccctagaagcccacctgcaattcttgacggcatcgttccccctcatgctccggggctggccttgagttcaggcggcagcaacccggggcatcgggacgtgatctaacatgcgggcctgaccggaacgaacgcacgggcgcgaggaagcctcgcggggatcctggcatcaacgggtccacgcgacgcgccgcgattcagagcagcgaggattgcgcggggacttcgggtgcgctcgccaggggctggcacgaggaacaccagtacgtgttccgtccaccgatgcgttgatgggagaccggtgtggcacagcgcgggcacggcgccccggcgcggccaaacacgttgcgccggtgcttcgcctggccctgaacgccgaagaggtctcgctgggttccccgcatgcggagcccttcatcgagcaccgcctggatggcgcggtccagccgcaccacctcatcggccgtgagagacgacgccagcctgcgtggggcaatccccgcctgccataggctctcgtccgcgtcccggttgccgaccacgacggcctgccgcaaatcccgggtgatgatttcgacttcaggtacctctgccacgcggacgtctcctccgcacatgcatggtgccggcgcctgaccgcgcgccacggagatgcccacccgncatggggnctgactgccctncgagcggagcgcgcgatgctcagccccagggccgcccgcaagcggacgcgcccctggggctcaggcgcggacctccacctcgcgaacctcgcgagacacctcccgcaccttcaccttcacatccaggaactgggcgatggtttggagctgcgtctcggcatgcccatccaatggcagcgtgcggaacacgccgcccttcgccagcgccacgaggagcagcagttggtcacacaggtgctcgcccaccggcacgtccgcgtcgaggtagcgcttcacctcttcagcgacctgtccggccacggcctccgcccgcttcccccgctcaccaaagccggtgaagacctctgtcacgtgctcgctctccacttcggcgaccagcacgttgccgggccccagcggacgcttcagttcctccgtccggagttcatcgggccgccacttcagcgccgctcccgccgtgcccagctcgcgctgcgccacgtcgaacggaatcatcgcaatcacggccttcaggtcgcgacggaccacgcgcccccgctccagcaggtgcagcggcttcaacggcgcgggtcgcacgtcgacccggaaccgcccgcccccggcagggaagaaaccggcacgctccagggtcgcctccacggacggccccatgcgacggaccagcggcagatacgcccgctggaggaagtcgaacggtggcgccatggggttgtgcgttcccccctccaacatcagcgtggaaggccccttcgccaggagcagcgccggaagcaccgtctggagcaccagcgtcgcgctgcccgcggtgcccaccgcgaagtggtagttccccgcggccagggcactcggccggaaggtcagctctcgcgagccgagctccgcgcccgacacctccgcggcccccacggcctccgcggccttcaccgacgtcaggtgctggcgcagcaggcccggcttcttccgacccgcgcggatgttctggatggtgaagggcttgcccgtcaccagcgacagcgacagcgaggtgcgcagcacctgccccccgccctcacccaatgaaccatcgatgcgcaccatgacgacttcctccttgctgctcgcgactcacgaaccacccggcacgcactgacacccccgtgaaaatagcggcgcccgcgtccccatcctggcggcctttcggcctcttggggagcgcgggcgcctcggtgtcttcatcccggcatggtcacctctgggtttctagcccttcacgcacacgacctgcttcagggtgtggaccacttccaccaggtccgcctgcgccgccatcaccgcgtcgatgggcttgtacgcagccggcgtctcgtcaatgacgtccacgtccttgcggcactccacgccggcggtcgccttcacgtggtcctccaccgtgaagcgccgcttcgccgcctcacgcgacatcacccggcccgcaccgtggctgcaggaatggaagctgtccgcgttccccttcccgcggacaatgaacgaacgcgcccccatgcttccggggatgatcccgaggtcaccctctcgtgcccgcaccgcccccttgcgcgtcacgaagcagttcttcccgaagtgatgctcacgggcgatgtagttgtggtggcagttcaccgccgcgtccttcagctcgaacggaggcagctcaccgctcaactgcagcgcatccaccgcctcttgcagcatcagcgcgcggttcgtcgcggcgaagtcctgcgcccagctcaccgcgaagacgtagtcctcgaagtgctccgtcccttccgccaggtacgccaggtccccgtccgggagattgatgaaccagcggcgcatgtcctccttcgccagctcgatgaagtagctcccgatgcggttccccaccccgcgcgaacccgagtgcaacatcagccacacgccatccgactcatcgaggcacagctcgatgaagtggttccccgttcccagcgtccccaggtgcgacagctccggcccacggccgatgcgcggatgcttcccgacgatgcggtcgtacccctccaccaaccgcgcccactccttctggtgccgcgcgggcgccacacgccacgcccctacgtcgttgcggccaccgttgtcggagcggccatgcggcaccgcgcgctcaatcgccgagcgaaccccacgcagcgagtccgggagctggtccgcccgcagcgtcgtgcgaacggcgatcatcccgcaaccgatgtccacgcccaccgctgccggcaccaccgcccccacggtggggaccacgcttcccaccgtcgcgccgtagccgcggtgcacgtccggcatcaccgagacccacttgtggatgaaggggaggccacgcaggttgcggagctgcttcttcgcctcgtcctcgaacggaacccccaccgtccacgccttgatggggcggcccgcctcgtccgacagcacctcgtagttcccgttgatgcggctcatcgtctccacctttcagtcgtccgccgggcgctgtgtcccgatcacggaggaggcctagagcagccggcgtgccaacaccgcttccgaggggagccctccaagcgagctggcattccctatccccatagataaaatcctatctcgatggcgaaatcgcgcgcgcgcaagacggtggtcctggggatgctcgggacgacgctggacaacgggcaggggccgcagcgctgggcgcggtggcggcccacggtggcgctgtgccagcaggaggacctgttggtgcaccggctggagttgttgcatccaccgaacgcgacctcgctcgcggccacactggcgggggacatccgccaggtgtcaccggagacggaggtgcggggcaggcccctgcgcatccagaacccgtgggacctggaggagacctacggcgcgctgctcgactacgtgcgcggctatgccttcaaccccgaggcggaggactacctggtccacatcaccacgggcacgcacatcgcgcagatctgcatgttcctgctggtggagagccggctcatccccggcaagctggtccaggtgtcacccgacccccgggaccgcgcgggcgcgggtacgcacaccctcatcgacctggacttgtcccagtacgacaccctggccgcgcgcttccggcaggagcagcgagaaggcctggccttcctcaagtccggcatcgacacccgcaacgcggcgttcaaccgcctcatcgagcgcatcgaacaggtggccgtccagtcccgcgcgcccctgctcatcacgggccccaccggcgcgggcaagtcgcagctcgcgcggcgcatctacgcgctgaagaagtcgcggcgcggcgtggcgggccccttcgtggacctcaactgcgccacgctccggggcgacggcgccatgtccgcgctcttcggccacgtgaagggcgccttcacgggcgcgctgagcgacaggcccggtctgctgcggcaggcgaatggcggcgtgctgttcctggacgaaatcggcgagctgggcgcggacgagcaggccatgttgctccgcgcgctggaggacaagcgcttcttgcccgtgggcgcggaccgagaggtggagagcgacttccagctcatcgccggcaccaaccgggacctccaagtcgaggtcgagcgcgggcgcttccgggaggacctgctcgcgcgcatcaacctgtggacgttccggctgcccgcgctgcgcgagcgcccggaggacattccacccaacctgctcttcgaactggaccagtcctccgaggccgtgggcacgcgcgtcaccatgaacaaggaggcgcaggagcgctttctggacttcgccacgtccaccgaggcgaggtgggcaggcaacttccgggacctcaacgcggcggtgctgcgcatggccacgctggcggcgggcggacggattactcgggacgtggtggacgaggagctcgaacggctgcgcgagcagtggcggccctccggagcgaaggcggcggtcgtcgccggggacctggtcgcggaggtgctgggagagaacctcgccagcgagctggaccgtttcgaccgggtccaactcgcggacgtgctgagcgtctgccgggcatcacgctcgttgtcggacgcggggcgcttgctgttcgctcagtcacgcgcccagaagaagagcgtcaacgacgcggaccggctgaagaagtacctggcccgcttcggactc

SEQ ID NO: 1964 - DNA, 684 bp, Myxococcus xanthus
acaaaacaaatcataaaagacgtttcttttacaatcgagcaaggacagtggatggcgctcattggagaaagcggaagcgggaaaagcatcactgctgcttcgataggaggactgctgccttcagatgtaacgcttaaaggaggatctattatctttaagcagaaaggaggggcgcctatccttggaaaagatatttcatatatctttcaagattatcgaagcgcttttacgccttttttaacaattggaaagcagtttgaggaaacggttcgtacacatagtgaactgtctaaaaaagacaggaaagccgccatttttcaggttttaaaagcggtgaatttacctaatgaacgcgtgtataaaagctatgcttcttagctgagcggaggacagcttcagcgtgtagcgattgcgcgtgccattagtgtaggtccgtctctgatactgttagacgaaccaacagcgagccttgatgttacggtacaagcaaagattttaaatttattaaaagatttgcaggagacttttcagctgtcttatcttttcatttcgcatgatttagcagcagtaaaatttatgagcagtcgcatgatggttatgcagcaaggcgaggttatcgatcaatttgaccgtgcacagctatttgataaaaacaggcatccctatacaaaaaagcttgtgcgt

SEQ ID NO: 1965 - DNA, 3333 bp, Myxococcus xanthus
tcggcgagcacgctggcggagatctccaggagctgggtgtcgtcggacgcggactccaccgaggccgtgcgcgccgcgccggacagcagggccatctctccgaagaaggtgcctccttcgagcgtcgcgatgtcctggcgctggccctcctccgtccggaagacgcgcaccgcgccctcgcagatgacgtagaaagcatcgccgtggctgccctggtcgatgattcgctcgtccgggccgaagcgccgcagcgggcagcgctcgaacagctcgatgaaggcgtcgcgaggcaggtccgagaagagcggaatcgtgggcagcgcgtccagggaacccgcgtcgggagggacctcctccgtcaggctgtagagctcctcctcgaggccgtcgctgatggacgtggcccccaggccttgccgatccaagcccgcctgcgcggccagctccaccgcgtgcaacagggagtcggcttccagctccaactcggtgaaggaggacggactcgccgccgtccggaaggaggcgcccagcgcgggtgacaggtcgtggcccgggagcgcggtggcgcccgcggggaccggtgggtcggcacggcgcgcccgcagtcctgggggcgcggaggcggccgcggcttcagaagctgcgggcgctgcctgcgtggtgatgggcgacgacagggcttgccagcggccgctgttcgagacggaccgtggcggtgcggacggcgcgggttcgggcgcgcgagcagcgcccaccgcgggcagccgctgcgacgcgcgcggtgccagtcctggcggcaacgcactcgtcgccggacgcgcgcctccgggttgaaccgcgggaatccgggtcgcgagcggcggcgcttctggctcacggagggccatcgcgggcgggattgaggccgccacgatcgtggatgcctcgacagacgtggccaattcggacgtcatcgaatcggttccacacgcgtcgtccaccagcgtccctgccacgacgggctccacgtccagcgtcaactccacgccagcggtcccctcttccgacgccagtcctacctcgaccgagtggacgacttcttcggtgccacgcgtggacgcgttggtggacaacgacagctctggaggcagctccgcagacaggtccaccgcgggaccaccagccgccaacggggctggcgaagcaccctcccccctctcccccaaatcaatggcggcgacggccgcgcgcactgcctcgggcagacgcgacgccccagcaggctcggaggacgtcttcaccgtcacggacgacgcgctgctcatcgggccccgggcacgtgcgcccatgggcgttccccggcgcgcgtacaggtccgcgagcatctgctgcacgccacggtgcgcggggtccagctcgaggatgagcttgctcgcggcgatggcgcgcggaaggaacccctcgcgcgcgaagccttccgcggcggattgatacgccgagatggcccggtcccgttgcccccgccttcacccaggcatccccggagcgcaggcgtgactgatggtccttgggctcggcccggcagtagtcctcgtagagctccgccgccttggaaaagcgtcccttggtgaatgcctcggacgccttgtccttgagcttgcgcaactccatcagggagcgccctccgacgcggtgctcgcggacgccggtgccgcgcccgcggcctcacgcaccgtccggaagtagtccgccttgagggcctccaactggtccgcatgcgcggcgctgcccagcttccggagcgacgaagccgccgcggcgcgaatctcgggcaggtcgtggaacaggtccttggccaccgcgtccgccgcctgcgcgtcgccgatgctccccagcgccagcagcacgtcgcggcgggccacgctgttgggctcgtccagcgccttcaccagcgtgggcacggcgtccttcgcctgaatccgtcccagcagggccgccgcgagcgccgcttccggtccaccttcgcgcaccacggcctggagctgcgtggaagcggagcccggcacggcgccggcgcgcgtgagcgcatccaacaccagcagcttctcgctccccatcttcggcagcatctcgatgagcgcggcctgccccgcctcgccggcctccgccagcacttgggccagggccttctgcaggtcgcggtccggctcgacgagcccggccttggccacgttgacgccctcggggcccagccgcgccagccccaccagggccgccacgcgcagcgcggcgctggagtcctgggtgtagccggtgagcagttccagggcgccgggcgccttcagcgcccccaacgcgcgcagcagcgtcgccagcggcaccagccgctccggcgccacgtcgtcatacagctcggtgggcacacggtgccgcaccacgtcccgcccggactcacgcacccgggcggcattgagctccttcacccgccccagcaggtccgcgtgccgcgacggccgctcatccttcaggccaggtgtcgacggggtgggcggcatggtcgaagggtcgaaccccacgccgaacttctccgggagcgcttgggtcacccagtcggcgcgcagcgcctccagtcccttgacctcctgctcgtagagcttctgcaacgcgggcaccacggaggcatcccccacctccgccacggcctccaccgcgagcaggcgcagcgtggcgtccgaatggctcagccacggcaccaccttgccgagcagcggcagcgccgcgggtcccagcccctcgacggcctggaggccactggcggccgtggccggacgtgccagccgctcgccaatggtgtccaccgaacagccgccgcgtgtgcgcatgctccggcccgcgacgagcgcctccgccggtgcgccctccatgacgatggcgcacagcgaagcatccgtctgcggcgtccgggggaaggacacgatggcgtcgatggccagcggactgacggcgctcttctccaccgccaccaactggaggcgctgcgtggccaccggatcctgaagcttcatcagcgcgtggatggcggactcgcgcagttccgggaagttctcctccaacagcaacgcgatggggctcaccgcgcgcttgtcgccggcgtcacccagcccgcgcacggcggcggcggcgaggatgacctggctgtcgcgaaccaagggcagcagccggttgacggcgtcgggacggccgctcttgcccagctcctcggcggcgcccacgcgctcgggcagcgcgccttcggtcagcgcgagctggttgcggtcccactgggagcgggcctcagcggcgaccacctccgcc

SEQ ID NO: 1966 - DNA, 342 bp, Myxococcus xanthus
aagcgccggcttggggagattctcatggacgccgggctcctctcggaaacccagctccgctccgccctcgcggaacaacgcaaatggggcggcaagctgggcctcaccctggtgcagatggggtacgtggacgaaagctccatggtccacgccctgtcgcggcagctcgccattcccacggtggatctggagcagcacgcagcgtccgcggtggtgctgcaggcgctccgggcggacatcgccgagcgctacaccgtcttccccatcgccgcggatccggccacgaagacgctcaccgtcgccaccgccgaccccaccaacgtggaggcgttccaggagttg

SEQ ID NO: 1967 - DNA, 774 bp, Myxococcus xanthus
tgcgctcggaaggtgtcgccacggccaaacacgagccagggtccgaccatgccttcgatgtagacgccggacttggcgaggttcgcacgcaggaccaggtccagcggaacaccgatgtcgttgccctcggtgatgagcattgcaccgaaccgagccccaacagacagcggccccgcgagcggcgtctcaacgcccagcgtgaagttgaagaccgcgctgtcatcaatccaataatcagccccaagcccaacacggaccgcggcctctgagttcgtgggaacgaggaagaggccggccgcgagcagcgcgccaaggcaaggacgaagcagcttcattcgagaggctcctctcaacacagcgggggagcccacactcaaccaagccgaacgcggcaatgccagcacacggagatccaaatcgtcgaaggcagtcgcagcggaaggcagcgactcgcagcggacggaggacgttcactgcaacacggcgcgcgactcaagggcccgcgctgcggcagtggaaccggttggcgttgcgaaggggcggcgcgagccgagcacctgctggtgctggccacgacggcggccctgctggcggtggggccgtgcgccgactgcgcacgcggcgccaggcccagcgcccgcggtgacgcgcggaaacccaatacgccccaaaacggaaaacccccggtgtccacgagggacaccgggggtttctcaaaaagaatccggcagcgacctactctcccgcgcggtttcccgcgaagtaccatcggct

SEQ ID NO: 1968 - DNA, 2724 bp, Myxococcus xanthus
acctctaccagcgaacccgcctcgggcgccgtgaagcggtcgaagaggatggcattctcgcgggcgtcgtactcccaaccggacgtcacgcggacgccgtccacatcaacgacgatgctgcctggagcttccggcgtctcggacagggggaacttgcggttcgcgccaaaggtgctgtcggacagcttctccaacgagctggcccagttcggcgtgcagatgctttccaccacgccgcccgtggcctccgccagttggatgtagcgggtgcccgagctgctggacgtggggcacctggccaggtccgacggcccgacgatggcattgacgctcagcttcgagcggtcattgcccttcagcgccagcaggtacgtctcgtagaaggacaccggctgcgcgctgaagtcttcctcgtccgacacgaagatgatggccaggcgggcatcctcgcgcaggaagcctgcgttgccgtcgttgggctgcgcggtgcgcgggtcatcctcgttatagagcagcgggtccgccaacgcgcggtaggcggcctccagtccctgctcgttccaatggcagacacccacgcgggtgttgctggcgaagacgcccgcggcatccggcgtcgccggggtgatgatgcgcggccgggagccgtccactgggaacaggcggccattgtctccgccctgcgagccgcccgggcactcggaccagccgcccggagacgggtccaagcccgtggtggtgacgccgatgcggtagtccaccgcggcgccgtccgccgcgctcaggaaggccgcgaagttctgccccaggttctgctgctcctccatcatcgaccccgagttgtcgaccacgaagagcacgtccaccttcgcctgtgactcctggaagaagcggtccgtctgctccgcctgcgtcacgccccatcccaccatgcccaccgtgtagacggagccatccgccagggtgaaacgcaacgccgccgtgtcagcgccgtcatccaccggggcataggtcgccgtcagcgcgcgcgcgctctggctcgccagcgtccacggggcgttgccgccaccatccacggtgaactcgcccgcccctgcgtcgatcgccacctggctcacctggatgggcccgacacacgagttcacggccaccaactcccgtgtgcgcgggccgcacgccagcttggtaacgccgaagtccaccgtggtgggctgcaccgcgaagcatcccacgacgccctcgccctgcagctccaccagcgggtgcccttgcgtggggctgttcacccaggcctcggccagccccgagaagccgccttcctcggagggcctgaagcggaccaccagcgtcgccttcgcgcccggctccagcacgccgttgcgcacgggagacgcggagaacaccctgtccgaaccctggacgagctgcatcgacgccaggtagcacgcctccgtgcccgagttccgcagcgtcacccccagcgccacctccgcgcccaccggcaccttgccgaagtccagttgctggggcagcacgtactggcacggcgcgaacacccggctgcgcccctccagcgccaccgcctccgtggccgcggagccgctgtcacgcaccgtgacggagagctgtcccttgctggcgtccgtgctccccgccttgggccggaaggtgacgctcacccgggcattctgccccgcgggcaccatcacgctggcgggcgcctgggccagggtgaagtagccgccctggtgcgtgtcgagttggaggtcggtgacgctcacgtccgcacggcaacggttgtagacggtgacgtcgcgcgtcgccgtcatgccctccgccaccgttccgaaagccagccgccggggcagcaccgtcacgcacgagccgccaccttcacccgccagcgacaccttggggcccggcgcgctggagccctgctcgcgcacgccaatctccacccgcccgtcacgcaccttgcccaccgccgccggcgtgaaggcgacgcgcagctccaccgccgcgcccggtgccaactgcccgttggccaccaccggctcactggcgatgcggaagacgccctccgagctgtccaccaactgcgagcccgagaagctcagcggctgcgtgccctggttgcgcacggtgatgacctgctccgccgtggcccccagcgccacgcgcccgaagtccacgcgcagcggcgtcacctccagcctggacgccacgcccgtgcccgtcagcggcaccatcaccggcgcgcacccgtcacacaccaccacgtgcagcgccgcctcggccgcgcccagccggcgcggggcgtaggccacaggcaccaccaacgcctcgcccggagccagcgaggagggcaggccctgcccggcggtgaactggtcggcgtccgcgccctgcaccgacagcgtcagcgaactgtccacgtccgatgggttgcgcaccgtcacctcgcgcatctccaccaggcccatggccacgttgccgaaatcgagcgcctccgaggacacctcgatgaaggccttcacgccgcgcccggacaccggcacgcgcccaccgacctcggcgtcggtaatgatttccaccacgccctgaatctcgccctctacctgcggcaggaagtggatttcgatgtcctgctcgccacccgcggacaggatgaagggttcgaagggaggaatgttgacgttgggcacgctggagacagcgccttcc

SEQ ID NO: 1969 - DNA, 558 bp, Myxococcus xanthus
ttccgggtggtggcgcgggggctgctggcgcggggcgaacctccagagcgggtgcgcttcgaggaaacgcgtggacgccagggcatgtggctggaggccgcgcgctgggaggcctgggggcgcgcggcgtccggggtgcctcgggacttcgtggggctggcgcagaaggtggtgtgccaccgcgagccggcgcgctgggcgctgctgtaccgcgtgctgtggcggctgacccatggagagccgtcgctgctggagtgtcacgacgacgcggacgtgtggcggctgcggtggctggagcaggcggtgcggcgggacacgcaggcgttgatggcggccttgcgcttccgccgggtgtggcgggacgggcgcgaacaccatgtcgcgtggtaccggcccgaacatctcatcgtccgggacgtggcgccgttcctcgtgcgccgcttcccggccttctcctggagcctgttcacgccagacacctgggcgcattgggaccgggagcggttgaccttcgaggaaggcggggcgctgccggagtgggcacgcgcccgggtagga

SEQ ID NO: 1970 - DNA, 1503 bp, Myxococcus xanthus
gcaacgcccgctcgagagccccactcgcgtcgacagcagacggcacgtgctcttgagccggcagcgcagcagggatgtcaaccagttggggcaccgcgccgcgctcgtggggggactctcgtccttcagtcgcgaagggagcaggcgagacaccgtgcccgcgatgaaccgcgggcgacattccgggaggaaccggcatccggcttgaatcgaagtccggcgccgagggaacaccgctcggccccgaagcccccaggtcttcctcgagatggaacggaggttccgttccatccgcggcagccgaggacggggcagcgtgtgcttccgctggaggagtctcgactggctcgtcggtccttggagcttccgcagcggcattgccagggactggcatgtccgcttccacgggccgtgcatcccccagtgacgcgggaggcggcatcgctccgggaggcggcatccccatggggagctgcgacggcatgtccgctggatgcgcagcgaccacgcctgaaggcggcgccggcgacacctgcgcgggcggtccgctcgacgggccccgcgccatgcccggcgtgggtgcgccctgcagggccacaggcggaccacctgcggccggaggtacgggcaatgagcccggaggcgtctgtccgtgaggcgagtgaggacggtgcatccccggcccggcgacggcccaagccccagcagtcatctccggaggcaatgctccgagagccacgggggcatggggccccccgtgcactgacggaggcggtgcgcccatcattcccggtggcaccgccccgggagacacgggggtatcgggccccccgtgagcagccgcaggctgtgcagccatcgttcccggtggcaccgccccggggggcacgggggcatctggcaccccgtgcgcagtcgcaggcggtgcgcccgtcattcccggtggcatcgtcccgggaggcacgggggcatcggcccccccgtgcgcagtcgcaaacggtgcgcccgtcattcccggtggcttcgtcccgggaggcacgggggcatcggcccccccgtgcgcagtcgcaaacggtgcgcccgtcattcccggtggcttcgtcccgtgaggcccaggagcctgaggccccctgtgcacggacgaaggcggtgcgcccgtcattcccggtggcttcgccccgcgcccccccggcaccgcaggcagtcccggcgacgacggcggtcgcgatcccatcatccccggaggcaccggcccgtgaggcataggcaggcccggcgcaggtggcggccgtgctcccatcgtgcccgcaggcaccggcccatgcgcccctggcaatccgggcgcggacggaggccgtgctcccatcattcccggtggcaccgggcccccatgaggcccaggcatcgcaggcaggcccgacgacgaggggcgtgctcccaccattcccggtgacaccggtccatgaggccccggcaccgcgggcaggcccgtcgcggacggcg

SEQ ID NO: 1971 - DNA, 2477 bp, Myxococcus xanthus
gcttcgaggtcgaccttgagttgggcaaccgccgcgctgtcgctgcccgggccccaggcatgccccacccgcgcgaggccgaggctttcgcccaggaggaaggcgcgctggaagcggcccgcgcagtacgccagcaccaccctgccgagcgtcccctgggtactcacgacatcgagcgccgacaacacgtgctccgccgtcacggaagggccacccacgggcacttccgtggccccgctggccgccgcggccaggagcgtggtgatgacgtccgaaggctccgccgccgtgggctgccagggctgctggatgaagtcccacgccgaagccagaggcacttcggtcgccgcgggcgatatggccgggccgtcgaggtccacaccgcggtccgcccaggtcgtctccgggacgtggccaatggggcccgtgtcatcgccgccctgccagcccacgaactcccacgtcgaggcgagctgcatcggctcgtcggatgcgccggacaggtcatccagttcaatgggcgcccggggcgtgggagcgacgggtggagtcgtgaattcgggagtctcgacgaagggcgagggagcgccgccatgcgcggcgggctccgtggcgtcgaggctggccgcgggggcagcaggggtggtgagcagttcgccatgctccgcgacgacgaagccgcgtgccttgcgcggcgccggggtgtcctgcgttggcgtctccgcgtgcttgccagttgaagcatcctccgccgtcgggtcggactcgctggcgatggccgccaagtccaacttgaggccgaatggctgcgtcacctcgccgaagggcagcgcggcccgttcgcccgtggatggcgtggcggcgggagcggactcgatggacggagttggctcggtctctgtggttgccgcagccgcctccacgaagccgtcaggcgcatcgctcggtgttacggcggttggggcgtctacggtggcaaccggcgtcgcctccgcagacgggctgtccgcgactgactcctgcgtggccggtgaggatgaatcgctcgtgagttccgagttcgccgctgcggtttcggaaggctccgtgcctgccagcgtttcggttgcagcggaatgaccaacggcatcggccacgatgacgggctcggctggacgctgcgcttcggctggcgtcgtggaagccaacgacgacgacgcctccgcggattctcccgtgaggactggaccggagtgggcctgcgaggcctccggcagcgcttccacactgggagattgctcagtcccttccggttcgggaatcgactccgcggacgcgacatcatcgggcgacgtcgagcccgccgcgctcaaagcgtcagcgttcgccgactcagttggagaggcggccgcgtgctgtgaggtcccagcatccggccctggagctgacgcatccgtcagctcgacggtcgacgccacttctgcggccggacgtgcgtcaacgcccggaaaaggaaccgctgcaccttccacattcgtggacgacggagcgtgctcacggtcgagcgccgcagctgccatttccacggagccatgaggccccaatgccgccgacgactcgccaagggcggacgcttcgggtgccgcatcgttcacaccggcagcatgcggctcggcgccaaccgaacgaatgccactcgaaccaccggagacatccggcgcggcagcagcagcagcaggtgcatccgaggtcgaggtggcctcggtggttgcggcgggagtatcaacgctcgcgcttgccacgccggagtcattcggatgggcagtaacgaagcttgcggccgatgcatcaacgttcgcacctggcccaacggagtcctccggctgtgcccaagcggcaccggccgccgatacggccaagaccgcattcgcatcaccagcaacatcctgtgcggagaaagatgcccccgccgccaagtcatcaacgcttgaggtggcgacattggccgcgtccaacacagcggatgcggctacagcttcaacgtccggactcgcaacacgggctacttccgactcagcggtagccgcgcttgctgccgatgcctcaacaactgcgttcggttcgtcgtgaatggggctggccgacggctcctcactcggttccacactgacgtccgctgccgtcactccaacggcttcgcttgcgacgccacccgattccgcaccggcgccctctgccgtcaccacagcggcttcgtcaactgcctgcggcccaactgcggcgtcggtggcaatgaccggctcaaccacgaccgtggcatccgtgaggtctggcgtctcgggaggcacctccacgtccaccgccgacgcatcttcggtcgcgacaggggtcgccgacaccacgtcggaagccgtgacggcaacggcctcgacgtcgaacaccacgtcagagtccgtgggcaacgcccgctcgagagccccactcgcgtcgacagcaga

SEQ ID NO: 1972 - DNA, 258 bp, Myxococcus xanthus
cctcacgtcgggggacatattcttgttcttgctacgctggatatagggaaaatcattttaatgatggcctcattatcctatattggactagggactcagccgcctactccggaatggggaacgatgctaaatgaaggcagggcttacttttacaatgctccgcagctaatgttgataccaggtgtgaccattattttatttgtgctgacgtttacagctttaggtgaatatattcgaggaaaatatcaagttaatcga

SEQ ID NO: 1973 - DNA, 282 bp, Myxococcus xanthus
tgggatgccaagcagatgaggcatcccgtcagtcaatacgacaaatcgcagctagagagtgtccgccaataagggacggccttcttcgccttccacatggccaactggacgcgttttcgcagcaccaatggcctggagcgcctccatggcgaggtgaatcgccgcacccgcggcatcggtgcctttccggaccgcgccagcgccctgcgcttcatcaccgccgtcgcacttgaagtcaccggcgtctgggttggccgtcgctatctcgacatgtctctactg

SEQ ID NO: 1974 - DNA, 2595 bp, Myxococcus xanthus
accacggtgccaccggcgaggaaggcctggctggcgttgctcgtgacggcaatgcctaccacgtccctcacgtcggaggacggggcgatggcgctttcgccccaggccacgacggtgccatccgccttcaacgccaggacgaaggaatcgcctcccgcgatggccacgacctccgtgaggtcggcggggacactcaggtccgagggaaggtcaccgccccacgccaccacggtgccatccgcctggagggcgaaggcggtccttcgcgacgtggccacgctcaccacgtcggtgagccccgccggaatcgggtggatgtcggccagggagggcccaccccagacggagacgtgattggaagcaaggacacccacgccccaatgctccccgtaggcgacggtcttctggggcaccacccacacggaggtggtggtgttccgccgccagggcacacccggcgtcacgacgacgtcgcgctcgcccggagcgacgtggtgcgccacccgcgccaccacctccgtgtcggaccaggagatgaagtcggtgacggcttctcctcccaccgtgacggtgaaggggccgcgctcggcgccgaaaccggagcccgtcaaggtcaggtgtcccccctggaccgccagcttgggcgcggagacctcgagcgcgcccagccgcgacagggccaggctgaccggcaggggctcgccttcgcgcacgtccagcgcggcctccgccttcgcgtagttcgccttgctggccgccagggtgtggcgcccctggggcacgtcttcgaggacaaagtgcccctgagcatccgtcatcgcggtggcgccatggccggagagcgacacggtgacaccctcgtggtggctttcgccttcaagttggatggtgcccgtcaccacgccgggcctgcgccgcagcgtgatgttgaccaccgtggtctcctgattccgcaccaccacgctccgctcttgaatctcatagcccgtccaataggcggacagcgtgtacgtccccacgatgaggccactgaaggagaagcggccctgggcgtccgtcaacacggaggcgttgctctccaccagcgccaccgaaatgcccgaggtcgtgttggcgtcctccagcaggaccacgcccgagatgctcccgcgagcgcgggacagcgtcaggctgacctgggcctgctcgccggcacgaacctccacggtacgttggcccgtggcgaagccgtccttctgggcctccaaggtgtaggagcccgtggggacgcctgtgagggagaactggcccgcggtgttcgtgcgcgcgctgaaggccgtccccgccagggtgacgttgatgtccaccggcgagctcccgccctcgagctggatgacaccggccacgttgccccgctcgcgcgccagcgagagcgagacggtggcctgctggttctcctgcacctggacggactcgcgcgccacggcgtagccgctcaaccgcgcttccaccgtgtacgtgcccgcggccacgctgctgaaggcgaaacggccctggccgttcgtggtcgtggtggcccccgtctccgccagggtgacggtgatgccaccgtggctgctcgcgccctcgagcagggccgtgccctccacgcggccctgggcccgtaccagcgtgaaggcgaccgtggccgcagcgcccgtgcgcaccgtgacggattgctgcaccaccgcgtagccctccttctgggcggtcaggttgtaggtgcccagcggaagcccggtgaaggtgaactggccttgtgcgttcgtcgtcgtgttggcgcccgtctgcgtcacggtgatggtgacgcccgagggggtggctccgtccgacagttggacggtgcccgccacgtccccgcgtaccagcaacaacgtcaggttgacctggctcggctggttcgcgcggacctccacggtctgctgcgcgtccacatagttctcccgccgcactcgcagggtgtacgtgcccgtcatcacgttctggatgttgaactgtccctcggcattcgtggtcgcggtgagggacgcttccaccagggtgacgacggcgccggcgtggttgctcgagccttcgagctggatgacgccggtcacactgctccgctcgcgtgacagggagaggctgaccagggttgagcccgtgccccgcacctccaccgtctgctgcgtcgccaggtagttcgtcttctggagcgccaccgtgtaggtgccctgggccaggtcggagaaggtgaagagccccgtcgcgtccgtggtcgtgttggcgcccgtctccaccagggtgacggtgacgcccgaggaatccaagacgccttccacctggacgttgccgaggattgaaccccgtcctcgcccgaggtcgagcctcacggaggccgttgctcccgtggtgaccgtgacggactgtcgggcctctgagtagccggacattctcgccacaacgatgtgcgtgcccgaggcgacgttctccaagacgaagcggccgtcagtggccgtggtggtgctcagcgaagcgccttccacggagacgctgatgcccgcgtgggacgaggccccctccaggatggcctggcct

SEQ ID NO: 1975 - DNA, 153 bp, Myxococcus xanthus
aacggccgcttccgggacgagtgcctgtcagcggagtggttttccaccaggagggaggccgtcgtcctcatcgaggcgtggcggcgcgactacaacgagaagcgcccgcacagcagtttgggctacaagacacctgcggaggtcggagctcgc

SEQ ID NO: 1976 - DNA, 267 bp, Myxococcus xanthus
ccggggctggaggaggagagccccgcctttaccgcgacggtggaggagccgaggaaggagcgcacaccccgtttggactgggccgggctgctgcgcaggacgttcgccctggatgtgttcgcatgcttgaggagtggaggcaggcggcgggtgttggcgtacgtgaagggagcaggaggggtgagagcgattctggagcacctggggttgcccacggcgggtgcgcacctggccccggcgcgcgggcctccccaggccgcgtggtgt

SEQ ID NO: 1977 - DNA, 1077 bp, Myxococcus xanthus
ccgagccccaggcccagcgaccagtggctggggccacgcgcgccctccatggtgcccatgcccaacacgagcgtcgtgtagaggtagcggctgcccaccttgatggcggtgttggcgtagttgaagtcattgccgaaggcctcgacgtggaactggccgttgcgcgcgatgctcaccaggcccaccggcacaccggaatccagctcccgcgacacgttcacgagcccgagctggaggccgctcatccgccccgccacgttgacaatccccacctgcgcgcccttcacgtcaccgcccacattgacgagggacagctgcgcgccccgggcctccgccgcccagttcaggcccacggccacctggaggcccgccatccggtcccgcgtgtggttgaacgccaccgcaccctgcacaccgtcgacgttccccgccgtccagttgccgcccacggccaattgcgctcccaccagcgacgtgccggacacattggcacccaccgccagctgcccgagcgagccgctggaccgcgccacattgagcccgaccgcggcctggatgccctccgcctttccgtgcgcccagttgccgcccacggccagctgcgtgcccgacatgtcgccccgcaccacgttggcgcccagggccagctgcaacccgtccaccctgtccgtggccacgttcgcgcccagggccattgccacgccgtccagccgcgccatgcgggacacgcccatggacatggagagatggttgtccacgggctcgccggcgttcatcaggtcattcgtctggaggccggggaacaggcccacgttgaagaagcgcgagcggtgcccgctgcccgccgcggcgacttccgccacgccggcaccggcgcccgacgagagactcgccggcaggggcccaccgccgcgcatggccgtcagctccccctgcaccgcgcggaaggcggaggccgccagcaccgtccggccgccctcccccagctcgaactccgcctgcgaggtctggtccagcaccttgcgcatcaccgagtaacggcccttctgcagccccagctcggtggtgcggcccgcg

SEQ ID NO: 1978 - DNA, 921 bp, Myxococcus xanthus
ttgggatgtggtggtccggagctggagaggcaggacgtcgaagcgacgggccgcatggaccaggcgattgtgggaggggtcgaggcacgtcctgggagtcatccgtggattgtcagcctgcagcaatacaacaatcacttctgcggtggttctctcatcagggttggcaacaaggaggagagcgatatcgtggtcacggctgcccattgcgtctacgacggaacatccggattgactgtcgtcgctggggctcatgatttcaatcgcccgtcgtcctcgcagcaggttgtcgccgcgagaaagactgtctaccatccagcgtacaacccggatacgacggcgaacgatgtcgcggttgtcgtgctcgacaagcccatcaagttcacctccacggtacagcctgtgtgtctcccgggggattcgttctcggtgagcggtacttcgtgcggcaagagcagtgttgtcatgcgtcccaacctggtcgcgcagtccccgttggctgaaacgtcgctcaaccctgtggggctctcgtcggtgggtgcggatgtcccggatggcacgatgatggtgaccgcaggatggggtcataccagggaggggggatacgatacatcctccatcttgatgcaggtgtgggttcccaccgtgaactctgagaccctgaagactgcgtacaagaaagcaggcatcaccatcgatccctacgtgatgctcggggctgggtacatgtcaggggggaaggatagctgccagggggacagcggagggccgttggtcgctctggccggtggcggatacgtgctctacggaatcacgagcttcggcgtgggctgtgcgaggccgggcttgcctggtgtctatgcccgggtctctgagttccgttcttggatcaatacgcaggtcatcatcaacagccgctcg

SEQ ID NO: 1979 - DNA, 822 bp, Myxococcus xanthus
gactccgggagctccgtcacgcccgtcaggtcagacaggatgtcgaagcctggccggagccgctcgagctcgcgcagcgacgcatcgccaatctggagtgcttcctcctccgtgacgacaccccagaggcggatgaccaaccggttcttgccaacgagtgcctcgaccgaaaacacagggccacgacctcctggcattacctgctatccctccggaggcagtctaccctctgaatggcaggcatttccaggttttcgcgtcccgacactccgcgtacggcctcagatttcggccacgccttcccgctcggcccagccctccaggccgttgggcagacggatacggacgaagcggcccgtctcttcgagcaggcgcaccttgaggccagcgtgcacctcgaagatggaacgggcgcccggctgaggcagctcgcgagccaccagcgtgggtgccagcaccacggcctcgtgcaccgaggcccccacgtaggcgtgcgtggccacgagcagccctgacggcaccgccaccgcgaagagcaggaccgccagcacacccaccgccgtccgccggccccgccccagcaagcgccagagcagcacgaggacgaaggccgccacccaggtgcccaggaaggtccaggccaccaccgggccgtccgtggccgccgcgacgcgaggcaggaaggcgtcttccgcggtggcgcccaccaccttgtccacctgccgcgcccgggccacggagaggttggcttccaggtccggcgcctggcccccttccttccgcgcctgttcgagcgccagcaccgcgcggcccacatccccc

SEQ ID NO: 1980 - DNA, 1416 bp, Myxococcus xanthus
agcgtggcggcccggatgccggagccatcccgcgtgaaggccacccaccgcacgccgctcaccgcgtccgtcacccgcgcggtgatgtgaatcacgccgctgtacgtctgccccggcaccggcagcagcagtgaggccaccggcgcggcgtcgtcgtagcgcaccgtgcgcgacagcgtggcgcgcatgcccgtctcgctcgtcacgtcgatggtgaacgcgttgtccccgggcaccaggtccagcgtcgcctgcacgccgccgccaccccggggcagcgtgtacgtccgccccgtggacagcgtcaccgtggtggcggacgcggagtacacgccgatgtcgtagggcatcgcgttccccggctgcggcccgacgagccacccatccggcaggcccgtggacacccacggtgcctccgcgtccacccacaccgtcagcatctgctccgtgacgtggcctaccgaatccgtggctcggaccaggatgaggttctcccccggccacaggtccacccggtgcgtcacgtccccgccgcccgcgggcacgtccgtcacctgcacccagttggtctccacgcgcaccggcgaccagtcacgcaccaccatccgcacatccacgctgtaggaacgcagggccgcgccgttggccggtgagaggaaggtgagctccggcgcggtgttgtccaccatgaccacggcttcctcgctggcgatgccgccgaacgagtcggtggccaccagccggatgacgttgggcccgtccatcagcggcagcaccgtgtccacgtagccgccgctggggtcgggggccaccgggtggctgacgccctggatgacgaaggtggctgagtcgatttccgcgcccgccgccagcggagtgacgaagccgcacacctccagcgtcagcgcgtccgtgaagcccggcagtccgcacagcgtcaccgacggcgcggggaagggggacgggtgcacctccaccgcgaacgacgcggagctgcccagccggttctcccgcgcgggcgccagcgtcacgcctgaatacaccgcgcgcaggtcccggacgcccacctcgctccaggtggaggcgcgcggacgccacacgaaggagtagacgccgtccccgtccgcgtcgttgtccgcgcccaccgtgacacccgccacggagaacgtcaccacgcccatgccggggcctcgtgcctcccagccgcggtcatccaccacgcgcgcggacagggtgttgttcagcgccaccgtgagctgtccgtccacgggcgaaagcagcgtggtggtggtgggcacgccgtcggtgggcggcggcgggttggtgtaggtggtgacgcgcaccgagcccttcactccctccgcttcctgggaggccgccaccaccatgacgtccgaggtgagcgacggctccagc

SEQ ID NO: 1981 - DNA, 270 bp, Myxococcus xanthus
tggctgctcatcgagtggccccaggaggagaaggcgccgacgaagtattcgctttgctcactgcccgcgaatacgccgctcaaggagttggtgcgcttgtccaagctgcgctggagagtggagcgggactaccaagaactcaaaggcgaggtggggcttgaccacttcgaggggcgagggtggcgaggcttccaccaccatgccaccctctgcatggtcgctcacggattccttgcgctccgccgggcgcttttccccccggaggagagc

SEQ ID NO: 1982 - DNA, 369 bp, Myxococcus xanthus
gtgaagacgacgctgacagaagcgagcctctcgggtgtgcgggaggccctgcggcaagccaacgcggggttcgagcgcgcctacccgggggactcgacccaacggcagccggtgcacgtggtgtacggcggcgcgcacctcttccgggcggagacggcccggaagctgggcggcatcgcgctgaacacgctcaagacgtacgcaccggatgcgcccgtgctggcccacgggctgggactgccccagcgcggccgcttcgcccagcgcgtctacgcgcgcgtggtggccaagctggagcgcgagccggtggaggacctgcgcatcgacttcgaggatggctacgggcaccgctccgacgcggaggaggac

SEQ ID NO: 1983 - DNA, 108 bp, Myxococcus xanthus
atggcatggattgtgttgatattggccgggtgtctggagatcgcctgggcgctcgcgctcaagcgagccgacggcctgacccggttctggcccagtgtcatcggcatc

SEQ ID NO: 1984 - DNA, 510 bp, Myxococcus xanthus
tactggcacccggtcgccttctccagcgagctgacggccgttccactccccgtgcatttgctggggacggagctggtgctgtggcggacgggctcgggcgtggccgtgacgcaccggcgatgtgcacaccggggcgccgacctcagcgtgggcgtcgtcaccccggaagggctgcgctgcggcttccatggctggacctacggctcggacggacgctgtgtgcgggtgccgtcacagcccgccgcgcccattcccgcccgggcacgcgtctccgccttccaggccacggagcggtacggcctcgtctgggtctgcctgtccccggagcccgccgcgccgctgccggagtggccggagctggaggacggcgccctggccaccgtgccactgccggtgctggagtgggacgtcgccgcgggccggatgattgaggtcgtcctggacgtggcgcacctgtccttcgtgcacgaaggcaccttcggcaacccggagcagccggaagtgcttccc

SEQ ID NO: 1985 - DNA, 471 bp, Myxococcus xanthus
ctccagcatacgtccgtcgtgcgcaccttcatccaataccggcgccgcctctggacagagtgggggtggtcgagtgggtggctgacggacctccccatcatgcacgtccttgacgccgcaccgacacaacctccgccgtcaggcatccttgaagcgtatcgcgtgggcccgtgcgcccgcgcggcgggccttctctccgaggaggagcgcattgccatggctgtgcggggcttgagtcagttcgcgccggagctggcctccgaagtgcagtgcggaacctcctacgcatgggacctggacccttgggctcggggtgcctttgcgtggttccggccgaggcagctcacgcagtggggacgtgcgctcgcaacgcgcgaaggcagggtccacttcgccggagaccaaacctctcccatgcccggctggatggagggagcgctcttgtcaggccaacgcgccgcccttgaaatc

SEQ ID NO: 1986 - DNA, 1254 bp, Myxococcus xanthus
tctcttccctgccgggcgccgagccgcgccaccaaccgggcgttctgcggccggtcgaggtcgggaatgtcgatgatggccacgcggccgtcaccaaaggtgctggtgaagatgcgagcgctgttgccgcggacgtccgcggccaggccaaagggctggctgggctggttcggatcgttgtcgcccacctgcacctgggcgacgagctgccccacttcttcgtcgaagatggccacggcttcgtcgccgctgcccgtcaccgccaccaggttgccgcgcccagggccgcgaggaatgacttccagttcgctggcgcccgcgggcaccggcagcgccgacacgatgcgcacgctgggggtcgtccccgcgtcgggcgccgtgcccgccgcgttcaggacgtccaggatgagcaacgtgtccggaccgcgcgccagcaggtagacgcgctcgtccacgatggtgagctcgggcgacgccgggtcgggcacgcgcgtggccgagggaaccaccgccacgccgcgcgcctcacgcaccgagtacgacagctccaggtcggtctccagcacgcggcccgcgacggtccggtccaccagccgcaggatgaagcgcgccggcagcgcccccatctgcgcggaggaagagttgcgccccgaggcgtacacataccggctgccaatggccgtcgcgtgcgcgacgccagagaggcggtcattggtccccagcgccacgaactcgctggtgttcagcgcgtcgcgcgtggggttcgccgcggggaggtgaagcacgtagcccgccaggtccgcttcggcgaaggtcgtcggcggtccggccagttccgtgtgcgtcacccagacgcgagcgtcctcgccgttgccggcgacgctgacccccagcggccccggagccgaaggcaatccgttggaggcacctgggacatccagcagcgacagcgcattgacgcggcagtcgcgctcgccgccctgcacgcagctcaggctgaggccgtcatcgcccacgtcgatggcgtgaagcagactgccctccgcccgcgccgggacgaacagccgcggtggccgccccggagggctccacaaggccatctccccagcgaagctttgaatctgcacgtaggactgggcgccgatgccaagcgacgtgacgtcgttgggcagcgactccccggggtcgaagtccgtgccgaagggccgcacccccacggcatccaaatccagcgcgacgaccgaacccgagtcg

SEQ ID NO: 1987 - DNA, 273 bp, Myxococcus xanthus
gtaggagtacagctttatacgctgcgtgaagaaacgaaaaaagattttaaagggacgcttcaaaaagtagctgctttaggataccaaggggtagaatttgcagggtatgaaggatatacagcgcaagaagtaagagcgtggataatggatttgcagctgaagccagcttctagtcatattccacttgaacaattagaatctaatttacagcaagtgattcactttgagcagcaaatcggagatcacatattgttagtcttatttatgcctgac

SEQ ID NO: 1988 - DNA, 504 bp, Myxococcus xanthus
ccaagcgcacgggccgcgaatcgtgtcatcgtcctccgcgccatgacttccacctcgcgtaccgtccagggacccacgggccagctcgcagtcaccgacactggcaatggtggactccccatcgtcttcgtccacagcaacgcctcccggcgtgagcaatgggccgcgcagcaagcacatttgaagcagcgctccgtgtcgttcgacctgcgtggcatgggcgactcgggcctcgacgcccagggccgctacggcgccgaggacatggccaatgacatccacgcggtggccacggccctggacctggagcgcttcgtcctggtgggccacagcttcggcggctacgtcgcggcggagtacgcccgtggctggcccgaacggctggccgggctcgtcatcgtggatgccgcggggacgatgccgccgcttccgcccgaacagctccaaggcttccacgaaggcacacgtcccgagtcctaccgcgccttcatggacgcatggttc

SEQ ID NO: 1989 - DNA, 954 bp, Myxococcus xanthus
gaagagctcatcctgagcttcctgtcggaaagcgggggcgattacacctccggtgaggcgctctccagcaagctgggcctgtcgcgcacggcggtgtggaagcacgtggaggccctgcgcgcgaaggggtaccgcatcgaggcggtgtccgcgcgaggctaccggctggtggcggtgccggaccggctcacctcgctcgaggtgggcccgctgctggacacccgcgacctgggccgcaccatccaccatcacgaatcgctgccttccaccaacgagaaggccttccgcctggcccaggacggcgccaggcacggtgaggtcgtggtggccgagcagcagaccgcgggcaaggggcgccggggccgcacttgggtgtctccgccgggcctcaatctctacttctccgccatcctccgtcccggcctgccgccccagcgcgcgccggagctgacgttggtggcggccgtggcgctggcggagtcgctgcgcgacgcgggcgtggaggccgccatcaagtggcccaacgacgtccacatcgacggcctcaaggtcgcgggaatcctcaccgagctgtccgccgaacccgagcgcgtgcacttcgtcatcgtgggcgtgggggtcaatctcaactcccaggtcgaacactttccggaggagctgcgggccaccgccacgtcgttgtcgctggccctggggcagccggtacaccgggctcgcttcgctgcgtcgctctggacgcggctggaggagtggttggacctctacctggacacgggcttcgacgcggtgcgtgcccgctggaaggcgctgtcctccactctggggcaggacgtgctggtgcgcaccgaccggcacgagctgcgggggcgggccgaggacatcgacccatccggggcgctgctggtccggacggcggagggctcgctcgaacgtgtgttggcgggcgacgtggag

SEQ ID NO: 1990 - DNA, 1158 bp, Myxococcus xanthus
ccggaggtactccgagcagaggagcgaggcgggagcgggatgacaaagcccaccatcagtccgcaggaactccgcgcgaggataggccatcgggcgaaatccgccccgacgcatcgcttctggggattgtacgtccacgtcctcaaacccgaagttctcgaagccgcctatctggaagcccggcgcaacggtggggctcccggtcaggacggcatcaccttcgagcacatcgaggagcgcggacgagcagggttcctcggtgcagtcgccgaggaactccgcacgggcacgtaccgccccagaccgtaccgacgaagagagattccgaaggagggcggcaaggtgcgcgtcatctcgattccgtcgattcgagaccgcgtcgtccagggcgccctccggctggtactggagcccatcttcgaggctgacttctcgggcagttccttcggggcgagaccgggtcggtcggcgcatgaagccatcgacaccgtgcgccaagggttgcgacggcgcaggcaccgcgtagtcgacgtggatttgaaagcctacttcgacagcatccggcatgcgccgctgctggagcgggtggcacgaagagtccaggacggcgaggtgctggcgctggtgaagcaattcctcaggagcacgggggacaggggaatcccgcagggctcgcccctgtccccgctgctggccaacatcgcgctgaacgacctcgaccatgtcctggaccgaggacgaggcttcctcacctatgcgcggtacttggacgacatggtggtgctcgcccccgactccgagaaggggcggaggtgggcagcacgggcgctggagcgcatccgccaggaggcggaggcactcggcgtgtcgctcaacaaggagaagacgcggacggtgacgatgaccgaccgcaacgcctccttcgcgttcctgggtttcgacttccgctggaagcggagcccgaagactggaacgtggtacccaaacacgaaccctcgacgaaagaaggtcaccgaagttctgcgccgcgtgcgccacgtcctgcgggacagccgagcactcgcagtgcagtcagccgtggtggaggtgaatgccattgtccgcggctgggtgaactactttcggtggggcaactcgtaccaggcgctcgacagggtg

SEQ ID NO: 1991 - DNA, 138 bp, Myxococcus xanthus
cccgtcggaacggcctacgatgtctgggtggggatgggcatgtgcggcgtcgcggtcttcggcatgctatttctcggcgaacaggtctcggcaccacgtatcttcttcctggtgatgatcggcatcggcgtcgctggc

SEQ ID NO: 1992 - DNA, 336 bp, Myxococcus xanthus
caggcggccgggctgcgcacccacatcctcgtctccctgggcgcgtgctgcttcacgctggccagcgtcttcatcgaagtggcgttgggccctgacaccccagagggtacccggggtgacatcagccgcatcgccagccaggtggtggtgggcatcggcttcctgggcgcgggcgtcatcctgcgccacaacggccaggtgaagggcctgacgacggcggccaacctctggctcaccgcgtccgtgggcctggccgccggcctgggcttctacttcgccgccgtcaccaccatgaccattgccctgctgtgcctggcgggcctgcgtcccctggag

SEQ ID NO: 1993 - DNA, 1710 bp, Myxococcus xanthus
ctcgacaaactggataaactcgcgagcggatttctacacagcaatgacccttactcatggatcctcgcccgactaacagcagagatctcgcacaagtacatcaaaacatctctttggacgccgatagataacatcttaacgaattcacacgagctcgcagcctctgctctttctcagtttgcacgagcctcttttacaaactgtcgcgcccttgtgtggccttcacaagcaaaaggaatcgaaaacctccgtacagacgactcttttattctatgcacaccaacaggctcaggcaagaccacaatcgccacccttgccgcaatcaaatccctattcaccgcccccgcaactgctcctagcgacgaccaacgccaatccggaaatctcgtcctatacttagtcccatcccgggcacttgccgctgaagttgagtctcgtcttgagcaggatcttcgcagcgtcgctcaagatccagtcatcgttacggggctatatggcggaattgactggggacctaccgacgcatggattgatagcgaccgacctacggtcttgatatgcacattcgaaaaagcagacgccctgcttcggtatctcggcattctttttctccaccgtgttcgactagtagtcatagacgaagcacatatggtggattttgagagaagcaatgcttcctcacttgaagacggaacatctcgttcattccgccttgaactactcggcacgcgactcttacgagcccaagatgcctataattttcgcatagtagccctatccgccgttgccgctaatgcagctcccgccttagcccgttgggttacaaccaatcgagactccgtaccgactcgttcagactacagaagcaccaggcaaatgcttggccgtctagaagtaagtcccaccggagtttttcgtattacctacgaactcatggatggacgttcattgcgtttcaagaacggacggacatacgagaagccatttattcctgcaccgttccccccattacccaacgaagtacaggacagccttgggccagaaaagcggctacgcggcccaacactatgggcagcactacacctcgcagcgcgccgttctgacgacaccagacccacggtacttatctcgttaactcaacacattacaccattcgcggaagactgcttagaacacctagactcatggaacactcacctccccgactactttccaacaccaccagcaactgacacgtgggcaaattgtctcgcatccgttgcggactacttttcggcggactcaatagagtacaaactactagtccgtgggatagcagttcaccacggcaaactccctccgcttgtctcgcgtcgcttaaaacaagtaatcgactctggccttgtaaaaatcatcattgcgacttcaaccctttcggagggagtaaacatctccgtcaactacctactgctacccagcgtattccgtgcaaacgacgcattcacagtacaggagttcagcaacctaattgggcgcgcagggcgaccaggggtttccactgaagggcatgctctcgccgtccagatggcggacaatgaaaaagctaatcgccagcggcaaggatttgacacactggtacatgaactcaaggaagtaacagacaacgcagcactcaacgaacaagaagacgcatcaagcccactattcaatttaatattagccatatgggac

SEQ ID NO: 1994 - DNA, 1638 bp, Myxococcus xanthus
tccagcttgacgcagaactggtcaatgtccatgtcgccagtgaagccgcgcttctcgaaccattcgcggaactcttttggcaggacgtggtgccgcggtggctcggccatgccagcccccgccttgcccgtcacgcgcatggcacgcacttcgggtccgtcgcccaacgcctcgcgcacgccctgcggcaactcgccatgcgcctgtgccagcatcacctggcccgcctgaatccgcacggcggcactgacgacggacagggagaggacgcctgcgcgcaccaactggcgcatcatctccacccactcggcggacacgaccgttcgcgtgcccatcatcacgccgttgcctcccaccgagagtccaatgccgagcaaggcgggagcggacggagacaccgggggcagcgagaacttcaacgccgaaagcagggtaagcgcctcgatggcatccttgagcaccagcatcttcgcgacgttctcggctcccttgcgcacggtcgcgatggtcgcggcgagctcgcccgagagctggcctacaagcgcggggacgtcttgcgccgcggcctccatctgcccgggctccagagaggagagcgccgccatggcgggcttgagcatctcctgccagcgccacagatccgcgaacatcctctccacgctgtagagctgctgggcgagcacggcttcagcgaggaggagaaagtcgagccagacggcgagcaggagcgagcccgtcatggcggcctcaagccgtgggccagcgaggcgcaacagcgcgagctgcatgtccgggtcctccacctccgaggcggcgttggccagccgggtgacggcggcgaggtgggcgtcaatccaccgcaactgctgggtgccgaaatcgacgtagcggacgaaaacgccgtctccgacgcgaatcccccgccaacgggccttcagcctggagaactcgccggcgatgcggcgggtggggtccgaaacgtcgagaaaggcgctgcgaaatgccaactgggccgcgagggcaccctggtgcgcatccctctccgcgcggtccaggcccacccctgtcacttccacccgggaggcctgtcgccgatgcagccgctccggcgtttcggactcaggcattgaggcgaggacacccggagcctcaacgcttggcccctcaaccgaggtaggcgccgccgcctcgtgcggcgcgtgacggaggttcatcccccggccgggcggtggtgtcagtgacaggcagcctgtggacagcagggcaagaacgagcagcagacccacccaaattgcccggagcgagtcagcgcgcatggtccatcccaagcccacagagccaaacgcccccgggaacagcgcacctatgccttccgggaacagcagcctggatgtcatggagacctccggaacaggagcctcctgactaccacccatccccgacatccaagaaaagtcagaatgtagcccctttggcagggagtatctcctccgtgtcctttcggcagccgagcgtgaagggccctggcgcccctcggcaccgtcttcggcccattggcgtagcgccgagtccctgggagcgatttcaatacctgaagggtctataaatagtagacccatgaccgcgacagccaccgag

SEQ ID NO: 1995 - DNA, 849 bp, Myxococcus xanthus
aggggtgccaccatggacgccgagcacagggttgatggacaggatgggacggcgggtgctgggcccgaaggtggctcgcaggcgccgtccgggcaggacggcggccagggcggtgccgtgagcgccgagctgcacgcttcggggggcccctcggggccgcagggcgagcacaggcgcgaggacgcgtcaccggagtccggtggtgagcaccgagccgagggcacgccccccgccgaaggttcagaacagcgagctgagggcacgcctgccgccgaaggttcggagcagcgagccgagggcaagccttccgagcagggcgttgcgcagcgcgccgaggacacgccttcggaacaaggcgagccccagaacgccggctctgcacaggggcagggcggtgagcctcctgtcgccagtggcgacactcagggtgagggcgaacggccgcacaacgcgggcggggaagcgccgggctccgcggacgcctccggaagcgaaggttcgaaggaccaggcaggttcgcaggaaggtggactgcaggccgagggcaccacgtcccaggggcaggcagagccacctgccaaggatgcgtctcatgcgcagggcgagcaccaggccgtgagtgattcccacgggcaggacggaagcgaatcgggaggcaggtccgtcgccaacgaggaggcgcgcgccgagcagtccccctccgacggcgaggcccgtgtcacgcccgggctggacgagcgcccgcaaggcgcgttctggacgggggaggccgacggggacaaatccggcgactctgacgaggcgtcgcgggaggacgtcctccccgaacccgagcagcggctttcgggc

SEQ ID NO: 1996 - DNA, 669 bp, Myxococcus xanthus
gaagattttttgtcgctgtttcattaccaagcagtagacgcaagcaaaacagaagattacaaacagctgctaaagcttgtgaatgagcaagaaacaactcatagaagtaaaggaaatcgtttgttttatttgtccgtagcaccagaatacttcgatgtaattgcgctgcatataaaaaaaagcggcttagaccaaacgagcggctggaagcgtcttatgattgaaaagccatttggacatgatcttgcttctgcaagaaagcttaatgaaaagctaagcagtacgtttaaagaagaagaaatttatcgaattgatcattatttaggtaaaccgatggtgcaaaatttagaagcgcttgaatttacgaaccctgtactgcaatcattgtggaataacaaacacattgcgaatgtccaaattacagcaagtgaaacagtcggtgttgaaaatcgtgcagggtattatgatcatacgggagccatacgcgacatgattcaaaatcatatgctgcaggttctcatgatgacagccatgcatcttccaaaacgaatttgctcagaaaacattttagaagaaaagcaaaaagtaatggagtcactgaggaaaattccagcacaagaagtagctcgcgatgttgtacgaggacaatacggaagcggagaaattgat

SEQ ID NO: 1997 - DNA, 231 bp, Myxococcus xanthus
aacgtggtgggccccttcctccttaccaaggcggtggccgggtacatgtcgggtaaagtcaaggggctggtcatgcacatcacctaggatgcgagtgggtccgcctatccccttgggggcgcatacggcgtgtccaagaacgcgctggaacacctggggcgcgtctggccccaggacctggagggcacgggcgtgcgcttcgtctcggtggaccccggggagatggacaca

SEQ ID NO: 1998 - DNA, 684 bp, Myxococcus xanthus
gaacgactacagaagtacctggcccgcgcgggagttgcttcgcgccggcatgcagaagagctgattaccgcgggccgcgtcgcggtgaacaacaagacggtgacggagctgggcagccgggtggagcccggcaccgacctggtgacggtggacgggacgctggtcacgcctccggatgaatcctcctacttcctgctctacaagcccgtgggcgtcgtgacgacgctgtcggatccgcagggccggcccacggtggccaactacgtggaagagacgggcaagcgcctgttcccggtcggccgtctggactacgacgccgagggcgcgctgctgttcacggatgatggggcgctggcgcacaagctgacgcaccccagcttccaggtgccgcgcacctacctggcgaaggtgaagggcgctccggacacggccacgctggacaagttgcgcggcggcgtgcggctcgaagacggcatggccacgccggtgtcggtgagcgtattcgaggcggcggagcggaacacctggctgaagattgtcgtggcggaaggacgtccgcacctcattaagcggctgtgcgcggcggtggggcacccggtggtgcgtctgttccgtccgtcctacgccggcgtgggcgtggaaggcctgcgccccggcgagctgcgcccgctcaagacgagcgag

SEQ ID NO: 1999 - DNA, 396 bp, Myxococcus xanthus
atcggctaccacgcctacctgttagggactcacgcgatgaagacggcgcttctccctcagcttcagaccttcctcgtggtggcgcgcctgcgcagcttcagcgcggcggctcgcgaactggggctctctgcctctgcggtcagccagtctgtacgccagctcaaagcgcaactcaatgtagtcctgctgacccgcaccacgcggagcgtgtcgctgaccgaagtgggcaggcgcttggtcgagaaggcaggccccgccctgggtcagaccttcgcggccctcaccgaggtctcagcgaatccaggtgagccggtcggccggctccggctgtcggtgccccggaccgcggtgccctttgccatcacgcccgtgctgccgacctttcgcgcacgccac

SEQ ID NO: 2000 - DNA, 16563 bp, Myxococcus xanthus
gaccacgaaggccaccagccgcgcttccaggccggagccggtggcaatcacgcctgcctcgcggatgtccgggtgcgtgagcagcgccgcttcgatttcgcccgcttcgatgcggcgcccgcgcaccttcagcatgttgtcgcggcggcccaggtattcgaacgtgccgtccggcacctcgcggcagcggtcccccgtggcatacggcccgctcccatggcggggctggccccagtagcccagcatcaccgtggggccttccaccatcagctcgcccacgccgtcgccttcctcccgcgcttcctctgagcccggcggcggccgggccaaccacacgcggttgccacagctcgctcggccaatgggcaccggctcggtgcggtggggcgaaatgtccgtcacctcatggaaggtgcagacgttggtctccgtgggtccatagaggttgaagaaccgcgcctgtggcaggtgctcacgaagcgggcgcaggtgccggatggggaacggctcgccggcgaagagcacggcgcggaagggcagcgccccatgcttcagcaggccgccttcctgcatcatcagcatcagcgccgacggcaccgagtaccaacaggtgaaccgctcgcggaggaccagctccaccagcttctccggcgcgaaggccagcgcctccgggatgagcgtgacggacgcgccgcccatgaaggccgcatacaggtccagcaccgagaggtcgaagaagaacggcgcgtggttgctgaagcggtcctccggtgtggtgcccaggagcgcatggcaccactcgatgaaggccatcgcgttccgctggctgatgcacacgcccttgggcgttcccgtggagcctgacgtgtagaggatgtacgccaggtcgtggtcgcccgcgccgtgcggcggcagcggctcagatgaaaaaccggacagccggttccagcagatctcgggccccttgtcgtccaccagcaggtagcgcagccggctcacgccggcgttgtggagctcggacgcgcgcgtggtggtggtcaccatcacgtcaatgccgcagtcgtcgaggatgagccgcgttcgcgtcgcggggttcagcgggtccaaggggacgtaggcggcgcccagccgggcaatgccctgcatcgcggcgacggcgcgcacggacttttccgtccacagccccacgcggtctccctgcttcacgcccagctcctggagcgcgcgggcgatgcggttggcgagcgcgtccaactggccgtaggtgagggtcccgtcgggacccttgatggcgatggactcgggagccttcgccgctgcacggatgacgatttggtcgagtgtcataggccgagctggttggcgatgatgtcgcgttggatttcggaggtgccggagaagatggcgctgggaatggcgtcacgcagcacgcgctcgatgcccgtttcggccacgtagcccatgccgccgtgaatctggatggcgtccaggccgctctggatggcggcctcgctgatggccagcttggccagggacacttccatgacggcgtcctggcctcggtccatcttccagcaggcctggtacagcagcagccgggatgcctccagccgctgcttcatgtccgccagcttgtgggagatggcctggttcttccccagggccttcttgaactgcttgcgggtccgggcgaagtccgccgtctgttcgagcacccgctccatcacgcccacgtaggcggcgaagaggcacgcgcgctcccactgcatggagcgcttgaacatcgccgcgccctggccctccgcacccagccgcgcggactccgggacacggcacccctccaggtagatgggggcgatgggcgacgtggacagccccatcttctcgaaggcgcgcccgacggacagtcccggcgtgtccttctcgacgaggaaggcgctcaggcccatgtacccatgggccggctgcgtggcggcgtagacgaggaagacgtccgcggaggggccattggtgacgtagctcttgccaccatcgagcacgtagctgtcgccgtcccgcaccgcgcgcgtcttcagggcaaacacatccgagcccgcttcgggttcggagatggcgttggcgcccacccattcccccgagcacaggcggggcaggtaccgggacttctgcgcgtcatccccgctctccaggatgggcatcacgcaggcgaagaggtgagctcccacggagaacaccagtccggtgtccacgcagccacgccccagcgcctccatcacccgtgcagtggtcagtgtgtccagccccagtccgccatgcgccgcgggcacgggcagccccaagaagccgaactcaccacagcgttgccacaaatcgcgtggcagggcttccttgctgggctttgcggcctcgggcaactgcgctcgcgcgaaggcgagggcacggtcatagagctccacctgctcgtgagtccaactgaagtccatgttttcctggcgttccaacgggtgacagcaacgagggggcgcgcttcgaacgcattgcgctcgcgctgcatggccctcggagatggatggtgagacgtgagaggagtcaggcgaagtctcgcgtgcgcgggaacgagtcgtcaagaacctcggggatggtggtcgggaagtgtgtcttttgaggtggcgctggatgggattgaagtgcggggctcggtaattcctatctgctgggtctggcccgaggtggactcaatgagttacaaatgggccgggacgcgattttccgctgccgcggaccacgtggtcgcgaaggccggccgcgcatccgcgatcggcggggaaacgggctgaaatgaggcccatgacccgcccctccagaccatgtattccgtttcgtttcactacccattgcactgggtacggtgtcactcattcccggcgcgagcgctcgcgccagtgctttccagcctatggccgcggtaaaattctacacgcggctgacctggtcgaactggctgagcactcatctcagaccagggtatgggccaacctggtcggtgattgactggtttgctcgtgagcagtttgcttcgggcatggaacgttgcgtcgttttggatttgcctggattgagcgcgaggtatgtcggcccctcggcgccaaacatgcaggcattcgtggagcgggggcgcatggtgccgctccagcccgtcctgccggcgctgaactgcaccatgcaggcgacgttcctgaccggaagatatcccagcgagcacggaatcgtcggagatggatggctcaaccgggagttgggagaggtccgcttctggccccaatccgatgggctcgtgcagacgccgcagctctgggacgccgcccgcaagctcgaccccagcttcacctgcgcccgcgtgtgctggttcatgaacatgtattcgaaggcggactacgccatcacgccgcagccgtccttcaccgcggacgggcgggtggtgcctgacgtgttcacggagccgctccacctgcgcaagccgctcgtcgaggcgctggggaacttccccgcgtatgactactggggaccccgctacagcatccgctcctcggagtggatcgccgacgtcgccatgtggctggagcagcggcacagccccacgctctcactcgtcttccttccgcacctggactacacgccgcacacgtttggaccgaacgcgaaggagatccacaagagcctccgggagatcgacgacgtcgtcgggaagctgattggcttctacgagtcgcgcggcgtgcgcgtcatcatcctctcggagttcggcgcggtccccgtgtcccgggccgtccacctgaaccgcctcttccgccgccgagggtggctggcgatccgggaagagggcggccgtgacgtcgtctatcccagcggcagtgaggcgttcgccgtcgcggacatgcaaatcgcgcacatctatgtccggaacccggcgctcctggacgaggtcaaggcgctggtcgaggcggagcccggggtggcccaggtgctcgatgccgagggcaagcgcgcccaccatctggaccacccacgctcgggcgagctggtggccctggcggaaccggatgcctggttcacgtacttctactggctcgatgacgcgcgtgcgccggactacgcgcgcaccgtcgatatctaccgcaagccgggctacgacccgctggagatgttcgtggacccgaagctgggtctgcgcatgctggaactggggggcagtgtcgtgaaggagaagctgggcgtacgctcgcgactggaggtcgtctcgatggacggctccctcctcaaaggggcgcatggcctgcccaccggcccggaggatgggccggtgctgatgacacgacatggcgagctgatcgaggcagagacactccacgctacgcaagtccacgacctcatcctggcgcacctgaccggacagcaggcggcggcctgaacggcttccgcgagcaacccgagcgttgacgctgcaagaggcgggacacggcatgaacaaacttcctgggagcgccattgtcattggcgccagcatcggtgggctctgcgccgcgcgcgtgctggcggaccatttcgagcgcgtcaccgtcattgaacgggacgtgctccaggatggccctcgcccgggcgcgccccaggccaatcacatccacgtcctgctgcgaaagggtgtggacctgttggagcagtacttccccggcctcgtcgagcagatgacggcggacggcatcgagcccttcgacttcacccaggacctccggtggttgcagtttggtgactggatgccgcgccaccgcagcggcatcgtcctgtacccgcagacgcgctgctccctggagcgctacctgcgagggcggcttcgcgcctattccaacgtggagatcctggagtcgacctccgtgcgggcgctgctggccacgccggatgggaggcggattctcggagtccagacgcatgaccgccatggggacggcggcgcggtgacgaaccggctcgccaacatcgtggtcgacgcgagcgggcgcggatcgcaactgggcaagtggttgtcggagttgggtttcagcccgccggaggagagccggctgcccatcaacctctgctacgtgtcacgcctcttcgagcagccggagacagccagggactggcgcggactgtggatcaccccgctgccgcccgacaaaccgcgcggcggggcgatgctgggcgtggaaggcaatcgctggattgtgtccttgttcggctacgaaggacaccacccgccccgcgacgaggacggattcgtggagttcgcccgcagcctccgcgagccggacatctacgaagccatcaaggacgcgaagcccgtctcggacgtcggggtgtaccgggtgccggacgtgagatggcgccacttcgagcgcatccgggacttccccgcggggttgctcgtcctgggggatgcgtggtgctacttcgaccctgtcttcggccagggcatgtcggtggcgatgctggaggcgaacctcctcaacgaggcgctgcaccaactcgacagcctggaggcggtgacccaggcctggacggcgtcctacctccgcacgggcgcgcagtggctccagggcctctggttcttcgtgacggcggaggccatgcggcatccccacgtccccggtgagcggacgcggctcatcaagctggcccagtggtacgtcgaggagctctacgcgctgaaccacgagcatccggagatctaccaggagttcctcaagctgatgcacgtccaggcggggccggagttcctcctgcgcccggacatcgccttgaggctcgcgaagcgcgcctggcagcagaagtccgagaagggcttgggcaccgaggcactgtggcccgccagccgggtggcgctgggagcgcgctacgcgggacggatgctggccaacctggtggttcctcaacgggtcggcccgcgtgatcgcatctgccacttcgacacggaagtgctgtggaagccggacaagacgctggggtggttcgtccgggatgccctgcgcgcccaaggtctgctgagcgaggcctccgaggtgcggcggttcctggagtactggctcccggtgcagggcctgggcatcgcgaagaaggcgttgattgagttctcctataacgcggacgagcccggcctgggcttcatgctctacggcgacaatgggacggtcacgcgggccttccgggagtacacgcggcagctcggcatcaccaacgagggcgtcgagcggtccgtggccatctgcgagacgttccggccttcggacctgggcctggtgcgcgcggagttcaagcccggaggccccacccggtattccattgccgccagctggcacttcgaccccatgcgcgggcactccggtttcgatgaggcgatgagccgcctgccggagcgcttccgggcagggcccttcgcggagcgggtgaagacccatgcttccgcgctgcggaccgaatactacccgctgttcctggggttgagcttcctggaggacggaacactcgaatccaagatgtacctggtgcgcttcgacgcgaatcggcctccattccagcctggctcggagctgtggcgcttcctccaggaaatgggtgtgtccgccccggagctggagcgggttcgccagctgaacgcgctgctctgggagcactccgcggataagatgacccaggtcgccatcgaggcctccgagttccaatcccagcccaagcgcgtcaacctcatctactgcgggatccagacctctgtggttctggaagccatctcccggttcgggtatcccgtgtcctcgaagcaatccgttcgggacttcgagcggatgatgcagaccgatcgcgcgaagttcgtcgcggtgcgggtggggcccgaaggattgagtccgcgtctcaagctgtacaagcacgccctttttgattttggcgatctgtccgtggtggaggacggaggcctcgggccgcgtgatgccacgccggccgcagtgaaagacgtttcggacgtatgtctttattgattcttgttggttgagaatgaagttcaaacaggtgatgagtctgagcggcttgcgagtcgccagcggagccgtgccttgatgttgtgtgaacccattgctgtgattggactgggcctgcgtctgcccatgtcggactgcccgcgtacgctctggcaaatgctatgtgatgggattgatgcgacgggggacatcccggccgggcgctggcctttgtcttcgctcttcgacgcggcacctgatcgccctgggacgattcgcaaccgcaaggccggactgattgaaggcgtggagctggccgaccccgcggcgttccggctgacgaagcgggagctgcggcagatggacccgcagcaccgtctcctcttcgagtgtgcatggcatgcgctggaggatgcgggcctgcccttcgacgccgtgcgagggagccgcacgggcgtcttcatgggcgtcaacttcagcgacttccagcggatgctggcgagggactggtcctcgctggatggctattccgtcctgggaacgacggcgtccttcgcggccaaccggctctcctacgcctttgatttccggggacccagcaccgtgtcgagcgtggggtgtgcctcctcgacggtggccctccatgaggcgtgccgcagcttgacgctgggcgaggtggagatggccctcgccgggggcgtcgagctgatgctgtctccggacagcagcatcatgctgtcccaggccggcgtgttctccgagcgggggcagtgccggaccctggatgcgcaggcggacggctacgtgcgcggggagggcgctggcgtcgtcgtcctcaagcgcctgtccaaggttgagcccggtgaccgcgtgtacgcggtgattcggggcagcgccgtcaatcacaacggccggaacgagtggatcatggcgcccagcgcctcggcgcaggcggacgtcatccggcaggcgtgtgagcagggcggggtggctccggcgagcatcgactacatcgagatgcacggctcgtcgttcctcaagggcgacgcggccgaagcggaggccatcggggaggcgctcgggacgcagcggccggtgccctgcaggctcggcgccatcagcaacaacgtgggttacctgggcgccgcggcgggcatcgcgcagttcatcaaggtgtgcctgtcgctgcaccaccggacgttggcgccgacgattcacgtggatgcgcccaacccgctggtttcgttcgacgcgctcgggctgagcatccagacggagctggagccctgggccgcgcgggagcctggcgtgccgctgcgagcgggcatcgtctccacgtccctgggcggtgccaacggcttcgtggtcctggaggcagctccggctgcggtgctggagcggacgcccgcgccggtccatttcctggcgctctcggcgctctctcaggacgcgctccgtcagcgggcgctccagcttcgggacttcctcgccacgacgccggactcggtggcgacgctggaggacgtctgcttcacggcggcgctcaagcgtcagcaccaccggcaccgtgccgtggtgattgcgggcgaccgggctgggctcgtggcgctcctggattcgctcgcgacgtcgagtgggacggcgctcctggttcaggagggcatgccgctggagcaggtggaggccgggcgtgtcttcgtcgcggatgggacggtgccgcccgaggtgttcccggtgcgtgcagggcgctgcgtgagcctgccggtctaccccttccagcgtcagcgcctgtggcccgagtggctttcacccgatgaagtctgccgctcacccaaggacgcgcggccggacgccgccaccctgcttcaggccgccgcggtggccgccggggatgcttcccgcgttcccgacgtgcatggggaggcccagatgcgggcgttcctgcgggggcacctcgcggacgtgctggaggtcgagcccgcgacgctcgatgtgcaggggcggaccttcttcgaactgggcctgaactccattggggccacgttgttgaaggagcgcatctcgcgggcgctcgagctcccgctgtcgacgacgctcttcttcgagctgccccggctggagtcgctggcgaagcggctgctgtccctgctggaggcgcggcgtggccgcctgccgtcggacccgggcgaggtgagtacgcccgagcaggaggagcagggcctgatggaacgcattgccgggctgtccgaggacgaagcgcgcgagcagatcgcccggacgttggccgaactcagcctcgaggtcgcgtgatgaaccgcaaggacggattcatggcggagttgtcgccactccagcaggcgttgctgaccatcgagaagctgcagaagaagctggccacggcctcgaatggtgagcgggaaccgattgccatcatcggcatggcctgccgctttccggggggcgccaccagccccgcgaagttccgtgacctgctgtggggggcacgggaggcgctgacggagattcccagcgaccggcaggcgctccaggggctctatgacccggacccctccaggcccgggaagctggccatgcgccgcgccggcttcgtggacgaggtggaccggttcgacgcggagttcttccacatctcccggcgtgaagccgagggcatggacccgcagcagcgcttcttcctggaggtgagctgggaggccctggaggacgctggcattcccccacaccagctccaggggacgcggaccggtgtcttcgcgggcgtccacgcgaaggactacgcgttcgtcacggggggcgggctggagaaggtgagcgcccactactccacgggtgtggacgccagctatgtggcgggccggctgtcgtacctcctcgggctcgaagggccgagcatggcggtggacaccgcgtgctcgtcctctttgtccgctgtgcacctggcgtgtcagagcctgcggacagaagagtcgacgctcgccatcgccggaggcgtgaagctcatcctggcgccgcaactcagcgtgttcctgtccaaggcgggagccctctcccccagcggccattgccgcacgttcgaccgggacgcggacggcatggtgcagggggagggctgtggcgtggtcgtcctgaagcggctgcgggacgccgttcgggatggtgaccgcatcctcgcgaccttgcgtggcacgggcatgaaccacgacggcgccagcggtggtctcacggtgccgaacgtcggggcacaggaagcgctgtaccggcgcgtgttgcagcgcgcgggcatcgagcccgggcaggtggactacctggaagcgcacgggacgggaacgcggctgggagatcccatcgagctggacggcgtgtcgcgcgtctacggcgcagcgcggacttcggagcgcccgctgtggattggctccgtcaagccgaacatcggtcacacggaggccgcggccggcatcgcgggactcatcaaggccgtcctggtgctccaggcgggcgaggtgcctccctccatcaacttcgagcacccgaccccggagttcgcgtgggagggctcagggctcgcggtgcctcgagcgcgcacggccctggcggagaaggacggccctcatcgcgtcgccgtgagctcgtttgggatgagcggtgtgaacgcgcatgcgctcgtcgaggcgtacgcggaggccgcccatgccgccgtggacgccgggccgtatgtgttgcccctctccgcgcgctcggagcccgcgctgcgcacactggcggcgtcatggctccagtacgtgtcggaggccggtcctggggcgcggctccaggatgcgtgcttcatggcgggcgctggacgctcacaccatgcgcaccgtgcggtgctcgtggcgaggacgcccgaggcgcttcgagcggcccttcacgctgtcacggagggacgcgatgcgccgggtgtcaatcgaggttcaggcgagggcgagcccgtcttcctcttcggtggcacggagcccgaggccagccggttgatgcgtgagctgctgggccgggacgtcttccgcgcccacgcggagaaggtggatgcggtcttccggcaggtggcaggtgggtccgtcatcgaacaggtggcgggagcgcaggcgggcgaaggacacccggtgggcactctcctcgtgctccagctcgcattggcggagctctggcgcgcgtgcggtctgacccccgcagctgtttccggcttcggcgtgggagcgctctccgcgggagtggtcgcgggagcactcagcgtggaagacgccgtgcggctcgccttgcagttgacgccagcgcagcccgtgcgtcctcaacccgtgaagtacccattcttctccaccgtcgatggcgcctgggtcgaagcgggcgccacggtaccgggcgcgtactgggagagacagcgcgccgcggtgatcgacccggcgtcgtccgtggcgaacctgtgtgcgcggaacgcctcggctttcatccaggtctcttgtgaggcttccgttggggcggcgttggaggccactgcacgcagccgtggaagcaaggccgtcatcctgcgtgccagcaggcccggagatgatgcctggacgggtgtcctgggcgtcatcgcgggtgggtactcctcgggtggctccattcgtttcgaggggctcttcacgggggcgcgcaagacggtggtgccgacgtacccgtggcagcgtgagcgctactggtgggacggagcggtcgctccagcaccgagcagcgtgcagcccgtccgggatgcatccccccgggacctcttctgcgaactcacgtggcatgcgcgtacggtggggcaggggcccgtggacgcggagggccgctggctcatcgtgagcacgcagccggctgcctcggagtcgctgcggcaatccctgtccaccgccggaggcacggtgcgcgtggccatcgtgggctccgagcaggcgtcggtgctccgggagtggctgtccgagagcccggcgccccgaggcgtcatctacctgtcgggttcggagcatcccgaatcactggaagggctgcacacatcggttcagcgagaggtccacgcggcggcgtcgctcgtgcagaccctggcgcggcactcggcgccaacgctgcctcggctgttcctcgtcacccagggctcgcaagccgctgacggagcggctggacccacggcgattgctggcgcgccactgtggggcctgggacgggttgtcgcctacgagcacccggagcttgcctgcaagcgcatcgacatcgaacccgcggccttcggtgcgctggtgacggagctggcgcgcaaggtctctgcttccgctgacgacgacgaggtcgtgctgcgcggcgagcagcggctggtgccctcgctcacgcagacccaaacgattccggaaggcacgggagcgtttcgtccccggcaagaccgcacgtatctgattacgggcgggctcggtggaatcggactgcggctcgcctcctggctggtggagcgcggcgcgcggcaccttgccctctgtggaagaaaaggtgagaccgacgaggcccgccaggccctggcgccgctgcgtgcggcgggcgcgcgggtggagaccttccgcgtcgatgtgagccgcccggagtcggtggcggagatgctggctgccgtccgccgaggcggagcgccgctggggggcatcttccacagcgcgggtgtgctggcggacagctcgttgttgcagtgggagccccagggcttcgagacggtcatgggccccaaggtcgacggtgcgtggaacctccatgcgctggccaccgacaccaccctcgagcacttcgtcctgttctcctcgacggcgtcgctgattggctcgccggggcaggccagctatgccgcggccaatgcattcctcgatgcgttggcgcacttccgtcgcgcacggggtctgccggccatcagtctcaactgggggagctggggcgaggtcggcatggccgtcgcggatgctcggcgtggcgaccggctggcggagcggggcatgtcgcccatgtccgtggatgaagccctggcggccatggcgctggtgctcgcggagaaccgcgtcacccggggcatcgcgcgcttcgatgtgacgcgttggactgccagccatccttccatcgtggcttcgtcgctgttccggaccgagtccgtcaccgatgccgtccctgacgtcatggaggcgccgcgcaagctgcgcgaggtgttgctcgcgttggaaggctccgctcgccgcggcgtcctggaggcgcggctcaaggagatgatcagcgaggttggaaagattccgacgacgaagctctcgtccacggactcgttcgacgcgctggggttcgactccatcatggcgctcgagttgcgggacatggtgctgggcgaactcgacgtgagcatgcctctcaagagtttcgttgatgaaagttccattgagcaggtgacggctgagcttctcggaaagctcgctgtggccagtgtgctcggcgctgcctcctcggagcgcgatgattcgaagcgggtcctgctatgacattgaatgagcttcttcaggccctcgctgggcacggcatcaagctgtcggtggagggggaccgcctggcggtcgattcgcccacgggcgagattccaggagcgctgcgcgagcagctcgtggcgaacaaggccgcgctgctgaccctgttgtcggagcagcgcatgccccaggcggagacgctgccgcaaatcacgccccggcccgaggagcggcacgcgccgttcccgatgacggagatccagcaggcctacagcgtgggccggcaggccgagctcgagatgaacgcggcgatgcacgcgtacaacgagattgactgccacgcgctcgacctggcccgcttcgaggacgcctggaacctgctcatcgcccgccacgagatgcttcgggtggtggcgctcccgggcttccagcagcgcatcctccccgacgtgccgcgctacgtcctgcccgtggaggacctgcgcgggcgcgaacaggaggagacggaggctcgcttccaggccatccgcgagcggctgtcgcagcaggtgctggcgctcgaccagtggccgttgttcgagctccgcgtgtgccagctcgacgggggccgctcgcgcctcttcatgagcatcgatggaaccttcatcgatggttacagcttccagattctctaccgggagctcgtccacctctacaaacacctgggcggggcgcccgcgcttccccaactggacctgtccttccgggactacgcgctggcggtgcagcatgcgcgcggtgctcgtcatgcgcgttcgctcgagtactggcgctcccgccttccgaacctcccgcccgcgccggacctcccgctggacaaggacccgggttcgctccggcgtcctcgtttcgggcgcgtgttcgaacggctggggccggatatctggcagccgctcaagcagcgagcccgcgcgcgcaagctgacggagccggagctgctgctggcggcgtacgcggaggtcatggcgcgctggagccgcagccctcgcttcacgctcaacgtcccgcacttcaaccggctgccccttcatccccaggtcaacgagattgtcggcaccttcgccagcttcacgctgattgaggtggaccaccggccggagcggacgttcacggagcgggcccttgccatccgggaccagctcttcctggcgctggagcaccgtgaggtcagcggcgtcgagctgctgcgggagctgttcagggcccaggggcgtatcgcgggcgccatcatgccggtggtgatgacgagcttcgcgtctcactccaagagcaaggactcgcactgggtcgacttcctggcggaggagttcggcgagctcatcgaggcgctgacgcagacgccccaggtgtggatcgacctgcagattgtctaccagcggggcggcgtcttcctgaactgggacgtggcggaggagctgttcccgtccggcatgattgaagacatgttctccagcttctgcgcgctgctacggcgcctggcggaggacgacgccgcgtgggaccagcaggggctggacacccgtccggtccggcaggtggaactgctggcccgcgtcaacgacacggcgcgcccgcggagcggggagctgctccacacgggcttctaccgccacgccgcggcacgcccggacgccctggcgctggcctcgtcgagcgtcaggctgagctatggcgagctcgcccggcgctccagccggctcggacatgcgctgcgcgagcgtggcgccgcgcccaaccgcatcgtcgcgattgtgatggagaaggggtgggagcaggtcgtggccgcgctgggggttctcagctcgggagcggcgtacctgcccatcgacgcggggctgccgcacgagcggcgcgtcttcatgatgcggaacggcggggccgagctggcggtgacgcagccgaagttcgcccaggagtcctggcccgaaggggtgcaggtgctggtcgtcacgccggacgccttcagtgagtacagcgaggcgccactggcgcccgtgcagaagcccgaggacctggcgcacatcctctacacctccggctccacgggccagcccaacggggccatgctcacccacgccgggatggtcaatggcgtggagtggacgaaccggaagttcggcgtcgggccggaagaccgcgtcatcgcgctcagcgcgctccaccacgacttctccgtctacgacgtcttcggcaccctgagcgcgggcgcggccctggtcatgccggacgcctcctcgcgcagggacccctcccactgggccgagctgatgtcccgtcatggcgtctccatctggagcaccgtgccggcgatgatggagatgctgctgacgtatctcgaaggcagcaacgcccggctgacctgcccgttgcgtctggtgatgctcggaggagattggctccccgtcaccatgcccgcacggctgcgggcgaagttcggcgacgtgaagctgatgagcgtcggcggcccgacggagacgtccctgtggaacatctcccatccggtcgtcgaagccgacgagcggcgccgcagcattccgtacggaaagcccatctcgaacacgaagtactacgtgctggacgagcacctggacgagcgtcccatctgggtgcccggcgagctgtgctgcgcgggcgtgggcgtggcgctgggctacgtgggcgcgggagcgggctcgaagaagttcaccgtgcaccctcggacgggtgagcgcctctaccgcacgggggaccaggcccgcttcctgccggacggcacgctggagttcctcggacgccgtgatggacaggtgaagctgcgcggctatcgcatcgagctgggcgaaatcgaagccaccctccgccagcacgcgtccgtgcgggacgcggtcgtcatcgtgcgcgaagacttccctggggaccagcggctggccgcctacgtcatcccg

SEQ ID NO: 2001 - DNA, 376 bp, Myxococcus xanthus
gttccgacaataaacggtcacaaaaatacgatggcatttacggtcgcgtatgtaatgaatgctgactcaaaaaagaaaaaagcatcttgggagctcattcagtacttaaccggaaaagaaggaatggaaaacttggacaagcaagggttatgcattgccaacaagaaaatccgtagcggataagcttggttttgctgaagacgaaaaacgaggtccattagtaaaaggagctgcttatgcaactgtctggcaagatggtccgtatttgcctattatcatgaataactttaataaccagtttttaagcgcctttttgggacaaagtgatttagaaacagctttgaaaagagcacaaaagcaggcaaatcaagagatt

SEQ ID NO: 2002 - DNA, 777 bp, Myxococcus xanthus
atggccagcggcatcttcatcgtgcctatcctcacgctgttcttcagcatcgacattcacgtggcgatcggcgcgagcatcatctcggtgattgcctgttcgtgcggcagcgctgcgccgctcctgaagaagcgcctgaccaatattcggcttgcgatcgtccttgagacagccaccacactcggcgcgctgacaggcgtgttcctgatcggcatcgtctcgaattcgtttctgtatggcctgttttcttttattttggcgctatccgcaaagcagatgctagcgcggcggcgcgaagtggaagtggtcgctaccagcgggccaaacgtgaagagtctggccacggtgctacgcctgcattcgagctttcccgaccatgcatcgggccgcgacgtgccttatcaggttggtcacgtgccaatcagcctggctctgatgtacggggctggcgtgatctcggcgctgctcggtatcggctccggcgtgctcaaaatccctgccatggataccgccttgcggctgcccatcaaggtctcgtctgccacatcgaacttcatgatcggcgtgacggccgcagcgagcgctggcgcctacttcgtgcgaggcgatatcgacatcggcattgcggggcctgtcgcacttggctcagtcgtcggggcgctcgtcggggcgcgtttgctgatgaggctgcccgctgagaaaattcgcatctccttcgtggtgatcctcaccctgcttgcggttcaaatgctcctgagcgccctgggtgttcagttc

SEQ ID NO: 2003 - DNA, 909 bp, Myxococcus xanthus
ccactccatatccagacgccctacatccgttcgcaagttgcatcccgccggctcggcaaagacgtcctgttcaagctcgaggcgatgcagccgtccggctcgttcaagctgcgcggcgtcggtgcggtatgtgacgcgcggcgggcggcaggcagccgtcgcttcgtgtcgtcgtcgggtggcaatgcgggcattgcggtcgcctatgcggggcgcgaactcggcgtgccggtactcgtcgttgttccggagagcacgtccgcgcgcgcacgcgacctgatccgcctcgaaggcgcggagttgatcgtccacggcgcgtcttgggcagaggcgaacatgtttgcgcaatccgtgctcagccctcatgacgcgttcgtgcatccattcgacgagccagagctgtggcaggggcattcaacgatgatcgacgagatggcggcagccggaccgaagcccgacgcagtcgtgctggcagttggcggcggcgggttgctgtgcggcgttctcgaagggctggctcgcaacggctggggcgatgtgccggttgtcgcggccgagacccaaggcgcagactgctatgcgcgctcgattgcgcaggggcggccagtcgaattgcctgcgattacgagtgtcgccacgtcgctcggcgcgaagcggccttgcgacgcggcggttgagtgggcgacacgccatacggtcgagaacatcgttgtgtccgatgcggcagcagtggccgcctcactgcggtttctcgacgaacaccggattctggtggagcccgcgtgcggggccgcactggccgcgctcgacgcggcatcgacggtgcttgccgccgcgtcacgcatcgcggtgatcgtctgcggtggcgtcacggcgacggttgagtatctgcaggcattgagcagccgg

SEQ ID NO: 2004 - DNA, 642 bp, Myxococcus xanthus
gtgatcgcgctcgaactgtccgtgcccgtggcgtgctggcgcaagggccgggcgcgcgagctggtggagaccgaggtcctgccgccgcccgcgacgtgctacggcgcgttgctctcgctcgtgggtgagcaggaccgggagcggcaccggggctgccgcgtgacggcgggtgtgttgaacgcgcctgtcatcagcacggtgcttcgcaccttctggcggtcgaagaacctgaaggtcgcgaaggggaatgacgagaacgccgcgccggaccagcaacagctcgtcatcgacgcgcgcctggtggtctggtgcgacagccgggaggagccggactcgggtgaatcgctggaggaccgtgtcgtccgggcgatgcgtgagcctggctccgtgacgcgggccggggggtggtcgctcggggagtccacgcacctcatcaatgacgcgcgtctgctcccggaggggcggccgccagcgggctgtcgggccttcctgaccgcgtccaccggcgctctcaccctgccggtctgggtggaccacgtgggcactcgtggcactcgttacgaggtggggcggctcgaagaggtcttggctgctcccgaggtccaacggcttccgcgcatcccgctcgcggagggcgctgga

SEQ ID NO: 2005 - DNA, 636 bp, Myxococcus xanthus
tcttccccaggtcccctcgtaatgtctccacaggctctgcctgccggcacgcgcgtggaacgctggcgcgtggagcgccgcatcggaggcggcggcaacggcacggtgtacgaagtgcgctcacgctccgaaggccacagctacgcgctcaaactggcccactcccccggcgatccgcgattccagcgcgaggcgcgaacgcttcacctgcttcgccaccctggagttgtgcggctgcaagcaacgggaacctggcgcgcagggaccgccgcctacccatacctcgtgctggagtacgtgcgaggcagcacgctgtatgactggtctcgggcgcgcaacccaacggcgcggcacgtcgccggcctgttggcgcaggccgcgtgggccttggacgccgcgcatcgcaggcaggtgcttcaccgcgacttcaagggagagaaccttcgcgtcgaggaacacggaagactggtggtgctggactggggcgcatgctggcatccccgtgccgcgcccatcacctccgccgcacggctgccgcccgggaccgggccctatcgcagcccccaggccatcctctggagcatgcaggctccacggcagaccgcccgctccgagaactacccctacacggtggcg

SEQ ID NO: 2006 - DNA, 423 bp, Myxococcus xanthus
atggggcctcggggctgccccgccgccggcacggggccgctgccgcccagggcggagtcccccggattctccgggatgacttccagctcgcgggcattgacgaccctccgcgccagctcatcgaactcgacctccagcacgcggccgggtcggtccgcgaggccaaagcggatgcgccagaagttggggcggatctccaccgcctccccggcctcggccagcaccaatgagttgttgcgggcgtattcctcgccggcctggaccacgtcccgagcgcccagctccgtctgcacggcggccgagctgggaggggcgggggggcggccggtgggccccgtcgcgcaggccatggaggccaggatggcgccgggcaagaggaaccgggggacgatgcgaaatcggatcggcggcatatgcccatgg

SEQ ID NO: 2007 - DNA, 339 bp, Myxococcus xanthus
cgtgatgtagggcaaggatatgcttttatgacacctacactgtttgtactattgctgtttgttattgcacctattttttatgccatctttttgtctttacataaagttcaattgctgggaggaactgagttccattttcgagggcttgagaactacatgaaggttcttgaagatgagaaagctaaaattgctctttggaatacggtgaagtatgtagtaattgttgtaccggtacaaaccgcattggcacttatactggctgccacattaaatgcagggctaaaagcagaaaaagtttttcgcattatttattttttacctacacttacatcaacggct

SEQ ID NO: 2008 - DNA, 384 bp, Myxococcus xanthus
cttctgctcgccgagagccatccccccacgctcgagcacctcaaaggcctgctctcccaggctgggtacaccgttcgcgcggtgaacgatccggtgacggcgttggagcacttcgcggcggacaacccggacgtggtggtgctgtcggtggaccttccgcgcgtggaaggcgcacacgtggtgcatctcatccgaggccacggacagggtggcagggtgcccattgtcgccatcgacaagggacacctggggcgcgcgcggggcgtgagctcggtgctggacctcaaggtgaacgcctatgtgtcggacccgctcaagccgggcgagctggtgccccagctggaggctctggtgcgcgcagcgcaggcggtgcagctcaccagg

SEQ ID NO: 2009 - DNA, 840 bp, Myxococcus xanthus
gattgttcctcgaagcggacctggacaccgcacccgcgcagggccgccagggcctgctccggacgcgcgtcgtgctccgggaaccacacgcccgcggcgggaggcggcgcgccatcccatcccagcagtcgctccgtccccagcaccgcgcccacggccgtgaggtgggcctgtcccttcgggtccaccacttcgattcgcagcgctccgcgaggaccttccacgtccgccacccacgccgcctcaccgcccgtgccgctgctggccatcagcgcgcgccgcacggacgtcagacggggatgctggagcagccggagcagccccacctgctggagcgccgcgagcatccaggtgacggtgcccgaatcgaaccccagccgcgtcgacaccgtacgcgcgcccagcaccagcggcagcgtggcctgctcgggcgtgtcgagccggaagacgcgcgtgggccgcccatccgggaacatcacccggcggccgtccgtcagcggcaacacctgccgctccttccctccctccgtgatgtcgaaggccatccccagccggtccatgtactccaccgagtccggacccgcctgatccgccagggcgaagcggatgcccacgtcgacgcgctcgacgcctcccacccgctccgacgcgcccgcgacgagcctgggcaccagtcccgccatccacgcggagctgagcaggacgggtgcccgtgggggcgtccccgacagccgcagcaccgccgacttcacacgcgacgtccagcgggtgatgtcgagcaccgccacgccttcccggaccgccgagcgcagcaccgcatcgtccgggtcattgaccagc

SEQ ID NO: 2010 - DNA, 648 bp, Myxococcus xanthus
tttccccgcccacgagttcgtttgattcgcaagctcctgcagacggcctttgctggaacggcggcggtgggcatcaccggtgtgctgtctcccgtggtgtcggcgctgtcgctgcgcgacgccaaggacgcggacggcgtgctggtgctgtgggcgcgctcgctgctggcgtccgcgggggtgcggcacgaggcggtgggcgtcgagaacgtccccaccgacacccacgtcgtcttcgtgagcaaccaccagtcgcactacgacgcgctggtgaacttcgcccacatccgcaagcacacgcgttacgtggcgaaggcggagctgttccgcatccccgtcttcgggcccgcgctccggcgcgcgggcaacatcccagtggagcgcaccgggggggcgggagacagggcccgcctgtcggaagccgtcacggcgctgcgggaacgggtgagcgtgctcttcttcgcggaaggcacgcgcagcacggatgggcggctgcggccgttcaagaagggagccgcgacgctggccatccaggcgggcgttccggtggtgcccctggccgtgtcagggacgcgcctcattcttcccaaggggggtcgggccgtgcggtggggacagcgcgtggcgctggtggtgggaaagcccatc

SEQ ID NO: 2011 - DNA, 432 bp, Myxococcus xanthus
tcggaggcggactaccgcgcggtggcggagcgcctccaggcggaagcccagcccggcgacgcggtgctgctcttcccgtggtggacggagcgcgcccgcatcttcgtcccctccacgctgccggtgtacggctacctgggctcggaccaggatgacttgtccgcgcacccgcgggtctgggtgctgggccagccggagctgccccgctcggacgaggcgggcttcctcgaaaccttcctgcgtggccgccgcgcggtgggcgccccgtcgaggcatggcacgctgacgctggcgctctatgagaacggccggcaccgtccccggcgcttcaccgccacggaggcctatgcgcgcgcccgcgtgtacctggagcaaccggatggcacgcgccgcgactgtcccttcgacggcaaggtgcaccgctgccccggg

SEQ ID NO: 2012 - DNA, 5967 bp, Myxococcus xanthus
tcggacctgacggaccgcttcgtcttcatcaagccaggtcctgaccgcgaagcgcacatgcgcgcgggggtggtggtcatcacctccagctatgagtcgctgaatctcacggcctacgaggcttccgtcgcgggcacccggctggtgctcaactcggcctgcctggccttcggtgacgacagccccttcgtcgacggggtccactgccacaagtatgacggcagcctggacgcgctggtggtggccatgcgcaaggcgttggaaggcccggagctggcccccgtccgctggacggtggaccgtccctattgggagcgccacgcgcgggaggcgctgcccacgcgaagccctcggtcgccgctggtcagcgtggtcatcatcaatcaggaccagggcatcttcctgcccatcgcgctgcaaggtgtcgccgccagcacgtacccggaagtggaagtcgtcatcgtggacgatgggtccacgagcgccttcgacatgcaggtcctgcagcgcctggagcggtccgcggctgaaggggaggggcttcgtgtcgtccgctccccgatccgccgcgggttcgcgggggctcgtaacctgggtgtccgcgccgcacgcggggaatacgtcgtgttcctggagtcggacgacagcctgtccccggacttcatccagcacgccgtcgccgcgctggaagcgcgacaggagttctcaggggtggtccccaccggaggccgcttccactccagcgaagagctggccaaccgccagttcaaagggttcatgacgtacctgggggattgtccgacgtacgcgctggccgcgaaccaggtctccgcgcccacggcgctgctgcgccgaaccgtcctggagcagcacgcctacaacgaaaccctgtccggctatgcggactgggatttcttcctgcggctcgcgcaggggggacaccgcttcctggtgacgaaccaggtccacttcttctcgcggcgggggcatgccatcaccccgtccgcgtcccagcagcgccagcacttccgctggctggtgcggctcttcgaaggcgtgcccgcgccactgcacccgtcgacgcggctcttcgcactgctcgcgcactcccgcgaggccatggtcgacccatatggcgcgctagacacgcatgagcgtcggccgtcctccgcggcgtccgcgtccctggagtccgcccaggcgctggccgaggccgcgcgcccgctgcgctacgacgtggtggatttgatgaacgcggccttgaagcgcctgcccctcgtgcaccccttgctcaagcaggccgtcgcgggcaaacccgctcccgccagcggagcggtggggagcgtgaatcccggggatgcgcctccgcttcgttacgtgctcgtggaccgcgcgaacacgctcttcaagcggatgcccgtcattcaccgcgcgattcggagcacggtcagccggctgacctgagcgtcggcgcgtcctgcgagacggaaggcgcgcgccgcggcgcttcggtcgccggcgccgcattcagtcgcatccccgcgagccacgcgggaacgaacatcagggccacgaggaacacggggtactgatagcgcacgtcgggtgacgggatgagcgcggcgagcgccgccgtgtgcaagacgacggggagcgccacggcggcaagccgccaggtccggtggcggatgcatgccaccgcgcaggcgagcagcagcaggtagagcggcagcgccgggcgccagagcagccaggccaggtctggctcaagcgtccggacggtccaccggagaaggggctcacgcaggactggaaggagtgagtcggaccgaaggtgtcgcgctccgggctcgagggtgtccagttccccgtggggccccctccagatgggaggaccattgatgtggtccgagccttgcgagagcttccacagcaccgaactgctgcacagcacgtgtgagagcactggcgctgcgtctcgttgtgtcaggcggacgaggagcggaagcaacgccttgttgtgccgggtcagcgcgttcatgtcgaagcgtccgtcccagatggtgaacacgttgctgaagcagcggtagttccacttgtcgtcgagcgggtggagctcctcgaggagggctcgttcgccgggctccaggtgcgttcctgccgccacatgggcgcccaggaatccgatcagcgtcatccccttgggaaagggtttgatggtgtacgtctggctcagcacccagcgggtccccgaggcgacgacaaacgtggccacgagcgcgagcgccaccgctttgtagcgctccctccggaggagacccagtgccaggaaggttccgaccaccgcgggcaggccgttgtgacggaacaacatggccatggctcccagcactaccatgctcacccagaacggcacgtcccagcgcgtggtggtgtcggtcgcggagcggaagacccagatacacagggccaggatgcagaggctgaacgggacgtccttccagagggtgacggccatcgtcccgttcacgggcgccagcgcgaacaccgtcgcggtgagcgcgatgatgcctcgggagacacctgccctcgcgagcgccgcgcagccccagccgacgagcacccccaggccggcaatctgtgcgagcgccaccgccgcgggtgattcccagagcttctggaggaatcggatggaagcggtgtggaacagtggatgcgcatcatccatggacccggaaagggcgtcacgccattgggatgtcgagtctggactcagcattcccgggtagacagtcagcagccagatgccagccaccaccacggtggggatggccgtcagcagtcccacccagcgccgtggcatgggcttgaggggtggtggcggacggcccgtgagccagagccccatcaggagcaggagggtgccgaggaccagtgcgtgggccgccaacatgacggtgattcgaatcccggcaatggaggtcaatgcgatgggaggagggtggaggaccaggtctcggcgtgcgtccgtcccgggcggcgaatagaggtcgagccgctcggttcgaccgttcacggtgtactccacgatgccggagtgcccgtgcgccaacaattggaggaccctgggcttgtgaccgcctgcttcccaatgcaggcgcgccggctggtcgaggtgcgaaagccaggcgcctccatcacggcgttcccactttccttcggaacgccagccatcggaaggcagtgggctaccgtaggcgtcgagcaatccgagaacccacacctcgctgccctgggaactggggttccgctcgcccgtggcacggaccgtcacgggcagtcgttccgcgggcatcatgacgtggagcggggtggctaccatcacgagcatggtgaccagggcgacgacccccagccaggtccgctgctgagcgggcgagtagcgcgtcagccaactgtgcagccacggaagtaggaagcggtagagcaccactcccaaagccaggcaccccaggaccagcacgacgcgggagctcagggattggaaagaggggacccatgcccccatcgtcaatacccccgcggtactgagcgcgagcaacatgctcatcgcggcgcgaggccagcgccgcgggtcggggcgtacgtcaaggactggcaccggtgcttcaggggattgcattgatggcgtgagtaccgtacggaggggggggcaatgcaaacctgagaagtgtgagtgcttctctgcgtgttcgtgcgtcagggcattgctgtggggactccggaatgtcgctgccattcattaccgtggtggtgggctttttcttcgtggtcatttcccagttcggcgcgcggctcgcggcacggcattccgtgacgtggttccttgccagtggcttcgtgctcgtggcggccatccgtccggattggttgctgcccgtggctcgactgatgggcatcagtttggtcagcaacatggtcctggctgggctcaccatgttcctgttcgttcagatgctggctcactacgcggagagcacacgcgcgcagcggcaactggggcaggtcgtgtcagcccttgccgctcaaacgtttcccgacgcgccagcgacgtccgaaggtggtcgcccccgcgtgctggtggttctcccttgctacaacgagtcggaaagccttcctgcgctcctgccgcgcctcacggcgctgactcgcgccacgccagactgggagctggatttctgtatcgtcaatgatgggtcggtggacggaacggccggggtgctacggcggctggctccacggaaccacgtcacacatcacaccaacatcggcgtgtccggggcgctgcggacggggttcctcctggcccagcggttggaggtcagctacgtcgtgcagtgtgactccgacggacaacatcccgttgagtccatcccggacctggttcgctcggcgcggagcgggcagaccgacctgctcattggctcccgtttctgcgatgtcgcgatgggaggcacggacacgttggtcagcacgacgccgcttcgctggatgggaggtcgcgtcgtgagcatgctgctggggatgtttggccagcgggcccaggtgacggacccgacatcgggcttcagggtgtactcgcctcgggcggtggccacgttgttgcgcctcatgccggatgagtacccggagccagagtccgtcgcgctcgtcgcgctcgccgggcttcgaatcggagaggtctcggtcgcgatgcgcccacgcacgacggggacctcgagcctgacggggctcaaggggttccagttcatgacgaaggtggcttccgccctgttcgggttgcggctgcggtcgttgattcgcaaggagccgagcgcactcgtgccggcggcggaaggtgtcgcgccccccgtggtgtcgctcacccctcgagagcccgcttcacttccaccggcagaggaggggcggttgggcgggtagcgcacgtatatggggccggctccgccgcatggagcggccgacgcttcaattgcggcgcctgaagaaccgctccatgacctgatgacgcagtgggcgggagtcgtcgtctgctcccgcgacccaaagcgcggcgcgcctcaaggtggcatgggcgaagtcgaaccgcttgagcgtggcgttcatcttgtcggcgaagcgattcaggagtggtggggaggccgagcctgtcgcgcgaagatggagttcctgcctgtgggcccggccgagctgcatgcggagtgcgcgctccgggtggagcggcaacgcagggtgcttctggcacaggtaggccatctgcgcatgacggtcattcactcgcatgctgcgggtcatcgagtccggacgcagccggtacaggaagagtggttccgggatgacggagcccgcgagccctcgctcggccagggagcagaagacgtcccagtcttcataggccgtaagccactcgtcgtagccgccgatttcttcgatgcgctgtcgctccatcagcgcggtgcaggtcgaggccacgttctccgcgaggagcgcgtcacgctcggtgccccagggaatccatccgcccacgggctggtccggcgactcgacgaaataggagacgagtgacgtgacgtaggccagccctggggtgctgtccatcaccgcgacggctttctccaggaaggtgggctggatgaggtcgtccgggtccagcgggaggacataccggccccgtgccgcgcgcagaccggcgttcctggccgagctgagccctccgttgggcttgcggaggatgtggaggtctggctcgtggagcgtctccagcacggcccggctctccgaatccgtcgagccgtcatccacgaggatgatttcgtagtccgtgaaggtctgggcgcgaatggaccgcagcgtctcggggaggtagcgccccatgttgtagtagggcacgaggatggacacgtacggtgt

SEQ ID NO: 2013 - DNA, 537 bp, Myxococcus xanthus
gtgaaggtgacgccgctggagattccggacgtgctgctgctggagcccaaggtcttcggtgatgaccgcggcttcttcatggagatgttccatgcggctcggtaagcggccgtgggcatccccgggcccttcgtgcaggacaactactcgcgctcggcgaaggggacgctgcggggcgtgcacttccaggagccgcaggcccaggggaagctggtgcaggtgctggcgggcgccgtgtacgacgtcgcggtggacgtacggcgcggctcgcccaccttcggccagtgggtgtcggtggagctgtcctcggacaaccgccgtcagctctggattccgccgggtttcgcccacggcttctgcgtggtgagtgactccgcggacttccactacaagtgcaccgcgctctacgcgccggagacggagcggagcgtcgtgtggaatgatccggacctggcgattccctggccggtgagcgagccgttgttgtcgcccaaggatgcccaggccccgagactccgcgacgcacccttgcttccg

SEQ ID NO: 2014 - DNA, 444 bp, Myxococcus xanthus
aacgcggaagacaactgcccgctggtgcccaaccccggccaggaggacctggacggtgatggcctgggcgatgtctgcgacctggacgacgacggtgacggcgtgctggacggcgacgacaactgcccccgcgtctacaaccccgaccaggtcatcaaagacgaagaggctcacttgtgccgcgtggatgcggacaacgacaacatctccgacagcagcgacaactgcccgggtgtgcccaaccccgaccagcgggatacggacggtgacggcgtgggcgacgcgtgcgaccccgacatcgacggcgacagcgtgctcaacacgcaggacaactgccccgccgtcgaaaaccgcgaccagcgcgacgacgaccgcgacggcattggcgacgcgtgcgacacgcgctactgcctggtgacgaaccccgagcgccccgacgactgc

SEQ ID NO: 2015 - DNA, 825 bp, Myxococcus xanthus
gctctacagatggccagctatttgataaaagcaggtgcaggaacgtgctacttagctggaggcgttgaaagtacaagcacttctccttttgaaaaaagagcacgtttttctcctgacaaaattggtgatcccgacatgggaattgcagcagaaaacgtggcccagcgatacaacatatctaaagaccagcaggatagatatgctcttttaagtcataaaagaagctgggagtcttttgaaaagagattgtttgaagaagaaacgcttcctcttcgaaatgtgatgcaagatgaagcatttatgaaaaaacgaaacctaacaaagctgctgcaaaaagccagccccgtctttttaaaaaatgaaggcaccgtcaccgcagccaacagctgtggaattaacgacggagcctgcattacgcttgtgatggaagaacaaaaagcacgcgctttaggctttcagcccgttttgcgttttattgacgctgatatttcaggagtgtcacctctttaccctgctattgcgcccgtttctgcgattaaaaatatcttgaagcgaaattcgcttacggtagatgatattgatttatttgaaatcaatgaagcatttgctgttaaagttgtcgcttgcatgcaaaaactggggatatcagaagagaaagtaaatatttgcggaggagcattgacgctaggacacccatacggagcatcaggagctattttagctacgcgtcttttttatgaaagtaagcgccgtgacgtgcgatatgtaatagctgctttaggaagcggaggcggaataggaacagcggtattatttgaagtaatc

SEQ ID NO: 2016 - DNA, 732 bp, Myxococcus xanthus
agcgcgccgaggacttcttcctcggtgatgtcgtccatgctcccgttcccggtgggctcgcggaaggccggcgtgaaacggaagccccattgctggggagaggtcgttccgaacaggcccaccgaagggagccggaagaaatccgccgcgtgcagcatgcaggagtcgatgccgaggaagccatcacaggcgccgagcagcgccatggcgacatcgagtggggcgcctgggacggacagcacgcggccttcatggaccatgggcgccagctccgtggcgctgtagtccacgttgagcacgagccattcggggtgggctgtcaggaaggcatccagcacggcgcggtagcgggcgacgggccactgtttccgggcgccggtctccgtatggagcgcgagcaccttggccccatcggggacgctgtcacgaaagtgcctcccgccctcggtggcctcggccgtcagcacgggggcctgggcgaagtcctccagcctcagggagggatccacctgctgggccagcgagaagagccggtccgcggaatgctggagttcttcactccggacccactgcttgtaacggcgatacaggcccactgtttcggtggccgccgggaacccctcgagcagctcggagacccccgtcgcgtgccaggtgttgaaacagacaaacaagtcgcaggcccccaccgcctgccggagcatctcggcgtcgatgctgcgctccgtgccc

SEQ ID NO: 2017 - DNA, 612 bp, Myxococcus xanthus
attcaagccagggacctgggcgccggctatggccctcgcgcggtgcttgcgaagctctctttcgatttgccctggcggcgcgccagcgtggtgctgggcccgggtggcagtggcaagagcaccctgctgcgggccctggtcaacgaccggctcggagacggcgctgacttctgggtgcggggccagctcacccttcccgtatcggcgcaggcggtggtgccccaaggccggcccgcggagtcccgcacactgggcgagctgctcggccccgatgcgcgccagacgctggagtccgtgtgggcctgcgcgccagcggcggcggtgcggctggaccgcctgcgcgagcggccggtggcgctgctgcccgaagggctgtggcggctggccctgctcaccgtcgccatcgccaacaaggcgcccctggtcctcctggacgagcccgaagtgggactgtcgggagacggcgtccgctggttggcgcggcggctgctgatgctgcgggccgagcgcacggtggtgctcgtcacgcagcacctcccgctggcgcgcatggtcgccgaccacgtgctgctccttgatgaagggatgctcgtggaccaggccccgccccgt

SEQ ID NO: 2018 - DNA, 927 bp, Myxococcus xanthus
ccagacgaaaaggcctgggcctccctgggggctgctctcttcatcgacacgtccttgagcgcagatggcaaggtggcttgcgcgacttgccatccacctgatgccgcctttacagacggcaagcctgtctcacggggtgtgttcgaccgcaccggtactaggaacgtacccagcctgtggggcctggcctcggcccgtgagtttttctgggatgggcgaagggcctcattagagacgttgatgttcgatccgcttacgaccgccgaagagcatgggatggaaggagaggaagctgtcatttcatctgtccaggctcgatattcagcggaattcgagcgactctttcctggaaggggggcgacgcgggaaacggtatctagggtgctcgcggcctatgtgcgccagcaggttcctcctccctcgccgtttgagcagtttcttagtggggacgcgcaggcacttcgtccggaacagcgaagagggttcgcgctcttcacaggccgggcgggctgcgcgcgctgccacccgcccgagggcggagccttcacggatgggtcgtaccatgccggtgagatttccgcggccctcatagctaagcaggcgggcgcggctcgagaactggcgctgctggaccctggcgcgcggcgggcggctgtctctgcgcgcgcagaagtggcggcgctggggcgatacgtggtgaccctgagggcttctgacctggggcggtttcgtacgccgtccctccgcaacgtagccgtaacggcgccgtacatgcgtgacggcagtgttcccacgctgattcaagccgttgaacgagagctgtattatcgcctgcctgaggggcttcaggtaggagacatgaccccttccgagcgctccgacattgtggcttttctccattcgctgaccagccccgctgcttcgaca

SEQ ID NO: 2019 - DNA, 1515 bp, Myxococcus xanthus
tctcgacccgtccaggacgcacttggccatatcaccgagtaccagtacgacgctcggggcaacctgaggcgcatcgaggacccaacggggcggaccctagagtacacacatgattccttggggcgtctgatcacggtgcgtgtcggtacggacgctcccctcaccttcacctatgaaggcgcggacatcatcgcggtgacgaatggcggggacctgaccacggagttttcccacgatgccctagggcgcgttgtcacccggcgcagccccgcagggcatgtcgaccggtacgagtacgatggcagcgatcggctgctcaagtacatcaatgccagcggtcacgtcgtcgagttcgcctacgacagatctgggagggttgtgtcctcgacggatgcccgcggccaggcgaccctttatgcctacaacaacctgggcctgctctccgagcggatggacccgttggggcgcatcgagacgttcacatatgacaccgcaggtcgcctgcaggcattcaaagatcgtaaggggcaggtgagtgggtggagctataactccgctggcgagacggtcctggtgggttttggcgccacggtgtctgcgccgacggtgtatgcaaacagcatcgccgtcgagtacgacctgggggggcgccttgtccgaatggaggacagcttgggagccattatcacccaggcacatgatggcctggaccggctcgtccaggaggtgtcgccgaatgggactgtggactatacttatgacgccgtgggccaactggcgaccatgaatgccactgggcactctcaggtaatttatacccacgacaacgccggccggttgaccgccatcgcgcagggggggcgtacagtggcttttgcccatgatacggtgggtcgtcggcagtccatttctctgcctaacggggtatcccagcattacgcctacgacactgctgggcgactctccgcaattgagtatcggcaggggatgtctgtggtgggagacctgcactacacctacgatggagacgggaatcgcgtctcagtcggtggcacccttgcacgcacgggattgccgctgacggcctctggcgctgtctacgatgcggccagccagttgacagtctggaatggtcagcctcgagcctacgacgccaatggcaatcttgtgtcggatggcgcgagaacctatagctgggatgcgcgcaatcagttggttcagatcgtcgagggtcccggagcgttggcgacgttcgagtatgagcccacgggaaggcgttcacgcacgatgttgttcggcgtcgtggaggactatctctatagtggggacaatttcattcaggttaagtccctggcgggaacgcgtgacttgttgacgggatttgggctggacgaagtttatagccagacgtcctccagcggttcctatgacttcttgtcggaggtcatgggaacgacagtggcgctcgttgatggtgccggcagcctgagctcgatgtactcctacgagccgtac

SEQ ID NO: 2020 - DNA, 792 bp, Myxococcus xanthus
agcagcgactgcgagggacggaagaacatcaaccgcccttgctccgccagggtatgggcaccaggcacctcacccacaggtcgcatcagcgtgacggccgtttcaccatcctgggacatgggctggctcaagcgcactgccagcaaggtgtccacccgtactgctgacgtaccgtctacgggaagcgagcccgccatcctcgctgaggagttcgaattcggcagcctgtcacgttcggcggcatccactcggacgaactcgccccggaccggatcgaacagttccgcagtgggcaccgcgcccgacgcgtcaccgccccagagcaacacgcggccatccggcagcagcaccgcagtgtggcccgcgcgggccacctgcatgcgggaggagagccgcgtcacctggagggtccttgaatctaggagttccgcggtatcgctagcccgtgaatccactgtctccccaccggtgaagagcacgcggccatccgtcaacaccgtagccgagtggcgcgcacgcgcctccgtccggagctccatcgcgctcgtgaaggtccgagtgtctgcggaaaaccattcggcggtgccgagtagccgtccggccgcatcgcgtccccccaccaccaagaccctgccatcgggaaccaccgtcgcagtcggatgcgagcgcgcgaacaccaggccattttccagcggctcggggacaccggtctccggcaggagctccgcgtcacgtgtcggctgttcgccccctagaaacaaccagcgcccgtccggcaagcgcgttgcaccg

SEQ ID NO: 2021 - DNA, 400 bp, Myxococcus xanthus
agcgtcaagggcatgtaccgggtgaaggagacggtccgtaagcccgccaagctgatggacatgctgggcacgcgctctacggaaatcggccgcatcgtcgacgtcatccaggagattgcggaccagaccaacctgctggccctcaatgccgccatcatcgccgcccaggcgggcgtgcaggggcggccccttcggcgtggtggccaacgagattcgcaacctggccgagcgcaccacgcgctccacccgcgaaatcggcgccatggtggcgggcgtgcgcgacgccgtgcagacggcggtggcgctggtgcaggaaggccgcgagcgagccaccgccggtgtggccctgggcgaccgcgccgccgaggccctggtggagattcgcaccatcacccagcgc

SEQ ID NO: 2022 - DNA, 1602 bp, Myxococcus xanthus
cctggctgggagacgcgccgtcagcgctcggcggacggcgccagcatctccagaggaagcagcgcggaacgggacaggcggctcacctccagcgccgggcccgctccactcacgcgcgccccctggaatcccgtggcgtcagcggcgccctcttcccacgccacgaaccaggccgtcccgtcccacaccaccacgggcgcgcgtgacgtcgccccggcgggcaacacgacgggcacatcgagcaactgtccatccaagctcacccgagcggccagcatgcccggcgtgccggagagattctcactccagaccgccagatagccatcggtgccccgcgcggcggcgaccggaggcttgtggccccacgggcgcgtgaggcgcagcgccggcctgtccttcaccacatcatcgtgcgtcacacgggtcgccaggatttcgtgcgggccgaattcatccgtgcctgtcgtcgtgcccgcgtaggtgacgaggaacttgtggtctccggccgccacggcgggcgcgatctcctgctggaagtcccccgtggagatggtgaagcccgacttcgagcccaggatgcttccgttgtcccccacccggacaccgcgcacgcggtggataccctgccgggtggcatcccagacgacgagcgacttgttgccactgggcgccacccgaggcgccgtctgctcgtccgcgcccgtggcgattccgaaggccgcgggcccgtccaacgcgaggttctttcggaaacgggcgccgtagatatcagcggtgtcgttcttgtcgtcctgccacacgacgaagaagtggttgcccgtccacgtcacgtcggggacggtttgagcaccctcacggacgacgagcgggacaccgccagccccatccagccggatgccgtctttcgtcacccggttcccgaagatgtccggcgtgaggactccaccgcgctggtcgctccagacgaccaggaactgttttccatcaaaggccacggccggcttgatggccatgttggaggcggagacggagagctgcgtgcgctcggacacgtctccgtcagacgtcacacggatggcgttgatgatgctctccacatcgccgatgaaggggaaggcgagcagacacagcttgtgtgcgcaggcgatgcctggaggccctcccacctcatcggagccgaagacgacgaaccggcggcgcacatccccgtcgcgctccacatgggcggcaaccagaccggaagcgctgacccaggtgaccaggaagaactttccgtcccaggccactcgaggctgcccgccatcaaacccgctgcccgcgttgatgggaaagccccccgggtccagcaccttccccttgggtgtcacccgcgcgccgaagacgcccccctcgcgttcgtcctgccagacgaccaggaactgttttccatcaaaggccacgccttctcccggacgtcccgtgggcggacgcttcccgatgctccctcccatctcggacaggccggcgcggccgtccaacgcctgccagacctcctccggcacgccttcgggcgcgtcgtccaagggcacaccgcaggcgcccaacagcactcccagcaacacg

SEQ ID NO: 2023 - DNA, 384 bp, Myxococcus xanthus
gacctgtcccgcgtggagggcgtcttcaccgacgtggatggcacgctgaccacgggccacaagctgcgctcggagacggtgcgggcgctggagcgcctgtcgtccgccggcctgcgcgtggtgctggtgagtggccgcccggcgggctggggagaggcctgggcgcggcagctccccgtggacggtgtcatcgtggagaacggtggcctgttcttcctgaagggcgcgcatggccggctgcggaaggtctacgcggaggcgccggcggagcgggtggcgaaccggcggcggctccagtccgaggtggcccgggtgctcaagcaggtgcccggcgcgcggctgtccatggacagcgcgtacacggaggtagacctggcggtggac

SEQ ID NO: 2024 - DNA, 297 bp, Myxococcus xanthus
ccggccaacgtgaagctgctcccggtgagcgccctggaggaccccggggcgcgcaacctcgtcctccagattggggacgccttcttccacggcttcctggtgcgcaagggtgacgcggtccacggctacgtggaccggtgtccccacgcgggtctgccgctcgcgcgcgaactggaccgctacctgacgccggacaaggggctcatcgtctgtgcctggcacggggctctgttccaggtggaggacgggctgtgcgtgggcgggccgtgttcgggcgggcgactcacgccgtggccg

SEQ ID NO: 2025 - DNA, 651 bp, Myxococcus xanthus
tcgcgacgccggcatccgtggcggtccacggtcgggctgaaggtgctgatggcagcgactggcatcgtgctggtcgtgttcctcgtcttccacctgctcggcaatctcctcgtttaccgagggcgggatgccctcaacgagtactccgcgtttctcgttcgggagcccccgctcctgtgggccgctcgcgcggtgctccttgcctccgccgtcatccacatcggcgcggcggcgctgctctggaatcgtgaccgcttcgcgcgcccggtggcttaccgccgactcaggccacgatccacgaccgtgcccgctcggacgatgcgcctcacgggcgtcgtgctcgcggggttcatcgtcttccacattctccatctgaccactgggaccatcgcgccggtgccgttcgagaagcatgacgtctaccacaacgtcgtggagggcttccgcgtcccctgggtggtggccatctatctcggcgcgctggccttcgtcgggatgcatgtctggcacggtgcatgggcctcgctgcggagcctcgggaggtcgcgcccctcgcctcggccgaaacggcgaccggttgcgtggatcctcgccctggtgctctggggcggcttcagcagcattccgctcacgatctggctcggaggtgtg

SEQ ID NO: 2026 - DNA, 471 bp, Myxococcus xanthus
ctggcttgttgggcccttggcgttccagccctgggtgtcaccgtgaaggaagtgccgcggctcgcggccaacgcatggtccgtggacacgaccaggacactcacgccgcagacgctggcggaggtggaccagctcggcaatgccttggtccgtgatggccaaggccagctcgcggtggtggtggtcgacacgacgggacgccagccgccacgcgccttcgcgctggagctcttcaatcggtgggggctgggcacggccggtcgtgacgacggcgcgctgctcttcatcgcgctcgaggaccgcgcggcggagatcatcctgggtgatggcgtggatggcccgaatgagcaggctcgcagtgacgccatcatggcgaacgacgtagttccagccttcaaacggggcagtccggacgacgcggtactggaaggcgcacgtgggctgcatcagctcatcgtgacctcggagctc

SEQ ID NO: 2027 - DNA, 406 bp, Myxococcus xanthus
ggtacaggaatatcaacctgttggccatcgcctacgcttttcagcctcggcttaggtcccgactaaccctgagcggacgagccttcctcaggaaaccttaggcattcggtggacaagattctcacttgtctttcgctactcataccggcattctcacttctaagcgctccaccagtccttacggtctgacttcgctgcacttagaacgctctcctaccactgacatcaaagatgtcaatccacagcttcggtgatacgtttagccccggtacattttcggcgcagagtcactcgaccagtgagctattacgcactctttaaatggtggctgcttctaagccaacatcctggttgtctaagcaactccacatccttttccacttaacgtatacttggggaccttagc

SEQ ID NO: 2028 - DNA, 897 bp, Myxococcus xanthus
gtcttacttggatccgttggagggccaaaatgggatcgtaacccttcacatttgcgaccagaaaaaggtttgctagctattcgaaaagaattggatttatatgctaaccttcgtccagtgacgttttatgatagcttagcagatgcctctcctttgaaaaaagaatacattgaaggtgttgacttcattatcgttcgtgagctaacagggggcttatattttggtcagcctagcgagcgtcgaacagaaggaaatgaagagacagttgtcgacacgttattttataagcgtacagaaatagaaaggattattcgccaagcgtttgaaacggctgtaaatcgacgtaaaaaggtaacgtcggttgataaagcgaatgtgcttgagtctagtcgagtgtggcgtgaagtagctgaagaagtagcaaaagactacccggatgtagagcttgagcatatgcttgtagattcagctgctatgcagttaattcgtaatccgaaatattttgatgtagtggtaactgaaaatatgtttggtgatattttgagtgatgaggcttctatgctgacaggatcgttagggatgcttccatctgcgagtttaacggttgatggtccatctttatacgaaccggttcacggttctgcaccagacattgctggacaaaacaaagctaatccgattgctgctattttatctgcagcaatgttgcttagacattcatttggattagaaacagaagcagcggtgattgaacaagcggttgaaagtgtattacatgcaggtcatcgaacagctgacttagcagacggtaatcattatttaggtaccgataaaatggtggatgcaataactgcggttattgccaacgattctgccatttcaagcattatgacagct

SEQ ID NO: 2029 - DNA, 225 bp, Myxococcus xanthus
caaaattcaatatcaggctacagtaaagctccacggggtctttccgtcctgtcgcgggtaacctgcatcttcacaggtactataatttcaccgagtctctcgttgagacagtgcccagatcgttacgcctttcgtgcgggtcggaacttacccgacaaggaatttcgctaccttaggaccgttatagttacggccgccgtttactggggcttcgattcagagctt

SEQ ID NO: 2030 - DNA, 372 bp, Myxococcus xanthus
tcactccccttccggggtgcttttcacctttccctcacggtactggttcactatcggtcactaggtagtatttagccttgggagatggtcctcccagcttccgacggaatttcacgtgttccgccgtactcaggatccactcaagagggaacgaagtttcaactacagggttgttaccttcttcgacggacctttccaggtcgcttcatttacttcgttcctttgtaactccgtatagagtgtcctacaaccccaagaggcaagcctcttggtttgggctaattccgtttcgctcgccgctactcaggaaatcgcatttgctttctcttcctccgggtacttagatgtttcagttccccgggtctgccttca

SEQ ID NO: 2031 - DNA, 525 bp, Myxococcus xanthus
cgctaccagtccgtggaattgccgccgctcaaggcccacgtcacgcagtggatgcgccatggcgtggagtgccccaggtgcaagcatgagacgtgggcaagcaccgcggcgattccgacgtcggccttcggcccgcggctgtccgccgtcgttggccttttgacgggcgtctaccacctgagtcggcgctcggcggtgaggcttctgggggatgtgctgggcatcgacatttcgctgggggcagtgagcgccgtcgaggcgcgcgtcagcgaggcggtgaagcccgcggtggacgaggcctggtcccgggtgttgttggcgccggtgaagcacacggacggcacgcagtggcttgaggccggcctggcgcgcacgctatggaccatcgcctcgtcaatggccaccgtcttcaagattctgccggacagcaagtctcggacacttgccccgctatacggccagaaacttggcgtcatcgtgagcgaccgcgccaccgctctgaatgtctggcccatggaagaacgg

SEQ ID NO: 2032 - DNA, 357 bp, Myxococcus xanthus
attgggcgtcgacaaagcgccacagcggacgagatcaagaaggcttatcgcaagctcgcccgcaaataccatcccgacgtgagcaaggaagccgacgcgtcggcacgcatggccgaggtgaacgaggccaacaccgtgctgtccgacccggaaaagcgcgcggcgtacgacgacctcggccaggaaagcgcccgctaccgcagcggtgccggtggcggtcaggacttccgtccgccacccaactgggatgccggattcgaattctccgaccacggcgacagccagggcatggacagtgccgccttcagcgacagagcgccgtggggcacagcgtcggcttcaactcgcccaccacgc

SEQ ID NO: 2033 - DNA, 468 bp, Myxococcus xanthus
agactgacgctcgggcagatggaggagcggcgactgttcgccgcttcgctgctgaaatcgggttggcgcccagtggacgtagcggacgagtgcggcgtcacccgaggagcggtgtcgcagtggtgcaaagccctcgcgcaaggaggcgtcaggaggctgcggcgcaagccgcatcagggccggccctcacggctgagctcctcggagtggaagcaagtggcccgagcattcaaggccggcgccgttcgggccgtctttcccacggagcgatggacccttccacgcatcgcacgtctcatcgagcaacgctggggcgtgcggtaccacccgcgctccttgtcgaggccactgcatcggctggggttctccgcgcaccgccctcgtccccaggctcgcgagcgggatgatgcgctcatcgaagcctggggaagaagagactggcctcgcatcaaaaaggggctcgaagaa

SEQ ID NO: 2034 - DNA, 831 bp, Myxococcus xanthus
gcggagcagcaggcatgcctcgcgctctgggccgttcccggcctggggccgaggacgctggtcgccctgcgcgcgttcgcggacggaagcctcgcgccgctcgccgcgactccagtgcgagactgggtgtcccaggcgccggtttcctcacaggttcgtcgcaagctcgcctccgtagagcgcctggcgccggtggcgtggcgggtgtgggaggcctgccgggcgtcgggcatgaaggtggcgttccaggggcaggcggcctatccagagcggctggcggaggtggaggatgcgccgccggtgctcttctaccggggcgtgccggggctgccgcggcgtcggctggccatggtaggcagccgccatccggatcagggcttcctgccgttcgcgcggcgcttcgcccggcaggtggcggcgtcgggggtgggggtggtgtcaggggcggcgtcgggggtggaccgggcctgtcactggggcgcgctggatgaggggggagagacgtgggccttcctggggtccgccctggatgcactcgacacggcgcaagcccgcctgcttcctcatttcctggaccgagggggcgtgttcttcagcgagctgcctcccggcgtccgggcgagcaccacgacgtttccccggcgcaaccggctcatctccggggcatccgacgcagtcttggtgctgagggcggggaaggattcggggagtctgtatacggcggaggcggggcgggcgcaggggcggccggtattcgcgatgcccggtgacgtacgccaggaggaggcggccggctgcaacgcattgctgcggaacggggaggcggcggtt

SEQ ID NO: 2035 - DNA, 2319 bp, Myxococcus xanthus
caggtgtcctgagacaaccagcccgcgtggcagaaccaggtcaacagcggaatccggacctgccagagcaacacgaaaaccaccgccagcgtgatggccagcttcgtccacccggacgcgccctccgcctcgtcgtcctcctgctgccggaccagcgccgagcgcaccatgtccaagcggtccacccgggcgttcgagggcagcttcggacggcgcgtcaccagcgaggacagctccggtgtcagcatcagccggtcattcagcgcccagcccgagccttccaacagcagcgccaggttgcgccggcgcagcttcagccagcccagaagtcctgccggggccatgacgacaatggcaatcagcgtcgccgcggagatgaggtccaccagcgtcagcgacttcacctgcgtcatgatgaacgcgaaggacgagcccagcgccgcagccgccaggccgcccgccgccacgatgcccgcgagcccgccgcctggaggtgctgcggctgctgcagcgggagccgcgcccgccgccggagaaggcgccaccggcggcgcattcgtcgcgttcgtgtagcccttctccagcgtcgaatcgaacgtcttctcgcccgccgacgccaggccctccaccttactggtgatgaattcgccgatgcgcgcgaagggcatggtcatcgactcccacagcgacacgggctgacgaaccacctgcgtcacgatggcgtcgctctccacgccgtccacgtcgtagaagacgccccgcttgcccaccgcgagctccgtgctccggccgctcgtcaccggcaccgccacttcatacccgggcgtcccgtccttcggcgccacctggacgtagaggatgcaggtggtccccagcgcggtgagcgcggagtgcgcggcccggttcgtcaccagcaccgacagcgtgtacttgcgcccgcccaggatgagcgtccccttctccaccagcgccaaccgcttgggcatgtagaggttgggcatgctgatgaagttgttcgcgaacagcagcagccagcgctggtagaggaccaaccgctccagctcgttgacggcatccagcgtgggcttgagcgcgaggtccgccgcgctcgccgcttccagggcatccaggtccgcgtccgaaaccgacggcagcgtgtccatcagcgtgcgcaccgggttcgcctcgagctgcgcctgccacgccagcacgccatccgccttcgccgccagcccccgccacgccgagtccgacagccgctgcgaatcccccgtcatcggcgtggcgacgtccgtgcggaacgcctccagcacctcgtacgcgggcccgcgcaggagacgggaccactccagcacacccgacgcatccggcggcgcgatgggcaggtcacccgccgccttccccagcgccgccatgtcgcccagtgcaccctccacccgctccgcgcgcaggcgcaggctcgccgccgcttcgggctgcgcggccaccagccggcactgcacgaagtacgcatccagcaacggcgccacgtcgcgcacgcgcttggctgtctccaggctgatgtcgccccagacgaacgccgcgccctgcttctcccggtgctcccgcagcttcgcgcgctcctcgcggaagcgtgccaccagcgccgcgtccacgcccgccttgcctgcccgattcgtcagcgcgggaaagctggccatcagctcctgggccaggggccgcaggtgctcggacaggtgctcaggagcgacgatgccatcgccgttctgcccggtctcgcgcagggccttctcgctctcgcgaacctgcgccagggagatgcgcccggcgtccgtcgccttcagcgtccggagaatcatctccgccgcgccgcgcaggggccgcgcctcctcgctgagcgcgttcaactccagcacgtcactggaagcatccgcgccgcgccggtccttgagctgtttggcggcccagtccaccgccgtgcgcacctccgccacgcggatgcggccgttgccgtccgcgtccatcaacgtcagcaggcgtggatcacagctcaagccctccaacgggcacgccgtggcaatccactgcgtttcggggatgcggatcgcctccaccagcacatcgaaggagggaatgtcgacctggagcgagccgccgtagcggcgatagatgagcgaagccatacaggcggcggaagtaagcacaccgcccgacgaatcgcacgatcctcaacaatcaaaagctacggcgtcgcggggacgctgtagatgccggccttcgggccctgcgtaatcgcgtacacggccagcgagtcattct

SEQ ID NO: 2036 - DNA, 348 bp, Myxococcus xanthus
attgcgcaggcggacgcgcaggtggggacgctgctggacgcgctgcgccgctcagggcgctatgacgatgcgctcatcctcctgatgtcggaccatggcgagagcttccacgcggaccgcgaggacctcgcgggcgccacgccggtgcatggcgcgcggctgtcggaggaggagaaccgcatcctcctggcggtgaagccacccaagggacgggggacggcgccagccctggtggattcgctggtgcggctcgtggacgtggggcccaccctgctggagttgtccgagctgccgaacctgtcggatgtggacggcgtgtcgctggcgccgctgctgcgcggcgaggac

SEQ ID NO: 2037 - DNA, 768 bp, Myxococcus xanthus
cgaaccatgttcaagagagcggcagtcctgatgttgaactgtggcgccttgctgtccggctgcgggcccgactcacataccgggaacgctgaactcctctccaatctgaccgaggcagggtttcgccccgacgacatcaccgtcgtcgatgacgccgtctacgtcgggggcgacgcgcatgtgacgctcgcggcctcccgggagatgctccagcgcggagagggaagcaaagagcactacatgacgaccaacatcgtcggctccagcgtgacgaggatttgcgtcaatcccacgacggagttccggagctatgtccggctcatccaaggtctcgatatggcactcgccaactacaatgccttgggactcaggattacctttgttcgaggcccggccaccggctgtaccgcgaacatcaccgcgaaaaccatggcggggagtggtcacgtcgcgggctttccctcaggaggacttccctatggggcgatttcgattggcaccggcctgaacagctacggcgtagacctgaatgagcatgtcatcacccatgcgctgggccacacgctgggcctccgccacacggaccatttcaacccgagcatcagctgtggcagtggcgcgatggagccgacgggcacgggcgcattgcacatccccggaacgccaacgggggcaacgccgggcgggtccatcatgaatacctgctacccgtctggcaccgacggtgagttcaccccttccgacatcgtcgcgttgaacttcatgtac

SEQ ID NO: 2038 - DNA, 3860 bp, Myxococcus xanthus
ctccaggttcctttcaccacaaaccttccacaccccgtgtatttccggacggcgagcctgcctgccgcggcgacgtacccccggcatcggcacccctggggggagttcgtctacgcgttcagcggggtgatggaactcaagctggccggcagccactacctggcgcccccgcagtacggcatctggcttccacccgacgtggagcaccggggcatgaaccgcttcgaggcgagccactgctcgctctacctcgcgcaggcgtggtgccggggcatgcccaagacgacgtgcgcgctggcggtgagccctctggtgaagtcattgctggagcacctccgcgcgcatgagctggcgcagcctcgcacgagcgccgagcgccgactgttccgggtgctcatcgaccagctgacgctggcccccacccatgggagctacctgcccatgtccgatgactcgctcctggagccggtcctcacggcgctcgagcagcacccggaggatgagcgctccctggccgagtgggcgcgggtgctgcacaccacggagcggacgctggagcggcgctgtcagcagcacctggggctgtcgttcagcgagtggcgccagcggctgcgcgtggtgaaggcgctcgcgaggctggagcagggccactccgtggaggccatcgcgctcgacctgggctacagcagcgcctccgccttcatcgcgatgttccggcggatgacaggcaccacaccggacaaggtccggggccacggcttcgtggcctcgtgagggtcgactcctggagccgcccgaaagaaaaaacaggccgcgccccccttggaatgggcgcggccctcacgtgcggcatcgaagggttgaaggactactcgcagctgccctgccgcaggtacgacaacagcgaagcatcgttctctgaagccggctccgcccccaccaggcactgcccctgggcgacgaccacctgcgagtcattcgcggagagcagcagctcgcccgtcaccacctgcaggccgcccttgaagcccgtggcgctgttggcgggcgccgcgcgcaagctcggtccccctgcgcccccgctgagacgcagccgataggtcgcgtcctcatacgccgcggggatctccgacgcggggtccgccttcagcggcgccaggtagaagcgcgtcaccaggtcgaactccggctgcaccttcagcagcggcgcgccgtccgccccgcgcgtcagcgtcacgtcgaagtgccgacccgactgctcattgaggtccagcgcgaagagcttgtcgttccccaggctcaggtgggtctgcgcgtcgccaaggcccaggttcttcaccacgaagtccgtctggttctccgtcgcctcgacggagtacgagatgccggccagggacaccgtccaatccttgccacgcagcgccggcgccaaccccgtgtaaggaaggcgaacctccgtggtgttgaggtccagcgagaagcgcgcgcgcttcgcctggccgtccgcctcgaacgccacgagcggcaccgcccgcgcggaggagaacgcgaaggtgctcccctccagcgccagctccagccgcagcgcgtccaggatggaggcgctgacaatccagtgcgactcgccctccttcgtcaccttgagctcaacctgccccaccatcaccttcggcaggaacccggccgactcggcgtcgagctgctccaccgcccccttcaagccgcccaggtccaccaccagcgagacggccttcggcaggaagcgcagcgccagcggctccgcgcgcttcgcgccgatgagcaactccaactccagggagtcgtcccccaggttcgtcgcgcgaacgcgcagctgcgcatcatccacgaagcggacacagtccgcgtccgcaggcgccctgccgtccgtgcagatctgctcgcccttcaagcggaagacggtggcgttgtcctccgtggactccacgttggcctcggtgaagacgcgctcgcgcaggaaccgctccaactcgtccgcctgcgcgtccacttcatccgcgtcgaacaaggtggacagcgcctcgccttcgtcacccacctgcagcccagggagcggcacgccctcgaagccagcgccgaacagcgccatcgcgtcgtccaggccattgagcgtcgacaggccgctcacggtcttcatgctgctgctgacacctcgcagcgtctccgccgaccgggaggcggcgatgtcggcgaccttcttcgcgtcgggagcttcatcggaatcacagcccgtcgtgacgaatgcgacggccgcgacggccgcgagccaggacctggagttctgcatggggtgttgctccttgggggtgggttgacagtgccccctcatcagcaacgaccgcgccaacccatacccccggtgtttccaagggttttcgacacacccttggcctcaaagtcggagttgccatgacattcctgtcatgacgcgcctgtcggcgccggtgccaggatgatgcttgcgcgatgcggggcattccctgaggcatcccctcagatgtgcagcagcctgtccctgcgctccggcgtcttcacgcgaaccgccttcaggcccattccgaatttgaggtccttcacgtcccggaacgtctcctccgtggtgaagcgccggccgtaggtgtccagcagctcctgggccgtggcctcgccgaagctggtggccagacaccagtccaccgactacgccacgcactccgcgcacgtcgcggatgcatacacccgctcacgcgccgcgggcttcgtgccctacgtcaccgtacgcgcgatggagcggatgacggtgaacgccgggtgggacccgcagtcgcccgtcccgcccgggtcaacagctcgtctcgacgaagcaccgcgcctcgaatgccacacgaggcgcggtgcccaccttcagcgccgccagtggaaagccctgtggagtacgtgcgaacggttgaggggcggaagcaggcagcggagccaacctgtctaccgaagcggcgctcccgcacctgaccggcctcggcttgccgtcagctcccagcggtgggggatgccaccttcagagaggccgttcgctcagggcgcgtatgcctccgccgtggcaagttggcgggtgccatcttcgccccccacgacgagaaccctcgaaaccgagcatgctttggctttctatgtggtcatgtcctgccgcgcagataccgccttggcgtttcgccggtcatctggcggaaaaaggcgataaaggcgctgtcgctggcgaagcccaaatcgaaggccaccccgctcacgttctctcccgaggccagcaagtccaccgcccgcagaagccgccagctctgccgccaagcctggtaactcataccggcctcgcgccggaagatgcgagtgatcgtgcgagcgctggctcccaccaggttcgcgagcccagagagttcgggcggcaattcgtcaagattgagccgcgagaggcgcggatcgctcggcaccggcaagagcatcggctcgcgccgggccgtccgcagctcatcaaggcagaccgccagcaggttcgccgcagccccctggttccagtcggtctcaaagggcgcatggctgatccgttcgaacacctcacgcagaagcggtgtcatcgacaggatcgccgacccctcggtcgggggcgcgatgcgggacgtgtcgagatagatcgagcgatattccacctcaccgcggatcaacacgcgatgcgcggtcgccggcggaatccatgcaacccggatcggcggcagcatcgaaatcatgccgggtagcgcaatgcggatcgagccggcgtaggcgaagaggagctgccctctttgatggctgtg

SEQ ID NO: 2039 - DNA, 258 bp, Myxococcus xanthus
atgaaaccaaaaacaattattgataagctttgggaacaacatgttgtacgtcgagaagaggggaagccggacttattatatatcgatcttcatcttattcatgaagtaacgtctcctcaagcattcgaaggtcttcgcgtggcaaatcgtcaagtgaagcgtccggacttaacgtttgctacaatggatcacaatattccaacggttgaccgttttaatattaaagatccgattgcaaagaaacaagtagacaaacta

SEQ ID NO: 2040 - DNA, 849 bp, Myxococcus xanthus
atgctcgatctcttcttgctgcgaagcttcgtcgcggtcgtcgaaacgggaaatttcacccgggccggcgagcgcctgcacctgacccaatcgaccgtcagccagcagctcattcgccttgagcagagcctgggttgccgactgctgaaccgcagccagcgtcatgtagtgcccacagaagagggggagcgcctgcttggctatgcgcagcggatccttcgcctagccgaggaggcgaccgttgagttgaaccccggcggcagcggcggtgtgttgcgattaggtgtgcccgaggatctcgggggcgaagcgctgatgccgctgcttacgcgcttcgcagccgagcgaccgcgcctgcgtctggaggtcgagtgtgggttgagccaccacctcttgcgcctctaccgcaacggcgagctcgatctgttgctggtcaagcagtggggcgccgacagcgattcccatgcgcgctgggcggaatccctgtgctggatcgacagcgcgacgcagccggtgacggcgaggtacgagggtggcacggatgctctgccgctcgtggcgttccccgtgggggcgctctatcggcaggacatgatccacgcgttggagagccgcgggcgtgcgtggcggattggctactcgagtgccagcctcgcaagcctctgtgcagcggtgagcgctgggctcggcgtcagtctgttgcctgcgagtagcgtgcaggccggccatcgcgtgctgggcgaaaaggatggatttcctgtcgtagacgggctcgagcttgccctctacgcccgttcgaatctcggcgccgtcggccgtaccctgcgcgacgagctgtccgacctttgc

SEQ ID NO: 2041 - DNA, 345 bp, Myxococcus xanthus
ccggaggtgctccgtgccggctttgaagtgggctgggtgggcgtggacctgttcttcgtcctctccggctacctcattggtcggcaggtattcgcgatggaggactcagcgcctctgggacttcagctccgcacgttctggctcaaacggtggatgcgaacgcttccgctctactttgtcgtcctcgccttctatgcactgaagccatggttgttcgggacacccttcgtgggaggaggttggcactatctcgtcttcctccagaactacgttggcgtgcgcgacttcgtacagagttggtcgctttgtgtcgaagaacacttctacgtggtcctgccgctgatc

SEQ ID NO: 2042 - DNA, 264 bp, Myxococcus xanthus
gacatcctcgcccggctccaatccattcccgggctcagcgttgtcctcgagcagccctcgccctttccgggcacacgcttcttcttgcttcagctcgaacagcccgcagaccacgagcgtcctcaaggggagcgcttccagctccggatgacgctccttcaccgctcggtggacgcgcccatggtgctctccaccgagggctacatgctggcgcccaggccctggaggccgagcccaccccttgctcggtccaaccagctctcc

SEQ ID NO: 2043 - DNA, 234 bp, Myxococcus xanthus
gtgaacgtctcacgcaaggagctgcgcgtcctgaacgtgctggctcaaggcgggcgtattctgaagcacaaggatgagaacgggcgtttgacccatgtggcgtgtgtcacgccagagggctggcagttgtcgctctgcacgctggaggtcttccagcagttgaagcggcgaaagctcatctcctcggtgaagggcggcccgtacctcatcaccaggctggggcttcaagcgctc

SEQ ID NO: 2044 - DNA, 1314 bp, Myxococcus xanthus
tcgtcgctcaccgagaagacatctccgctgatcttgtccacgatgacgtcgaagaaggcattgttctggtctacatccgtcacgctgaagtcattcgcgcctcgcgcgaagttctggaggacgctcactcccgtggagcctcgcgagacggagatgtagagggcgtcacccctggaatccagactgacggtagggttggccgccgggctgaggactcgcggcgcctcccagcttgctcccgcgtcgacggtccgggtgaatatcagcgtgcccgcgctggtggccgcgacgtaggcaattccggtggggccgccttcaatcgcgacttccgccgcgttggtgatgcccaggggagtgggacctacccaggtgtggccacggtccacgctcacgctgacatggacggcgccaccgcacctcatgacgacgtagaagcgccccagtgcatccaccgcggccttacggcccgggttcgagttggccgtggtgcagtccaatgccccgctgatgagcgtggggggcacatttgaaaaggcatccagttggcacgcggcgtcgcagccatccccggggatcgtgccgccatcatcgcactgttctcccgtcacgctgtcgaccaggccgtcgccgcatacctccacgccacgggagtccgctcggcagccgtctcccgcgacgcggttgccgtcgtcacacacctcacccgaatcgatgtagccgtcgccgcagacaggcggccccctgacggtgatgatgaccgtggcggtatgggaggtcagcgcgccatcgttggccgtgaaggtgaacgagtcctccccctggaagtccgcggccggcgtgtagagcaactgggcgcccgtcccggacagggttccgtgagcgggatccgtcacggtgaacgcgagcgcatccccatctacgtcggtggccgccaacgtgatgggcgtcgacgtgttgtagcccaccgtcacagtggcagaggcagccacgggcgcgtcgttgaccggagtcaccgtgaccgagacggtggccgttgcctgcttcttgccgtcggagaccgtgacctggaaggtgtcctctccggcgaagttcgcgttcggggtgtacgtcaccgacgcccccgtgtccgtgagcattccatggccgggcagggtgaaggagaagtcgagcacgtcgccatccgggtccaccgcggggatggtgatgtccaccgggatgtcctcggaggtgttcgcgtggacgtcctcgaccgtgggcgctgagttgttgtcgcaaacgcttggctgccccgtgcaggtgtagcccggctccacc

SEQ ID NO: 2045 - DNA, 1791 bp, Myxococcus xanthus
atgaaactctctaggatttattcgaatcgcccggctgtttttgggccagttgatttcttgcctggtctgagtgttgtatttgcggaaattcgactgccgcagaatcgcacgaaggatacgcacaatctgggcaagaccacgttggggcggcttgtggatttttgtctgctctccggtcgggatccgagattcttcctttttaagcatcggcagatgtttgatggttttgtgttcttgatcgaaatagagttgctcgacggttcatatgtgacggtgcggcgcggtgtgagtgagcctacgaaagttgccttcaaacggcatcatgctcgttcgcagaactatgcggagttgccagttgcgcaatgggaccatgttgatgttcctttcgagcgagcgaaggacttgcttgatggtattctggatttgcgagcaattagtccgtggagttataggagggcgcttggctatttgctgaggactcaggatgactaccgtgatgtttttcagcttcgaaacggccataaacatgtggactggaagccgtttcttgctcatgtccttgggtttaattctgcatttgttgaggggctttatagaaaagaggcagagctttctgaaaagcaatcgaccgtgcaggccattcgagcggagatcggtagctctgttgaggatgttagcaaggttgaggggatgctcctcttgaagcagaaggaggccgagaagaagcaagggctgcttaatgcctttgattttcgaggcgcggacaaggagagaactagagctattgctgatgatgttgatgcgcgaatcgctgtgcttaatgctgagcgctattcgctggcgcatgcgaagaggaaaatcgatgcgtcactggaagaggaacaagtcctttttgatccggatgacgctcagcggctctttgctgaggtgggagtgacgtttccgggacagttgaagaaggactacgagcagttgatttcgtttaatcgggcgatcaccgacgagcgccgacaatatctgcaagaagaacgaattgaaattgaagcctcgctgaagagggtggcggccgagctcgctgaacttggaaggcgacggtctgagatgctggcgtttcttacgggtactgatgtcttcgcgaaatatcgacgggtctccgaggaactcgtcggtttgaatgcggacatcacgtcgcttgagcgccagcgcggctatcttcatcgtctgcaggagatgcgtacagagattcgaacccttactgatgagaaggggcggttgcaaactgaggtcgaaaaggacgttgaggtgcagaactcggatgggaatagtttgttttcgtcaatccgtatttactttagcgaaatcgtcgaagacgttatcgaccgtaaagcgcttctcagtgtcgctccgaaccagcaagggcacctggagtttcgagcggagattcttgatgagtctggcaacgcgacgagtgctgacttggggcatacctacagaaagctcttgtgcgtcgcgttcgatatggcggtgcttcgcgctggtctcgataaaagggcgcctcggttcgtgtatcacgatggggtctttgagtcgctagatgaccggaagaagaccaacttgcttgcggttatgcgcaagtatgcgaatattggacttcaatttgttgtcacgcttattgattctgagcttccggcgagagccgagagcgatgggccaatgtttgccgacggggaaattgtactcaggctccatgatgaaggacctgaaggtcggcttttcaagatggctgcttgg

SEQ ID NO: 2046 - DNA, 474 bp, Myxococcus xanthus
atgtggctcaagacctttccgcaggtcgcaacactggcgaacatcgaccccgttgattcgccactcatagtcagccccgacgagttagcggaactggtagaggcattcgcccgtaaccaacaagtcattcaggccgccgtcgacagtccaccgacgccacgcgtgtcctatgcggacaagaactcgctcaacaatatgtcggaggattacgctcgacagcaacggcgaaactacctgaaggataccacgcagattcaagcgttccttgcagccccggaaaacttacaattgcgtcgactctatgagaccgtggtgatggagtttcagctcaaaattaccgccaagagaaaatctcatcagtcgtttgatgacgtgctcgaatatcttaccgatctcttgtttgggcgggatccggtgctgcggtcgaataagcgattgacgcgagctatgctgttttacatgtattggcattgt

SEQ ID NO: 2047 - DNA, 348 bp, Myxococcus xanthus
cttgtagtgtttctttgtcaacagttgctcggtatctctgtacagggtttttcgaaggggcccgacggggggcgggacgcgaagttcataggcacggcagaattgcttccaagtaggtcagcgccttggcgcggcactgttatcgtgcaggccaagcacacgaatggagtcaacaagacattctcggatgcggatttcttcggcgaagcgacgaccgaaactgtgctcggtaaggagattcctcgaatcaagagccttagggcggcgaacgcactcgaccactatatgctcttttcgaatcgtcgattggctgggaacgccgacgaggcgattcgtgggctcctttct

SEQ ID NO: 2048 - DNA, 423 bp, Myxococcus xanthus
caaacgaagcggggcaagaggacgaaggtcatggcagctgcagacggcgctggtcttcctctcgccattggcacggcaagcgcttctccccacgaaaccaggctcctcgaagccactctcgacgaaagcctcatcgacgagcttcccgagcggctcatcggcgacaaaccctatgacgctgacaagctcgacgagcgactgtggcatcagcggggagtgaagctgattgcctcgcaccgccgaggccgcaagacgaagacgcaggatgggcgcgagctacgtcgctaccgtcgacgctggaaggtggagcgactctttgcctggctccaaaacttccgccgtctcgtcacccgctacgaggtgaaggtggagaacttcctcggattcctccacctcggctgcatcctcatcctcttgaggcaa

SEQ ID NO: 2049 - DNA, 480 bp, Myxococcus xanthus
ggtgtctccccccgcgtccacccgggctgcttcgtggacgactccgcccagttggtgggtgacatcgaggtgggggaggactcctccatctggttcaactgcgtgctgcgcggggacgtgaatcccatccgcatcgggaagcgcaccaacgtgcaggacctgtccctgattcatgtcaccagcggcaggtccgccaccacggtgggggacgacgtgacggtggggcaccacgtcatcctccatgggtgcaccatcggcaaccgggtgctggtgggcatgggcgccaccgtgatggacgacgcggaagtgggggacgactgcatcatcggcgcgggagccctgctgacgccgggcacgaagattcccccaggctccctggtggtgggctccccgggccgggtgaagcgccccatcaccgagacggagcgtgagttcctcttgatgtccgcgcagcactacgtgctgctcgcggccgagtac

SEQ ID NO: 2050 - DNA, 228 bp, Myxococcus xanthus
agcggcgccacggcgctgttcctcgccgcctggaagggactgagcgcgagcgtctcggcgctgctcggacggggagcgaacccagacctggcggacgagggcggcaacacgccgctgcacaccgcggcccgcaacgggcatgccgaggtcatcgagttgctgctgacgggtggtgccgatgcgcggctgcgcaacgcggccggtgagagcgcggcggaccgtgcccgc

SEQ ID NO: 2051 - DNA, 1623 bp, Myxococcus xanthus
agcagccgcacggtgtggatgcccgggcgcacgtcgctcaggcggaagcgtccgtcctgcccggtgaaggcatccgagcgcccgcccacggccttgtcgaggaacaccgccacccctggcgcagggcctcccccccggctccacaccgcgcggccggagatggacgccacgccgccggtgagcggcacctccacgtccgaggtacccccgggccgcagcgtcacctgggcttcgcccgtgcggccgtcctcggtgcgcaccgtcaccttcagcgcctgggcgggcgcgtctggaagcaagaaggtgctgccagcgaagcgccgcgtggtgggccaggcgccggcccagggcagggcctcaccgttggcctcgagcagctccagggtgaagccatccggagccgcgccgctgcccgccaccacgcgcccgcgcagggtggccgcgggctccagccgcaccgtgagcggtgcctggtcctcatgcgcggcgggcagccgccccacgcgccccgcgttgtgggccaccagctccaggggctgggcgccctgggggcgcggcggcatggcgaactggcccgcctcgtccgcgcgctccttgcgcgtcatggggaagtccccgccctggatggcggccacgatggccagcgggctgggcaccccggagggctccagcacgacgccggacaacacggagtcttccttcaacagcaggtcctgccgcacggcgccgcccgaaggcaccgtcacgaacgggtcgctctccatgtggaagtagatggcgggcgtctggtggagcagcgcgaccagttggtagacgcccgcgggcaattccaactggaactggccctgcgcatccgtctccgtggaggccgtgcccgagccgccccgaggcacggcgtggaccagcgcgggctcggtcagcggcccgcccgacgcgcgcgtcacctgtccccacacggagccggagtccgccagggtgaagtccgcgcgggtgacgactcccgccttcagcgtctccatgcgggacgtccaccgctgcgagccctcgcgccgcgcgcgcacggaggtgggcctcgcttccagcccctccagcttccaggcgccctcggcgtcggtgagcgccgtgtgcgccacgccagagaaggacgccggttcggcgcggacctgcgcgcctcccagcggtcgtccctccgcgtccaccaccaggccttccagcgccgccgttgcgggttccagccgcacgtccaggggcgtgtggccgcccgggttcaccaccacggcttcgaacacgcggcccgtcattcccaccgcgcgcaccgtcacgtcgtactcgccgggagggacgtccatccgccactcgccatcttcctcggacgccgcccggcccagctcgccctggccgcccgcgggagacgccaccaggatggccccgcgcaccggcgcaccctccaccgtggacaccgtgcccgtcaggccactggccgcgcccagcgtcaccatgagcccgcgcagcgtctcgcccggcgcgacggacagcggccccggcacgcggcccagttggtccccacggcgggcggacacgacccacgtcccggcgttgacctccagcgcgaagccgccgcct

SEQ ID NO: 2052 - DNA, 339 bp, Myxococcus xanthus
ttgagggtggtcggcctgttggggacggtcgagactgctcgggcctgtctggaggcgatgcgcgagccgccatgggcgcgcctggcggcggagtcgttctcgctggtgacaggcatggaggttcccgcggtggctccgggcgtggagtcgggcgacgaggcggcggccgtggagttcgcgccggaagcagacctcccgctgccggatgtgccccgtgtggaggcgtggtgggccgagcacgcccctcggttcaagccgacggtgcgctacgtgcggggacggcctttgggacaggagtcgttgctcgacgcgttacgagaagggtcgatgtatcgccgc

SEQ ID NO: 2053 - DNA, 1512 bp, Myxococcus xanthus
gggacaaaacgtccgacgatgggtctgaagcccgcgcctgccactacatcttgtgatgagccagcaagtacgagccgatccgctccatccaatgcggacgcaatcggaatcccgcctcccgatggtatccagtcggactccacccaatgtgtctcggcccatctcctggaatgcagctccattcccccccctctgctggaatgaagggcccaaaaaagagcaggacgatcagccgaatccaccatcaagttcagactagccatctccagatgatgattcaccgtcagaacatgcttcaccctctcccaagattctccatcccagagccaagtcgaaatggaagaagagttcccttcgatgaactcgtgaacaaccagccaacgccctccgcgagagtccactacaaaatcgaatgaaccgaacctcgcttcaagataagttgctgtaacaggcgcaccaacggctgaccaaccgcctccgctccagcgccggacgtgtacgcttggcgtaccgtcggacgtctccacactccatgcaacgaggaactcgcctcccggtgatatctgaagggagcaagccataatgatggattcggcagcgctcgctccaagcacctcacccaactgctcccatgccgcgccggtccaccgcatgacgtagacaccatgttcggaaggcgaatcgccatcaacgaaagcaacaacagggtttccattcccatccagcacaaacgagaacttcgagacgttcgaagcctcgacagtgccggcagaaagggcccctccgtaatggagatgcctggggatggcccactcccaatccagtgccgttacatccaacgcgttgcctgccacgtctgtcaccgaaggcgcgatggtcacagatacatttgagtccacgggaatttgcgtagcaggcgtcagcgtcaccgtcatgccatcggccgacaggcgcacccctgcagtaatatccgattgattgaccaagagcctgatggactccgcgttcacggtggacggctcgacagcctcggagaagacagcctgaatgggagcatgcacggaaacgtcccggtccccagaccgagggctctgcgtcaccacccacggtgctgtccggtcgacgaacagcgtgttcgccgcactcacgtaaacacggtcgccgattgatgcccttgcggtgatgatgtactggccctcgtcgaggtcacgggtgctccaccgcaactcgtaagaaggctggggcaacgtcgctgtggggacgccatcaaccagcaactcgaccgactccggcgccaactccgcgaccgaaactcgcacatcgacatcaccattcgtcgccgcacgcgacagcgttagcgtcacatcctggcttggcggccccgcgtccggcgactcgggcacaatttcgattccaggcacgttgatgcatgcccagaacaaggaactgagacacactgcccaaaccctgatggagttcatatgtcctaatcgggcatgcagcagccattcc

SEQ ID NO: 2054 - DNA, 2868 bp, Myxococcus xanthus
gcccttgtcccagctgcgcacgtgcgaggcggcttccacggcgccgtcgaggaggcgcaccgtggtggacgaggcaaccagcgtgaggggccggcgcaccaggccctcgggaatggagtagtcgttgccgtcgaagcgcacgtagggcgtcttgccggaggcggcggggcgcaccacgtcggtgggcagcgggtgcgcgggcagcggcagcagcagggagcgctcggcttccagggcctgcgccaccgtgcggcccgaggcgtcgccgggcacccggcgctggtgggccacctcctccacccagcgctgcagttggcggttgacgtcgtcgaggctgtggaaggtgcgcgcggagaagaaggagtcgcgcaggtagcggatggtgcgctccacctttcccttctcattgccgcggtagggggcgcagggcttggggacgaagtggtagtggccggcggcttccaatatgcgcgggtggaagtgaatgacgtctccggccctctgcagcacgacggacttcaggttgtcgtagaggaggttgcgaggcacgccgcccagcgcttcgaaggcttggacgtggccctggaggaagcactccatggtttggcccaggaagaagcgcgcgtacatggcgcgcgagtggcccagcaccaggacgaagcaggagagcgtccgggtggcccgccccacccgcaccttgccgaagctgccccagtccacctgggcctcttcgcccggcagggtattgcggcgcaagaaggcctcggcctgggggcctgggcgcacccgtcgcacatagcgcttcacctgctcatagccgcccaggtagccacgggccttcaccatgtggaagaggcgcgtggccctcaggcgcgggtgggccttgagggtgacgtcaatgaagtccgtgtacgggcccagcaccgtgggcttcgccgtgcttctgtcagcactggctaccggcgcgtcctccagggccgcctccacggtgtcgtggtgcagccccagctgcgtggcgatggtgcccaccggccagccttccgcgtagtgcaactggcgaatccgggcgcgtacctcgaggccaatcatcctcccacctgcgtgtaccggaccatggtgagcaccgattccggcccgaggtgagcacccgttccgggcatggtgagcacccgttccgggcatggtgagcaccgattccggcccgaggtgagcacccgttccgggcatggtgagcacccgttccggacatggtgagcacagtcgggaacggtacggagcgttgacggcactgggcagcagggtctcgcctccacctccttcgaggaggtggagatggcccaagagaggctggcggtgcgcaagttgagagaggtgttgcggttgcggttcgcgtcgaagctgtcgacgaggaacatcgccacgagtctgggcatagggaatgggacggtgtgcgagtacctggggcgagcgcgggtagcaggggtgggagactggccgctgccgccggagctggacgacgacgcggcgctcaccgcgcttctcttccctgccgagggcaagggggttgcgcaccggccggagccggactgggcgcaggtgcatcgagagctcaagcgaaagggggttaccaagctgctgttgtgggaggagtacctggcggccaacccgggtgggtaccagtacagccagttttgcgagcggtatgggcgctggcagtccgtcctcggtgtcaccatgagacaggagcaccgcgcgggcgagaagctcttcgtggacttcagcggggatggagtcgaggtggtggagcgcgacaccggagaagtgcgggtagcgaagctcttcgtcgccacgctgggggccagcagttacacgtacgtcgagcccgtttactccgaggatttggccacctgggtgggctgccacgtgcgcgccatggccttctttggcggtactccggcgttggtggtgccggacaacttgaagtccggcgtcacccacgtgcaccgctacgagccggaggagaatcccacgtacgccgacctggcccggcactacggcttcgccattctgccggcgcgtcctcgccgcccgcgcgacaaggcgaaggtggaggccgcggtgctggtggctcagcggtggattctggccgtcctgcgcaaccaccgcttcggtggcctgcacgaggtacgtgaggccgtacggccgttgctcgagaagctgaatggccgcccgatgcggcatgtggggcgctcgcgtcgccagctgtacgaggagctcgagaagcctgtgctgaaggccctgccggtacacgcctacgagctggccttctggaagaaggcgcgcgtccaccctgactaccacgtcgaggtggaggggcacctctacagcgtgccgtactcgctggcgcacaagcaggtggaggcccgctacacggaggggagcgtcgaggtgttcctcgggggccgtcgggtcgccagccacgtgcgcaagcacgccaagggctacaccacgctgaaggagcacatgcccgccagccaccgggcccacgcggagtggacgcccacgcggctgctgacatgggcggagaagacgggcccttccacggccgcgttggtgcaaggcctcatggagcgaaaaccccatccggagcagggcttccgcggggccttgggtgtcatgcgattgaaggacaagtacggagaggcgcggctggagaaggcgtgcgccagggcagtgcgtcaccgggcctacagctacaagtccgtggccgccatcctccagcaccacctggaggacgcgcgggaggagcgcgaggagaagccgcccctgcccgcccatgagaatgtgcgcggcccccactactaccac

SEQ ID NO: 2055 - DNA, 339 bp, Myxococcus xanthus
gacacggagccgctgtacgcggcctcgaagctggtgccggcgtaccggtcgctgccgcgtttcccggcggtgctgcgggacctggcggtggtggtgccgctggagttgcccaacgacgaggtgcgtcgggtgatcctggaggtgggcaagccgctggtggaggacgctcaggtgttcgacgtgtacaccggtgagcagattccccagggtcggaagaacttggcgtacgcgctgcgctaccgctcggccgagcggacgctgaccgatgtggaggtcaacgaggcgcatcagcgcatcgtggatgaggtgaagcagcggctgggggctgccttgcgcgcc

SEQ ID NO: 2056 - DNA, 1380 bp, Myxococcus xanthus
ctgcggctgctggacctcttttccgggtgtgggggcctcacgctcggcttcgtcagcgcgggctgcgtcagcgttggaggagtcgagatcgacgcgcatgccgccgagtcacacgcgttgaacttccacccgctgaaagatcgatcagcggctccctggcacgcgatgtccaaggacatcctgcagctcaagcccagctcgctgaaccatctgctgaagcgtcccccaaatgagggggtcgacgtgatcgtcggcggtccgccctgccctgccttcacacgcgtcggccgggcgaagctccgggaagtgttccagcatcccgaggccttcaagcaggacccccgggcaacgctctatgtgcagtacctgcagtatgtccaggcgctcaagcccctggcgctcgtcatggaaaatgtccccgacatcctcaactggggtgggcacaacctcggggatgaaatctgcgagtcgctcaaggccatggactaccgctgcgcatatacactcctgaatgcggcgagctacgacgttccgcaaatgcgcgaacggttctttctcgtcgcagtccacaaggagaccaggagcgaccccagctttcccgtgccgacgcggaaggtggattttccacggggctattccagcagccgcaatgtagccctcaagaacgtcctggcgcagtcctcggacaaagggtcctggtatgtcgcaccgcctgccgccccagcgaacgcacctcccgcggtgacagtcgccgaggccctcgcggatttgcccgaattgacggatcatctccacaacagggatcgtcgtggcgcgcgtcacctcaacggtcgtgtgccccataccacggccccgcacagcgccttcgcacgactgatgcgggagtggccaggattcgagtccgacggttttctcagggatcacgtcacccgctgcctgaccaagcgcgactaccggctcttcgaagccatggagcccggggaggactatccgaaggcacatgtgcgagccacgcagttcttcgcacaggaattggagaagcgacggagatcgggtgctcgcctcacagagggctcacttgagtacgaggagctcaaagccgcattcgttccgccgtacaaccccggaaagttccccaacaagtggcgcaagatggccgccgatgagcccgccagaacgctgatggctcacctgggcaaggatacctacagccacatccactacgactcaggtcagcagcgagtgatttcggtgcgtgaggctgcgcgcctccagtcctttcccgatgggttccgcttcgccggaaccatgaaccccgctttccgacagatcggcaacagcgtcccaccactcctggcctggcacatcgcggacgaacta

SEQ ID NO: 2057 - DNA, 369 bp, Myxococcus xanthus
ccaatgggcctctcccgttccgaacagatgtcgcggatccgcggccgagacacctctcccgagcgtctgctccggtcggcgctctggcgggccggactgcgcttccgcctgcacacgcgaactactcatggaaggcccgatgtggtcttccccaggcacaaggttgctgtcttcatcgatggctgcttctggcatgggtgccccaagcactatgtgcgcccgcgaacgcgtgacgagttctggtcctccaagcttcgagaaaacgtcgagcgggaccgccgacaaacgctcctcctcgaagaaggtggctggcgcgtctgccgcttctgggagcaccagatcttcgagtccctcgcggaagtagtcgag

SEQ ID NO: 2058 - DNA, 702 bp, Myxococcus xanthus
ctcaagttagctcgccaccgggattcgagtggggacgacaagcagactcacgcgcggacgcttcgagagctttcggcactcctccttctggaccatccgaacatcgtcaagcaccgtgggtatggatactccgagcagggaaatgtctatctcgcgctcgagtacgtagaggggtggacccttgctgaatgggcggagcgtaaacaccccacggttcaagaggtcttgcaggtcttcgacaagatttccgccgcgctttcgtacatgcacggccgtggcgtcctacatcgggatttgaagctgtccaacgttctgattcggaagagcgatggagagccggtcattatcgactttagctgtgccagctactcgttggctgaagagctgacggattggggcttgcctccggggacggaccgctttcgcgcgccggagcagttcgcatggcttcgggagcacaaggccgaacagcgcgcgaagtacgccttccgcgtcgcggacgagattttcgcggtcggcgccatgctctatgagttgctgaccgacccccgacccacggaggttcaagcgcgagttacgctcaacagcaccgtcatgaagccgcctcctgcgcgtgcgttgaacgtgcgtgttccagaagctctgaacgacctcgttgattgcatcctgtcgcgtgacccggccaagcgccccgtcgactca

SEQ ID NO: 2059 - DNA, 261 bp, Myxococcus xanthus
gcgcccacgccccgggccgagcatctcgctaccgggccgaatcaggtgtggagttgggacatcacctacctgaagggcccggtgaagggggctttcctctacctgtacttggtggtggacgtcttcagccgccgcatcatgggcttcgaggtgcacgaggaagagtcgtccgagcaggccgcggccctcatccgccgctgctggcaggaagctggctgctccgaggggcttgtgctgcattcggacaacggtggcccgatt

SEQ ID NO: 2060 - DNA, 1212 bp, Myxococcus xanthus
ccccccaacggagagaggtccgcgaccagccccgtccgtccgggcgtgccgtccgtcacccagggctccaaccccgtctcgccgccgtccgcgctgaagagcagcgtcccggcaccggtgtcgaagagcggcgagtagttctcgtcgccggtgaagagcccccggctgagctcccgtgtccccgcttccgtgccatccgtcacccagaggcccacttcgcgcggcgcgggccccgaggtgccaatggccatggacacgtagagcttcccgcccgcgaccgccgagtactcgacgtagggccgcgcgtcgggctggcccgcgtagcggttgggcagccacgtcgccgtcgccttgccaccgcccgcgagcgacaggcgggagagcttcaacgcggagccgcccgcggtgccagaggccacgtagacatacccacccagcgcgcccagcaacctcacgtagccgccgaaggagtccaggcgcaccgtgccgcccggcgtgccatccgtccgccacacctccgtgatggggccttcatcgtagaaggaaaacacgctcaggcccgtcgcagtgacggccgtgccctgcgtccagaccagatctgcgtccagccgcttgacgaccgtggtccccgccgccgtgccatccgtccgccacaggtaggtgccattcgccgcgtcgtgcagggtgaacagcagcgctcccgcgaccgggggcacccccgactcaaacgagtcctgcgcgccgaaggtcaccaagcggaacgttcccacctcagtcccgtccgagcgccacagctccagcggccccctcgaggccggtcggcggaagaaggtcagcacatcccccaccgaagcgaagagcatcaggtcgtcactggcggggcctggcgcgaagtcccgcacgagccgcgtgcccgcctcagtgccatcgctgacccacagttcccgtccgaccacggggtccttcaccagaaagaagacgcgagtccccaccgcgacgagcggcgagaagtcgcggtaggtccccgcaatcacggggaactccttcacaggcacggtgcccacggaggtgccgtcactgcgccacaggacgccggggccgtcgaagaggtcgaccacgaagaagagcgtgccctccgcgttcgtcagccagtcggggaccggcaaggcgttggaaggcaccggcacacccggcggcaggacgtccttcacc

SEQ ID NO: 2061 - DNA, 255 bp, Myxococcus xanthus
gcgggtgttcagcccgacgcgggcattgagccggacgcgggcattgagccggacgcgggcattgagccggacgcgggtactgagccggacgctggcactgagcccgagcccgagcccgacgcaggcactgagccggacgcaggcactgagccggacgcaggcactgagcccgacgcaggtaccgagcccgacgctggcacagagcccgacgctggcacagagcccgacgctggcacagagcccgacgctggcacc

SEQ ID NO: 2062 - DNA, 3777 bp, Myxococcus xanthus
acggcgtgcgccgggatgggcgagcaggcaggcgttgacggcggatgcctgggccccggcgccgccctcgcgggctcccatgcggtgagcgcggaggcctcaaggtggcgccgggccacggggagctacttggacttggaaggtaccttgagcgaaaaggcctgctcccgtggcgggaagatggcctgtgcggcgccagagaccaacggcgaggcgtcctgctggagccgcgccagccggcccagccgctcgggcgtccatccgcgccccggcgccgcgtcgtgcaccaggcaccagacagccacgcgccgagcctccgcgctcgcgctcgcgctcaaccgggcctccatcgcctccagctcacccttgggcaacatgctcacgacgagacggcacgcctccagggcatccgcatggaggaggcctgcctcccccatctggaccagcgtttcagccaactccagcggtgaccgtgccgccatcacacattggatgtacagcggcgccagacgactgtcccgggagaggacccgctctgccgcgcgcgccgcctgcatgtagctggcgcgggacttcacctccaccgccagcaactgcgtcaccgcggtgttcagtgcgcgtcggtccaaagccaccgcctccaacatgccctccagccgctccaggtcgcgttcgttggagcgatggagcagggccctcatcgcccagctcacctcttcatcgtatggcgacgtcagccgagccccacaggcatcaaggaaggcgcgctccacatccctgacggggagatacgccgcgcgcgaaagcaggccaatgcgcgcctccggctcggggcgagccagcacccgcccgagcagcgcggacagcttgcggtcggaggtctcggtgaggcggttcgcggggatgtctcccagccgtgaagccaccacccaatcagggtcctccgcagcgcgggcgaagacggcccaggtgggctcgcgctccaggtggtcccagagcgcgcgcagcagggcgatgcgcacgtcccgatgcaggctcattccgcccaactccaggagccgctcgtaggcggcctccacgcgcagctcccccagcaggcgcacgacctccttggccacggtgactttggtgagggggacgcccgccagcagggacagcacgcgcgcgggaggcatgccgttgaaggcacggcgcaggccatagatggcgatgcgcgcacgggcatcctccaggcagcgcagcagcgtggtcacgccttgcccctggtcgcaccggcccagcacccggatggccctctcccgcaccacgggccgcgcgtcgtccacccgggtgcatagtccctccatcgtcccccaggtcaacgccgcgagtgtcgagacaccccagagcaacgtcggcgtgtctcgctccgggtcctcgaccagccggcagaccgcgtgcgagtagagggcgctctgccgcgcggtccaccggaagaaaccgcggtcatcgaacgccagcaaccaacccgtcttctccgtcgagaaacgaccggtgatgacgggcgcgctcaggtagggcgtcagcagctcctgcctgcgccgatgcaggtacgtgttcacgaccgggaagcagatgacgctggcatcggccttgagcagctcgggcaggaagccgtcgaaggcggcccacgcctgtcgccggagcaccaccagggcggagtgcgcctcctttcccaggcgaagcgcgacccgcttcagtccggagctcagctcgggatgcagcggtcgcgccgcatcctccgagtgggccaacgcgatgacttcggagaaccaccccaggtcgaggaaccgccggaccgtggcgcccacggtggcttcgaagcccgcgcggtcgtgcttggactgccactgggccatccccagcgccagcaagggccagggcgtctcctcccgcatggacacaatgagttcctgcagtcccgcgaccagactcacacgagcgcccaggctgttcaccaactcgagcagcggcccgccccgctcgcgctgagcccatccccgggcaatgtccaggagctggggcgcggcggcgcgcacctcgtcatcggtgaggtactcgcccacgcgagcgttgaagagccgaccacgctccttgaggagggtggccagccacgtcgccccccattcgggggccctggcgaaggtgcgcagcagcaacgtctccgcgaactccgccgtctgataggacaggtcggccgcgtccagcgcgtcgcgcaacatccggcccaccgcctcggtgtgctcgcggcgccacacgcggcgaggccaccgcacgaacgcgcccagcatcagcatccgcacggggtcctgctcgttcttgcgcgccaacgccagcggcagggcacggtccaccaaggcgggctcgtccggacgcagcccggggatggccaacagcgacgccaacgccatgcctcgcacgctggcatccgggtgaccgatgtatcccttgagcgccgcctccgcttcatcccacggcagcaggcatgcgtacctcatgcgttgctcgggccgggagcccagggccaccacctcgtggagatgccggcgcgcctcgcgctcacgcaaatcgatgggcagcgcggtcaccgtctccagtgcgatgacgccatcgctgttcctcgcggcgacgctccagcgggcatggacgcgctcccgttcgcggacatcggaaatggagcggagcagctccgtcccccagaccggcgccacatccaccgtggcgcaccacgcctcgacgacgacgcggcgcgcggtctcggagagccgggggagcagcgtcttcgcatcccccagtgagctgggagcatgacgaacgagccacacgagcgagtccatgctcaaccgcgcggcggcgcgggcaaactgcccctcgaaggggaacgcgtgctcgtgccgctggagcagcgacacggcggcctcgggccgatggagcaccaggcaatgccagtcataggcatcgggatggatgcggcgggagagcagcagctcgaacaactccaaggccgcgtcgggggcctggtcagcgatgcgatgcaggtacgcgttgaggtacatgcgcgtcaccggatcgggttcgcccgtcacggccctcaaacgtgcggcgaagacctccgcgaggatgccgggggcgttgtgcgccatccgactccagaagcgcacactggggcgcgccagtgcgctggggaggtgacggcgaatgccctcggacgtcgccaaggggacggcatcagcgaagtcaggcacgcccgtgcaggtggccagccagtcgagatacgcatcgatgacggcctgccgccgcgtcttcatgaacccccagaggagtccctcctggcggcgaacggcgcacgccatcttcagggtctccagcgcctgggcgtcgtcacaggccaggggcaccagtcggaaggccagagaacgaacacgagcggacgcatcggtggtggcggagagcacctgccccccatcgcgccaggtgaactgggcacacagggcgaggtaccgctcgaaggcatccccttgagacagcaccccaagcaactcgcggacgccagggttcgtcggcgccaggcgccccagctccaccatcctgcggacgcgggcatcgtggtggataccggacagctcgtcgcgcaactcggagaggcgaggctcgtgcatggccgcgggagactgcccgacgttcccgcgcctgacaaacagcgggccacgcccgcgcgcgggctccagcaactccgcg

SEQ ID NO: 2063 - DNA, 440 bp, Myxococcus xanthus
gtggatagaacgttactcctgtgcggcacgtcatcttccgggtggagaaggagcgttacgggttgccgctctcggcggtgcgggaggtcgtcgtgcctcccgagcgcttcacccgtgtgccgcgtgcgccactggccattacaggcgtaatgaatctgcgcggcagggtcgtgacagtggtagagctgcggcagcttctgagtcttcccgagggtcctaccccgcccggacgggtggttctactggaccgcgggcggagagacctgggactgttggtaacggacgtagatggcatcgaagcggtggagcgggtgagcacggcgccaggaaagatgacgcctgccatccggggcgtcgccaggctgggtggcctgggagtgactgtcctggacccagaagggttggacgccgcggtggttgccttgttcacccattccaag

SEQ ID NO: 2064 - DNA, 249 bp, Myxococcus xanthus
gtgagccttacgcacatccagtccttcgtcgccgttgccgaggagtgcaacgtgggccgggccgcgcgccgcctgcacctgacgcagccgccgctcagccgtcacatccaggcgctcgaggacgaactcggagcgcgcctcttcgagcgaacccgggctggcatgcgcctgctccccgcgggcgaagccttcctgcggcacgcgcgtcgcatcctcgcggaagtggacgccgccgtgctcaccgtgcgg

SEQ ID NO: 2065 - DNA, 4902 bp, Myxococcus xanthus
gaccttcttgagcactttcggaccactgccgcgacgaatcgcgagcagggcacgtacttcgaagagctaaccgtcgccttcctaaagaacgagcccgcgtaccgagagctgtaccgaagcgtcgagccatatgcggcatgggccgagcgccacagcctcgacaagcgggatgccggcatcgacctcgtggcggagtccttctccgacgagatccacgccatccaatgcaagctgtacgcgcccgactaccgcgtgcagaagggtgacatcgacagcttcttcacggcctccggcaagaagccgttcacccaccgcatcatcgtaagcacgacggacctctggagcgaacacgcggaggaggcgcttcgagaccagaatacccctgtcacaaagattgacctcgcggcgctcgagaagagcgccatcgactggtcccgcttcgcgccgcggaaggcgcccgtcctcaggaagaaaaagacgccccttccgcaccaaaagaccgcattgaaggcggtcctcgaagggctgaacgcgtccgagcgaggcaagctcatcatggcttgcggcaccggaaaaactttcacaagcctcaagattgccgagcacctcgcgggggagggcaagcgtgttttgttcctcgttccgagcctcgcacttctctcgcaaaccctcaccgaatggacgcaagagagcgaggcgcgcattcagagctttgcggtctgctccgattcggatgtgggcaagcggcgcaagaaggacgatgacaccgtccagaccttcgtccatgaacttcagtaccctgcgacgaccaacgcagcgcgactggcggcagcgatgaagaagcgccacgacgccgagcacatgagcgtcgtgtacgcgacctaccactccgtcgaagtaattcaccaggcgcagaagaagcaggggctcccggagttcgacctcatcatctgcgacgaggcgcaccgcaccaccggcgcgaggttcgatggggaggaggagagccacttcgtccgggtgcacgatggggattacatccgcggcaagaagcgcctctacatgacggcgacgccgcggattttcggtgacgcggcgaaagccacggccgagcgggacaacgttgcgctctgctcgatggatgacgagcgcctgtacgggccggctctgcacgtcctcacgttctcggaggcggtcaagcgcggactgctcgtcgactacaaggtcattgtccttgcaatcgaggagtcccacgtcagccgccgcatccagagcctgctgaaggatgcgaacaacgagctgcgtgtcgacgacgcagcgaaaatcgtgggttgctggaaggcgctctcaaagcagggactccaggaaggaatcacggacgaccatgctccgatgaagcgggcggttgcgttttgccaagtcattgagcgcccgacgggagcgaaggtccacaaggtcggctcgaagaacatcgccgacatgttccaggctgtggtcgaagcctaccagcagagcgagccagcagacggcaacgccgcaacgtccgcggcactgcggtgccaagccgagcacgtagacggcagcatgaacgcctcggagaaggaggcgaagattagctggctgaaggcggagacgcccgaggatacctgccgcatcctgagcaacgtgcgttgcttgtccgaaggcgtcgatgtacccgctcttgacgcagttctctttctcacgcctcgcaaatcgcaggttgacgtcgtgcagtcggtcgggcgcgtgatgcggaagccggccgacagcagtaagaaacgagggtacatcgtcctccccgttgtcatccctgcgggagtcgagccccacgatgcgctgaacgacaatcagacgtacaaggtcgtctggcaggtgcttcaggctctgcggtcgcacgacgatcgcttcgatgcgatggtcaacaagctcgagcttgaggcgaaggacctcacgaagatggaggtcattgcagttaccgacaagattacgaagcgcactaggtcggccgaaggcaagaaggaggctgcgaagagaaccgcgaggggcgggaatacgattggtgctccccagaacctcagcccgaagcccgagcagcaggagatggagttcgagattggtgagatcgaacacgccatctacgcgaagctcgtccagaaggttggcaaccgccaccactgggaggactgggcgaaggacatcgccaagattgcccgcacacacatcgaccgaatcaccggcatcctcgatgagtcgaggaacacgcgtgagcgggaggccttcgatcggctcgcagaggaactgcgcgacgacctgaacgacagcatcacccgggacgaaatcatcgaaatgcttgcgcagcacctcgtgacgaggccggttttcgaggcgctcttctcaggccacagcttcgctgccgagaactcgatgtcgcgcgcaatgcagggagtcctcgatgcactccaggagcatcgcctcgacaaggaagcgagcaccttggagaagttctatgcctcggtgaagatgcgtgccgagggcgtcgagagcgcccaaggcaagcagaagatcgtcgtcgaactctacgacaagttcttccgcaacgcgttcccgaagatgtccgagcgccttggcatcgtgtacacgccggtcgaaatcgtcgacttcatcctgaagagcgtcgaccatctcctacgcgccgagttcggccaaacgcttggtagcgagggagtgcatgtaatcgacccgtttaccggtaccggcacgttcatcacgcgtctgctccagagcgggctgattgcggaggaagatctgccgcgcaagtacgccaaggagattcacgcaaacgagatcgccctgctcgcgtactacatcgcggcgatcaacatcgaagcggcctaccacggactcgtaggcgggatgtacgtgcctttcgagggcatttgcctaactgacaccttccaactctacgagaaggacgacctcatctcgcgcgtgctggtcgacaacagcgcgcgccgaaggaggcagaagaagctagatatccgggtggtcgtcgggaatcccccatactcagagggccaagagagcgagaacgacaacaacgccaacctcgcctatccacttctcgacgcacgaatcgccgcaacctatgtggcgcgctccgatgcaaagctcgcgaagaataactacaacagctacatccgagccatccggtgggcgagcgaccgtgttggcaaccgtggaatcgtcggcttcgtcaccggggcgggtttcgtcgaatcgaacaccacagacggactgcgtcggtctttgaaagaagaattcagcagcatctacatcttccatctgcgcgggaacgcacgttcgtccggcgagcgccgccgaatggaaggtggaaatgtctttgacatgggcagccgcgcaccagttgcaatctcatttctggtgaagaacccggacgccaaggagcacggcagcatccaattttacgacgtcggcgactacctttctcgcgaccagaaactccaagctattgcgaacttcggcagtatcgtcggaatcaacgaggcgaacggctggacccgcatcacccccgatgcccatggtgactggcttaggcaacgcgatgagagctttgataaatatatcgctcttggagtgaaggacaggaaagagtcgtcgccacgactgttcgaaaacttttcgcttggcgtcgtcacagcacgggacgcctgggcctttaatgcgtccaggcgcggcatcgccgagaacatggtgcggttgattgagttctataacgctgaactcactcgcttcaacaaggcgcaccagcagctcgataagagggggcgcgaggcacgaatcgaagacttcatcaatacggatccgagcaacatcagttggagccgggccctgaagaatgagctggccaaaggaatcgccttggagttcgacgcaaggcgaattgtgccgagcatctaccgccccttcacgaagcagtggctctattttgaccgcaagctgaacgagatggtctaccagatgccccggctattcccgcacgcgagcgccgagaatcgggttatcatggtcaagcagcgctggtccggcacgggacatcttgcgttgatgctggacgtcgtctccgagtttcagatcgacggcggagcgcaatgcttccctctctacctctacgatggggggaacagcgcggatggagctgacgagtcgcagggccagctctttgctactgcgaagaaggtgcccgccagccttgggcgccgtgacggcatcaccgacgtaggcctcgctcacttccgggacgcctaccctggagagaccatcacgaaggaggacattttctactacgtatacggaatgctccactccgccgattaccgcgagcgcttcgcagataatcttggtaaggagctccctcggatcccgcgcgtgaagagggctgaggacttctgggcattcagtcgcgccggccgcacgctcggcgatctccatgtcgggttcgagcaagtcggcgagtatccagctcgtgtcgaaggtcccgccaagcctttcggagcgagttaccgcgtcgagaaaatgagattcggcaacggtaaggataagagcgtcatccactataacgaccacatcaccgttcgcgacatcccactcgaggcctacgagtatgtcgtaaacggcaaatcggcgatcgagtgggttgtggagcgacagtgtgtaaagaccgacgacgcgagcggcatcgtgaaggacgcgaacgcctgggcggctgagacagtccgagacccgcgctattcgctgtcgctcctgctacgcataatcactgtcagccttgagacggtcaggctcgtcaatgcactcccgcgattg

SEQ ID NO: 2066 - DNA, 276 bp, Myxococcus xanthus
gtgaaggttgccctggtccacgattggctcgtcacccaccgaggtggtgagcgcgtccttgatgccctctgcgaagtcctgccagacgcggacatctacacgctcatccacaagccgggctcccagtcgccggccatcgagtcccgccgcatcttcacgtccttccttcagcacatccccggcatccacgcgcgctaccggcacttcctgccgctgatgccgaaggccatcgagtccctgcaactccaggggaagtacgacctggtcctctcctcc

SEQ ID NO: 2067 - DNA, 246 bp, Myxococcus xanthus
atggtccgagagctcgtccccgacgcattctggcagcgtgtggccccgctgctgccagcaccgaagccgaagaagaaatccggacgccctcgtgcggatgaccgcgcagccctggaggccatcgtcttcgtgcttctcagcggcatcccttgggagatgctgcctcgcaagcaattcggcctctctggaatgactgcctggcgccggctggaggagtggacgcgagcgggcgtgtgggaggaactg

SEQ ID NO: 2068 - DNA, 636 bp, Myxococcus xanthus
gacaggcaggtcatcctcgagaagtacggcccctacgtccggtcgctggcggcgaccgtgcgcaagcagttcaacgcccagctggagctggatgagctgctggcctacggccagataggccttctggaggccgccgagcggttcgacccgaaggtcggggccaacttcctcaccttcgcgcactaccgcatcaagggcgccatcttcgacgggcttcggaagatgggcgtgctgcggggttccgatgcccgcaacgcctatgtgggagagcgggcggcggcgtatctgggaaatctttcggatcgtgaggccggagcaggcaaccgcggcagctcattcgacgatgatgtgaatgacatctcggatgcggtgacggggctggcgatggttttcgccaccagcatcgaaggcgcggacacggcgggttacaccgacgagtcgctccccgtcgacatccggatggagcaggagcagctgaagacgcgggtgcgggcggcgatcgagaagctcccggagaaggagcgaaagctcctgatggggtactacttccagggcaggacgctggaggaagcgggagcggagatagggcagtcgaagagctgggcttcgcggctgcatgcgcgggcaatcgaccgg

SEQ ID NO: 2069 - DNA, 903 bp, Myxococcus xanthus
tgtggtggtccggagctggagaggcaggacgtcgaagcgacgggtcgcatggaccaggcgattgtgggaggggtcgaggcacgtcctgggagtcatccgtggattgtcagcctgcagcaatacaacgatcacttctgcggtggttctctcatcagggttggcaacaaggaggagagcgatatcgtggtcacggctgcccattgcgtctacgacggaacatccggattgactgtcgtcgctggggctcatgatttcaatcgcccgtcgtcctcgcagcaggctgtcgtcgcgagaaagactgtctaccatccagagtacaacccggatacgacggcgaacgatgtcgcggttgtcgtgctcgacaagcccatcaagttcacctccacggtacagcctgtgtgtctcccggaggattcgttctcggtgagcggtgcttcgtgcggcaagagcagtgttgtcatgcgccccaacctggtcgcgaagtccccgttggctgaaacgtcgctcagccctgtggggctctcgtcggtgggtgcggatgtcccggatggtacgatgatggtgaccgcaggatggggtcttatcagggaggggggatacgatacatcctccatcttgatgcaggtgtgggttcccaccgtgaactctgagaccctgaagactgcgtacaagaaagaaggcatcaccatcgatcccaatgtaatgctcggggctgggtacatgtcaggggggaaggatagctgccagggggacagcggagggccgttggtcgctcaggtcggtggccgatacgtgctctacggaatcacgagcttcggcgtgggctgcgcgaggccgggcttccctggtgtctatgcccgggtctctgagttccgttcctggatcaatacgcaggtcaaagac

SEQ ID NO: 2070 - DNA, 228 bp, Myxococcus xanthus
ctgccgggcttgcgcgcgcagttggcgacatcccggatggtgacgcccgagtacttccgcgacgagctgcgctcgttcagaggggcggctttcagcttcgcgcccacgttgatgcagaccacgttcctccgggcgcaagcgcggagcgaagacgtcgaccacctctacctggtcggggcggggacgcacctcggagcaggactgcccgcggtgctgtgctccgccaag

SEQ ID NO: 2071 - DNA, 423 bp, Myxococcus xanthus
gtctgcggggacttcatctgcggcgtgggggaagacttcctcacgtgtcccgaggattgtggagttgcggagtactgcgggaatggttggtgtggcctctgggagaatgaagcaacgtgtccggcggactgccagtgcggagacggcatctgcagcggcgacgagagcgttgaccgctgcccgatggattgtggctgtcccgcgcagtgtggaaatggcgtctgcaacaacaacgagaccccctctacctgtcccgccgactgcggcaccctctgcggagatggcgtctgcaatggcggtgaggacgcctatacatgctacctggactgcggaagcttctgtggcgatggcatctgtggcttgggcgaagaccgctggagttgcccgagcgattgtgggcggccctgcgttgggaagatctgt

SEQ ID NO: 2072 - DNA, 2514 bp, Myxococcus xanthus
gagagcgcgtgcgtctccacgtcctcggtctcgaagaccttggtcagtccgtccaggtggatgagcgccttgccgggctccgcgcccgcgtcctcctgcgccaccgcgccttccggggaagcagccgtcttcgtgtcgttcgtcatcatcgctgacccacccgctccaccgcgttccacgcggtcatgtctgaagtctccatcggcctactccgctcgcagggcgatggccgggtccacgcgcgtggcccggcgcgccggaagccaggcggccagcacggccaccgtgcccagcagcaacgctacgcccgcgaaggtccacccgtcgtacgccgccaccccatacagcattgcatccaacagccgcgccaatcccagcgacagccccaggcccagcaccacgcccagcgcggtgagccgcaggccctgccccagtaccagcgtcagcacgcgggtccgcgaggcccccaacgccatgcggatgcccatctcccgcgtgcgctgcgccaccgagtagccgatgacgccggagatgccgagcgccgccagcagcagcgccgtgcccgcgaacaggcccatcaacagcgccgacacctggcgggagctgatggactcatccaccaatcgcgtcagcggcgccaccgcgtacaacgccaggttgccatccacggcgcgcaactccgcctcgatggcggtgcgcagcgcctccgggctgccgccggacttcgcccggaccgcgagcgccaggaagggcgtgggcaccttcgccgccgggtagtacgcggcgggccgcgcgggcgtatccaggccccattcgcgcacgtcgtccacgatgcccaccacggtggtccactgcgccgtgtcccagtgcagcttcaaccgctggcccagcgcatccccctggggccagtagaggtccgcgaaggtcttgttgatgaccacctgccagggcgcgtccggcccctccgtcccgtctccctccaggaggtgcccctcgcgcggggtgacgcgcagcgtgcgcagataacccgggctgacggagcggaactccaccgcgggccagacctcatccggcgcctgcggccgtccctcgatgtcgaagctgctgtccgagcgccctcccagcggcagcaggttggtgacccccacggcctccacgcccgggagcgactggagccgccccaacagctcccgctggaaggccaccttgtgtgccgcgtccgggtagcgcgcggagggcagcacgagcttgcccgtgagcacgccctcgggcgtgaagcccgcgtccaccgcgcgcagggccaggaagctcttggtgaacaaccccgcccccaccaggagcaccagcgccaccgcgacctgccccaccaccagccccgcgcgcatccggcccgaaccatggccctccgtgccccggctgccctcgcgcatggcgacgctcaaatcctcccggctgccatgcagcgccggaccgagcccgaagagcacgcccgtgaggaggctcacgcccatggtgaacaccagcggccgcgcatccagccgcacctggctcgcgcgaggcagcgcctctcccaccagcgccaccaacgcgtccgtgccccacaacgccagcagcatccccagcaccccgcccgccagggacagcaccaggctctcggtgaggaactgcgccaccagccggccccggctcgcccccagcgcggcgcggatggacacctcgcgtccgcgcgccgccatccgggccaacagcaggttggccacgctgctgcacgccgccagcagcacgaagcccaccgcgcccagcaacagccacagcgtgccgcgcacgttgcccacgaccttttcgtccagcgacgtcaccgagaaggaccaacccaccttccggtaccgcgaggggacggcctcctccatctccagcgccacgcgcgccaggtccgtgcgcgccgcgtcctgcgtcacgccgggcttcaaccgtcccaccaccgacaggaaccgggcgccgcgctggtcctcctgccgctgtgtctcggtgggcacgaagggcacgtacatctccgcccaggcggggtaggccactcccgcgggcaacacgcccacgaccgtgtacggctcgccgtcgagctgcatcgtctggcccagcacctgcgcgtcccgcgcgaagtgcacgcgccacgccgtgtcggtgagcaccaccacccgctcacgcccctggacggcctccgcctccgtgaaggcgcggccgagcaccggcgacacgcccagcgtggcgaagaaggacggtgtggccgccaccgcggcgagctgctgggggatgtccctgcccgtgagcgtcaggttgccgccccggtaggccgccaccgattcgaaggcgcgcgacagcgtcgccaggtcgaagtactccggcacggacagggagatgtcctcgagcccggcttgcgcgatgttcccctggaggtgcaccacccgctcgggctccgagaagggcggcggagtgaggagcactccgttcaccacg

SEQ ID NO: 2073 - DNA, 456 bp, Myxococcus xanthus
accagcaccatcatcgggacggtgcgtaacgcatatcggcgcgttcccgtcgccaatgctgtcgtgaccgcgagttcccccaacctccagggggaattgagagtctcgaccaatgcacaagggagctaccgcatcccgcagctcccaccgggtgagtacacgctcacgttcgagaaggaagggttcaagccctacacacgctcggccatccaactgcgtctcgaccggaccatccgggtcgacgtggaactcctctcagctctacccgcggagctggtaggtgtcgtcggcgctccaccgaccatcgacgtgggctccacgaccatgggcgtgaacgtggatcaggagttcatcaagcgcatcgccgtcgcccgtccgggcggccggactggcgcgacccgcgtctacgagccccccaacgcgatgagccgcccccacggtgtgtccctcaacggt

SEQ ID NO: 2074 - DNA, 378 bp, Myxococcus xanthus
gcacgacgaagcaacgatgagcgcagcgcgacgacgcggcaggcgctcgtgagcgcgagccgggcgctgttcgtggagaaggggtacgcgcagacgtcgacgccggaggtggtggccgccgccgccgtgacgcgcggggcgctctaccaccacttcgaggacaagcaggcgctgctgcgggcggtgctcgagcgggaattcgccgagctgcgcagggccatcgaccaggcgacgccgccggctttgggcgcgcgggaggcgctcatcgctggaagtctggcctacctcgacgcgatggccatcccgggccgcacgcgcctgctcctcgtggaagggccagcggtgttcggccatgcggagatgatggcactcgacgag

SEQ ID NO: 2075 - DNA, 726 bp, Myxococcus xanthus
ggtgccaaccctcccgtcgttctgctccatggactgatggggaacggcgcctgctggactcccctggcgcgtgtgctcgaaggtcaattcgacgtcgtcatgcccgacgccagagggcacggcggttcgagcacgccgcaccacggctaccggtacgacgaccacgcgaacgacgtcgtgggcatcatccgcggtctggagctctctcgtccggtgctgcttggccactcgatgggcggaatgaccgccgcagtggtggcgagtcgagggacggggggcctccgcggcctcatcctggtcgacccgacattcttgagccccgagcgtcaacgcgaggtgcgcgacagcgacgtcgccgaccaacaccgctgggccctcggcttgcacaagtctgacctcgttgcacaggcccgagcccgcaacccgcatcgctcgcccgaaatcatcgaccttcttgccgaggcgagactgaacacccgcctgggcgccttcgacgttctcacgccgcccaaccccgagtatcgcgacgtgatgagcgcgattggcgtcccgaccctcctcgtcattggagaccgcagccccgtcgtcacgctcgagatggcaatgggactgcggagcctcaacccacgtgtgcgaatcgaacaggtacagaacgccgcccacggtcttccgtttgaccaacccgagcgactgggagccgtggtcgtgcagttcttgcgcgagctg

SEQ ID NO: 2076 - DNA, 474 bp, Myxococcus xanthus
ccggtcctctacgtggacgaggtggacatccatctcaatccgaaggtgggacgcgactggtgcctgcccggccagcgccgggtggtgctcacgccaggcaacaacaagaagcgatacctggccggcgccctggactcgaagacgggccgcctcatctgggtggaggacaagtcgaaggccagctcactcttcatccaactgctttggcgcatcgccggtgagtaccctggcgccccacgaatccacctcatcctggacaacgcctccatccacagcagccagaagacgagaaaggcgctcgagaaactcggcggccggattgtcctccacttcctgccgccttactgcccggacgccaatcgcattgagcgcgtctggctggacctccacgccaacgtcactcgcaaccatcgctgccgcaccctccagaagctcatgcggcgcgtccatgcctacctgcacgctcgcaacgtc

SEQ ID NO: 2077 - DNA, 699 bp, Myxococcus xanthus
ccaacaaatggaatagctgcagtgaatgcaaatggaacgtttagttatcaaccaaacttgaattttaatgggacggatcagtttacggtattggtgtcagacggtcagggaggaacggcagtttcaacggtgagcattaatgttatccctgtcaatgatcccccaattacgtccaatgttagttttacgattgcggaagatagcacgttaatcaatcaagtagtggcggtagatcccgatggaaatccgttaacgtttagcttacaaacggcaccgggcaacggagtggccgtggtgaatacggatggaacgtttagttatcagccgaacctgaactttaatgggacggatcagtttacagtgttggtgtccgatggccaaggaggaacggcagtttcaacggtgacggtaatagtcacgccagtgaatgatgcaccaacggtgccaaattacacgtttagtacgcaagaagacagccctgtggtaggagcagtggtaggaacggacgtggatggaaattctcttagttatcagctgcaaaatggtccaacaaatggaatagctgcagtgaacgcagatggaacgtttagttatcaaccaaacttgaattttaatgggacggatcagtttacggtaatggtgtcagacggtcagggaggaacggcggtttcaacggtgaccatcaacgttatccctgtc

SEQ ID NO: 2078 - DNA, 387 bp, Myxococcus xanthus
gtgagagacctggacatcaccgaggtggcccggcgcacgggcgttcctgcctcgacgctgcgtttctatgaagcaaagggcctgctctcctcgacgggcaggcgaggcctgcgccgcctgttcaatcccgacgtgctggagcggctcgcactcatcgccctgggacgcgaagccggcttctcactggatgagctggctcggatgttcgcgccggacggacaaccgcgcatcgaccgggagctgctgacggcgaaggcggaggaactcgacagcaccatccggcggctgagcgccatgcgcgatggcctgcggcacgcggcgaactgccccgcgccgagccacatggcatgtcccaggtttcgccaactcctggcggctgccactgcc

SEQ ID NO: 2079 - DNA, 1080 bp, Myxococcus xanthus
gcagcgtcaccgccgatcagcttcacgccatcgaaggcgtagcccgcgccataggagacgtccgcccaaacggaagcgaagccgtccttcaacttgccgagtgcgccgtcggcgaaccccttcagcccgccgagaagcgcgtcgccgttcaggtccttcaacccttcgagcgaggccgcgacgccgtcgaggttgagcgcgcgggcgagaggcgccgccatgcgtgccaggttgcgcacgacgaaggcgaacgtttcgagctgcccgcgtgcccacgtcccgacaatggccccaagccccgtgaagagttcccggaagaaggccaccgcgcgcccagcgacttcggtgacgccccgccaagcagacacgaacgcatcgcgcatgccggtgctcgcgtcgttccacgccttgtaaagcgtgcccgccagaagcacgacgcctgcaacggcgagcgcgacagcggccagaggcgccgccaccacgaggattcgcgcggcggcattgcggaaggccgcagcaaagctcgcgtcgacctgctcagcccccttcgcgactttcttcaggttgccctcaacaacgggagtctccccacggacgaagccggagaagcgcacgacggcctttcccgcgccgtccagcgcaggggcgacaaccgtacccacaatttcggcagtgctcttaacgacgccagcggcagtccccagcgcgccacccgcgagcgccgccgcagtcccccataccagcattgtcccaacggactgcttgaccgaaggctcaagtcgttggaaccacccgagcgcgtgttcaaggacttcggagagtctctcaatgtgcggcaggacggcttcgccgatttcagcgaagacgttggtgaagatgagcttgattctgtcgagccgctcggtgacgccgctgtcgaactcagccacggcggcaagcgcgccatacaggcccacgctgaacagcccgccgattgcgccaatcttcttcccgagcttctcgattttgtcggccgtctgcgcaacgtccgcgacaatgcgtcgcatggacttggagaactcgccaacggcggccgtgacg

SEQ ID NO: 2080 - DNA, 402 bp, Myxococcus xanthus
cgaacgggtgacacgcgaggtggtccagtgacgattcgactcaagcgagcgtacgaagcagcaagccgcacggatgggcggcgcttcctggtggaacggctgtggccgcgaggcgtacggaagacagcgcttcccctcgaagcctggctgaaggacgcagcccccagcaccgagctgcggaagtggtttgcacacgaccccgagcgctggtccgagttctgccgaagatacaccgccgagctcgcggcgaatcccgcagcatggcagcccctgctggaagccgcgcgccacggcacggtgacgctcgtctacagcgcccatgacaccgagcacaacaacgcggcggccctccaacagttcctcgaagaggcgtccggcggcgccgctccgaagaagcctcca

SEQ ID NO: 2081 - DNA, 5523 bp, Myxococcus xanthus
gctgtccgtgctggcggcggcccactgcgacgtcacgggggcgctgtccaggatgggctcggcctcccacgcggacgccgcttcgatgggctcggcctcctccatgacgggctccacgtccacggaggcgtcattccactccgcggaggcaggcgtggccgtgtccgcgagggagacctcttcagcggatgcttcgttccagttcgccgtctgctccgacgaccactcggtggtggcgggggcgtcccaggtcgcgctggtgtcgtggctggtcgcggaccattccgcggccgcgggggcgttgtccgcgggcgtgtcccactgcgaggcggcaggcgcgctcgttgaggcccattcggcggccggagcggcttcctcgatggggtcggcccactcggcctggacttcctcggtggcgggcgtggaccactctgcgtggggggcttccgtgggcgttgcccacccctgctgagcgccctccgccggagcggcggcccactcttcctggacttcttctgcctcgggggcggcccactctgcctgcgcgccttccgtgggggcggcccagacaggctgggcggcttcggtcgcaggcgaggcccactcaggctgggctgcggtttccgtggcaggcgtggcccactcagcctggacttcctcggtcgcaggcgaagcccattccgacgccggtgcagcggcatcggtcgcccactcggcctggacatcctccgtcgcgggcgaagcccactccggtgctggagcagtgccttcctcgggcgtggcccactcggcctggacttcctcggtcgcaggcgaagcccactccggtgctggcgcagcgccttccgcgggcgttacccattcggcctgagcttcctcggcagcaggattcgcccactcgccttgcgcctcttccgtcgcaggcgaagcccattcgccctgagcctcttctgccgcaggcgaagcccactccggctgcgcggcttccacgggcgctgcggcccagccggcctgcgcggcctcggtcgcgggcgtagcccactcggactgggcgccttctgccgcaggcgaagcccactgcgacgatgcggcggcttcggtggcaggcgtggcccactcgccctgaacctcttcaactgcaggcgaagcccactccgacgatgcggcggtttcggccgcaggcgtggcccactcggcctggacttcctcggtcgcaggcgaagcccactccgacgatgcggcggtttcggtggcaggcgtggcccactcggcttgggcgccctcggccgcaggcgaagcccactccgacgatgcggcggcttcggccgcaggcgtggcccactcggcctggacttcctcggtcgcaggcgaagcccactcaggctgagcaccttcgccgggcacggcttcggtcgcaggcgtggcccactcgggctgcccggcgttttcggtaccgggagcggcccagtcggttcgtgctgcttcagccgcaggcgtcgtagcccactcgggctgcgcggcggtttcggtcgcaggcgcagtccattcggtctgaacttcctcggcggtcgcccacccgttttcagaagaggcagtccattccgactgagcggtgtcggcgcccggcgtcgtccaacctgcctgggcatccgtagtggcgtcagcgatttctggcgcagcccattcggcctgggcctccgtcgccgcaggttcagccgtcagggtagctccatcctgctgggcggggtcgtcccactcggcttgcacttccaccggcgctgcgtcgagcgtaggggtcgacccatcggcctgaacctcagtgggcgaggcctcagaagactcggcccactcggcctggacttccacgggcgctgcttcagtcgacgccgtgttccagccgtcgcttgggggcgcttcagccgtggcccactgggcctggccgtcctcggcgatcggctcagcccactccgcttggatttcgccgggcgcggtctcggtggaggacgaagcccagtcggcctgggctgcctcgggcgtgttcgcagcccattctgtctgctcgctgccgagggcagcttgcgcggcggtctcggtccactgcgcctgcgcctcggtgtgcgcctgctccgcggaggtggcccactcgggttgggcttcaggggctgccgcgccttcggccgcaacccattcgggctggagctcggtggtggagtcggcccactcggcctggccagcctcggaggcgatgcctgtatcggaagccgcccactccgcgtggcccgtggcagccgccgtttgttcggaggtcgtccactcggaagcggtgacaggctccgcccactccgcctggagttcgacggtttccgaaacaggatcctcccagcctgcatacgcatcgctggcagcggcctgctcaccggaagtggcccattccgtctgagccgcttccgcagcgggctgctcggaagtggaagcccattcaggctgcagctcgatggcgcccgcgtcaccctccgccatcgccacactgcgctcatcggtcggcgcgaagtgtccgtgggccaggaactcgttcgccgcggcgagaggcacggcctcttcggggttcccgctcaggtcgaacatctcctcggcggaaggcgtgcgcgcggacgactgcggcggatctcccgccacctcgatcgtttccgcgtggaggtccggacccacctggaccggccggatctcgagcgacgggacatccgacgacgcgaagggcgcagcctccggcgggaagtccacttccgaagcggtggcctccgtaccgacttcgataacctcgagcgtgggctgctcgctcccgccgtcagcggcctggaacgatgcctcgtccccggcgtgtccgggcgcggactcgacatcgatgacatcgagcgagggctcgtcggacgacacctcggccgcgttgagctccagcgtggggacgcttccctgctgcgcgggagactcttcgctcacctccgagccatcgagggcgatttcagccgactgcggctcggcgacgtcggaggcctccagggaaatctccgcggccggctcaatcggggcggactcggcgacgtctgtggcgtcgagcgtgatttcggagggcgactgggcggaaggcgattcggcgacgtcggacgtatcgagagcgatttcgggctcgctcatctcggtcgcgtcgaggacgacctccttcccatcgaaggcctcactcgagtggtcgtaggtgctgtgagccgtctcgggcgcagtctcgatggcagccaattcgctgacgtcggaggccgcatactccgtggtggcaaactcctcggccgcgtccgtgctgccccatgcgctggatgcgagcgccgtgtcggaggtggcttcggcagcggtctccaccgagtccaactccatcgtggccgcatcactgacatcggcggtgtcgagcgccacttccggatacgcctcggcagtggccgactcgctcgtttcggacgtcgcgaaagcgtgctcgctcacagccgtgtcgctgacctctgcggcgtcgagcaccgcttcggcgtacgtttcaccagcggcggttgcatcgccttcgctgaaggcagtctcggcgaagggctcttcgaacgaggctgctgcgctgccgtagggggaagcctcggcgacgacttcgctgctggcatccgcggcggccagctccggctcgggagcagacgtttcgatgacatccgaagccgagagcgccaactcgggagcggctgcggtcgtatcacttgcctcggaggcagtcagcgccacctcgggataagcctccgccgtcgaggcatcgctgacatcggccgtcgcgaagtctgcctcagggtaggcctccgccgtcgcgaactccgtcgtgggataggcctccgccgtcgcgaagtctgccgcggggtaggcttccgccgtcgcggcatcgctggcgtcagacgccgtgagggccgtctcgggataggcctccggcacggcgacatcggacgcgtcgagcgcgatttcagcgggcgagtaattggcgcccggctcggaccccgcagatgcgtcgaacgccatctccgaggcgtgctcaaccgccgcatcgctcacgtgggctgcatcgagcgcaatctcggtgggctcggcttcggccgaagcctcatccgcggtgtcgagtgcaatctcggcgggctgtgcctcgtacgtatcgcccgcgctggccgcgatgaaatctgtcgcgccgtggtcggccgtcgccatggcatcagccgtcacgtcggtcgtcgcacccgcgtcccacgcatccgtcgtatccgcggagtccgcagccgacgcttcgaccatttcggaggaatcgagcgcgatttcggaatccgcagcctgcgaggccgcctccggctccgccatggcggcaacgtcgatgatgtcgcccgcatcggcgacgtccatgtgctccgtctcgacggcgagcggcgcggaggcccacgcatcatcgattggggcgggagactgctcgtgggcaaggacaggttcgctgtcggcggtgccgtccagcaactcgacctcggaggaggggacctccacttccgtcgaggccagggcatcgcccgtgggcgccaccggcgcatccggtgccgactcgacctccatcgacaggtcggcgaacgatgcctccagcgaggtctcgggttcggcgctggcggccaccgctggggtgtccgaccccacttcggagaagtcatcctccgcaacgctcagggcttccggctgcgcctcctcgaatacgggctgcgcattctgctggatgtccgcggtgacgtccgcgaacgacgcagactggtcatccaccgtggacggctgcttgtccgaggacatcggctcgatgctgggttattgctccccgctcattgcatactgagcctgtccaccggcgcctggcgtgatccacggcgacgggctcgctcagcgcgggaatgtcgatgtcgtccgaaaggctgaggttgtccggctcgacagccggctggtgtgccggagcggtggggtaggactgctgctgcgcggactgcgcggcataggcctgcggatccgcctgccatgcttcggcagtgccctgagcgtagcccgcattcgggtcatgcgcctgctgcgcgtaagcctgcgcattcgggtcatacgcatgctgcgaataggcctgggcgttcgggtcgtagccttgctgtgcgtaggcctgagcgttcgggtcgtaaccctgctgcgcgtaggcctgagcgttcgggtcgtagccttgatgtgcgtaggcctgagcgttcgggtcgtagccctgctgtgcgtaagcctgcgcgttcggatcgtacccctggttcgggtcgtagccggcggggtaggggtaccactggccgtcagcggcgtagtagccctggggttgctgctcgtagccggcggggtaggggtaccactggccatcgtcggcgtagtagccctggggttgctgctcgtagccggcggggt

SEQ ID NO: 2082 - DNA, 315 bp, Myxococcus xanthus
atgtcgtggctgcttgttctcgttgctgggttgctggagacgtgctgggctgtgggcctcaagtatacgcagggcttcacccggccttggcccagtctctttgttgccgtcacgttgattagcagcttggcgctgctgtccattgcgatgcgcacgctgccggccggaactgcgtacgcggtttgggttggaattggggccttgggcgccgcgcttgttggcatcgtgctcttccgtgagccggccacactggggcgcttcttcttcctcggactcatggtcgtctctgtcatcggcctgaagttcaccagcggc

SEQ ID NO: 2083 - DNA, 216 bp, Myxococcus xanthus
gggggtgtggcccgcgtccgtgccaccgtcagtcccggcatccgtgcccgcgtccgtaccggcatccgtgcccgcgtccgtaccggcatccgtgcccgcgtccgtaccggcatccgtgcccgcgtcgggctcggtgccagcatccggctccgggtccacgcccgcgtccggctcggggtcggtgccggcatccggctccgggtccacgcccgcgtc

SEQ ID NO: 2084 - DNA, 756 bp, Myxococcus xanthus
atgaaccctacatacgacttcaaaggacaggtagcgctcgtcaccggcgctagctctggcatgggcctcgccaccgcgaaggccttcgccgcagccggcgcctccgtggtacttgcagatgtcaatacggcagcgctcacgtcggctgtcgacgccctgacatcggccggacattccgcgctcggtgtcacctgcgacgtgtccgacgaagcccaggtcgccgcgctggtccggcgagcagttgaggcctatggccggttggacatggccttcaacaacgccggcattcaggcaccgcccaccgatgcggcggatgagccttctgacctgttcgacagggtcaacggaatcaaccttcggggggtctgggcttgcatgaagcatgaactcaagcagatgcgtcagcaaggcagcggcgccatcgtgaactgctcgtcgctcggtggtctcgtcggcctgcctggtcgagcggcctatcacgcgtcgaagcacggagtcatcggcctgacgagaagcgctgcgttggagtacgcacctcgtggcatccgcatcaatgccatctgtccaggaaccatttctacgcccatggtcacggacatgctcgccaagggggaacttgatctcgccggggcgattgcgaatcagcccatcgggcgcctgggagaggctgaggagattgctgcctcggtgctctggctttgcagcccaggcgcaagtttcgttactggcgtggcacttccggtcgacggtggatac

SEQ ID NO: 2085 - DNA, 429 bp, Myxococcus xanthus
gttcgccctgttgagaggggcgactttgaacaatggcttccgtactggaagagctaccaggaattctacaaggtcactttgccggaggaagtgacccaggcgacctgggagcgattcttcgacgaccgcgagccgatgcactcggccgtcgcggtggacggcgaacgaatcgttgggtttgtcaactatctctttcaccgttcgacgtgggcgcagaatgacttctgctacctcgaagacctcttcgtcgctccagagacacggggacgccatgcaggcaagaagctcatcgagttcgtacaggagcgcgcccgcgcaaaggcctgcgggcgtctctactggcatactcaagaaaccaatcacacggcgcaacgactctacgattggatcggagagaagcctggtgtgatcgaatatcggatgtcgctc

SEQ ID NO: 2086 - DNA, 858 bp, Myxococcus xanthus
ctccaaacgttcctcgctgtggcgcgcacgcggagcttcagcgccgcagctcgcgacctgggtatctcgcgctccgcagtaagccagagcgtgcgcttgctcgaagggaagcttcgagtgcccctcgtcgcacgcacgacgcgcagcgtatccctcacagaggcagggaggcgcctcgtggagtccgcaggcccagccgtcacacaggttcaagcagcgctcacgcaggcctctgcaaaaccaggtgaggtggtgggccgcgtacggttgacagtcccccgcgccgcctttcatttcgtgattgagcccgtcttgccgaagttccgggaacgtcatcctcgtatcgaggtcgacctcgtcttcgaggaccggatggtggacctcgtcggcgaggggttcgatgcgggcgttcgcctgagcgagtatgttgagcgcgacatggtgagtgttcgtctcaccgatgcctttcgattcatcgtcgtcggctcacccacctacctaggtaggcacgggactccagggcgcccagaagatctcctcgaacatgagtgcttgacctttcgctcgtccaccacgggttcgctctacgcctgggaattcgaacgcggtcgccggacgtggcgggtgcccgtccgtggaagccttgtcgtcaacgacggtctgatttgcatacgatgggcggagcaagggctgggcctcgcgtatgtgatggagcctttggtcggcgagcagcttcgaaagggaagtctgcagcgcgtgctcgagccgtacgccgcaaccgttcctggcttcttcctctactatcccagccgcgcgcagagctcagctccacttcgtctcttcgtcgaaacggtccgt

SEQ ID NO: 2087 - DNA, 2289 bp, Myxococcus xanthus
gagcgatgtgacccacccaaggcggttgagccgaatccgcctcaactcatcgaggtccccagacactcttcatatgtggaaggaggaggccagctagacttccacgtctccgcagtggatccgcagggcagcacgctcagttttgattggttcgcgaacgtcggcaccttgagctccgcccaggaaacctccagcacgagccatgtcacttggcgagcccctgcgtgcctggcctcgggagtcactgcctccttcacaatcaccgcgagcaatgatttcaaactatctgcctcggcccagttctccgccattggcatcccggattgcccgacatgggaaccaaccggcagcatgagtgaaggccgctctgaattcacggccacacttctacgctcgggcaaggtactcgtggcaggaggatacggggcgacccaggggtacacagtcccgcctgagatttacgacccggtgacagacacctgggcagctaccgtcaacctttccatgggtcgcagaggtcacacggccacgctgctcccttcgggcaaggtactggtcgcaggtggctacggaagcactggattcctcgccacggcggaggtgtacgacccgttcgccggcacctggactgctactggcaatctctccgtgggccgaggccgccactcggccacgctacttgcctccggaaaagtcctgatcacaggcggcaatgccaacagcggcccccttgccacggctgaactctacgacccgaccacaggcacctgggcctccgccgcaagcatgacctcgggccggctcctccacactgccacacttctcccctcaggcaaggtcctggcaacaggagggactctcaataacgaactcctcgccacaacggaactctacgacccatacaataatacctggacctccaccggcagcctctctgcgagccgacgcgagcacacagctacgctgcttccctctggcaaggtactggtaacaggcggctatggcattggcggaaccctcgccacatcagaagtgtatgagccgaacacaggcacctgggcctccactggaagcctctccactgagcgaaacttccatacggccacgctcctaccctcgggcaaagtgctggtggcaggcggctccggcaagggcggataccgaacgaccgcagaagtctacgacccgaccccaggcacctggaccgcaacgagtagcctctcggtgggccgcaatcaggctacagccacattgctgccctcgggcaaggtgctgatggcaggcggcagaaacgaccttgtgacagcagaggtttacaatccggggacaggcacctggggctccaccggcaacccctccacgggtcgcattgagcacacggccacgctgctcacttcgggcaaggtacttgttgcaggtggctacgggagtggcgaaaagcacttcgccacggcggaattgtacgacccgaccacaggcatctggacttccactggcaatctctccgcgggccgaagcactcacaccgccacgctgctttcctctggaaaggtcctggtgacaggcggccagggaaatacccctgggtacctcgccacggcagaagtgtatgacccagacacaggcatctggacctctatcgaaagcatggcctctggccgtatctaccacacagccaccctgctcccctcaggcaaagtcctggtgacaggcggcgttctcggcacaacgaacctcgcctcggcagaattgtacgacccgcacactggaacctggaccactactggcagtctctccgcgagccgaagtgctcacacggccaccctgattccccctgggaaggtgcttgtaacaggcggtaattcattgagcggcactctcgccacgaccgagatgtacgacccgcacactggtacttggacatccacaggcaacctctctgcagagcgttttctccatacagccacactgctcccctcaggcaaggtgctggtagcaggcgccggcaccgcagaactgtacgacccagcaacaaatagctgggccttcaccggtagcttggtaacagaaagctatgagcactcggccacgctactcccctccggaatggtattggtaacaggtggcgtcaacaccgcagaggtattcaacccggaaacaggcacctggttccgcactggcagcccaaagttcagatacaccaatgcggtggtgttgctacactcggggaaggtactggcaaccggatacaacagcccgaacctcggggtggcagagatatacaccccc

SEQ ID NO: 2088 - DNA, 228 bp, Myxococcus xanthus
ctgcgcgccgacacgggcttggccatctacttctgtgacccgcacagtccatggcagcgaggcacgaacgagcacaccaacggactgctccgtcagtacttcccgaaagggacggacctgtcccgttactctcgtgcggagctggccactgtcgcccttgccctcaacagccggccacgcaagacgcttggctggaaaacacctgccgaggctctcaactcttatcta

SEQ ID NO: 2089 - DNA, 273 bp, Myxococcus xanthus
gaatccgagcaatacgccagcgaggactaccgggagcggctggcagagcacggagtcacctgctcgatgagccgcaagggcaattgctgggacaacgccgtcgtcgaaagcttcttcagcagcttgaagatggagctcgtccacacgcgccgcttcctgacgcgagaagaggctcgacgagcgctattcgatttcattgaggtgttctacaaccggaagcgccgtcactcctcactcggctacatcagccctgtggaatacgagcgaacggct

SEQ ID NO: 2090 - DNA, 381 bp, Myxococcus xanthus
cgtccgtgcgggcctcgaaagggggccctcacgggcccaaacccgacggatagagcgaaggcgggcagtcagcatcatctgctcgtagaggcccagggactgccgctggccgagtcgctgacggccgccaacgtgcacgacacgcacgggcgcttcccggtgattgactcggtacctgcggtgaagactcccacgggacagcgacgctttcgcccgacgaaggcccatggagacaaggcctacgcttcgaggaagaacaggcgaggaatctgccagtccatctggacccgtccagttctcaattctggagcatgtcgcgggacttgcgacagggtaatagccccgaccgtggaaggttcgattcccgctggcgagcgacga

SEQ ID NO: 2091 - DNA, 348 bp, Myxococcus xanthus
atgctttcagcggttatccaatcggcacatggctacccagcgatgcctctggcgagacaactggtacaccagcggtgcctccaacccggtcctctcgtactaaggtcagagcctctcaagtatcctacgcccacagcagatagggaccaaactgtctcacgacgttttgaacccagctcgcgtaccgctttaattggcgaacagccaaacccttgggacctgctccagccccaggatgcgatgagccgacatcgaggtgccaaacctccccgtcgatgtgaactcttgggggagataagcctgttatccccggagtaccttttatccgttgagcgatggcccttccat

SEQ ID NO: 2092 - DNA, 644 bp, Myxococcus xanthus
gtgccaaacctccccgtcgatgtgaactcttgggggagataagcctgttatccccggagtaccttttatccgttgagcgatggcccttccattcaggaccaccggatcactatgacctgctttcgcacctgctcgacgtgtccgtctcgcagtcaagctcccttatgccattgcactcgacgcccggtttccaatcgggctgagggaaccatcgcgcgcctccgttactttttgggaggcgaccgccccagtcaaactacccaccagacagtgtcccaatcccggctgacgggacatggttagacaccagaaatcaacagggtggtatttcaccgttgcctccaccgaacctagcggcccggcttcaaaggctcccacctatcctacacagtcaatccctagtgtcactgtcaagttatagtaaaggttcacggggtctttccgtcttgctgcgggtaaactgcatcggcacagctatttcaatttcgctgagtccctctccgagacagcgcggaagtcgttactccattcgtgcaggtcggaacttacccgacaaggaatttcgctaccttaggaccgttatagttacggccgccgtttactggggcttcggatcatcgcttcaccttgcggctgacgaatcc

SEQ ID NO: 2093 - DNA, 353 bp, Myxococcus xanthus
ccgcctgcgcgcgctttacgcccaataattccggataacgcttgccacctacgtattaccgcggctgctggcacgtagttagccgtggctttctggttaggtaccgtcaaggtacgagcagttactctcgtacttgttcttccctaacaacagagttttacgacccgaaagccttcatcactcacgcggcgttgctccgtcagactttcgtccattgcggaagattccctactgctgcctcccgtaggagtctgggccgtgtctcagtcccagtgtggccgatcaccctctcaggtcggctatgcatcgttgccttggtgagccgttacctcaccaactagctaatgcaccgc

SEQ ID NO: 2094 - DNA, 357 bp, Myxococcus xanthus
ggtgcaggaatattaacccgctttccatcacctacgcctttcggcctcggcttaggttccgactaaccctgggaagattaacttgacccaggaaaccttgggcttacggcgagggggtttctcaccccctttaacgctactcatttcggcatcagcactcccagtcgctccagccgccttttcagtcgaccttcgctgcaactgggacgctcccctaccgccacacgctttacgtgtgacccgaagcttcggcactagtcttgagccccgttacattttcggcgcggcctgtcttgaccagtgagctattacgctttctttaaaggatggctgcttctaagccaacctcctggttgt

SEQ ID NO: 2095 - DNA, 531 bp, Myxococcus xanthus
atttcgctgagtccctctccgagacagcgcggaagtcgttactccattcgtgcaggtcggaacttacccgacaaggaatttcgctaccttaggaccgttatagttacggccgccgtttactggggcttcggatcatcgcttcaccttgcggctgacgaatccccttaaccttccagcaccgggcaggagtcagaccctatacgtcggcttgtcgccttcgcagagtcctgtgtttttggtaaacagtcgctaccgccatttctctgcaacctctctcagctccggctgtacgccttcacctaccagaggcccaccttcttccgaagttacggtggaaatttgcctagttccttggaggagagttctctcaagcgccttaggattttctcctcgcccacctgtgtcggtttgcggtacggacaccctgtaagctccctacgggacttttcttggaagcagagcatcagcgacttaccccttacggggcgccatcgagtctcggggatagctgccgcgcctttattcgtacgc

SEQ ID NO: 2096 - DNA, 147 bp, Myxococcus xanthus
  unsure (1)..(147): unsure at all n locations
ggcgtaacaggccatccagggcccttcccccctggcaaggcacgtcatcggggcggagcgcaccgggtcagannggaccgctccngcctcttgtcgtttggcggatgtttggcctccgatggtttgctaccgggcaaaagtgcgtgc

SEQ ID NO: 2097 - DNA, 624 bp, Myxococcus xanthus
gccagcccctgccgcacgaggaagagcgagcagcccgcgtccacgaagggctcggcatccgggaactcgcgcaccgcctccaggcggccctgccgaagctccacacgggtgagccccgtatcggtggcgcagaacagcgcgtcgcccgccgcgcaccgtccacgtggcgcgctgcccagccacgagccgtcaccggcctccgccaccgcgctcgcgcgcacggccccgtcgtggcccaccaccacgcagtgatgcagcgtgcgcccaccggcttcctccaccaggaacagccaggcggagggcccatcgaagacacagtccacgtccacgagctttcccgtgggccaggggagcgacagtccatccttcaagcccaggcgctccgcatcgaagacgaaggcgccgcgcagaccgcccgcgcgatggaagcccaacccgaagcgtggccccacgaagagccgcgtctgtccttcgagcaccgcgcccacgcgctccggcccatatgcgccgtcccgccacagcccgccgcccacggcccagtaccggtgccgcgcgttggtggcgaaagcggactggccctccggcgcatccacgcccatccggtccgggggccggccgggcgcc

SEQ ID NO: 2098 - DNA, 237 bp, Myxococcus xanthus
atgttcggaaagccggaacgcgttgcggagtcctcacccatgcagtcgtgcccccaggaaacgacgctgacggacttgcttgccgggctgctttccgacgctcaccgggcccaagtcctggcacacgtcgagacctgtgccgactgtcggtgggccctgggagcgggagtgggcactcaagcgccatccagcgctccgacagcccctggggaggaggcgaattcccagccactgccg

SEQ ID NO: 2099 - DNA, 4194 bp, Myxococcus xanthus
tccaccgggccggtgatctccacaccgcaggacgcgttggcgccgcccggcgtgccccgtccaccgccaggaagcacttcctccgagtcacaccagtaccaggcgtgctggctggcccgcgtgcccaccaccacggacgacaggttcatcgagcgccccgtcgtctgcgggaaggaggccgagtacgccacgtcatccaccacggtggcgcccatctcgacgaagaggtgccccgagtggccaagctcgaagagcgtgctcccgtagccgtactgcgccaccacgccgccgttggtggcctcatccgtgttgctcgcgaggacgaaggtgccccggcccgggacgacgagcggccggtccccggtcgtcagcacgctgaagtccgtctcaccgcccgcgccattgtcgaagcggatgcgcaggttcgcgatgtcccgcggtccgtcgacggtgctggtcagctcgatgtactcggtggtgttcgcgtccgggcggtgcatcacctcgctgatgaccaactcacccgccacgggcgcaggcgccgtgtcacacgcccccgcgacacagacgccgtcctgccccgggcagacctccggggtggccgtgtactggcactccgccaggcccgccgtcaccacgcacgcttccgcgtacgccacacgctgcacaccgtcctcgtcacactccggcgcgcgcggcgcgcagacgatatcgccgcaggggcccggcaccgagatggagacgaacgccacggtgctgccgttgttcgagccgtcgaagacgcggagcgcgaagtaccaggtggccgcctgggacggcggcagcgcgtgaatcacttcctccgcctgtcccggcgcccgtggcgccgccgtgggcacctcgctggcgagcgcgaagctctgcgggtccatgggccccgcgctgtagcgcagctcgtagcgcgcggcgttgcccacgacgccgttgtctcccgtggccagccacgtcaggcgaaccgtcgtgttgtccaccaggctggcgttcagaacgggctcggcgggcgcgacgtcgtcggtgatggtgaccatcgtgtcgacggacggcagcgacgggttctccgtggtcgcggagaggacgaagctgcccgcctggtccaccgtgaggtcgctgaagacggccacgcccgcctccggcgccaccgtcaaggtgccgcccagcgtcaccccgaccgcccccaccaactggagcgtcacggacggcgccgtgacgttcgagacgttgccgaacgcatcctgcaaggccacccgcgtctcggacagcggctccaggacggtgcccggctccggaggcgcgacgaacgcgagctgcacgggcgcgcccgcctccacggtgaagtcagacgtaccggacaccggggcatcgccgtccgtgaacgtcaccgactgcgctcccgccgtctcgaaggtgatggtgaaggtgtgcgctccctggtccgccgcagtgtacacgtgcgccgacaggggcgcagcctccgggtccgtggacgcgggcgccaccgttccctggtacgccgtcagcacgttgccgaagcggtcacgcgcggagacggtgaaggattgaggctcgcccgcgacgatggacttcgtcggccccgctaccgacaacgccgcgaggagcccgggctgcaccgtcacagaggcattcccagtcaacgtcgccgtcgtggtgtccgtgacgacgagctgccccgtgcccactgtggcgaactccacattgaagaggcgctgaccggcgtccaactcggtgaaggtgtagtccgaaggcacggtggcctgggcgtcccctggaatctcgaagtggacggtgccccggtagcccgaggcgaggttgccgtggacatcccgcaccgacacggtggcccccacgggctcgcccgcgcgggtcgtcgatgagtccaactgcaccgtcaactgcacagcgggaccagacaggacctgggtgttcagcgccgcctccagccccgtgttgccctcctcccgcaccgtcaccgagcgcgcgccggaggtcaccagcgtcaccgagaacgtgcgctgccccgcgtcctgcccgggaacgaaggtgtagttcgcgggcagcgtcgcctcagggtcactcgattcgaactgcaccgtgcccgtgtagcccgtgacgatgttgccgaaaccgtcgcgcgcgatgacggtgaggctctgcgcctcgccggcctccacttcggcgggaagcgcgctcagcaccaactcagcggccgcaccggtgctcacctccacatcgagcgtgtcggtcagctccggccgtgccgtgtccaccacggcgacgctctgaggcccagaggtcagcagcctcacgccgctgaaggtccgctggcccgcatccgccacggtgaacgtgtagtcgcccggcagctccgcctcggcgtcagtggacgagaaacgcaccgcgccggtgtagcccgtggccacgttgtcgaaggcgtcatgggccgtcaccacgacgctgcccccggcgcccgcggccaccggcgagaccaggcccgcgagcgacaaccggacggcgtcgcccggcgcgatggtgaacgcgtcgctgggcaccggatccaaccccgtggccgacgcgacgaagcggtgcgttcccgcctgctccaccaccacgcccgagaaagtcgccacgcccgcgaccgccgccacctgcaagggtgtgaagtcgggctcgtcctccagcgtgagcgtcaccggcgacgtggccgtcgtgacgacctctccatcctcatccaacagcgagacgcggagctccggttgcgtatcgcccgcgtccccatccacgggctgctgggagaagacgagccgcgtgacgccctgcacctgcgtctgcaccatcaagctggaggagcggaccgcgttgtcctggttgtccgccacgcgcagcgccacgtagtagttcgtgccgggctgaaggcccgtgagaacggcggactcctgcgtgccagcctccgcgggctcgcccaggccgcccaccggcgtcgcctggttgaagtccgcatccgtctcaatcgggttcagcgagtaacgcagggcatgcgacgcggcccgcccctggtcgccgtcatcacccaccgccgtccaggacaccgtaacgctgtcgtgcgtggccgcggtcgcggcgaggacagggatggcggggaacacgttatcgatgatgtcgatgtccgtgctcgtggcgggcgtcagtccatccgcagtggcctgaagctggaagcggccctccgtgtccacgtgcacgctggagaacgacgccagcccctccatgggcgccacctcggtgacaccacgcagtggcgcgccacccgccggcacgagggacagcgtcaccgaaggtgcacccacgggcgtccggttgccatgcgcatcctggagcaccacctccacggcggtcagcgcggcgcgaacggacgcatgcgagggcacgcgcgcgaaagccaatgccgaggtccggtccgccgagacgcgcacgtcctggcgccccgccaggcccgcttgcgcggcgtcctgcacgtcgacacgctgggtgcccgcccgccgcagggtgatgcccgtgaaacggaagcggcccgcgttcacctccgtgaaggtgtgcccgcccggcagcgtggccgtggcgtccgaggactgcacgctcagcgtgccgcgatagccactggcgacgttgccgaacgcgtcacgcaccgtcacctccgcatcatgcgtggagcccgcgatggcggtctgcggcagccccgtcacctcgacagtggcggcggcggccggcgtcacgtcgaacgaagggctgaccgcgccctcgacgccggtggcctcggccttgagttgatagcccaggcccgcgcgcatcagcaccacttcctggaagcgggcgacgccgtccacggcctgagcccggagcgtgcctcccagggaagccccacccgggccagcggccagcgacagcgtcacctcccccgtgacggacgaaaccgggcggccgtcagcgtcccggaactcgacgtccagcccgccaatgggtgcaccggctcgggccgacagcgaggccgccgcgaaggccagcctcgtggcccgcagcgcggtgaagccgacgacgggacgcgagcccagcaccaccgcgcctccctcggcatccaccgaggcc

SEQ ID NO: 2100 - DNA, 372 bp, Myxococcus xanthus
ctctccagcagcgctcgggtgctgggaactctccacctgggtccgggagccaacatcgcgcaaggcgcggtggtgcgctcgcacgaaggcgccgtgcggttgggcgccggctcggccgtgctggagaacggtgtcatcatcggactgccgcagcagcctgtcacggtgggagagcgcaccttcctggaccaccgcagcatcgtactcggcgcggaggtcggcgcgctctgcgatgtgggaggtgcctccatcctcatgcccggcgcgcgcatcggcacgcgctgcctgctggcggaaggaacgctcattccagcgggcaccgtggtgccggacgactccgtcgtcgtgggccgccccggccgcattctccgt

SEQ ID NO: 2101 - DNA, 1152 bp, Myxococcus xanthus
aacagcacccctgcggatcaatccacacgcaccagcgccgcctgctgcaagccgtcgtccgcgctcacatccacggacaggtagtgccggcccaccccgtcgaatgtctccggaatggcgccgccgccgccggagatgaaggcggggatgcccgcgttggcgaacgaatagtaggagtggatgtgcccgtagagcgtgaggtccacgcccgcgcgcgccatcttccccaccaggcccgcggcctcaccccggttggcgaagccgccgccgcgcagccccaccgggtcctgcggcggcacgtgcatggccaccacgtgcgtgccgtcccgcgaagccgccagccacccctccaattgctcctccacgccggggtccaacgtgccgttgctggagtccaccaccgagaagcgcacgcccttgaagacgaagctctggctgccgcgccccaccagcgcgtggtactcggcggcgtcgcgggtgaacgtctcgtggttgcccagggtggcgtacagcggaatgcgcgagcccgcctccagccgctcctggaactccgtcagctcatcgcgcgtgcctgactccgtgaggtcgcccgcgaagaggatgaagcgcgccgtgtcgtcccgccgcatgcgcgcgtagatatcgccgacgcgcggcagggcctcctgcacgtccgccagcgcgaggaagcggaagggctcgcgcgattcggaatccggcggcgccacggacagccgcgctgtcgtccccgcgcgcagcgccacgcgccacaccttcacggtgggcagcgcctgcggaagcgcctcctgcgccagcggcgcgcccccttcctcctcggccaccagcaccgcgtccggcatcgcgttgcgcaccgtcaccagccagtcggacggcgcctgggcgcccacgtcgatgcgggcggtgaaggccggcgcgttgccccacagcaccagcgtgcccggcgccaattcgcgcaccgtcgccagcccatccgccaccgacagcgtcaccccgccctgctgcgcctggcccaccttggaatccgcaatcgcgcggttctccgcgggccgcatgccgcaccccgcaaccaccagtgccgccatcactcccacgcgcatcaccgctcacctcccagggcacgaatcaacgaca

SEQ ID NO: 2102 - DNA, 249 bp, Myxococcus xanthus
caacctcttcccccatccgaggaaacccaaccgtcgcagccgactgacaccgcgacgcagccgtctggaattgccgctccgcccgccgtgggtgatccttccacgcagcagcccggcaccgagtccgcgcccaccgcgcagcagccgggcgtcacgcccgcgcccaccgcgcagcagccgggcactgaacctgcccccaccgcgcagcagcccggaaccgaggccgcgcctaccgcgcagcagccgggc

SEQ ID NO: 2103 - DNA, 1158 bp, Myxococcus xanthus
gagctcacgtcacttgatgcggtgactcgcgcgccgaacaccggcttgcgcccatccgtgacgagcacctcgcaatcgttcccctccatgtccacctggaaggtgacggtgccgtccaccctgtcctcacccatgtccgcggcggtgctggcgtagacctcatgaacagagaaggacaccagcaatcgatagcgccccggctccagaatggacacggccatcccatcctcctcctggatgtatgcgccggaggaggccaactcccactgcttctcgtggtgccaccgctggagaacgaacacgggatagggcttctgggtccgtgcctctatctgtgcccgcatggcgccatccatgcgcagcacgagccaccggtaggccttcacgcgccacgtcacctctgcgtcccgcacacccggctcgggcctgaaatcgaaagcctgttccgtcgcggccaccggacgtctggaaactggcgatgccacctcgacgcggaagcgggacggctcccaggacggcaaccccgacacgacaaagcgcccatcctgcgcgagcgggatttccacgtcccccggccccaggagcctcgcgccctccggtggacggaacgttccttccagctccagcttcccccgcagcgtcaccgcctcacccacgccatcgggaaagagcgaacccacgtccagcaccgccggctccacacgcccctcgcgcagaggcacctccacccacgcgctttcccttcccgccgcgctccggagtaccagccccaccgcggggtccgtgggcaagggcagcaactccagcgacttccccacgggaagtggaagcgccgtaccgtccgcgagcgcggaggcgatgtccggcgcggcatgccgaatcacgggcaacagttcgctcgcgcgctccgcgtcgcgagcgtcccgggatacaccacgcaccacacgaagtgagaacgggccatgctcgggtcgcgctcccgcgagccgcacccgcacaccggtaggcgcccgggcagacagcacggcctccacgatgcccgtggtggccccctcctcgggcaccacgtcgcccagccagaacgttccatccgctgcccaggccaccacccggtagagcggtgccactggcacgagcatcggtcccaacgtccccccc

SEQ ID NO: 2104 - DNA, 402 bp, Myxococcus xanthus
caggacaggttccatgcggcgttcgtggggctcgcaatcggtgatgcgctcggctttccgctgcgcggcattccaccggcgagcctcacgcggctgcccggccttgccgaagacttcgcgccccgcccgcgcggaaagttcgccaagggccagttcagcgacgacacgcagttgctgctcgcggcggcggagagcgtcatccgcgaaggcaaggtggacggccgcagcgcggcggcgcacctggcgtggctgtggcaggagggcatcatcctccagccgcccaagagcctggcggacgcgctgcagcggctagccagtggcgtgccgtggatgagcgcgggcgcgtccctgggcacgcgctgccattcggtgctcagccgcgcgctggtggtgggcctgctg

SEQ ID NO: 2105 - DNA, 372 bp, Myxococcus xanthus
aaattgtgtgtagttggtttaggatatataggtttaccgacagctgttatgtttgccaatcacggcttatatgtacatggcgttgacctaaatgaaatagcaccacaattaattaaaaataagcaacttcatatagaagaaaatggcttacaagaacgtttagaatcagcaattgacaaccgccactttacggtaggcacaacacctgaagaggcggatattgttattattgctgtaccatcaccaagtaatgaagataaaacggcgaacttgaactatgttcgacaagcgacaaaatcaattgttccttacgttcgtaaaggaaatttagttattttagaatccacagttgctccgcgtacagttgaagac

SEQ ID NO: 2106 - DNA, 540 bp, Myxococcus xanthus
aacgttctgttagtatacggaggaggaagcatcaaacaaaatggcgtatacgacgaagtgaaagctgaacttcagtctattaacgcagttgttcacgagctgtctggtgtagaaccgaaccctcgtttgactacggtagctaaaggcgttgacatatgtaaaaaagaaaacattgattttctcttagccgttgggggaggaagtgtgattgattgtacaaaagctatcgcagctggagccgtgtacgaagggaatacatgggacttaattacacgcaaagtagagattacaggtgctcttccttttggaacggtcttaacacttgcggcaacaggatctgaaatgaattcaacttctgttattacaaattgggaaacaaaagaaaagctaggttggacgtcttctcatgtatttcccgtcttttctatcttagatccggcgtacacgttttcagtgccgcgcgaccaaacagtcaatggaattgttgatagtatgtcgcatgcgcttgaacactattttcaccgcacagaaaatacgccg

SEQ ID NO: 2107 - DNA, 636 bp, Myxococcus xanthus
aagaaaacaagtcagcgtctgtatggaaagcatattcaagcaggcgtttcgagaatggagaaatttgaagcctgtccgtacgctcattttgcttctcatgggctcaaacttaaagaacgaaaagttttcaaattagcagctcctgacataggcgagttatttcacgcggcgctgaagatgatttcagacgagcttcgcggcggtcaaaaagaatggaagaacttaacgagaaaagactgtcagcagctttctacggctgcggtgcacgaacttgctccgcgcttacaaaacgagattttattgagctctaatcgtcaccattatttaacgcataagctgcagcaaattattgaacgggcgtcgcttgtgttaagtgagcacgctaaggtgagtgggtttgttcctgttggattggagcttggatttggacctagcgcggagctgccttctatgcagttcacactgccaaatggccatacgatggaactcgttggtcgaattgacagggtagataaagcggaaagctctaaaggacttttactgcgtattgtcgactataaatcaagcgataaagcattaaacttagtggaagtgtactacggtttatctcttcaaattttagcttatttagacata

SEQ ID NO: 2108 - DNA, 504 bp, Myxococcus xanthus
ttgaatgatcaaattcaagattttattcattatttagtagtagagcggggactggcgaaaaatacgattgattcgtatgaacgagatttaaaaaagtatgctcaatatttagagcatgtagagcagctgaaatcatttaatgaagtaacaagactccacatcgttaattttctgaaatatttaagtgatcagcaaaaatcatctaaaacgattgcgagacatgtggcttcaactagatcttttcatcaattcttactaagggaaaaagcagcggatacagatccatccgttcatattgatactccgcagcttgagcgcaagctgccaaaagtgctaaatgcagaggaagtagaggcgctgttaaatgtgtttgatacttcgacgccttttggcatacgagacaaagcgatgcttgaattgctttatgctactggaattcgtgtatctgaactcgttaacttaaatattgatgatgcacatttgacgatgggatttattcggtgc

SEQ ID NO: 2109 - DNA, 642 bp, Myxococcus xanthus
atcattaaagataaagcatatcgccagcagatcttaaattcactgcctgttggaattatcacaatagaagatgagacaaatagtatatttgctaatacctcagcaaaacagtttttagatctcgatgaaaaggatatttgccggtatatgaaggaatgtcctcaatataatactgaattttggagcatgttgaattcgggagaaattcacgaaaataaaaaagtattatttggaacgaaagagacgtgctattgctttttagcctctcaaacgcagctgtttaatgagaagaacgaaagcattggaaggattttttatttcattgatatatcggataccgaagaattagaaaagcgaatgcatcagtctgagaaacttgccttggttggagaagtggcagccggagctgctcatgagattcgtaatcctcttgccgtgattcatggatttatatctcttatgaatcagtctctttctgatgaggagaaaaagcgtttttacctgcctctgcttatgaaagaactagagaggattaattacatcattgaagaaatgctgttgttatcaaagcctgggactccggtgatgaaaaaagtcagcatgcaggatattattaatgagttattgcctttgattactcac

SEQ ID NO: 2110 - DNA, 246 bp, Myxococcus xanthus
aaaacgaatggagaggtgagcgtcgctcctaaacatgaattcggccctccgacgaaaaatgatttaaacatcctttattctcaacttaatttacctattgctttaatcatggatgcaaaagtagtgcctggcaatttaaaagaagcaaacgtagatgaaaagtggttaaaaaaacagctggcaatcaagaaaataaaggaatacagcgaagttttttatgctgaatggcagcaagagcgaggacta

SEQ ID NO: 2111 - DNA, 318 bp, Myxococcus xanthus
ccagccagccctcagtttcatccagcggctacaatttttgtgatttcagattttattggccgtcccaaccgtttgtctccagcggatctaaaaaaatttgttgattcaggatttttttctattcagtctcataccgctactcatccggatttaactaagacgaaaaatttatcctatgagctagctgattcaaaacgaaaaattgaagccattacgagccagcccgttattgctgttgcttacccttacggaaaggtcaatagccgcgtagtcgaagaaacaaaaaagaattatacatttgggctttcaacgattcca

SEQ ID NO: 2112 - DNA, 396 bp, Myxococcus xanthus
cgagaagatttatattttcgtttaagcgtcgtaccgattaccattccatctttgaacgagcgccctgaagatatttttccgctgctcacacattttgccgagcagtttgaaaagaaatataaccgaaaaagaacgtttgataatgcggttattcacgcactgctttcccacgagtggaaaggaaacgtacgagagttaatcaatgtgattgaacacgcggtggttgtatcttcacaaacgctgattacaatggagcatttgccgcattctctgcataggaaaaaacgggttcagcacgttgaagaacatggggaaatgaagcttaatgacgcgttaaacgagctggaaaaagagatattagtaagagcaaaaaaacagtataaaacgacaacagaa

SEQ ID NO: 2113 - DNA, 556 bp, Myxococcus xanthus
cggaaagtcgaagctaaagtatttgacattcaaagggtacctgtgcattaacattcaggcattaaacagctgtctcagaaaaagtttcgtttagctttaattatcggtgtcggaatggcaccttttcagcagattcaaggctccacctcaattatttattatgcaacaagcattgcccgtcaagttggtttagcgccgcaggtagcctgctggttttacggttattgttggggtaatcttcgttgtgacaacacttatttttctgcagtttgttgataaattcaaccgccgtaccattcttacggttggcggagcgggaatggctctttccttttttacaccggctattcttggagcagtaggcgttaatgaatccgttgttaactgggttacgttaattgcactttcctgctttatcctgtgctatgcgttttcttgggcgccgcttacgtggatcatggtagcagccattttcccgctttctgtgcgcggaatcggtgctggaaattcatctgcctttaactggacaggatcgcttgcagtagggcgtgtgttt

SEQ ID NO: 2114 - DNA, 243 bp, Myxococcus xanthus
actggcagcagcattacgtaggagtatatgtagtgcatcttggacccggtgttcaccatcaagtcaatgcgagtggtcaggggcctgatgtcgtcggtattccatgacatcgtgacgtcgttggcgggcacccgcgcggtgtagagcgtcccggtgtgggtgagcatctaccgggtcacgtgggcggtgatggccgcgttcacccaggcgcctaggtgttccaatcaaccgaggccggtggcg

SEQ ID NO: 2115 - DNA, 377 bp, Myxococcus xanthus
ggaatgacggtgggcgtgtccttgtgagcaccgcagcggaatttgtccctgtcgatgaagttggcaatcggctcgcagaacattccctaaggggtgctgatgcagctagtcgctgcgggcctcgaggcgtttctcgtcgcgcctcgtgtatcctgccgctgctcatcggcatggtgaacgctgtcggcgtgatattcgtcgtggtggaccagtcgcacagctacgcccatcatccgtgagcagtggccttgcaggcggtggatatgttgtatgttattagccgtgatattagtccgcagatccaccacgacgacttagagccggaggcatccactggcgttatgtggggcattgtactctcgttcatgctgctcatg

SEQ ID NO: 2116 - DNA, 300 bp, Myxococcus xanthus
gatgaaccacatctgacggggcaactgactccctgagttctgtctgagaacgtcgaaagcggggagacggagggggccgaaaacgtccatacccaccgccatgtggctggtgttatgcacgaggaggtgcttgccgcttatgctagccacccagcgtgggatcctgggccaagtgccggctggggactcgttgagctacagcgcgtacctgctgtgccagccggtgaaaatgtccatgttccggctgggccctatgacaccctgttgagtagcggcgaacgaatgggcgaagtctcgggg

SEQ ID NO: 2117 - DNA, 364 bp, Myxococcus xanthus
cccagaaacgacgatggttccacggccatccactgacaggcccatcacgaagtgatccaaccacacgtccttgcttaccctggtggcagggatgacgcgaccgcccccttcgatggccatccccgaggtcgtacttgacgcacaaatcgacaactagcgccggtacattaacgactgcacctctcttgacaacggatgcgtggcacacctcctgcgcaataccgagcccgtctacgtagttaaccctgtccccttcctcatacagtcccatgacgaggccaacacgatgaccgcccattacgtgcctgaactgggacatgcaaccggggccgtaatcctcgcgcgcacgcgctcgggatccgac

SEQ ID NO: 2118 - DNA, 591 bp, Myxococcus xanthus
agagaagtatgtgacagacacggcattctgcttatttttgacgaagtgcaaaccggctttggacgcaccggagagtggtttgcagctcaaacgtttgacgtgacgcctgacattatggcaatcgcaaaaggcatagcatcaggacttccgctaagtgctaccgtagcttccaaacagctcatggaaaagtggccgattggtacacatggaacaacttttggaggcaatcccattgcttgttcagcagcacttgcgaccatagacgtactaaaagaagaaaagctaattgaaaactcaaaagcaatggggcaatatgcagcggatcagcttcagcatttaaaagcgaagcatgaagtgatcggaagcattcgttcagtgggactaatgattggaattgaaattattaatccgaaaacaaagcaaggtgacggaaatcttcttcttgagattttagacaaatgtttggaaaaaggggtgctgttttacctttgcggaaatagcggagaagtgattcgaatgattcctcctttaacgattaaaaaagaagaaattgacgccgggcttcgcgtgttagacgaagcattaacagaa

SEQ ID NO: 2119 - DNA, 348 bp, Myxococcus xanthus
cgcccggttcttcaaaaatacggcaagtacttatttattcatgataagcattttgatctttcggaaaactggtttaataaatacggcgcgggcgtgggtttctccgctcgttttgtcccggttgttcgacacgcgatttcgatccctgcaggtattgctaaaatgccgttttggaagtttacgtctttaaccgtgttagcgatgattccttggtcgattttatttatttacttaggcggaaagctaggcgagaactgggcgaacattgaagacgtagcaagcaaatatacgcttccgtttgtagttgcggcatttgtgattattgttctttatttcgtattcaaacgc

SEQ ID NO: 2120 - DNA, 429 bp, Myxococcus xanthus
tctaaagaagttcgcaaacttgcagaacaatccaatcagtcagccgaacaagtagcaagactcattcagcatattcagcaagaaacgtttcaagccgtagcattcattcaatcaggaactgctgatgtaaaaaacggtattttactagccaacgaagcggaaaatgtttttaatcgaatcgccgacgcatctacgtacgttcacgaacaaattcagcaaacggctgcttccgcacagcaaatagcagccggatctacgcaggtgctccatgccgtcagcgagatgaccgcttttgcgaaccaatcagcggcaagtagcagcagcatttcttctgcttccgtgcgtcagctggaatcgctgcagactatcgaccaaacggcggaatttttaagtgagttagttgaagagcttggcagcgtaacgggaaag

SEQ ID NO: 2121 - DNA, 318 bp, Myxococcus xanthus
cgaaatgatgtattgaacagtgtagaatcattaacatatgaacaattaaatcagcagccagcatctaatacatggagcgttatgcaagtattagaacatttatatttgatggagcgcatgattgtttcacgtgtaaaggatcagttagaaaacggtgtagatcagccaaccgaagataagccgtttcatttagcggtagaccgttctcgaaaagtagatgcaccggctcaagttacgccttctaatgaaaatcagacattagaagaaatgaagagtaagctggcggaatcaagagcggctttagtagagttagaagaa

SEQ ID NO: 2122 - DNA, 708 bp, Myxococcus xanthus
ctagatcaagtcatgaaagaagttcagcctgatatcgtacttgtacacggcgatacaacaacaaccttcatcgcaggtcttgcggctttttataaccaaatcaaagtaggccatgtagaagcgggtcttcgtacatggaataaatattctccgtacccggaagaaatgaaccgccagttaacaggtgtattagcggaccttcattttgctcctactacaaagtctgcccataacttattgcaagaaaacaaaaaagaagaaacgttgtttattacaggaaacacggcaatcgatgcactaaaaacaactgtgttagaagaatattctcatccggtattagatcgtgtaggggatgaccgtttaattctgttaaccgctcaccgccgtgaaaaccttggtgaaccaatgcgcaatatgttccgtgcgattaaacgaattgtagaggaacatgatgacgtacaagtagtctaccctgtacatttaaatcctgttgttcgtgaattggcagatgaagtgttaggaaatgatcctcgcattcaattaattgaacctctagaagtagtagatttccataatttcgcttcgcgtgctcatatcattttaacggattcaggcggcgtgcaagaagaagctccttcattaggtgtgccggtattagtacttcgtgatacaaccgaacgtcctgaaggccatagaaacagcacggtt

SEQ ID NO: 2123 - DNA, 681 bp, Myxococcus xanthus
gaaaaattcaagtatcaggaattaaaagaattcgtaaattctcacggcgtaagtgagctgggaaaccaattaatggataacttcaagccgagcacatttcttaaacaagtaaaaacccgacttaaagaaccacgggaagcacgaagacttctagatgctgagaaatcacttccgctatcaggtgtctcaggtataggaagagtcatcgaaaagcttgaaaaaggcatgattttagagcccgaagagctaatgcgcgtatccgattttttaaaaggctgtagaaaagtaaaacaatatatggtggataaagaattttttgcttcgctcttaagttcctatgcccattcgatgaaagaactgacaggtatagaagaggaaattaattttgcgattaaagccggaaaagtagacgctgcggcaagcaaagagcttaagcgtatcagaagacatatagaaggaacggaagctaagatttcagaacagcttgcgaaatttttacgaaacggtaaaaacaaagagtatattcaagacttcttcatcagtaaaaaaggagaccgctatacgattccgatcaaggcatcctataaaaataatgttggaggaacgattgttgaaacatcttctaaagggtcaacagtgttcatagagccggcgtctattacaaagctgaatgcggaacta

SEQ ID NO: 2124 - DNA, 384 bp, Myxococcus xanthus
aaacctgccagtaaaaatgattatattcgaattcagaagtttttacaaaatgcgggtattagcacagcgggtgtagaagaacatattgatcaatttgtcatcatggaaagtgaagaaggcgagctgctagcaacagttgggtttgaaaaagaaggcatggacggaattcttcgctcccttgtcgtgtcaccttctttgatgcaatctgatattctgctgctatttaaaagtatcgttcagctggctcaaaagcatggtgtgaagcaactatatttactaacaaataaggcatcctctctgcatttttttcaaatgatgaattttcagcaaacatcttatagtgctctacctgatttgttaaaagaacattcgtatttaaaacag

SEQ ID NO: 2125 - DNA, 297 bp, Myxococcus xanthus
attgttgacggcagttcagattttttccaatctattattgatcactatcaagatcagggtaagcgagtaggggtattaccgacatctgaacatgaagatgtgtataaagccgatgccgtcattacatgtggatctcgctcaaatttagagacggttgctagccacttatatgagtctcttcgttcatttaatgagtgcgatgtagatattatcgttagtgaaagtttttctgaagaaggagtcggtcatgccgttatgaatcgattaatgaaagctgcaggacatcacgtgattaag

SEQ ID NO: 2126 - DNA, 204 bp, Myxococcus xanthus
attagtgaaatgatcacgttagtcattatggcgtttgccttaggaatggatgctttctcagttggtttgggaatggggttaattcgtttacgctttcgccaaattttctacattggtgttgttatcggtatatttcatatttgaatgccgctattgggcatgtttattggacgacttttgtctgataaacttggaatgtttgct

SEQ ID NO: 2127 - DNA, 678 bp, Myxococcus xanthus
  unsure (1)..(678): unsure at all n locations
aaaatgattcaattgactaaggaagcaaaaaacgctgtaagtggagtggaggagccttcgggtacgcttattattggatcttctgaaagccagtgtacctatagattgcctcccatattaaaagagtttaaggatcaatttcctaaggttaaaatgatttttaaacctatttattctcaagaacaaacaagagcgcagctactagacggcactcttgatatcgcctttacaatggagcctattcagcatcatgatgcaaatctacatacacaatgtcttgttgcagaagacttaaaaattgttgcttctcctcagcatcctttagctgataaaacggatatctacttagaagagcttgaaaatgagactctcttgtataccgaatcaggttgttcatatcgcgtagtgttggaaaacttgtttcgtgaggcgggtatttgtacatccactaaatttgaatttgcaagtgtggaagctattaagcaatgtgtgatgttggatttaggtattgcgatattgcctgaagtagtggtaaaaggagagcttgagaaaggaatattaaaagaattggcttgtactaaagtggatacgaccctttatacacaaatgttttggcataaagataaatntatgtctcttcctttacaatcgtttattcaattggcttgcagtactttt

SEQ ID NO: 2128 - DNA, 633 bp, Myxococcus xanthus
ttaattgaagatcaaaccgatatgaaagtaaaccttcgttcgtcgcttgggaaaacggtatttgtatttgaggctctgcgtaacaaggaaattgatttgtaccctgaatatacggggacagccattgtgacgcatctaaaggagcagccggacagcaaagatgaaacacaggtgtacaagcaggcaaaagaaggatttaaaaagaaattcgggcttgtctatttagatccaatgaagtttaataatacgtacacattgaccgtgacaaaagaatttgccaaagaaaataatctaacgaatatttcagatttggcaaatgcaacagataaagtaaaagcaggatttacacttgagtttaaagatcgtgaagacggctacgtaggcattcaaaaagaatatggccttactttcccgaatattaaaacgatggagccgaagcttcgctatcgcgctgttgaaaaaggcgatattaacatgcttgatgcttacgcaacggatcctgaaatcaaacagtttggtttaaaagtcttaaaagacgaccagcagttcttccctccgtatcaaggagcgcctgtgcttcgtgaagatacgctaaaagagcaccctgaactgaaaaaaatcttaaatcaactg

SEQ ID NO: 2129 - DNA, 222 bp, Myxococcus xanthus
cgttctttatgggtaagcgtagtatttgttaatctgtacggaggttttatctatgtcatgaatcgtttactcggtgcgaattatttatacatgatgaaaaagccagagcacgcttccttgctggatgttcttggacctcatccttggtatttagtatggattgaaggaatcatgattcttagctttcttgtcctttatcttccgttttgggtacataaaaaa

SEQ ID NO: 2130 - DNA, 156 bp, Myxococcus xanthus
atgaaaacactggttattttagcgcatccaaatttagcatcttctcgtattaataaagcgtgggcagagcgagtaaaaaaagaggaggatgtgtacgttcatgatttatacgcagactatcccgatttcaaaattgatgtagaaaaagagcaggag

SEQ ID NO: 2131 - DNA, 654 bp, Myxococcus xanthus
ttctctgttattgatcactatacgtatacgttagtaggcgatggtgacttaatggaaggcatttcttatgaagcgatgtcaatggctggccatatgaagcttggtaaacttattgctttatatgactccaacgatatttcgttagacggggaattaaatctttcatttagcgaaaatatccaaaaaagagcggaatctgcaaactggcagtatttacgtgtagaagatggaaatgacgtggatgaaatcacaagcgccattgaaaaagcgaaacagaacacggaacagccaacgctcattgaagtgagaacaattattggctacggaagtccaaaagtagcgggaacaaataaagcacacggcaatccgcttggagaagaagaagcaaaagcaacaaaacaagcctacggctgggacgctgaagaaaacttctatgttccagaagaagtaaaagctcattttgaaaagctagaagaaaaagggatgaaagcagaagcagagtggaacgaactgtttgcttcttaccaaaaagaataccctatgctggcagatgaattagaacgtgccattactggtgaggcactaattgaagtgaatgatattttaacattctcatcggaaaaagcgatttcgacgcgtgttgcaagcggagaa

SEQ ID NO: 2132 - DNA, 480 bp, Myxococcus xanthus
gaaattgtagaagctacgggaagcagtaaagggaatatttattatcactttaaaagtaaagaagggctttttctttatttaatagacgaatgggatcttgagtgggaacgaaactggaaagaaagagagtctctttacaaaacaacaagagataagctttttggaatagcggagcaaatcattttagatgatttgaatcatcctcttacgaaagctgcggatgagttttttaacaacgaggagaagggcagcgacatcgaagagcgaattgatgagatggtgaaacgacacgtggagtttaaccgggaacttttgcaacagggcatcgatgaaggcgagttttctcataaaaatgcagagcagcttgcagtaattttagaagggttgtttgttggaatgagccgcatgtctcgaaaaacgagtacggaaaatgccctgcagctttaccattcagcaatcgatgtatttttaaacggaatt

SEQ ID NO: 2133 - DNA, 396 bp, Myxococcus xanthus
aattttcccccagcgcctcactatcagcagttaaaagaagggaaagaagtagtattaaaagatggttttctattcaatggacaagagtttgtaggagaacctaaaaaagggaaggtcatcacggttttaggagatacaagaaggtgcacgcaaagtgttcagcttgctatgcatgcgaatgtgttaatccatgaagctacgtttgcagcgggagacgaggagcttgcttacaactattttcattctactgcaaaagaagccgctgaaattgctaaaacagcatcggccgagcgtcttattttatctcatatcagttcgcgttaccaaggagacgcagtcagccagttagcagaaggagcaaaagaaatttttccgaataccgatatagcagaagac

SEQ ID NO: 2134 - DNA, 126 bp, Myxococcus xanthus
caaagcgaacgcgctgatttaatttttgttgcgcgcgaacttctgcgcgatccgtacttcccgcgcacggcggcaaaagaattaaatgaaacactttcagcacccgttcagtacgaacgcggatgg

SEQ ID NO: 2135 - DNA, 372 bp, Myxococcus xanthus
atgattaaaaaaatcggtcaaattatggtgtatgtaaacgatcaagatcaagcggtaaagttttggacagaaaaaatggtatttcaggttatgtccgagcaaaataatgagcaaggcatgaagtggattgagctagcgccggtagcgggtgctgaaacaaccattatccttcataacaagcagctaatagcaaaaatgcagccggaattaaatgtcgggacaccttcgcttctgttttttacggagaatgtggatgaattatatagagatttaactgctaaaggcgtaacggtgggagaaattgtatcgatgccttcaggaaaagtctttaatttttcagacagtgaaggtaactattttgcagttatggaa

SEQ ID NO: 2136 - DNA, 438 bp, Myxococcus xanthus
gcttctattggattatcggctacagccattgcacccgggaagtttgctacagcggagcatatgaactttactactgttttatttgaaacgattggtacggttacaactgtagaggaagagcagcttcacgctgtaacaggactatctggaagcggcccagcgtatgtctattatttagtagaagcaatggaaaaagcagctgaaaaacaaggcttggatacgtcagtgtcaaatgaactaattcttcaaacgcttatcggtgctgcagaaatgctgaaacagtcacctaaaacaccggccgtacttcgaaaagaagttatgagtcctggcggtacaacagaagcaggaatcgaacagcttatttctcataacttccaagaagcgatgatgcagtgtattgaacaagctaccattcgctctaaatatttaggagatacg

SEQ ID NO: 2137 - DNA, 588 bp, Myxococcus xanthus
aaaggaaagccaaatgtagtgaaagtcatactgcaaacagcgcttgaacaaggcgtgaagcaaatcggactatttgattcggttgaccgtggtttatcaagctatgcagctgaagagcaagttgtttacatggaaacaaaagaacagatcgtcgactggcttgacctaaccgaagaacgattgcagcgacgtgaaaataagtatttggaagcagtgcaggaaggaaccgtacacggcctttcatttgccccgatcatgcttgtggtagacggatttgtacgattccagcaaaacttagacagtgtcttgcaggatcgtattacaaaattgatgaaaaattatagccacctgggctttaacttgattgttgcagggaacaacaatgagttttcaaaaggatttgacgcgttaacaacagaagtgaagcaaattggccaagctgtgttgttgatgaagaaaacagagcaaagcttatttacacttccttatgaccgaaaagaagccgacgttaaccctggcttcggttattatattaaaagtggaaaagaaacaagaattcaaatcccgctatgtgtaagtgaaaggaag

SEQ ID NO: 2138 - DNA, 632 bp, Myxococcus xanthus
  unsure (1)..(632): unsure at all n locations
gatttgtatcctcttcagctgaagcgcatcactaaaaatgaacttttatcggtgaaagacgaccttgaagtgattgccattaaaagcaagatggaaggcgggttgcgttaactgctcaaattattaaaagcggcttaactgataaagagcttgccgttattagtgagcagctgagtgacttgcctggcgtcgatacgacaacttactgggaccgtatgtatacatacgatgacttacttagcacgctgcttggtaaaatcacatcggcagacgaagggttaccaagcgaaaacttacagtactacttgtcccacggctacagccgaaatgaccgagtaggaaaaagttatttagaaaagcagtacgaagacgttcttcgtggtcaaaaagcgcgcatacaaaacgtaaccgatcgctccggcaacttagtgagtcaagagaccgttactgaaggtcagcgcggcactgacttaattttaacgattgatatggaactgcataaacaagtcgaagatgttttaacgaaagctgtacttgaaggctctgcgaggaaccgcttaatggaccgagcgtttgctattatgatggacccacatacgggagacattttancaatgggaggaaaacagctt

SEQ ID NO: 2139 - DNA, 576 bp, Myxococcus xanthus
cttttggggtaacagcccctttaccgaaaagaagcgctagcagaagtaaaagcacacgcgcaaagtatgactgatgctttaaatgaaagcggtatcttaccttatccggttgtgctgcaagatttagctgtgagtgctgatacgattacaagcatgatgaaagaagtgaattaccgagatgaagttgccggtgtaatcacgtggatgcatacgttctcgcctgcaaaaatgtggattcgcggtaccaagttactgcaaaaaccggtgcttcatttggcaacacaatttaacgaaagtattccttgggaaacaattgatatggattttatgaacttgaatcagtccgctcacggtgatcgtgaatacggctttatcaacgcgcgtttgaacaagcaaaataaaattgtagtaggctactgggagcgccccgacgtacagcagcaaattgcacagtggatggacgtagccgctgcttataacgaaagcttcaacattaaaatcgcgcgtttcggtgacaatatgcgcaacgtgggggtaacaaaaaggagataaatcgaagcgcaaattccatttgga

SEQ ID NO: 2140 - DNA, 654 bp, Myxococcus xanthus
acgcctgtgtttgctatctatgccaatgctgcagcgctcgtggtgtcaggaatggttactttattaatgccgaacttagatataaaaacagaagctaaagaaaataaactctctgtaaacacaattggagaagattggaaagcggtgtttcgtttcagtagagctaacagatacattatcaccatttatgtattgttcagtttcttaatggtcatggccacggcaattgattctcttgaagtttcatttgcaacaagagtcattcatttatccgaaagcgaatacggatttttagtaagcgtagcaggcgctggcattatgattggcgcagttgtgaatacactgttggctcagaagctgtcggcgaactttctcataggcgccggcagtgtaggagtatcgcttggctatttgctgtacgcgtgttcgtcttcttttcaaaccatgggaacaggattttttagcttatcttttgcgttagcttttgcaagtgctggttttcaaaccttttatcaaaacagcattcccgttgacatgatggggagagtaggaagtatctatgggctacttgagtcactgctaattattatgatgacctttctatgcggaatgtccgcgcacatcttttcgattcaaggagctgtagttggtgga

SEQ ID NO: 2141 - DNA, 465 bp, Myxococcus xanthus
gtgccaacactggtgggcagaagcatcttccagtccatatgctactggcactcgtggaggtgcagcacaacctacatcagccggtggacggtgttcatgcccacggggtcgaggtatccgtccgggctgatagtccccagggtatagagtaagagccccatggtcttcctgcaccgcacgagcttcctaggcatgaacagaaagtattgtattccgtgcgagctggtgcattgcccatcaaggtagtaggtcatgtccgcgtgcgcggtacgccgctcccagttgacaacctagtagcccaggtccatgaacgcgtaaagggtctcgttcgccacctccatgatcgtgcagtagatcatgtggctggtctgggtgagcagtggccgtcccatcagcttgtgcttcaagacctgtcaaactctgaccaggcacggaatcagctcgtggatcaccgccaagcgctca

SEQ ID NO: 2142 - DNA, 141 bp, Myxococcus xanthus
atcagcacgcaaatgtcgatgatggcacaagacgaccaagggtatgtagccggactaaattctgcttatacaagtcttggtaatattattggacctgttgtagcaggctttctttttgatataaacattaattacccgtac

SEQ ID NO: 2143 - DNA, 327 bp, Myxococcus xanthus
atgctcaacgcggtctatgtggggattgcgatcgtgctatagcaggtgcggaccatagcccttaataggtctaacgtcttccagcgcagggggatgtgcatcctaatggacgtgagctatggcgcggcgttcaagtgcgtgtcgtttgggctgagggcgatccccgcgggtgtggcgaactcgatctggtcgggccaggagatcgtccttgtctatggggcggagtggctcgttcagtggcaattcttgaaggtccgggcggtcgcaggcaacgagttcgtcagggtgggtgagatggtcatcaatacgttttccagatgggcggtg

SEQ ID NO: 2144 - DNA, 668 bp, Myxococcus xanthus
atggcaaaaatgcacattcaagatattcaacatatgtgccttcgcacaaagtctgggggcactgagcttgaacacattaatttgtctattgaagaaggagaattcgtttcctttgtcggcccaagcggatgtggaggaacgacgcttctatcgattattgcaggcttgattgaaccaacgtacgggtctgtcacaatagacggtgaaaatattggaacatcagtcccaaacatcggttatatgcttcagcaagattatttgtggcagaggaaaaccactaaaaggaatatctcacttgggcttgaaattcccgggcagcgaacggataaaacagagagtaaagccccttcggttgtaaaattaattggtgtacagtacgtaaatgacctatatccgcgtccagtaatccggaggcatgagacaaaaggtcgctttagtcggatgaatggccaatgagcagggtattgtggtgtcggagtagcctatataagcactggaggttcaaacaaaactcaagcgtgaagaaggtgtctcgaaggtctatgatgtcctatcaagaaacggccgttttggtcacgcacgagatcggcgaagccaatgctatgaacagccgaatctttttattttcagccaagccggggaagatcgcaaaaacatttacggttcct

SEQ ID NO: 2145 - DNA, 513 bp, Myxococcus xanthus
cttcttcgcgctatgaagcttggaaagcactttatgtatcgaagcgctgcggctctaacaaaagtaatgggcggcgtgagcgataaagaccttttaacaaaagaagagctcattaaagagaagtcgtcaaacgacgcattaattatggttggttcacacgtcaaaaaatcaacggagcagttagaagaattaaagaaatgcagcttcattgaatttattgaatttgactgtcatcttgtcttagaacctgaaaagtttgaacaagaagtgaaccgtattatcaatgaagcagataagcttatttcacaaggtcaaacggtagctgtgtatacaagacgcgagcgcttagatcttggcgaaggcaaaaaagaagaagagcttaaattatcggtaaaaatttcagatgcggttacaagcattgttcgccgcttaaacgttcgtccagactttatcgttgcaaaaggcggcattacgtcaagtgatattgctgtgaacccattgtctgcagagcgc

SEQ ID NO: 2146 - DNA, 520 bp, Myxococcus xanthus
ctaaggggcgcaataggccggttccggctccacttacggaggactgcggcatgcgatatacgcgcgagcaccaggtgttttactgattgactagtccaataatgggccacgcgcgtgcacccgattgacgtgggatacggatagcttcacaaaaagctgaccactgactcatgggtgcggtcacaccagcgcgtatatgcgcgctacctaacaggagaatacctgccagatacagtgggtgtatgtgttatagacctgagcttaatatcactcacacaagggctgccaccagtgctaacgtacatagcaccaggcggattatcactcgcgctagctaagccctagctataggtgggggctgcaccacgtagggaaagacggcctggtgcctgatgtccatcccaatgaggatggcatcgacactgtgacggactatgtactcgaacatggcctggacgatctcgggcagatggactacactgtgccccgccccgttggcaatgacgacgcacttgctctg

SEQ ID NO: 2147 - DNA, 567 bp, Myxococcus xanthus
atggcaacgtttaaagattttcgtaacagtgtaaaacctaactggtgtccggggtgtggagatttctccgtacaagcagccattcaacgcgcatctgctaacgtaggtttagaacctcatgagcttgctgttatttcaggtattggatgctctggacgtatctctggttatattaattcatatggttttcacggtattcacggacgtgcgcttccaatcgctcaaggtgtaaaaatggctaatcgtgatttaaccgttatcgcatctggcggtgatggagatgggtttgctatcggtatgggacacacggtacatgcgattcgccgaaacatcgatgtaacgtatatcgtaatggataaccaaatctatggtttaacaaaaggacaaacatctcctcgcagtgaagtaggattcaagacaaaaagtacgcctgaaggatcaattgagtcgtctttatctgtcatggagctggcgttaacttccggggcaacgtttgtagcgcaaagcttttcaacgaatttaaaagagttaacaagcttaattgaacaaggcattcagcataaaggt

SEQ ID NO: 2148 - DNA, 531 bp, Myxococcus xanthus
tggaaacgaaacttgtacatttgctggttcggttctttttgcaccacagccgggatgagtttagttattccgtttttaccgctttatattgaaaagctgggagttcacgatacaagctccatcagcagatgggctggtattgcgtttggagctacctttttaatggcggctattgtttctcctttatgggggagtttggccgataaatacgggcgaaagcttatgctccttcgcgcaagcttgggtatggcaattgttatgacttctattggttttgtgcaaaatgtctatcagcttgtcgggctgcgctttttaatgggggccgtttccggcttcatctctgcagccattacgttagtagcgactcaaacacctaaagagcacagcggtaaagcattagggacgttgtctacaggggctgtatcaggatctttattaggaccgctagtaggcggctacttaggagatacaattggattgcgtcacgtctttttcgtaacaggcgcatttatgtttttgtcttttttaatt

SEQ ID NO: 2149 - DNA, 441 bp, Myxococcus xanthus
tattataccgtaaaacaagaaggttcacatgaaatcactattcaaaaatctagattcatttgtcatatgaaacgtgtaacaactgaggaagaagctcagcaatttattcaagacattaaaaaacagcactggaatgctactcataactgttcagcttacctaattggagaacgagatcaatttcaaaaagcaaacgatgatggagaaccaagtggaacagcaggcgtaccaatgttagaagtgcttaaaaagagaggcttaaaagatacggtagtcgtcgttacgcgctatttcggaggtattaaattgggcgcaggtggattggtgcgcgcgtatggaaaatccgtttccgaagcgttaaatgaaataggtacagtcaaacgaactctcatggcggttatgcatacaacccgtcaactatacatgggcttggaaaaaatt

SEQ ID NO: 2150 - DNA, 552 bp, Myxococcus xanthus
  unsure (1)..(552): unsure at all n locations
cttcagcaagcccttgctccatttggagaaatgttcaaagcagcatttaacgtaaacggtgtcgttccaaataatgaagccatcgttgcgattgcactgagtaaatatggttcttcgaccgcattaattatgttttttggtatgattgtaaacctgctgattgctcgttttacacgatttaaatatatttttctgacaggacatatcactttgtacatgtcatgtatgattgccatcattttatccgtaagtggttttacatcgttttcattaattctctttggtgctttaacggtgggaattttcatgacgctttctccagccctcgttcagccttttatccgtaaactaacaggtaatgataatgtggcattaggacattctggagcagttggttttgcagttggtggtctcgtggggatggctgtaaagggaaagaaagagattgtatcaacagaaaaaattaactttccaaaaggtctcggcttcttacgagacagtacngntagtattgcattaactatggcgattttctacgttattgtcgctctt

SEQ ID NO: 2151 - DNA, 474 bp, Myxococcus xanthus
gaaattcagcttttaccaagctttgcttctcagctgccgctatccattgcagagcccatttttttcggtaagccaaatgcagtatatctttggccgtttcggggctatcattacgttcaaggaactccacgtgcaagattagcagaagaagagcacatacaatctgcttctgtactagcaaggtttcttcgcacgctgcatcactatccgtattcaaaagcgcaagagcttgctgttccatttgatgaattaaatagattggatatgatgaagcgaaagccggcgttagaaaagtatgtcaagcaaatgaaagagcgtaatctttattcaaaacaagagattcttgaagactatgtaaatgacatacaagaaattcactatcaagaaaaacatgtactagttcacggagatcttcatattaaaaacatgattgttaatcaaaccaatatggtttcaggcatcattgactgggga

SEQ ID NO: 2152 - DNA, 588 bp, Myxococcus xanthus
ggcgtgtcctcgcatctttccgttatggaagttactttattatcagcgctcgtgtatgccggggctgctcagtttattatttgtgcactgatggttgcgaacagttcgatttcagctattattctcacaacattcatcgttaacttacgacattttcttttgagcgctacggtcgcgcctaaattcacaaaatattcgttattaaaaaacgtcggaattggagcacttctgacggatgaatcatttggagtgtcttcaaataaaattgcaaaaggtgagccaattaatgaccgctggatgaacggattaaatataacggcttacgtcagctggattattgcctgtacggcaggagctattttcggtcatttgctatcaaatccagaagcctttgggtttgattttgccttaacagctatgtttttagctctgcttgttttacaaatcgaaagcgtgttaccttcaaaacttaatcattatttacgtttaattctttatatggcgattattatgattgtgctgtcttttttggtaccttcacatgtagctgtcttaatttcaacgattattgtagcgacgattggggtg

SEQ ID NO: 2153 - DNA, 702 bp, Myxococcus xanthus
agtattgacatggcaaaacaagcggtatcagaaggcattacggctattgttgccacgcctcatcatcagaatggcagatattttaatgaaaaagaagctattttacagagtgttgaacaattaaatagtttattagttcgtgaaggagtgccattaaccattttacctggtcaagaaaaccgtatttatggtgaaatcttagacgactatcatcaagacaaaatactcactttaaacaatacgggaaaatacttgtttgttgaatttccttcgagtcaagtccctcgatatacggagcggctgctgtttgatattcaatcacagggaatcatccctattatcgtccatccagaacgaaacagtcggttgttagaagaccctgatcttctctataactttattaataaaggagcattagctcaagttacagcttctagcttggttggacaatttggaaagaaaataaagaaattttctcaccagttaatagacgccaacctcgtgcattttgtttcctcagacgcccataacctccaacatcgctcttttcatatgcaagaggcgattgatgtgattgagagtgagcatggaagagattattattatatgtttctagaaaacgctcaatgcgttatcgacggaacacagtgttacaaagaatcttcagaaaaaattatgcggaaaaagtttctaggcattttt

SEQ ID NO: 2154 - DNA, 450 bp, Myxococcus xanthus
atagataaaggccgaaaatcatttattgtagcaatcaatcctgaaaaaattatgaaagcacaagaaggtcaggaactaaagtcactgttaaatcaagcgacttatcaaattccagatggaatcggtgtgattttagcttcaaagctcaaaaagggacgtattcgtgagcgtgtaacgggtattgatatgatgctgaagctgtgcaaagaagcaactaataacggtaaaagaatttttttatacggagccaagcctggcattgcagatgaagccaaagctaaattggaagagatgtttccagggattttaattgttggaacattaaatggctatgaaaaaaatgaagaagttattgcacgtacgattaatgattcaagagcaaaaattgtgtttgtcgctttaggcagtccagcgcaagaaaattggattattgctcataaaaaaaaactc

SEQ ID NO: 2155 - DNA, 675 bp, Myxococcus xanthus
atcgatcccaaaaaagatgatatatccatttattttatgggcgtagatgacagtgaaaccagaaagttcggaaaatcagcccgtacagatgctttgattttggcgacctttaacgaaacaaataaaaccgtaaagcttgtaagcatacctcgagattcgcgggtttatatacctgaagtgaacaaaaaagataaaattacgcatgcgcatgcgtacggaggtccaaaagcaactgtagaaacggtagaacagctgtttaatgtccctgttgattactatgttaaagtgaattttaaagctttcacagacattgtagactcacttgggggaatcgattttgatgtaccttatgcgatgagtgaaaaggactcaaaagatcgtcataatgctattgtcttaaaaccaggaaaccaacatttgaatggtgaagaagcgttagctgttgctcgaacacgaaaacaagacaacgatattgagcgaggaaaaagacaacagcagttgatcgaagccatgattaaaaaagctgcttccattggatcacttaataaatatggcaatcttatcgaagcggttggcgataatatgaaaacgaatttaatgttcggtgaaatgctttcgttttatgattacgcttcgaaaaaagtagacatcgaaaccattaacttagacggtagc

SEQ ID NO: 2156 - DNA, 177 bp, Myxococcus xanthus
gtggacaagcagcgagcaaaacaaattgctgattcacccgttatggctaacgttacgtataacgatacggccgtttatattcaacatgtaagcgaagaaaatgatacggcaagaatttatccgctaggtcagccggaaaatgaacaaaatgttgcggtgagtccattagtagagaat

SEQ ID NO: 2157 - DNA, 309 bp, Myxococcus xanthus
atgaattttatctggcaatctgtaatcttgattttaacgggaatcttattgttgagaatagcgggaagaaaatcgattgctcaaatgacgctcgctcaaacggtcggtatgatttccttaggtaccatcatttgacaacctattggtgagaaaaggatgctaaaagccattggggggggagcaatttttggtcttgctattttaagtttagaggacttacaattaaaggttaatggatttgaaaaaattctgacagggaaatctaaaatcggtattaataatgggcaattagatactaagcagcttaaa

SEQ ID NO: 2158 - DNA, 471 bp, Myxococcus xanthus
aatttctttcagttttatattattgaaaaatttaatttgcctatcaaaagcgctcagctttacgtttttttatttatgattgcaggggtgtttggaacattctttggaggtccgcttgccgatcgtttcggaaaacgaaatattttattgttttctatgttagggtcagtaccgtttactttattactccctcacgtttctctcggagtcgcagcgcctcttttaatactaatcggctttattctccagtcaagtttcagcgtcacggtcgtctatgctcaagagctgatgccggggaaaattggcttggtttccggcttaattgtagggcttgcttttgggatgggagctttaggagctgttgtattcggtaaattagccgatgtcttcagccttcagtttattatgctgttttgcagctatttaccaatcctagggctgttaacatggctgttgccgagcgataagcgt

SEQ ID NO: 2159 - DNA, 474 bp, Myxococcus xanthus
gcgcaaaaaacatttgaaacatggcgtaacgttcctgctccaaaacgagcaagattaatgtttgcgtttcagcatttactagttaagcatcacgaagagttagcgaaattagttgtacaagaaaacggcaaggcttttaaagaagcttacggtgaagtacagcgcggtattgaatgcgtggagtttgctgcgggtgctcctactttattaatgggagaatcattaaataacatagcggaagaaattgattctgaaatgttccgtttcccacttggtgttgtcggaggcatcacaccttttaattttccaatgatggtaccgctgtggatgttcccgcttgccattgtatgtggaaatacgtttgtattaaaaccgtctgagcgaacgccgcttttagcaacgcgacttgctgaactttttacagaagcaggagcaccggatggattattaaatattgtacacggggcacatgat

SEQ ID NO: 2160 - DNA, 426 bp, Myxococcus xanthus
actgaaacacaaaaaacggtgaaaattattgagcaaacagaaaagtttggggcacataactatcatccgctgccgattgtaattgaaaaagcagaaggcgtatgggtacacgatccagaaaataataaatatatggatatgctaagcgcgtattccgctgttaaccaaggacatcgtcatccgaaaattattgaagcattaaaacgtcaagctgataaagtaacgttaacgtcacgagcgtttcataatgatcagcttggtccatggtatgaaaagatttgtaaattaacaaataaaaatatggctcttccaatgaatacgggagcagaagcggttgaaacagccattaaagctgcacgccgctgggcttacgatgtgaaaggtgttgctgaaaatcaagcacaaatcatcgcatgtgtgggcaac

SEQ ID NO: 2161 - DNA, 141 bp, Myxococcus xanthus
ttttttaacagacgatgtacaggagcgattgtaggataccagccttttggcggatttaatatgtcaggaacggattcaaaagcagggggaccggattatctagttcttcacatgcaagcaaaaacaacatctgaaacattt

SEQ ID NO: 2162 - DNA, 156 bp, Myxococcus xanthus
ctagaagcatctctttggtcttttctgcaaagtgatgactacaaagaagctgtacttaccgctgtgaatttaggagaagacacagacacaataggctttattaccggtactatggcaggagcatattatcagctggatggcattcctgaagagtgg

SEQ ID NO: 2163 - DNA, 546 bp, Myxococcus xanthus
tctagtccgttctttgtcgaagccaccgtgatggactgtgcgccagggcactgctctccccgagcaatcgtatgccacttaggcattgctggcaccaatgacaacccaatcctgaaggagggcgcaccggtaccgtcaaccggggaaccccggccgtggttcccgctgtggtaagcacggaacactagaaccggcctgcataccggtacagaggagctaccaagtgacctggaacaacaaccggaactcgcgctgaaagacacagcctacactctgtaagggagaccgccggccttgcaacaccgtcgtattgccaccgggaaggaccgggagcacaccatccacatgttgcgaggtgacaacccataccgaatgcggacgctgaactaatacgcacgacgtcggcccgtgggagtcctattgagggcaggacgcacgcaccaactgaggataggcgcgaccatgtaccgtacgtacgccgtctttcgtgagggcggcgaccaagtaggcagcggtctgcgcacgaatgtaaggggagatcttcgc

SEQ ID NO: 2164 - DNA, 567 bp, Myxococcus xanthus
atggtacaggtcagtcaaaatgaaaaagatctgcgtgcaaaagatgagcagtatgtatggcatggaatgaaaccatacagtccggatgcaacgatggtagctacaaaagcaaaaggtgcttggattacagatgaacaaggaaatcgctatttagatgcaatggcagggctttggtgtgtaaataccgggtatggacgggatgagttagcgctcgcagcttacgagcagctaaaagaactggcttattttccgctcactcaatctcacgtacctgctatcaaactagcagagaagctaaatgaaatgctaggtgatgactatgttatcttcttttcaaatagcggatctgaagcaaatgaaacggcttttaaaattgtgcgtcaataccatcagcaaaaaggagagcattctcgctacaaatttatttcgcgttaccgagggtatcacggaaattcaatgggcgcactagcagcaacgggccaagctcagcgtaaatataaatatgaaccgcttgctcctggcattattcacgttgcgccgcctgattcataccgagggcaagatgac

SEQ ID NO: 2165 - DNA, 666 bp, Myxococcus xanthus
aaagagcacggcggttttatggaactgtcagatttgaaagaataccagattaagattgatgaacccgtgtggggagattataaaggataccgaattgcttcttccaacatgcctagtgcaggaggagctacggtgctgcaaattttaaagctattagagaacttcgatgtgtctcagtacgacgtgaaatcgtgggaaaagtattatttgtttgcagaagctatgcgcattgcattttcagataaaattgcattctctggagatccagcctacagtgacattccattaaaagggcttttaaatgacgaatatataaaggaacgtcaaaaattaattaattggaagcataaaaatgagaaagttgattttggcaacccgtgggattatgagaaaggccaaaaagtgaacgttgtgcgtcagccttatgaacctgaacgcgagcttagtgaaacaactcacttcacggtagttgaccgctggggcaatattgtcgcgtgtacatcaactgtggaacatccttttggtacaggaattatggttaaagaccatggatttttactcaacaacgagcttactgattttgatgctattcctggagggctaaaccaagcggatgcaggaaagcgtccggttagctgtaaaagcccaaccatcgttgttaaagac

SEQ ID NO: 2166 - DNA, 348 bp, Myxococcus xanthus
tatgttgttccaaatggcgtatcggctactcaatataagcgccttcaggactcaggtctatatccttattttaaagaagtatttgtttcagaagatacgggctttcaaaaacctatgaaggaatattttgattatgtttttttacgtataaaagagctgtccgtacatgaaacattaattgttggagattctttgagtgcagacattcaaggcgggcagctagccggtattgatacgtgctggtttaatcctcaggaaaaaaagaatgatacaaattggaattcaacctatgaaataggaaggcttcaagagctttataccctgcttaatgtaaataatgaagtagct

SEQ ID NO: 2167 - DNA, 309 bp, Myxococcus xanthus
atggagcgcttttttacttatgacaacagactcggtataaaaattcctgctcttgaaagagaatggacattctattctgaaaaagttcagcaggatatcctcctaacatgggaatccattcgagggcaaattccagacaaaattcaatctgtagaaaagaggattaatcaaaaacaagcggcgttagaagatgagactaattttatccgctcctgtgaattaaatagcgagataggagaacttgcttctattattaatgatttgtggctttggtatcgaacaaatgaggaaatatcagaaaaagttcac

SEQ ID NO: 2168 - DNA, 111 bp, Myxococcus xanthus
atgatgagtaatccaaaagttgttttagcatattccggaggtttagatacatcagttgcaattaaatggttacaagaaaaagggtacgatgtggtagcttgctgtttagac

SEQ ID NO: 2169 - DNA, 96 bp, Myxococcus xanthus
atgagtaaaggaaatcagtggtcttcacgcctcggttttattttagcatctgctgggacagcaattggtctaggagcgatatgggaatttccatac

SEQ ID NO: 2170 - DNA, 711 bp, Myxococcus xanthus
ttactagctgtgcgcattattgtaaatagcattaaatactgctatgcggtgttagggattattcacacgtgctggaatccaatggcaggacgtttcaaagattatattgcgatgccaaaacaaaatatgtaccagtctcttcatacgacggttatcggaccaaaaggtgatccgttagaagttcaaattcgaacatttgacatgcaccaaattgctgagtatggaattgctgctctctgggcttacaaagagggaaaaacagctgagcatgcttcatttgaagaaaagttaacgtggtttagagaaattttagaatttcaaaatgatgcaaacgatgcagaagagtttatggaatctctaaaagttgatttgttttctgacatggtttatattttcacgccaaaaggcgacgtcattgagcttccttcgggttctgttccaattgatttttcctatcgtattcattctgaaatcggaaataaaaccattggagcaaaagtcaacggcaagatggttacgcttgattaccgtttgaaaacgggggacattatcgaaattttgacgtttaagcattcatatggtccaagcaaggactggttaaagcttgctcaaacgtctcaagccaaaaataaaattcgccaattctttaaaaagcaaagccgcgatgaaaatattgaaaaaggcaaagagctggttgaaaaacaaattcgt

SEQ ID NO: 2171 - DNA, 582 bp, Myxococcus xanthus
catttaggggaaatagataaaacgggttcactaaaagaagcagctggtaacctgcatattacgttacctgcattaagccaatctataaaaaatttagagaaagaactaaatataatgatttttcatcgttccagaagaggatctattccaactgaagaaggtcataggttaattgaaaaggccagcgctgctttattgaaaattcaagaatttatggatgaagcagaagcgtatacaaatacaatgaatggtgaaataaagattgcaacctacccaggaccaatggagattctcgttcgcttaataacagaaattaaaagagaatatccgaacataaaggcttctgtctatgaaaatagcaccgagtatattatagataaagttctagatggggaagtagatgtaggtttcattacttatacagaaaaagaagaaaaaaagtatcggaacttggtatttaaaaagttattggatggtcatatggtagctgcagtaaataagaagtcgccattagccaaacaaacactcattactgaagagatgttaattaaccagccaattgttttatataacgacaagtat

SEQ ID NO: 2172 - DNA, 390 bp, Myxococcus xanthus
gatgtaaaaaatcaaattttatcggtactggatgactatacaatcggaacgttagctacgattcaagatggaaaaccttattcacgctttatgatgttttttcatgaagatcttgtgctttacaccgccaccaataaagatacccacaaagtcgaagaactagaaaaaaacccttacgttcatattttattaggctatgatgggcaaggttggagtgatccgtatgtagaggtagaagccaaagtaaatgtagaaacaaacgaagagttaaaaaagaaattttggaatgaaaagttaaaagagtggattaaaagtccagatgacccaaattttttgcttcttcagctgactcctgaacgcatgcgctattttgataaagccggaagcaaa

SEQ ID NO: 2173 - DNA, 528 bp, Myxococcus xanthus
ggaatcatatttgcttacaaacaaaaaggtgaccatcttgtttacagtatgtatcaaggagaaagcgtttctgagcaaaaaatacctctagaagaatggatctcgtatgagcattttttcgaagcgctaaataaaaagaaaaagcttatgtacgagcttcaaataaatgataaacgctatgtagtaaacttaacccctttatcttacacagaaaaacctgaaattatgggacattgcgtgaatataactagttatcaggagaaaaaagaacagattcagccttttatttatcataacgcagatgctgttgctatcgttgacttagagggtaaaacgcttcaagtgaaccctgcgtttgagaatacattcggctggacgtttgaagaaatttatcaaaagcctcttccgattataccttcgtttttaaaggagcccgtgtgcgaacttcataagactattcaatcaggggaatcgaaaacggaatttgagacggtcagacagcataaagacgggcatttaattaatgta

SEQ ID NO: 2174 - DNA, 312 bp, Myxococcus xanthus
  unsure (1)..(312): unsure at all n locations
tttcagtcacctaaactgttacaggatatgcttgatcaaatcgnaagtatcacatcgggagcagctttgtttgcggtaggagtaacgattggaattggaaaaattaacttcagtaaaggtgcgcttgggatcgctgtcttaaaagtagcggttcaaccgatcgttatgcttggaattgcagtatggataggattatcttcagatgaagtgacaaaagctattttactggtagcttttcctgggtctgctgtagctgcgatgattgctttgaggtttgaaagcttagaaaacgaaacggcatctgcttttgtc

SEQ ID NO: 2175 - DNA, 192 bp, Myxococcus xanthus
attcgcggcggagcactggaatcattcgttcctgtcttctctggtacactaggaagtcttggacgcaaagatgcaattggtacaatcggcggaaacaaaacgcaattaaaaggtttaccagcatcacttatgaaagaagcaagtaacgttcgctacttatctcatatcaaaggattattcgcattagcttat

SEQ ID NO: 2176 - DNA, 378 bp, Myxococcus xanthus
gtagaaattgcccactcgtatcaagtgcctgtacttgttgatgaagctcacggcgttcatattcacttccatgatgatttgcctctgtctgctatgcaggccggtgcagatatggcagcaacaagcgttcataaattaggcggttctatgacgcaaagttccattttaaacatacgcgaaggcttaatttctccaaaacgcgtacagtctattttaagcatgctgacaacaacatcaacctcttatctgctgctggcttctttagatgttgcacgaaaacgtctagctacagaaggaaaagagctggctgaacgtgcaatttctcttgctgaaaaagcacgaaaagaaattaatacaattgagcatatccgatgtata

SEQ ID NO: 2177 - DNA, 597 bp, Myxococcus xanthus
cgattgcggacgaacttccacatatacctgcaactggacgccctgttcgagcatagcacggaggggggtctagccgatcccgtggatcaccagcgggctcaacgtgctgcaggcgtcctgcacggcatacgtgcccatgcacatgacggcgcactgggacaccactgcggccatggatgcgtggacttgaaggatcaacagagacccgactcacggagcgacagcaaccctggagggggagacatccacggacccctggaacctgccgccattgaccacctccttgtgcaactggtgcaactacacgaggggctgctaattacgtcgcgcaaccatgggcacctgccagggcaggaccatcatcttaatgggactgttgagctagccatcacggacggctccaccctgcatgaacgtgactgtgatgcccggcatcaatgcctacggaaccaagaagtccatctacagttcaacctgcagcacggtcacctgttgcgggcgcactggcttaggctgccacttgacagggacggcctgttccgcacgacccacctcatagggtgcgaggggtgcgcctcgggcatgcttgcaccggag

SEQ ID NO: 2178 - DNA, 525 bp, Myxococcus xanthus
aaagaagcaggtatttttgtttctgatgaaccaggaagagcaagagtgcttccactgtcttatgaaaaactggcgcagctaagagagcgttcgggcattttggtgattccaggattttttggctactctgaagaagggaacatggttactttctcgcgcggtgggtcagatattacaggttcaattgtagcagcaggagtaaaagctgacttgtatgaaaactttactgacgtagatgctatttacagcgtagatccaagacttgtggaaaagcctcatgaaatgaaagaagtcacatacagagaaatgcgtgaactatcctatgcaggtttttctgtcttccatgatgaagcgctagagccggtttataaactaggcattcctgtatgtgttaagaatacaaataatcctgaagcaaaaggtacatttattgtagctgagcgctctcacggcgatacgccagtagttggaatcgctggggacaaaggtttttgccatattaatgtgagcaaatacttattaaac

SEQ ID NO: 2179 - DNA, 378 bp, Myxococcus xanthus
gtgctcgtgcatgactagtgcaccgggtccgacgagaccggaagccacttgtgcacatggcggccatacttggcgcatgggattgacgagtgtgtacacaccgcgcaggcggttggcgcggcgctcatgagtgtacctgctcactgaaagccgggcactgctcgaggagacgaaggtcctggtgtacagaacacccaatcgcatgaggagtcattccgcgccacctaatgacaaaccacccagtgcagggccggcgctcatgacatacccttgcaacagctgatcccacaccagctggactgcgtgagcataacaccgattcaccgattagcatcgagtagtgacatgaaccacaagccaattactggctgggccatt

SEQ ID NO: 2180 - DNA, 495 bp, Myxococcus xanthus
tttaaaacgatggaattttcaaatctgcttcttagcttagaaagtaataaaattgatctgattgctcataacatggctcagaacgctgagcgaaggaaaaagtttttatttaatgatgaaacatataattattctccgctttatgtaacagttcctaaaactcgaaatgatattcattcattaaaagatttagaagggaaaaaaatgattgtaggagctacaagcaatgcggctgtctatctagacaaatataataaaaaacacggcaataaaatcgatgtagtttacgccggtcaaggtgcggatgatgctaccactcaattaaaaacaggccgagcagatgctacgcttgcgacgccattttccatcgattttagcaatcaagcgctaaaatttcagcaaaaaacggttggagatattgtgattaattcaaaagtgtattttatgtttaacaaaaaggacgaaaagttaaagtcagaagttgaccaagcgatt

SEQ ID NO: 2181 - DNA, 162 bp, Myxococcus xanthus
attacacttcttgtgaattatttagcaaatgcgattccaataggaggcaaaacaacggcagaggcttctgcgcaagttcctacgttgtttacaccagccggttatgcctttgctatctggggcgttatttatttgttattaaccatttgggttatacgccaa

SEQ ID NO: 2182 - DNA, 437 bp, Myxococcus xanthus
ccaaagcttatcatttgtgatgagccggtttcagcgctgaacgtatccattcaagctcaaatcttaaacttactgcgcagtttgcaaagagaaatgaagctttcatatctctttatctcccacgatttaagcgtcgtaagacatattgcagaccgcgttggcgtgatgtatttaggaagattagtagaagaaggaccaacagatgagattttttcaaaccctcgtcatccttacacaaaacttcttttatcatctgtcccagcgattaacgaacatgaaaaacggaaaaaattgaggttaaaggtgaaattccttctcctcttaatccaccttcaggctgtgcgtttcataaaagatgcccgttcgcatttgaccgctgcatgaaagaaacacctgaagatacagtgattgatagcaagcataaagtaaaatgtcac

SEQ ID NO: 2183 - DNA, 390 bp, Myxococcus xanthus
gtcggacgactagataaggattcagacggcttaattttacttacaattgacggcaatattattaacgaaattttacgtgcagaaaacaagcatgaaaaagaatatattgttgcagtagataagccgattacacccgagtttatcaaaaacatgtctgagggagtaaaaattttaggtacaaaaacgcttccttgtaaagtgacacagctgtctaagtacgagtttcaaattattttaacacagggcttaaatcgtcaaattcgccgtatgtgtgaagtgctcggatatgaagtataccgacttcagcgtacgcgtattatgaatattcacttaaacaacttgcctgttgggcaatggagagatttaacgaaaaaagagcgtacgcagcta

SEQ ID NO: 2184 - DNA, 417 bp, Myxococcus xanthus
ttgccgctgtatataacggatacgttaaagcaatccgtttcgattgtaggaattctttttaccgttacgtctgtttttgaactaatatttatgccgttaggaggctatttttctgataaaatcggagtcaaacgcttctttgttatcggcatagcttgccaagtgctttattttgttttaacaagccttcatttaccgctgagtggattgattgcgcttcaagtattttatgctttcattctatccgctacaatgggagttggcatggtgtatgctcagtcactggccccgcgtcaaattggactagccacgacggcatatatgacagctatacaaacctcaacagttgtcagcagcttagctatggggtcactagttagcgtgattcccgtgccttctactttttacattttagct

SEQ ID NO: 2185 - DNA, 330 bp, Myxococcus xanthus
atgattgtactagaaaatagcgaaatgaaagtcagcgttgaagaaaaaggagcggaagttgtagaagtatttcataaagaaaaaggcctgcagtttatgtggagcggagaccccgcttattggggacgagtatcgcccgtattgtttccaatcgtaggccgattaaaaaatgatcagtataccgttgatcagcacgaatactctttgcctcagcacggctttttacgtgattctactttcaccgtgattgagcaaacaaacgaaacagcacgactgaaatttgccacaaacggccggtttaaagacgtatatccatttgaatgttcactt

SEQ ID NO: 2186 - DNA, 690 bp, Myxococcus xanthus
atatatccgaaagaagatgtgaagccaattcttttaaaggcgctacctgacctgaaccgcactagtgacaaagaactagaaacgcgttatgacgtactacctttcactcgtgcagtatctgaaacgcttggtgaagagcgcaagtgggtacactacggtttgacttcaactgacgtagatgatacagctctatcttatttattaaagcaagctaatgaaatcttgctaagtgacgtatagcgctttgtagaagtactaaaggaaaaagctcaagaacataaatatacggttatgatgggacgtacgcacggtgtacacgctgagccaacgacatttggtttgaaaatgggattatggtatgaagaaatgaagcgtaacctagagcgtttaaaacgtgctgcagctgaagtggaattcggtaaaatgtcaggagcagttggaacgttcgctaacatcgatcctttcgttgaaaaatacgtatgtgagaagttaggaatttcaccagcaccaatctctacgcaaacattacagcgtgaccgtcatgcacactatatgtcagtactagcgttaattgcgacatctattgagacatttgcagtagaagttcgcggtcttcaaaaaagtgaaacacgtgaggttgaagaaatatttgcaaaaggccaaaaaggctcatctgcaatgcctcataaa

SEQ ID NO: 2187 - DNA, 387 bp, Myxococcus xanthus
atggaattttttctgacgatattagtcttattggctttgattggtctatctaatatcattaatcattttgtgccatttattcctgttccgttagttcaaatagctttgggagcagggcttgctatattgccatttggcggagatgtccatttggaacctgaattattttttattttatttattgccccgctattatttaatgatgggaaaaacgtgtcaagagctgctctttggaagcttcgtacacctattttattactagcgctgggactggtttttgtaacggtggcagtagggggatatctaatcaattggcttatcccttccattccgttaccggcggcatttgcactagccgctattttgtccccaacagatgtagtggca

SEQ ID NO: 2188 - DNA, 423 bp, Myxococcus xanthus
atgagtaaagtatcaagtaagtttatcttcttcttcggctcatttgccggtattttattcggttatgatattgggattattgctggtgcagaaggtcatatccgtgaagcgtttcatttaagtccgctgtggctggggattgtagtttcatcgctaatgggtggagccattatcggttctattttaagcggattattaggtgataagtttggacgaagaaagttaattttaatttcctctatcatttttctgttaggctccataggttcagcgattgcaccagaggaaattacgttaacgattgcgcgcgtctttttaggtacagcagtgggaacggcttcttcgctagttcctgcctatatgtcagaaattgcacctgctcatattcgcgggaagctttcaggtttaaatcaggtaatgatt

SEQ ID NO: 2189 - DNA, 432 bp, Myxococcus xanthus
gttcatggagcaaatcgtctagcaagcaattcattgttagagtgtcttgtattcggaaaacgggcagggcgtcatattttacataaagcgagaacggtatctcgttatactcccgttcgttacgtctataaaggcatgcctaaaatactgcctgccacaagacaaattcagcataaaatgatggattgtgtaggaatcattcgtcatgaaaacgaattggctaccattgtgcatgaattcacaaattatttggatggaatacctcttgatcaagaagttatatattcgagggaagctgcaaccatctgcaatatgctaactgcaggtctgcttattgccgagtcctctcttgcaagaaaagaaagtagaggaggtcattaccgaagtgactttccgcatgaaaagcaagagtgggagcataagcgaattatt

SEQ ID NO: 2190 - DNA, 345 bp, Myxococcus xanthus
agccgtcctttttttgaaaatgcccaagcagccatttttcgaatgttagaattccgcactgagcatcagctcatgctgaagctggtacaggaacagcagttaggcactacagcagtgcaagacgtgcttgtgcgagtagaagaagagattttgacttatataaaaaacaaaatcgaaattgcgatttctaaaaaagaaatcaaaccgtgctacccggagctcacagcttttttactatttaaaatgtacattgcactcgtctatgattgggaaaaacggcatgagccgctttcagaagaaaaaattgctgaattaattgaactatactttttacgcggtctgtct

SEQ ID NO: 2191 - DNA, 402 bp, Myxococcus xanthus
tatgactgtgtcattataggtggaggaattgcaggacttcaagccgctattcagcttggaagatataagcgcagtgtattggttattgattcaaacgatggacgttccaatctctgcaagaattatcaaaatatattgggatggcctgagggaataagcgggcaaactctaagagaaacgggaaggcagcaagcaaaaagctacggcattcaatttaaagaagattgtgtcatacagtgtcaaaaagaaatagatgggtttaacgtcatcacaaactctgcgaactacgaagcagctcctttactgtttgcgaccggagtcgtagatctgattcatactgaacttcggcaagagctatatccttgtatgggaacaaccgtatatgtatgtcccgactgcaac

SEQ ID NO: 2192 - DNA, 447 bp, Myxococcus xanthus
aataaaaaagaagttaatttgggttttgataaactgaaaccgtacggcgtcatgagcgaccggtcggctaaagaagtgagcgattttatcgagtatttgatttcagagcagtttattttagtaggacaagggtcatttcctactttatccgtagcgtccaaagaaaaaggggtgcttcttggtacggaaaaagtgatgaggaaagaacaaatggaagtgaagcaaattgtccaagatgacgaactgtttgctcatttgcgctccgttcgaaagcagctagcagatgaagcgggcgtgcctccttttgttattttctcagacgacactcttcatgatatgtgtacaaaacttccggtaactcttgaacagttcgccactgtaaaaggagttggagaacaaaaacaagagcgatacggagaacgattcacgactgaaatcaaacagttt

SEQ ID NO: 2193 - DNA, 342 bp, Myxococcus xanthus
aaaaaatataatattccagtggaagcggcattagaagtcattggaggcaagtggaaagtcgttattctttgccacttaattaaagggacaaaacgccctgtagaattaaaaagaattatgccgcgcgttacacaaaaagtattaacgcagcagcttcgtgagcttgaagcagacggcatcattattagaaaaatgtacaatgaaatgccgactcgagtagaatattctttaacagattacggatggtctttaaaaagcattcttgattcactatgctcttggggagaacatcatattgaaaaaacgtaccctgataaagaagctgtacttatgcagcctgta

SEQ ID NO: 2194 - DNA, 156 bp, Myxococcus xanthus
acgtctggaggatataatttcttaagatggttaggcgcagcgtttgctcctttattatcaggagttataggcaatgccgtagcgcctcaagctccttttcttgtagcagcgattcttggatttgtagcttttgttattatggttataaaagtaaaa

SEQ ID NO: 2195 - DNA, 396 bp, Myxococcus xanthus
atggcagaacatccaattaaaagtttaatgtcgacagctatggaaaatttaaaggaaatgattgatgttaatacaatcattggtgatcccgtagaaacacctgatggcagcgttattttaactgtctcaaaagtaggttttggctttgcagcgggtggaagcgagtttggagtagaagggcatgcgccatcttctccagggcagcatcagcaagaatcaggtcatccatttggcggaggtagcggtggcggtgtatcaattacgccaattgcctttttaattgtgagtggaagcggaattaaaatgcttcaccttaatgaaagtacacatttatatgaaaagattttagatacagcacctcaagccattgaacgcgtgcagcaaatgttcaagcga

SEQ ID NO: 2196 - DNA, 276 bp, Myxococcus xanthus
attatgtcacttttagaaagcgccattgagctgaaagaaaagcataaaaatggtgcaatcgtcacatcgttaaaaggaaaaacgctggggctcatttttgaaaaatcttcaacaagaacaagagtctcatttgaagcgggaatgatgcagcttggaggaaacgccctctttttaagcagccaggatttacaaattggacgcggagaaacgattgctgatacagcacgcgtaaaatctgaaatcatcgatgctatcatgattcgtacgtttgcacat

SEQ ID NO: 2197 - DNA, 666 bp, Myxococcus xanthus
gtctgtacattttcgcaagttggatgttcatttgaagtgtgcacacaagaccgcgagatccttaaagttcaacctagctcagatgctcccgcaaacgctatttcaacctgtgtgaaaggaaaattcggctgggattttgtaaactctgagaaaggtattactaagcctttaatcccaaaaaatggcgcatttgtagagtcatcatgggaagaagcgctcgatttagtagcgagcaggttaaactctatcaatcagcagtgcggacatggatccgttggttttatctcttcttctaagattaccaacgaacacaactatgttattcaaaagctggctcgccaaatgtttgaaacgaatgacgtagacaactgttctcgctactgtcagtctcctgcagccgatggattatttcgaacagtcggaatgggagacgatcccggcacgataaaagacatcgcaaaagctgcactggttatcatcgttggagctaaccctgccgaaggtcaccctgtattagcaactcgtatcaaacgcgcgcatgagcttcatgaccaacaactaatcgtcgcagatttgcgcaaaaacgaaatggctgaacgctgtgacatttttatcagtccaaaacaaggcacggaccaagtatggccaatggctgtaacaacatac

SEQ ID NO: 2198 - DNA, 345 bp, Myxococcus xanthus
aataaggaatttaactgtgaaaaagaattaacgcttgctattatcggcggaaaatggaagatgctgatactatggcacttaggacgtgaaggaacaaaacggttcggggaactaaaatcgcttattcctgatattacgccgcgcatgctggttaaccagctgcgggaactggaagaagatctaattgttaaccgtaaagtttatcctgtcgtaccacctaaagtcgaatactcacttacaaaagaaggagaaagtttaatgcctattttaacagccatgtacgattggggtaaaaattaccgtgatacagtgctggtcaatcaagaacaaaaggcagaaaagtta

SEQ ID NO: 2199 - DNA, 399 bp, Myxococcus xanthus
gaaacattttctggtaaaaaggctcaagagggaggcgttgctggattaggagaagaagatacaacaaattactcatctagcacaggaagtggagacggagactacgaaaaaaacgaagaacgtattaattatgaagcgaatagaattcataaagaaatcgttgaaagtccatacaaaattcaagaccttggcattcaagtaatgatagatccctccaatgcaaaagggaaatcacaagtgtccgatacacttgagtcagacgttcaaaaaatgttaggcacaattgtccggacttctattttaaaagatgccaataccaaagctctctaggataacgcggtcagcgataagattaccgtttccgttcagccgtttaatggacaagaaacagctgacagc

SEQ ID NO: 2200 - DNA, 474 bp, Myxococcus xanthus
attaaagatgccatgctgtttaatcagcttgtgatgcaagtaagcaaagctctttggaagtctactgaaaaggattgggaacagtgggttaagccgtacgatctgagcattaatgagcatcacattttagggattgcttatcagctggaaattgcgtcgatgaccgacatttcaaagctaggcgtcatgcatttatccacagcttttaactttgcaaaaaaattgcacctgcggggctatcttaccctttctaaaaatgagaaagataagcggaatacatacgtgcagctcacagaagaaggaaaaaagatgtttttaaaaacgatcgaggattataaccctcttgaaaatcctttgtttcaaggagcgatgccgctgcgagatgtttatggagagctgcctgactttgttgagctgacggctctgattcgaagcatatacggagatgattttgtccagttcatcgaacgttct

SEQ ID NO: 2201 - DNA, 213 bp, Myxococcus xanthus
gcgattgcaagagcgtggatgaataaccctgaaattatctttgcagacgagccgacggctagcttggattcagagcgaggaagagcggtcgttcaaatgcttgcagatgaagtgaagctaaggggaaaagcggttgtaatggttacccatgaccaaagaatgctggatttatgcgatcgcgttgtgtggatggaagatgggaaattagtagaa

SEQ ID NO: 2202 - DNA, 210 bp, Myxococcus xanthus
atgtcaaaatctattcatgaatttaatgatattattcggaagcttagaaaagatttatttggaaaaggaccggaaagaatacatacggtttttgttgaaaatatggctgtctcaacactgtatggaaatttaactccatcagaaacatttattgcaagcacttctgaagggtgtgacatggttcatttagctcgaacaaaaatgatacaa

SEQ ID NO: 2203 - DNA, 294 bp, Myxococcus xanthus
gaagaagccgaggagcacgccaaaacgctagatgattggctgttgaaagtagccaaaggcggagacacaacggtttcatcgatagaagaagtgcgcaatcgttcttattcagaagaagagcttaaaaaaataagcaccaatcgtcctcgtatgatcgtaggaaatccagctgaagtaaaacaaggattaacgcagctgcagcaaaaatacgataacgacgaatttttaattattacaaatatccatgattatgaagcaaaaaagaagtcttatcaactgcttgcagagctattt

SEQ ID NO: 2204 - DNA, 444 bp, Myxococcus xanthus
aatcgcgaagaacagcttttagaagaaatctataaatgggaagagagcttacagagcgtagaagcaactgagatggagttattgtacgaagaatggttagaaaaagggcttaacttaattcctgcttctgttcgtgagacctatttacataaaattgatgagggactctttcagttaactgcattaattcaaggtacggaaatgcaaactcaagcgacaaaacgaattattgaaaccgcccgtgtattcaaagaagatatcacagatctgtcagaaatgaattcccttcaagtagatcagctttcttatatatgcgaacagcaaatggccaagctgcggttgtatgcgctgagtcaaggagcactttcaggaaccggccaatcgctgctagtcggtattgatatacccgctgttttatgcatgaatattcaagcggtgcaacag

SEQ ID NO: 2205 - DNA, 123 bp, Myxococcus xanthus
ccggttttggatagggtacaacgagaccaagcatttattagctaccctcattctccagttaaagttatggttatttctacttacgaagaagttatgattgcacgtgacgttactcgtttagcg

SEQ ID NO: 2206 - DNA, 588 bp, Myxococcus xanthus
gtgggagtaaaaaaactaaagttaaaagaaaagccaacttctattcgagaaaaacaagcagcagcctctgtcgggcaatgtgagcttatgcatatctacagtaaattctttggtgagtacagtcacattgttggtcaagtactgttaacaaaagatgtaatcgaagatgaacatgtgcgcaataacgttgtgaacacgtttgaaaaattaattgaagacaaagtgattcctattgtgaatgaaaacgatacagttgcaatcgatgagattgaaaacatcgtgcgttttggagataacgataatttatcggccattgtttcagttttgattcacgcagatttactcgttattttatctgatattgacggtttctttgattcagatcccacaaaaaaccctaactctaaattaatgaaagtaatagatggcatcacgccggagcttgagaattttgctggagatagtggaactgacgttggaacaggcggaatggtcacaaagcttaccgctgctaaaacagctacaagtgcaggcgtgagcttaatcttagcaaatggtaaagagccaagtattttgcgagatttattg

SEQ ID NO: 2207 - DNA, 480 bp, Myxococcus xanthus
tgcaactcagccgaaaagctgattattcatgaacgggcggctcatgaatttttgccgattattgttcaagcgctacgagagaaagatgtagaagtacgcggtgatgaacgtgcgctcacaatcgttccagatcttgttccagcaggggatgaggattggaagaaagaatatctggatttcatcatggcagttaaaatcgtagatgatatcgatgaagcgatttcccatattaatattcatagttcacatcattctgaagcgattgtaacaacaaattatgctcatgctcagcgttttttacagcgcgttaattcagctgctgtttatgtgaatgcttcaacgagatttacggacggagaagagtttggtttcggggcagaaatcggaattagtacacaaaagcttcatgcgcgtggaccaatgggattaaaggaattaacaacattaaaatatattatttacggagatggacaaattcga

SEQ ID NO: 2208 - DNA, 702 bp, Myxococcus xanthus
aatccgcggtttgaccatattaaaggtcagatgaaaggcgttaaaagtgtgggtacagaaagcgagccaagcttagaagcaatcgctgctttaaagcctgacttgattatcggaaataaaatgcgacaagaaaaagtatacgatcagcttagtcaaattgctccgactgtattctctgaggagctgcgcggagattggaaatcaaactttaagctatatgcaaaagctgtaaacaaagaagaaaaaggtaaagaagtattagctgactatgacaatcgcgtagcagatttaaagaaacgccttggagatcagttaaaacaaaaaatctcagttgtacgctttacagctggagacgttcgtatctatcataaagattcattctcaggtgttattttagatcagcttggatttgctcgccctgagtctcaagacaaggatgattttgctgaaatgaatgcaacaaaagaacgcattccggcaatggacggcgatcagctattttacttctcttatgaaacgggagacggtgaagcaacaaagcttgaaaaagaatggataaacgatcctctctttaaaaagctaaaagtggctcaagaaaatcatgttcataaagtagatgatgctacttgggatacagcacgcggtgtgttagcagctaatatcgtacttgatgatattgaaaaaatcttcttagataaaaaa

SEQ ID NO: 2209 - DNA, 228 bp, Myxococcus xanthus
gcagcccttcctcatccgatggttccaagaagaggaagtgaagtgcctaagaccgactcctttatctttatcggcgcaggtacaaacgatcctatttgcgcagcatcagaaacggaagaactttctgctcttttagaaaaagccggagcggacgtacaggtccattgggaatcatttggacatcagttaacacgaacagaaattgaagcagctgaaaaatggtatcgg

SEQ ID NO: 2210 - DNA, 780 bp, Myxococcus xanthus
  unsure (1)..(780): unsure at all n locations
catgcaaagggtgtaagcgttgtaggtgattttaataaatggaacggttttcaacattcaatggttanagttaatgaagaaggtatttggatgacatttatccctgaattagaacaagggactatttataaatatgaaatcatcacacaaagcaatcaaaaaaaattaaaagcagatccatacgctttcttcagtgaagtgcgtccaaacactgcgtctattgtttactcattggatgggtacaaatggaacgaccaatattggcgtagaaagaaaaaacagcaaaatatatatgaaagaccactgtgtatttacgagctgcatgcagggtcttggaggactcatgaagatggcagcctttatacatacagtgaattagcacaggagcttattccttatattgctgaacaaggttttacacatattgagttattaccagtcattgagcatccgctcgaccgatcctggggatatcaaggaactggatactattctgctaccagtcgatacggtacacccaaagagttgatgaactttatagatgagtgtcatcaaaataatataggcgttcttttagactgggtacccgggcatttttgtaaggatgaacatggtctgtatatgttcgatggagaacctacttatgaatacaaaaaagaacccgaccgtgaaaactatgtttggggaacagctaatttcgatttaggcaagcctgaagtacaaagttttctcatttcgaacgctttgttttggttggagtacttccacataaatggattt

SEQ ID NO: 2211 - DNA, 342 bp, Myxococcus xanthus
ggactgatgccagcacctccaagaagtgaaggtggatttcgtctgtacacggaagaacacgtagaattcttaaagaaaattacgaatgccaaagaagtcatgggtttttcacttcaagaattacaggaatttcttgctttaagtgatactcttgaaatacaaaagatggattataggcaagtgaaaggaacaagtcaacaaaaagaaaagttagagcgagtgttacatacggtagaagagcagctcaagctgattgaacagaaaaagaaaaacatcttaaaagtagagtctgaccttctgtcactgagagatcgtgctaaggctgcaattgtaaaattcgag

SEQ ID NO: 2212 - DNA, 168 bp, Myxococcus xanthus
gtgctggccggctcggtggtaggcgtgccggtgttccttcttctgttcaggaagtacggtctgggcttggaagtcctgcccgggccctttggccatcagtttcgctccgtagccgaagttgccgttccaaggcttgaaaggcttgcagcttcatggggcctgtcggct

SEQ ID NO: 2213 - DNA, 276 bp, Myxococcus xanthus
tcacacgggctccttaagtcaaaggtctctatccgctacctaggcctgtttgtcatggaggaccactcccgatgggacgtggtccagccccgcacaattatgagcagtgggtgcaacccgcatgccttgttgatgcgggaaatgcccattaggtgcgcgtgggccagcacactgaggcactacatgaacttgtccgtcataagccagcttctggcggtccgcgcgcccattaagacgcgggtgtttacgcccaagcagagggcgatagtatatgag

SEQ ID NO: 2214 - DNA, 609 bp, Myxococcus xanthus
  unsure (1)..(609): unsure at all n locations
aataagacccatgtgataaagccgctgctcgacgatgactatccagttatttcatatggaaaaggaatttatttgtacgaccaagatgganaaagatacatagatgcttcgtcgggggcagttacagcaagtatcggacacggcgtaaaagaaattattgatgcaatgaccgatcaggcacagaaagttgcgtttgtatatcggtcgcagttcacaagtgatccaacagaagcgttagctaagaaactatgtgaattaagtagcaatcatttccagtggagtttttttgttaacagcgggaccgaagcgactgaaacggctatgaaaacggcaattcagcattttcaagagcaaggaaagccaaccaaaacaaaggttttgtcacggtggatgagctatcacggtattacaataggagctctgtctatgtcagggcacgttggaaggcgaaaacgcttctcgtctctgcttgaagattatccttcagtttcacctccttattgctatcgatgtccgtttcatcaaacctatccatcctgtaatcttgcttgtgcacacgaattggaaacagttatcaaacgaaccggccctgtacatactcgtgctttt

SEQ ID NO: 2215 - DNA, 666 bp, Myxococcus xanthus
ggtgctgttgtaggagtgttgattaatgcttttgctccaagtgcttttgctccgctggacaagtacttgtttacgccgcttgggcaaattttcttaagcttaattaaaatgattgatgtgccgatcgtgtttttctctatcacgttaggcgtagcaggtttaggagatcctaaaaaactgggaagaatcggggcaaaaacagtttcgtacttcctagtgacaacaaccgttgctattgtaattggtttattattagcgtttgttattaaaccaggaacatttggatcttttgatacaaaaaacgcttcttttgaagctgaaaaagcaccgccggttggagagacattcttaaatatgattccagtcaatccaatccaagcgatggctgaagggaatatgcttcaacttatcgctttctctatctttatcgggtttggtattacgatgcttggaagtaaaacaaaagggctttacaatttactcgagcaaggcaatgaattgatgatgtatcttgtaaatctggtgatgaagtttgctccttacggaacatttgggcttcttgcaaccgcggttggaagtcaaggctgggaggcaattaaagcgatggggctgtacatgattgtagtcgtgctggcgctggtcatccattcaatcgtaacatatggg

SEQ ID NO: 2216 - DNA, 843 bp, Myxococcus xanthus
atggaatcctctttgaaggaagtacgttttgattccattacagctgaacacttcaagcaagtgaaggagcatggttttacagatgcgtatctagcaagcgtatggaacgtgccagagcttgacgtaagagcgaaacgtaaagcactacatattacgccaagctacaaaatggtagatacatgtgcagcggagttcgaatcctctacggcttatttctactctagttattatggcgagagtgagattgaaccatcaacgaataaaaaagttgcgattatcggttctggaccgattcgtatcggccaaggagtagaattcgactacagttctgtacacggtgtgttagctcttgaaaaagaaggatacgaaacaattttaattaacaacaatccagaaacggtaagtacggattttgaagtagcagaccgcttatattttgaacctgtaacagtagaagatgtgctaaacgttcttgatgctgaaaatgtgacggatgtaattgttcaatacggaggtcaaacggctatttcgcttgttaaagggctagaagaagctggcgtcaatttactagggattacaaatgatgttattgatgcacttgaagatcgcgacctgttttataagctcttagacgactgtgatattccgcatatcccaggtgaaatggcgaaagatgagcaagaacttgtacaaaaagcaaaagctatgggattcccattacttattcgtccttcttacgtcattggcggaaaaggaatgctgacaattcaaaatgaaacggagctgcaggcttgtttaccagctattaaagcgtctcatttcccaatgcttattgatgcttac

SEQ ID NO: 2217 - DNA, 273 bp, Myxococcus xanthus
  unsure (1)..(273): unsure at all n locations
aaaagagttattgcgcttgttagtgcagactttgaagatctagaactatggtatccagtgatgcgtcttcgcgaagaaggagcagaagtacatttagttggagaaaaagcaaacgaaacgtacatggggaaatacggtgttccagccgtatcggactatgcatttaaagatgttgatccagctgaatatgacgctatnntagtacctggaggctgggcgccggataaactgcgccgctaccctgaagtaattgaaatggttcgtcatatggat

SEQ ID NO: 2218 - DNA, 120 bp, Myxococcus xanthus
gaaattggatcgcttattattcgtttagtattaggttttacatttttagtacacggctttcaaaaatggcaagggggaattgaaaatacagtaggcttcttcgatagcttaggaatcccg

SEQ ID NO: 2219 - DNA, 372 bp, Myxococcus xanthus
  unsure (1)..(372): unsure at all n locations
attattctattaggatacatactaaaacgaacaaacctccttcagcaaaaagacggggaagctttagcaagaattatttttaatattacaatgccttgcttgattattgttacattcagcagtattaaaattgatggatcgcttattttactattagttattgggattgtctatggcttgctgttagctgcagtcggaatttttgtttttcgaaaagatgagcgaaaggtgaaaggcatgctgacgatgatgattccagggtttaatattggaatgtttgcctatccgttagtagaaggcatttggggaaaagaagggctntaatactttggtatgtttgatgtcngaaatgcttttgttatttttggttta

SEQ ID NO: 2220 - DNA, 684 bp, Myxococcus xanthus
  unsure (1)..(684): unsure at all n locations
ggattcagctatatcatttccgctatcggaattggaaaattgctttcatattctctatcatgcatcttgnctgataaagtcggacgaaaacctttgattattgtttcgtctctgacgatggctattttcttaattggcattccattatcgccaaattatcaaacagcctttatctttgccattattgctggtattgcaaactctgctatggacgctggaacataccctgctttgattgaagtttttcctaaatcttcaggttcagccagtgttcttgtaaaagcatttatatcagctggagcagcgcttctgccgtttatgattgccttttttgcggatcgtgatttgttttatgggtatgcttttttccttcccgctcttatttatttactaaatatgatctttatgttcaaactgccttttcccaatcataaacgcgaacagaatacagttcaacagcaaagtacagaagagaataaatttctctctcctcctaacatgaaacaagaaggaatcgctcttattgtgattggatttacttctacagctctgtttacagtggctcaaatttggcttcctacttatggtcaacaagtattagatatggctgaaagcagctcggttcgccttttaagctactacagcatcggagctttaatctctgntttagtattagccgtatta

SEQ ID NO: 2221 - DNA, 678 bp, Myxococcus xanthus
tcagtcgtgacgccgtttattcctattttaatggggggaaccacatacttaatcagtcaatcgttactaggtattttagttaaaaatgtcgattttccaatctcaacgttcacgcaaacgctcttagtagctattttgtttggaataggtacggattactgcattcttttacttaaccgtttccgtgaagaattggctaacggacatgataaagtagaagccacgatcacggcttaccgtacagcaggaagaacgttattcatcagcggaattgccgtatttattggttttgcagccatcggatttgccaagtttgctattttccaatcggccgttggcgtaacattgggagttggtgtgctgctagtgattttatttaccttgctgccactttttatggttacgcttggagaaaaattattttggccgtctaaaaaagtggcttctcatagcgataataagctgtgggggtttttaggaagaaaggcagtagcgcgaccgttcgtatttttagtcattacagcgattattaccgtgccttttattgtaacgtatgactcaaaagtatcgtttgattctactgctgaaataagcagtgattataaatctataaaaggactaaatgctatcagtgacgcactgggagaaggaaaagcatttcctgtcaatgttattatt

SEQ ID NO: 2222 - DNA, 498 bp, Myxococcus xanthus
agtagaagtggagggacagacatgacgaacgagctttcaatgaagaacattacaaaaaactttggttcttttcaagcgctgaacaaagttgattttactgttcaaaaaggggaaattcatgctttattgggagccaatggtgccggtaaaagtacgttgatgaaaatattgtgcggagcttacgacgagtacgaaggaaagatttacaaagacggaggagaaatctctatttcttctcctaaagaagcgaagagccacggcatcggcattgtacaccaagaagtcgatgtagcgctgattccttcgctatcagtagctgaaaacattgtgttagacgtgcaggtttctaagaaaagtaagacatttgtaaactggaaatctatttataagaaagcggaagaagctctttctttacttggttcttctttatccgttaaaaaaaatgttgttgatctaactctatcagaaaaacagcaggtgcttattgcacgtgcaatt

SEQ ID NO: 2223 - DNA, 780 bp, Myxococcus xanthus
  unsure (1)..(780): unsure at all n locations
cagcttgcagcaatcagcaaacagcttactaccatcaaaacnggtcttcaacaagcaaatgagatcttttcagctcagcaaggccaagtgggaaccctatcagacagtatcaatcaattagcagaaggtgttgatagtgcaaatgatgggctaacgaaaatctcagatggcttaacaaaagcaacaggtatgcttgataacatgagtgacagctcaacagttagagatacgggtatttatcttccagcagaagtgatgaaagataaagggtttaaacaatccatcgacaactattcttttgcagatggaaaaggagttaagctcagcgtagtgctcgatcaaaatccatattctgaagaagccatttcaaccgtaaaaaatattgaaaaagcggtggcaagcgaagtcgttgatacgccgtttgagcatacagaaattgtgtacggaggggtatcgagctcaaatgcggatttaaaagatttatctacaacggatctttcacgcacaatggttattatgatgattggattgtttattgttttgaccattttattccgttcaatgatcatgcctgtatacatgattgcttcactgttgcttacgtattatacagcaatgggaatctcagagcttctattcgtggatataatggggaatgacggaatcagctgggccgtgccattctttagttttgttattttagttgctcttggaattgactattctattttcttgttagaccgttttaacgaagaagtgaaaagcggcgtagcagaaggc

SEQ ID NO: 2224 - DNA, 354 bp, Myxococcus xanthus
ctgcagcagtactgccgctttttagcacaaaatgtgtggtacggagatgatatcgcgcaagaaacgtttttaaaagctcagcgatataaaggcgaagagcacaatttgtcttctgcgctgttaaataaaattgcgtaccaccactggattgacctgctgcgaaaacgaaagcgtgaaggaatagtcgaagaaaaagctttggaacaacaagccgataagcatgcgtttgatagtaagggacactcggtcgaactgctgcttagtcaatttacgccgaagcaagcggttatctttttcttaaaagaaggctttcgctatcagctgaaagagatcgcttcgattttacaaacgtca

SEQ ID NO: 2225 - DNA, 687 bp, Myxococcus xanthus
aaaactgttcagttaattaaaaagcttgttgcgattcccagtccttctggaaatacagaaaaggtgatttcatttgtcgaagactatgtaaaagagctaaatattcaaacgtatcgcaatcgaaaaggaggcttagtcgctactattcccggtaaagatacagatcatcaccgcatgctgacggctcatgtcgatacattaggtgctatggtaaaagaaatcaaaccgagtggacgtctgaaaatcgacttgattggagggttccgctacaattccattgaaggagaatattgtgaaatcgaaacgtcagcaggagaagtatttacagggaccatccttatgcatcaaacatctgttcatgtgtataaagatgcaggtaaagctgagcgaaatcaagataatatagaaattcgattggatgaaaaagtacatagcgcagaagatgttcgcagtcttggaattgaagtcggcgactttgtttcgtttgatcctcgtgtagaaataacaaaaagcggttttattaaatctcgtcatctcgatgataaagcaagcgtagctttattgcttcagctcgtgaaaacaattcaagaagagcagatcgaactgccatacactacgcactttcttatttcaaataatgaagaaattggatacggagagaattcgaacaatccgcctcaagcggta

SEQ ID NO: 2226 - DNA, 459 bp, Myxococcus xanthus
attgcagttgatatgattttacctgttttagggcataatagactggcaaaattaccgaccaacaccggtcatttattagagcgttttgctttgttaacattaatcctgttcggagaatccgttgtcagcattcttgctgtgatacagccacaaaaaggggactggaatgccattttattttcggctatttcatttgtcctgattattgccatgtggtggcagtactttgagaatgtagaaaagaaagtaaacaagtctattcaaagagccggacaaacgattatttacggacacttacttatcctcatgtctctaagcatgattgcagcatcgattaagctcatgtttgtacatgaagttcagtacacattcagcttatattttgtattcggatccgtgctgctttattttatggcaaccactcttgttggtcaccaatatagatttgaacaacatcgt

SEQ ID NO: 2227 - DNA, 273 bp, Myxococcus xanthus
gtgtcatttgatggtatttttacatatggcattttacaagaattatctgagaccttggtttcaggacgaatttcaaaaatatatcagccgtttccaaacgagttgattttacaagtacgcgctaaaggtgaaaaccgcaaacttttaatctcagctcaccctaactattcacgcgttcattttacaaatgagccctatgaaaatccatctgagcctcctatgttttgtatgcttcttcgcaagcatttagaaggaagcattattgaacaagtg

SEQ ID NO: 2228 - DNA, 255 bp, Myxococcus xanthus
atcaggcattgggatttatttttagcaccgtataaacaagccgttgaagaacttaaggtgaaattaaaaggaattcgttcacagtatgatatgaagtctacgcattcacctattgaattcgtgacgggacgagtaaagcctatcgccagtattttggataaagcgactcgaaaaggaatttctctcgatcgcttagaggaagagatgcaggacattgcgggactccgtatgatgtgtcaatttacggacgatatt

SEQ ID NO: 2229 - DNA, 264 bp, Myxococcus xanthus
caaatgcttgttgactcagataacatgtcatttgtatatgttgtagatattaatgatcaatttatgtatgttggccttagtgataatatttgggcgaatttaaagcacgtcttacataaagatatgaaagtatttttagaaattaataaggaagtaattgagctatcagccgttaaagaagagctgtcttatctcatcagtaacatcgaaggaaacgtgaattatggagacgagatggtagcaagagtagaggaagttttttta

SEQ ID NO: 2230 - DNA, 336 bp, Myxococcus xanthus
attccatgggattatgatgcaacttggggaagagatgtaaatggaaaagtaatggaaggagactatgtccgcgcacaaggatttaatacgcttacagctcgcttactggcggtgaacagcattaaaaagcgatatattcaaaaaatgaacaatgttctaaataatcaatttacgatagaatacatgaaaccaatcatttatcaactgcatgagtatattgctccttatgtattaaaagatccttacgtaaaagataacttggagcaattttataaagaacccgaatttatgctgtcttttataaaagaacgaacagcgtatattaaaaataacatt

SEQ ID NO: 2231 - DNA, 309 bp, Myxococcus xanthus
gtaggatatgcgttaggtatcggctttgcacctgttcgtaaagaaggaaaattaccgcgtgaagtaattgaagtacattacggtttaaaatacggtaaagacgtattaacgattcacaaagatgcaattaagccaggtcagcgcgtgttgattacagatgatttattaggaacaggcggcacaattgaagcgacaattaagcttgttgaagaattatgctgaattgttgttggagctgcgttcttaattgaactttcttaccttgacggccgtgacaaactacacggctacgatgtattcacattaatg

SEQ ID NO: 2232 - DNA, 234 bp, Myxococcus xanthus
atggcaaatgagcaagtcctaacagcggaacaggtcattgacaatacgaagcgatatttaaatgaagaagacgtggtttttgtacaaaaagtatatgattgtgcgatagaagctcacaaagaacaatatctcaagtcgggtgaaccatatattatccacccgattcaagtcgcaggaactgtagttgatgtagatatggatccagcaacaattgcagctggatttctacatgat

SEQ ID NO: 2233 - DNA, 387 bp, Myxococcus xanthus
ctctcagcttttcaagttattgctccgttttatttaattattacgtcagaccaaagcaactggattttatatgaaagaacggcaatctttttatttggcctcacgtatttatatgtaggcgtgacggtattaaaaggaatgcagggaacggggctgggctattattcactttgggtatcgattatcgctttagtgtacgttacggtttctcttgttcactatcatgacgtagtgaatgccattacatggattctttggtcgtttttatggtttttattttatgtgcttaatacgagcaaaaaagatgtatctgcatatgtagggaaagtggcgattgtacagtcttgggtgaccttaacaatcccagcgctgttttcgctaacgggc

SEQ ID NO: 2234 - DNA, 480 bp, Myxococcus xanthus
ctgtacttctatttaaaccggtttttcggacaggtaaagagtggggaagtagcaagcagcgttgaaatgtttcagcaaagtttttttcacaatgttaaatacttagggctcatttggatactaggaattgctattattggtttgcctgtagtgttaattctgctgtttttaaaaggaatggtgattggttttaccgtacgctttttagtcaatcaaatgggactctctgggtttgcgctatcttttgtatctgttatgccgcaaaatatctttctcataccggcatttctgattctgtctgcagcttcagttgccttttctttgaagctcgtgcggcagcagttttttaaaaaagcagcggagccaatttctgcatcctttttacgctatagcggcacgatgattgcaatgatatgcttggttgcctgtgcagctacagttgaagcttacgtatcacctactttaatgaaaagtgtaatg

SEQ ID NO: 2235 - DNA, 285 bp, Myxococcus xanthus
atgatcacattaaaaagtgaacgcgaaattaatttaatgcacgaagcaggtaaattattagcttcttgtcataaagaaatcgctaaaatgatcaaaccaggcataacaacaatgcaaattgataaatttgttgaagagtacttagcaaagcacggagcaacgccggaacaaaaaggatacaaaggatatcaatatgcaacgtgcgcttctttgaatgatgaaatttgccacggttttccaacaactaaaccgttaaaagacggggatatcgtaaccattgatatg

SEQ ID NO: 2236 - DNA, 363 bp, Myxococcus xanthus
gtataccaggggcaggaggaacccatgcgtctccctcgcctagttggtgaagcaaaagcaatggagttaattttaacagatcagcgcctcgcggcatgagaagcaaaataatgtggtctagtaacgaaggtagctcctggatatcaaatagaagaaacaatagatatttttatgtcgcttttattaaaaaatgggccaattgcacttcagcaagcaaaatttgctatcaaagaaggaatgaaggccgatttgcagtctggtttgcaaattgaacgaaaagcatatgagttatcgattccgacagaagatcgtctagaggcgcttcaagcatttgctgagaagagaagacctagttttaaaggg

SEQ ID NO: 2237 - DNA, 672 bp, Myxococcus xanthus
tttagcggtaatattcgttcggtcgtagaaggcgaaatgatttttgctaatgaaccgatgctgcaaattgacgctcctttagcagaagcgcagcttattgaaacgccgcttttaaatattttaaatttccatccgctgattgccacaaaagcatcgcgtattcgcttagccgcgggagaagataatttatatgaacatacgggtacaaatcagcttatggaatttggttcaagaagagcacatgagctggatgctgctttttacggggcaagagctgcttatattggaggctttgacgcaaccagtaatgtaagagcgggaaaagtgtttggaattcccgtgtccggcactcacgcccacgcgcttgttcaagtctatcgtgatgaatatagtgcgtttaaaaaatatgccgaatcacaccgtaactgtatctttttagtagatacatataatacgttaaaatcaggtattccaaatgctattaaagtagcaaaagaaatgggagaacaaattaattttatcggtattcgattagacagcggaagacttccatatctttctcaagaggcaagacaaatgcttgatgaagcgggctatcatgatgtgaaaattttcgcttcgaatgaccttgatgagtacagcattctagatttgaaagcccaaggtgcccaa

SEQ ID NO: 2238 - DNA, 579 bp, Myxococcus xanthus
ctccaagtgccgtttatggcagatgtggtcacgatggtggatccgaatagtccatacacgttcttaggagatctgcatgagcatgagcgcttgtatcagttttatttctttgaaaagtttcatattccgagaaatgaatacaatcactattgccgctgggtagcgagccagctgagtgggcttgaatttaacagcacagtaaaagaagtaaaaatgcatgaagacgctaagccttactacgaagtaacagttgaaaaagaaggaaagctttatacctattacagctatcatcttgttactggagtaggtacgcagcccgtagtgccaagagactttcaaacagtggcaagcgatacgttttatcactccgctcattacaaaatgaagcgtcagcaaacgctgcaggctaaaagcataaccgtaattggctctggtcaaagtgcagctgaaattgtctatgatttacttcaacagcagcctgagtttgagtataagctgaattggtatacgcgctcaaaaggtttttatccaatggaatattcaaagcttggccttgaacatttttcaccggattatacc

SEQ ID NO: 2239 - DNA, 681 bp, Myxococcus xanthus
gcacttctcgctgcactgccaaaagcaccgaattcctattctcctattttacatccagaaaaaagtatagaacgtagaaatgttgtgttaaacgccatgcaaaaagcaggttatttatcagctgaaaaaaatgtccgtttgcaaggaagaacgctggggttgaacataaaggagcaggctaaaaatccagcgtatttaacctatatcgatatggttatccaagaagcagagaagaaatacagcatttcgggcaatgagcttctgcgcggaggttatacggtcaaagtaccgatgaatataaaagtacaagaagccgcctacgagctgatgaaagaaaatcgttattttccaggtacagataacagtgcccaaggtgcttttgtattagtcgataacaaaagcggaggagttttatctgttatgggaggacgagattatgtacaaaaatcgctcaaccgcgtaaatgtcaaaagacagccaggttctacgatgaaacctattgcggtatatggccctgcgttagaagaaggtcaattcaagccttattcgttgctgcaagacaagcttagaagctacgggggatacacacctaaaaacgtagacggccaatatgctaaaaaggtaacgatgtacgatgccttaaaagattctaaaaacgcagctgccgtctggacattgaat

SEQ ID NO: 2240 - DNA, 138 bp, Myxococcus xanthus
ggacacagtgtgggagagtacgtcgccgcctgcctcgcgggcgtgttctccctcgaggatgcgctggccgccgtcgcagaccggggccggttcgtccagcagctgcctccaggctcgatgctcagcgttccctccccg

SEQ ID NO: 2241 - DNA, 582 bp, Myxococcus xanthus
ggtgttattgacgatcaaatttggagtaatgcgcgctttaaagtagcgttaaaagtccaagatgccgctgatagtaaagaaatcttaaaaaatgcagacgctgcttctattacggtgacgggtcgaggctatctgcaggttggaaataatgaagtgtatgaactgtttcagtcagcttggagcggcgcgccgtacatggaagatacgtatggggctgaagatgaagtagccattatcacagatctcgggttgattcctttatctgatgtatctactcagcagacgtcatccaaacaagcggaagcagaaattgatgttgtggtgcaaaaaatcgaacaaacgcagcaggaattaagtatcaaaaaattaaatagtccatggctgccgcctcttaaagagagattgcttcgcagtgagtacaaagagaagcgagacggcgtattcccaattggcttaattgatgaacctgaaaagcaaagtcaaacggtatataactatcagctgatggacgatggaaacattggtatatttgggtcgtcaggatacggtaaatcgtttacaggcatgatgttgcttcttagt

SEQ ID NO: 2242 - DNA, 204 bp, Myxococcus xanthus
attaatgaagcagctgcacgctaccagctggatcctaaacttattcgttctgttattaaacaagagtcaaattttaatccctctgccaaaagttctgtcggagcggctgggcttatgcagctaatgccagcaaccgctaaagctcttggtgtagaagatcagtatgactccaagcaaaatgtatttggaggagccaaatatctt

SEQ ID NO: 2243 - DNA, 645 bp, Myxococcus xanthus
  unsure (1)..(645): unsure at all n locations
ttcanaaaagacgaagtgtacgagtttgcagatgcggtaggagactcctaacagctggctcaaatagcggctgaaaatagagaagctgagcatattgtgttttgcggcgttcacttcatggcagaaacagctgatattttaacagatgaaaaccaaaaagtcattttacccgatatgcgagctggctgttcaatggctgatatggctactattcagcaaacagaaaaggcatggcctgtcttgcaggatcttttcggagatacgattattccgcttacgtatgtaaattctacagctgcaattaaatcttttgtaggcgaacatgatggtgcaacagtaacatcttcaaatgcaaaaaatatggtggagtgggcattttctaaaaaagagcgcattctctttttaccagatcagcatttgggcagaaacacagcttatgatttaggtgttggactagatgaaatggccatttggaatcctattgaagaaatgctcgaatatgaaggcgatataaacaacatcaaggtgattctatggaaaggtcactgttctgtgcacgaaaatttcacggttaaaaatattgattatttacgcgagaagcagcctgagatgaatattattgttcatccggagtgttcttgagag

SEQ ID NO: 2244 - DNA, 591 bp, Myxococcus xanthus
gacgaaacagtggtaatagccaatccagaatctgttacggctttagttaataaaaagcatcagcttcctgaatcttaccagccttccgatttagtctatgccgacgttccgtttatctttaacgaaaaaatagaaaaacgaatgcttagaaagcctgcggcacaagcgcttgaagaactttttcgagacgcggaaaaagaggggatcagcttacttggtgtatctggttatcgatctcacgagcggcaaaaagagctttttgcattttacgcaaagcgagacggtgaagaacaagcacgcacttatagcgcctacccaggaacgagtgaacacgaaacgggactagcaatcgatgtcacaggaggaaagggaatatgtgctgcggcagactgctttgctgatacactagaagctcattggctttcaaaacatgcgtatcaatacggattcgttattcgatatcctcaagatgaagaagaagttaccggttataaatacgaaccatggcaccttagatatgtaggaaaaaaagcagccgcatccatttttaatcaatatataacgttagaaacctatgcaagtaagacaaaa

SEQ ID NO: 2245 - DNA, 684 bp, Myxococcus xanthus
attttagtcgtgagtgaccctggtgtggttcgtgcgggattagtttcacccattgtaactgccttggaggcttctggttaccgagtgctggtatttgattcaattgaacaaaaccctcgagatacgaactgcttggaaggtgctaagttatttcgtgactttagtgcggaggcagttgtggccattggtggcgggagtgcgatggacacgggaaaagctattgcgctgtgcggcccaaacggcggagaaccatctgactatgcagacggccgactcctgtattcaaacatcgcaccagttatttgtattccaactacttcaggtacgggctcagaggttactcgttctgccgttattaccgaggcatctacacatcggaaaatgacgctcaaacatagtacattaagacctgtcttggcgattcttgatgctgaactaacattaagtcttccgccttctgttacggctgcgactggcattgatgccctcgttcatgcgattgaaggttatacgtgtaaagtaacaaatcctatttcacaagcgcttggggctcaagcaatgagaacgattgtttcggcattgcctatcgttttccgcgatggtaaaaatgaagcggctcgtcaagatatgctggaaggaagtctcttagctggcttgtgttttggatctgcagatgttggttcg

SEQ ID NO: 2246 - DNA, 735 bp, Myxococcus xanthus
aaaaaggtaaagcagatgtacattttgagcgaaaacgaagaaatgaaaacagcggtttctagagctgagagagcagctttagtagaatctagtgtgttaatccatggagaaagtggagttggtaaagaaaccatggcatatttcattcacgagcgtagtccacggaacaaagggccgtttgtaacagttcgttgtggtgcaattttattatctaatatagaaaaggagatttttgggcaaggggaggaaataggagcaattgaaaaagcgggcggcggtacggtttttttagatgaaattgatttattgcctttgccactacagctgaagttatcttacctcgtagaacagcaactaacatcctcatatactagtgctcggtttattacggggacttcaactaatttaacggaaagtataaaaataggggaatttagaaaagagctgtattatcagctaagtattatccctattcaaatacctccgcttcgaaacagaaaagaagatattattccattgacgttacattttttagagaaaattaatttcttgtatgaaagtaagaaaaagctacatcctaggctgttgaaaaaactacaaaactactacagctggccaggaaatgttcgagagcttaaagcgttagtagagcgattatttgtattaacagaaggagagtggattcaagaagaacagttaatgagtgacatactagtaagtgcaaaaaatgaaaag

SEQ ID NO: 2247 - DNA, 456 bp, Myxococcus xanthus
acgcgttatttagtaaaaccaatcgtcaagctaacggaagcaacaaagcaagtggcgaaaggaaaatacaacgttgagctgtacgtaaagcgccgagacgaaatcggcgcgcttgcttcacatttttccgaaatggctaaaagtttagagcagcttgaagagatgcgccaggaatttgtatcgaacgtgtcacatgaaattcagtctccgctggcgtccattcaagggttttcgaaaacgctccgttctgctgacctttcagatgaacaaagaaatgagtatctgtctattattgaagaagaaagccggcgcatgtcgtccctcagcaaacagctgcttacgcttgcttcacttgataaagaaagtgagcatatcgaaaaaagcacgtttgacgttgcaactcaaatcaagcaagtgctgttcatgacggagtggagctggcgtgaaaaagaattg

SEQ ID NO: 2248 - DNA, 360 bp, Myxococcus xanthus
acgtttaacgatacttttttaaaagcctgtagaggggaaaaaacggatcatgttccggtttggtatatgcgccaagcagggcgttcacagccggaataccgaaagctaaaagagaagtactctctatttgaaatcactcatcagccggagcttggggcatacgtaacacgcctgcccgttgaacagtacggagtggatgcagctattttatataaagatataatgtcaccgcttccttcaattggagtggatgttgaaatcaagtcaggaattggtcctgtcatttctaatccaattcaatctttaagcgatgtagaaaagctaggagaaattaccccggaagaagatgctccgtatgta

SEQ ID NO: 2249 - DNA, 249 bp, Myxococcus xanthus
acattccatccatttggtttgataacggtaagtttatcgtggacactttcacctgataaaagagctgtttattatgtttatgagaaaaaaggggatatagccgaattgattggcaaagtgaagggaaaaggagcatttgaaaaagagcgtgtgaatctgctcgacagtcctacttattatgtagttccttacaattcccaaacacaacaaaaaggaaaaaaatccaacgaagtaacacctgctcttttt

SEQ ID NO: 2250 - DNA, 675 bp, Myxococcus xanthus
ggttcacttttcttaattttagccaatttaccttttcaagcctacacagattttttaacagaacatcctaagctaaaagcaagcattttatatccgtacagaggaacgttggaaattatggctttagtagctacgttcgggattgcctatcgcttagcagaatcgtataaagtggatgcacttgcttcaggtgcagtgtctttagctgctttctttgtcggtacaccttttgtttcgtatacgattggagaaaacgcagatggaacggctatggtcgaaacagcttatcaaacggcgatgttcacgagtaaaggtctttttgtggggatggtcatagcggttatcgccacagaagtttaccggaagattattcaaaaaaatattgtgattaagcttccagaaactgttccgccagctgtcgcccgttcattttcagctttaataccagggtttggcgctgtaatggttatatggatgctacgtttgcttgtagaaaacgtcggagacttcgggaatttacataatgtcgtgacggttttactgcagcagcctttaactcatattggtacaagcttagtcggtacgattctgatttttatcttaattactcttatgtggagtacggggctacacggtgcgacgattgttggttctgttatgacgcctgtatggctt

SEQ ID NO: 2251 - DNA, 549 bp, Myxococcus xanthus
aaagagcgttttaagttgctgctgcagcagttagagctgacgagtgatcaaattgttccttattttgaaaacgcagcgattgaaaagctcgtcattcagaaagaacaaaaaaaatggcattttcatttttctttagaagggttattaccttttgagatctatgagttattccatgctcgcatgtcttcagctttttctcatattgcgagtgtttctttttctattcaaaccgttaataaagaatgtacggaagagcatgtacagtcatattggaagcattgtattggagaaatgcagggaatatccccgcttttacagtcgcttttacaagatcaaatgccgagattgaacggtgccaaattgattgtgaacgcacgacatgatgcagaaggaacggctttacgtaaaaagtacagtcagttaattgctgatcagtatgcgtcctatggctttccgaaccttcagctaatgacggaagttgtacattcagaagaagcatttcagcagtttgtagagcaacgaaaacaagaagatacagaagaagtatta

SEQ ID NO: 2252 - DNA, 264 bp, Myxococcus xanthus
cattttgctaatcccgaaatgaataaatccattatattggtgggactagattatattgtagctggttttgctcttacatatatcgcggttaaaacaaaaagcttagaaattaccattggcgcacacgcagccaacaacatgtttctcgctctgttccttacaacggacgattctgttttcgggtctataccgagtttgtttaaggtagctaacactgagccaggagctaaccttatttggtcgattgttatgttcagtgttttc

SEQ ID NO: 2253 - DNA, 276 bp, Myxococcus xanthus
ttttctccctatacgattgtaacggttattatcttttatggttattttgttttaatgaccaagtattttggacaaacgcttggaaagatggtgtttgggcttaaagtagtatcgctgaaagactccaccttaacttggcctgttgtgctgtttcgtgaaggagttgaacacattatgcgtaaaacggggcatttactggactatctatcagatgcacttctacctaagaagcagggagcgcatgattactacgcagatacaactgtcatacatgaa

SEQ ID NO: 2254 - DNA, 529 bp, Myxococcus xanthus
atgaaagcaatggtatgtacaaagtatggaaaaccatacgtttttcagcttaaagaagtagaaaagcctactccaaaagagaatgaaatactcgtaaagatttatgcaactacagtgacatcgggtgactgcagagtgaggagctttaatagtccactattattgtggcttcctatgcgaatagttttgggattacggaagcctagaaaaccgatactaggagtagaataggcgtggataagtagaggaagtagggaaaaacgtaacaaagttcaaaaaaggagatcagctatctgccatgacaggtatgaagttcggaggatatgcggaatatatatggttaccacataaagggacaatagctataatgccggagaatataacctatgaagaagcggcttctatttcttttggtggcacagcggctctgcattcttttagaaaaggaaacattctcgccggactaaaagtgcttatctacggtgcttcaggtgcggtcggaactgccgctgtacagcttgctcactat

SEQ ID NO: 2255 - DNA, 336 bp, Myxococcus xanthus
tgtgtaaacgcgtcgaggttacagaatcacgagagaggggatatcccactggctgagacagacacgcttacggacctgctaaaacaggcgcggggctgacaaatctaccttctgctcacacccgggaacccgctaaatgttccacgggctgactcactgccctatgtggtacctaacgctctggtggcgggggtggaccctgtcgggtacacactgccagactatgaacttaaccagggatttgggccgacctgggaacaccgacttactatagaaccctaccacgacactgtccatgaccgacatggacacttacttcggcctgttcgacactgg

SEQ ID NO: 2256 - DNA, 282 bp, Myxococcus xanthus
gaacagtttcaaggcagtctcccaaataacggagaagtaaatatgctgctgttaggaagtgactcgcgcggggaaaagcattctcgtacagactctattttaattgctcactacgattctaaaagcaaacacccgaaaattgtttctcttatgagggatatgtacgtggatattccaggacacggcaagcaaaagctgaatgctgcttacgcgttcggaggtcctgagctgctgcgtcaaacgatcaaacaaaattttgatattgatattaactattatgca

SEQ ID NO: 2257 - DNA, 147 bp, Myxococcus xanthus
gagaagtcgaaagcttataaaaagaaagttggaagagagctagaactttctgataaagtgttatacggtgatttattacgatttaataaattagatgactttaaaccggtcgatccatcaaaatacatgtatggaaaagaccaagaa

SEQ ID NO: 2258 - DNA, 729 bp, Myxococcus xanthus
  unsure (1)..(729): unsure at all n locations
gatttaaaatgggatgatgaactgctagatatcttaggggtaccgaaatcaatgcttccagaagtaaagccttcttctgaagtatacgctcatacagtagattatcatttctttggtaaaaacattccaattgctggagcagcaggggatcagcaagccgctttatttggacaagcttgctatgaaaaaggaatggcaaaaaacacctatggaacaggctgctttatgctcatgaatacgggtgaaaaagcagttaagtccgatcacggcttattaactacattagcatgggggattaacggaaaagtagaatatgcgcttgaaggcagtatttttgtagcaggatctgctattcagtggcttcgcgacggtttaagaatgtttaaaaatgcggctgaaactgaaaactatgcaacacgagtagagtctacagacggcgtatatattgtgccagctttcgtaggacttggaacgccatattgggatagcgatgtacgtggagcgatgtttggattgactcgcggtacaaaaaaagaacactttattcgtgcaacgcttgaatcactagcttatcaaacaagagacgtattaagcgcgatggaagcagactctggaattacattaaaaacattgcgtgtagacggaggagcagttaannanaatttcttaatgcagttccaaagtgatgtgttaaatgttcctgttgagcgtcctcaagtgaatgaaaca

SEQ ID NO: 2259 - DNA, 384 bp, Myxococcus xanthus
cactggaaagaaacaaaagatgctggtacaaaactaggcgtatttgcaacggggccagcaattgcgaacccatttgcaaacgttttaagtgaggcgattggaacatttgtattagtagtaggaattttagcaattggagcaaataaatttacagatggattaaatcctttagtagtaggatttttaatcgtaagtattggtttatcattaggaggaacaacaggctatgccataaaccctgctcgtgatttaggaccacgtatcgctcatgctatcttgccgatacctggcaaaggcagctcgaactggaaatacgcttgggtgccagtagtgggtcctttattaggcggatcaattggcgcagtattttatcaagcggcattc

SEQ ID NO: 2260 - DNA, 147 bp, Myxococcus xanthus
atggaaaaatttattttatctttagaccaaggaacaacaagctcacgagcaatgttatttaataaaaaaggtgaagttgtacatgtagctcaaaaagagtttacgcagtacttcccaaaacccagttgggtagagcataatgctagt

SEQ ID NO: 2261 - DNA, 195 bp, Myxococcus xanthus
gaaaagaatgtcatgaaagttgagcgaacaattcaagaatatggatctcacgccatcatcgcaagctactttttaccaggaatgcgacatgtgatgcctttttttctcggggcaagcggaatgaatcatcgtcattacattaaagtctcattttcttttggtttcatttggacgctggctttatttattttcggt

SEQ ID NO: 2262 - DNA, 645 bp, Myxococcus xanthus
gggcatacgagtaacaatgcgcaaagttggctgcagcttggcggagcaaacatgcagccggctgagtatgccaagcttgttgtcattttatacttatcgtatgttttgtctaaaaggcaagagtatattgacaacatcaaaaaagctttttttggacctatgggtcttgtatttctaatattaggttttgtagcgattcagcctgaccttggaacgggatcaattatttttgcgatttccgttaccattatgctatgttcgggaatctctaaaaaaacctttttccgcatgttagcactaggtattattttgcttacggtcattattacgattggtttttttacaggtcagtttactgccaatcgaatcggccgttttaccggtgcgtcagatccgtttgctaatgctcaaggaaccggttatcagctggttaattcatatttagcaataggtacaggaggcttaaaaggccttggtttaggagaaagtgtacaaaagtatggttatcttcccgagccccataccgatttcattatggccattattgcagaagaattaggattctttggagttatgctcgtgctgggccttttaggcttcttaattttcaggattttaatgctggctaaaaaatctcaggatccg

SEQ ID NO: 2263 - DNA, 657 bp, Myxococcus xanthus
ctacagattgttggaaacctggcaaaacgaatggtcgaaaaagcaggagtcccaattgatattcatcttacgttggatcgaagaaaagcgttaaaagatgctgactttgtcactacacaatttcgcgtaggattgttagacgccagaatgaaagatgaacgaattccgttaaaatacggcgtgattgggcaagaaacaaatggaccgggcggcttatttaaagggctgcgcacaattcctgtgattttaagtattgtgaaagatatagaagaactatgtccaaatgcgtggcttgtaaactttacgaatccagctggtatggtgacagaagccattttacgctatagcaatcataaaaaagtagtgggcttatgcaacgtgccaatcggtattcgcatggggattgctaaagcgctagaagtagacgaaagccgcgtacaggttagctttgccgggttaaatcatatggtctttggattagatgtctttttagacggagtgagcgtgaaagatcaagtgattgacgccatggcagacccgacgaatgcgatgtctatgcgaaatatcaaaggagtttcatgggatcctgactttattaaaggcctaggagttattccatgcggctaccaccgctattactataaaacaaacgagatg

SEQ ID NO: 2264 - DNA, 642 bp, Myxococcus xanthus
  unsure (1)..(642): unsure at all n locations
ttctctacttttgccgaactttcaagcacaaaagtgacctctcaaactggacaggaagttacattaaatgaagttgtcgatattaaaaaaggtaaaacgtcgaatacggtaacgcgccgtgataataaaatttatgcagaggtaagtgccgatattaagagtgacgatgtaggcggcgtttcttctaacgttcaaaaagaagtgaagaaaattgatttgccaagtgatatggacattaactttggcggatcatnagagcaaattaatgactcatttagtcaattaggaattgccatgctcgcagccattggtatcgtgtacttcgtacttgtactgacatttggtggaggtttagcgccatttgctatcttattctcacttccatttacactcattggtgcgctagtggcacttttaatctctggggaaacgattagtatttcttcgatgattggagctcttatgttgattggaattgtggtaaccaatgcgattgttctgattgaccgcgtgattcataaagagcaagagggtctttcaacgcgtgaagctttactaaaagctggaatgacncntnttcgcccgatcttaatgacagctattgcaacgattggtgcactgcttccattagcttttggattt

SEQ ID NO: 2265 - DNA, 219 bp, Myxococcus xanthus
gtggtaagagtaagtggattagcaagtgggatggatattgatcaaatcgtcagtgatttaatgaaggctgaacgaatgcctattgataagatgaaaaaacaaaagcaaacgttagagtggcagcgcgacgattatcgctctatgaatttgctgttatcagactttaataatgttgcttttaatatgtccttgcagtcgtcttattcgtccaaaacggta

SEQ ID NO: 2266 - DNA, 639 bp, Myxococcus xanthus
tctgctggaattgggaatgccgatcgtattcatagtgcgatgatgcttgaagggttatctgaagaagaagcgtatgatcgtttttgggcatatgattacagaggtctgttaaccgaagacatggaagatttagctccttttcaacagccttacgttcgccaaaatgaagagattaaagaatgggaaaaagacgatgaaaataaaatttcactgttggagcttgtgaaacaagtgaaacctaccattttaattggaacgtcaggcgtcacggatgcttttaccgaagaaatcattaaagaaatggccaaacatgtagagcgccccgttatcatgccgctttccaacccaactaaacttgctgaagctgttccggaaaatattataaaatggacggaaggaaaagcgcttattgcaacgggaagtccatttgaacccgttgaatataacgggaacacttatgaaatcggacaggctaataatgcgtttgtgtttccgggtcttggtttaggtgccattgtggttcgcgctcaaaagtttactgaatctatgtttgcagaagcagccaatgcagtagcgcgtatagcagaaacagatacaaaaggagatacgcttcttcccaacattaaagatcttcaaaaa

SEQ ID NO: 2267 - DNA, 372 bp, Myxococcus xanthus
atcaatcgttatattgatgaaattgttggagtcgatatatcagggaagctaacgtttataggaaagtttgttgatctcgggttagatgtaatggttttgtataatggacgtgattatttgtatgttcctcttttacgcgtacgtcgcttgtgggaggtttcgggagaagattatactcctttatgagccatagaagagagcttagtataaggaagtcggcggatttcttgtcgtagtattttacggcaggcaaaagggagatttgttgagatttatgtagcaggagggaaatcattgcatggctatattacaagcgtgctggatgattatcttgtgttttattctccagtatataagggtgtctttgtttct

SEQ ID NO: 2268 - DNA, 462 bp, Myxococcus xanthus
atgtacataaacggagaatggagaaaagcagagaagcagcgctctactgttaatccagcgacaggtgaagtgattggatatgctgcagaaggcagcgcagaagatatgaaagcagcaattgaagcagcacgagaagcctttgacaacggaatttggtctgagacttctgcatctgacagagcagccatcttattcaagattgccgataagcttgaggaagcgaaagaagaactagcaacattagaaacaatggataacggaaagccctatcgtgaagctgaggctgatgtggaagatgcagctgcttgttttaggtattacgctgggttaattacaaagccagacggtcaaacgtacagcgttcctgcacctatgcaagcaatggttataaaagaaccaatcggcgtgtgcggattgattgtaccttggaattatccgctattaatgagcgtgggaaaattg

SEQ ID NO: 2269 - DNA, 576 bp, Myxococcus xanthus
ttagtttttgtacttgtattcggacatacggcaggaaacgcaacaagttggcttgtacttggtccagttaggatacagccattagaattaacaaaactcgtcattattgtctatttagcagctgtttttacaaataaacaggaatatataaatgacttaaagcgtgcaattattccacctattattatcgcctttttcctttgcattttaattgccatgcaacctgattatggtggaattctgcttattttaggcatcgttgcagcgattgtcttatgttctggtatttctagaaaatcaatgctgaaaattgcgatgctaggggtagtaggcatagggattatgcttgtcgttttattagtaactggccatattgatacagtcttctctcctgtacgtatctctcgttttacaggatacctacgtgcatttgaaaatcagcaaggccatggatatcaacttgttaattcttatttggctataggaaccggggggttacaaggtttaggtctaggacagggtgtccaaaaagctggttatctacctgaatctcatacacattttattatggctgtt

SEQ ID NO: 2270 - DNA, 471 bp, Myxococcus xanthus
caagctttaacacatttacagtcctattttggttatgattcgtttcgaaaaggacaggaagagtcgattcgttatgttttagaagggcacaataccgcttgtattatgccaacaggaggagggaaatcactttgttatcaaattccttcattattattagaaggtacaacactggtgatttctccgttgatttccttgatgaaagaccaagtggacacgctgaatgcagctggtattccggccacgtatattaacagctcgctgactcacacggaggtacagcagcgcttagaagaagtagcgcttggtgaatataagttactttatgtagcgccggaacgactggagtctccgcagtttttagaacagcttcaaatgcttcctatcccgcttgtagcgggagatgaagcccactgtatttcacagtgggggcatgatttcagaccaagttatttgcgtatcaatgaactc

SEQ ID NO: 2271 - DNA, 594 bp, Myxococcus xanthus
aaagtaagctatggcataaccaagcagcaattatctgttgatcgagcacactctgcaagttttaattttggtaaaaatgtgaaaggcaagcactctgctcccatgcttccaaaagagggaaaggttaagctccatatgtttgtagaccattcgtctgtagaagtatttggcaatgacggcactgcagtaataacagaccagctctttccaacgctttcaagtaataaaataaagctttatagcaaagcaggctctgtaaaattaaattctcttaagatgtatccgttaaaatctatttggaataaaagtcctgttgatacaggcttatctggatggaagaatattagcggactatgggccgatacgattaacggaaaacaaggacgaagcaaagaagattcctttaccttatcatcaaaagaagcaaaaaatttcacatatgaagcaaagataaaggtgttagacgattctgtttcaaattctacaggagcaggagcgctagtattccgttcggatgaacaggcaaacaatgcttatgctgcgaatgtagatgtgctgaataatcaaataaagctcattgcggttatagacgga

SEQ ID NO: 2272 - DNA, 306 bp, Myxococcus xanthus
ttattaaataaatttgcgcgcattccactttgcggccaaatttcactgtatagcttagaaaactaagatgttgcactcgtgttcaaacaccttttattaattaacagtgcgctaatgaaagggtttatcgtagccgactatgctgacaaattccctgaaggcattaagcagttaggcgaatgggtgcagcaagggaaaatcaagtacagcgaaaacgttgtagaaggttttgaaaatgtacttgaagcgttctttggtttatttgaaggagcaaacttaggaaaacagcttgtaaaagtagcagaa

SEQ ID NO: 2273 - DNA, 372 bp, Myxococcus xanthus
atgaagataaaacacgtcattttacggcatttaaaaatggatttacttcatccgtttacgacaagtcttggaaaagaagtggatcgagattttattttagtagaaattcaagacgaagacggacaatccggctgggctgaatccgtagcgtgcgcggatcctttttataaagaagaaacgcttaaaacaaactggcacattatggaggattttttaattcctttgcttcaacagaaagaaattcagcatcctgatgaagtatcccaacgctttgctcatattcgaggcaattacatggcaaaagcggcgttagaaggcgcagtttgggatttgtatgcgcggaggcaaaacctctctctatctaaagcgtta

SEQ ID NO: 2274 - DNA, 387 bp, Myxococcus xanthus
  unsure (1)..(387): unsure at all n locations
cttaacnatatttctcagtatatacattcctatggtaatattgttattttacttgtacttttttgtgggatcgttggaattccagcgcctgaagaatcatttttaatattattaggcatgtttattgccaaacatcagctgaacttatacgaatcatctctttttgcttttttaggtgttataactggaatgcttactgcttacgggctaggaaggtatgcgggaaccccattttttgataaatacggaaaatacgtagggttaaccaaagagaaaattgaagcggcaagcggcagctaccataaatatgggatatggaccattttatttggtttatatattccaggcttacgtcaaattagcccatatatggcaggaataagtcgc

SEQ ID NO: 2275 - DNA, 147 bp, Myxococcus xanthus
attcttcataaacagcgtttcccatcatcaaatcctcgcgtgacgctgtgggtgattacatatgcatgtcaagggcttaagattaaaggaatgcttgcagagccaaaagaaaaaggaatgtatgacggctttttatacttaagaggg

SEQ ID NO: 2276 - DNA, 348 bp, Myxococcus xanthus
aaatttatcttaattgtactggtagtgtttggccatttgttacctcccttcattaatgatgaacagtggttacgaacactccacatatttatccatacttttcatatgccagcgtttattttaataagcggatattctgcaaaaggataccgaaagaaagtatatatgtggaagatggcgaagaaagtattacttccttatattatctttcaacttatctatgcggtatatgattataaactgtatgatgaatcgtcatttgaagtttcagtatttcagccagcttggtcactgtggttttgactaagtttattttgttggaatgcgacctctgttcatttctccaaa

SEQ ID NO: 2277 - DNA, 499 bp, Myxococcus xanthus
gaatcgcaagcgactatttttgctggcgctccgacaatgtataattttttacttcagcatgacaaagggaaaaaagagcactttcacactgtaaggatatgtatatcatgcggggcatcaatgccaggggaactacttacccattctgaacgtaagtttggggtcatggtagcagaaggctatggattatctgaggcttctcctgtgacgtgtttcaatccgattgatcgagagagaaaagcaggttctataggcacatctattatgaatgttgaaaataaagctgcaagacacctgcctaacagaagtagaagtaggacaagttggcgaacttatcgtgaaaggccctaatgtgatgaaagggtcttataagcttcctgaagatacagcatttgctctccgagatggttggctgtatacaggtgacttaccaagaatggataaggaaaggttatttttatatccctgacccgaaaaaaagatttaattatttgtcgga

SEQ ID NO: 2278 - DNA, 645 bp, Myxococcus xanthus
atattcattcatttaattaagatgattgtcgtaccgatcgtgatttcagcattaatcgtagcggtcgcaggagtaggcgatatcaaaaaattaggtaagcttggcggaaaaacaattctttattttgaaattgttacaaccattgcgattgtagtggggattattgccgcgaacttattccatcctggtgcaggggttgatatgggacatattgaaaaaagcgatatttctcaatatgaggcaacggcaaaaacgtctgaaagtacagggattgctcaggagcttcttcatattgttccgacaaacgtctttcagtcggtagcagaaggcgatcttttaccaatcattttattttccgtactgtttggtgtaggcgtagcttcgattggagagagaggaaaacctgttttagccttttttgaaggcgtcttggatgcaatgttttgggtaactaatttggtgatgaaatttgctccagtaggtgtatttgcacttattggtgttaatattataaagtttggtgtcggatcacttattccattaggaaaattagtgttcgccgtttacttcaccatgattttctttgtgcttgtggttcttggaattatcgctaaaatggctggaacaagcatgtttacgctgata

SEQ ID NO: 2279 - DNA, 305 bp, Myxococcus xanthus
atactcgcgctacatgaaggtgaactccccggggagaaggtggtgcacttcggaaatggcgaactgctgcacctctagccttctcagggagggcttaccatggtcggacggctgctgggcacctgacacgccatggcgccccaacagatccgcctagtacccattgggccagacacaagacatgtacgctctgggagtgctgcttcatcatctaagaagcggacgttatcctttccagtgcacaggaccgaattgagctggagcgcgtgcacttggagggactcgagcaccagcccagagccatc

SEQ ID NO: 2280 - DNA, 492 bp, Myxococcus xanthus
ggaatcaaatcagaatcacgcggaaagttaaagcaccgtcgcgtttccatgatttccattgcaggtattatcggggccggcttgtttgtaggaagcggatccgttattaacgcaacaggcccagcagcagtagtttcatatgcagcaaccggactgttagtcgttctattaatgcgtatgctcggtgaaatggctatggtaaatccagataaaggttcattctcgacatatgctcagcaaggaattggaccgtgggcaggttatgctgttggatggctttactggtttttctggctaattgtaattgcaatcgaagccaatgcaggaggagcaattgttcatgaatggctcccttccgtaccaatttggcttttaagcttaatcttaacctttgcattaaccttaacaaacttattctcagtcaaatcatttggagaatctgaatattggtttgcaatcattaaaattgtagcaatggttgctttcatcttg

SEQ ID NO: 2281 - DNA, 723 bp, Myxococcus xanthus
gtcggagcgacgcttggaatgggatttgagcgcggagggatacatgagcgaatcagcacatacctgggcctagaaattgaaaagatttctcttgagaaaatcatgaaagttcatcttccacatcgtacactaatttattatcaagaccggtatcagcatatttcgtatattcaaaaacaatttcctcataaagcgaagaatattaggagcttctatgaaagtgtttttagagttgcaaaagaaattcgcaagctcatgcggccgctgccggttcttcctcctctcacaatcggtgagtggagtaggctggtaagttcgttaaatcttgggtctgtgaagttattaccttattttcatcgatcgtttagtcatttactaaaaaaacacaggttgctagacgaaacggactttattcattttattgatggtcaattaatagacagcatgcagacaacgagtgagaactgttcaatgcttatcggatgtctagcgttggatatttatcacgaaggagctttctatgtgaacggtggcttatacaaagtcgcagaagccctgcaaaaatctattaaagccaacggaggaaaaacgactctaggaaggaaagtagtaaagatagagcgtgataacgacgagtggatcgtgcatgatcatagaggtaaccgctaccgcgcttcagacgttgtatgcaacgcgccaattcaaagcttaaagtctttactg

SEQ ID NO: 2282 - DNA, 615 bp, Myxococcus xanthus
atgtctaaatttttacagggaactattattttaataattgctggcttaattacacgtgtactcgggtttgtcaatcgaattgtggtggctcgaatgattggagacgaaggtgtgggactttatatgatggcggtccccacgctggtattagtaatcaccttaacacagcttgggctaccggttgccatatccaagttagtggcagaagcagaagctttaggtgacaggcataaaataaaaaaaatacttgtcgtctctttaagtattacgtgtacgctgagcgttttatttacgctcggactaatattattcgctcccgttgtagcaaaaaccttctttacagattcacgtacgatctatccgctgcttgcgattattcctgttattccgatcatcgccgtgtcgtctgtcattcgcggatattttcaaggaaagcagcaaatgaagcccgctgcttattctcaaattattgaacaagtggtgcgaattacgttaattgctgtctgtacaaaagcatttttaccttatggaattgagtacgccgcggctggcgctatgctctcttcggtatttggagagctcgcttccctgttttacatggtctaaagctttaga

SEQ ID NO: 2283 - DNA, 219 bp, Myxococcus xanthus
aaaacgtacagatcatcgcttattctgcttctcgctattttaattggggggatagcaggatatgctatcgggcccgatgtggcagtcgtaaagccctttggtgatttgtttcttaatttaatgttcatgattatcgttccccttgtcttttttagtgtggcttcggcgctcgcaaacatgaacggaatgaaacgtcttggtaaaattatgctaggtatc

SEQ ID NO: 2284 - DNA, 321 bp, Myxococcus xanthus
aaaaaaataaagcgtgaaattcttacatacacaagcgtcatcctcggcaccgttttgctttctgttgtcgttcagcactattggtttcagccctacactgtaaaaggcgattctatgaagcctattttgcacgaaggcaatcgaattattattaacaaacacagcaagctggagcgctttgatattgtcgtgttacaagctccctatagcagtgattttctagtaaagcggattgtgggcttaccaggagaaacggtcgaatacaaagatgatgttctgtatataaataacaaagtcaaaaaagagccgcatcttcataaa

SEQ ID NO: 2285 - DNA, 405 bp, Myxococcus xanthus
atggaattgttagggttgcatcatgtatctattctgacggggaaagctgagaaaaactatcagtttttcactaaagttttaggcatgcgattagtaaaaaaaacggtgaatcaagataacactcagtcttaccacttattttatgcagatggagaagggaccccaggaacggaagtaacgttttttgatattccagggcttgcaagaacacatgaaggtgcatctgacatttcgactgtgtcgcttcgcgttaaaagtacggattctctacacttttggaaagaacgcttcgagcagcacggagtggaatatgaagaaatagctaaacgagctaatcgtgatacattagcatttaaagattacgaaggtacacgtttgcttcttgtcgcggacaacggtgaaaaa

SEQ ID NO: 2286 - DNA, 135 bp, Myxococcus xanthus
aatccaaatcaacgagtaattgcggttgatcctagcgttattccattaggttcaaaagtatacgttgaaggttatggtcaagctgtagcggcagatacgggtggcgcaattaaaggaaatcgaattgacgtattc

SEQ ID NO: 2287 - DNA, 696 bp, Myxococcus xanthus
gggctcttacgctttgcgcttccgaatgatattcatgcgattgcagctgctcacatgttagaagtgatgtataagccatgcccaagcaaagatggcttttttgcaggggagattcttttagaagaagcaaagtacgatgcaattgcagttggaccagggcttgggagaacggaagaaacaaagaaagttgtcgaacaagtacttcaacagcccgtttctgttgtaatcgacgcagatgctctttttcatctgccggatttgatgaaagaagtaaaagaaagagaacacgcaacgattttaacacctcatcccggagaaatggctagactcgtggatacaacaatcgcagaagtagaagcaaatcgattttcgatatctagccaatacgcagtggaaaatggtgtgtatcttgtattaaaaggcccaaacacgatcgttacaacgccggatggaaaacaatacgtaaataccactggaaacgcaggacttgcaaaaggtggaacgggtgacacgttaaccggaatcatcctcgcttttattatgcagaatgattctcttcaagaagcaatcagcaatgcggtatatgttcatggaaaagcagcggatgtgctgctcgatcaggggcatacaatgatagatatgttagcaagtgacgttatttctgcacttccggcagtcttcgggcagctgaatgag

SEQ ID NO: 2288 - DNA, 741 bp, Myxococcus xanthus
  unsure (1)..(741): unsure at all n locations
ttgacaaaatatcggatcatgacctttgatggagggggtactttaggtgctttaagtttacaacttttgaatagattggcttatcaaaatcccaagttaattagtgaaactaatgttttttcgggaaattccattggttcattcactgctcttgcactagcaagcggaagatcaccagaggagacgtttcagtttttcaaagatcaaatcttaccagcgttcagcgtttcccgaccgggcggacctgtttttaatcaacaattaccctattctggttttattaaagccatacgaacgtttttcccccgagaccttcgtcttagagacttaaagaaacgaattgttgtgccatccttccacttattttcaccagagctgaatcgttggaatcctgtgttatttcataacttcccaggttctccttatcttaatgaaaaagcgagtgacgtaatacttaggagcagcggtgctcccgcgacgcaaagagcttatcaaaactacgtagatggttatacagtagcaactaacaccagtacagctagtatcgcatttgcagtgggaaaagcaaagcagccgctggatcaaattgccgtattatccatcggcacaggtgaacagccaactcaattaagaagagatacgaagggatggggaatgggtagtgccgantacatacgaccagaagatatggaggacctgccgccanantgnggtgtacttttagaccggtctcctaatgaa

SEQ ID NO: 2289 - DNA, 372 bp, Myxococcus xanthus
cattcgatgcacacgccagaatggctgcacggaattcttgtactaggactgtttcgcggtacggcagggcttattagcctcatgctgcctcctgtggctatatctatcccggggtttgcccttctagaaaactacggttacttgcctggcgtcgggtttaatatggatcgtttgttcaagcgagcaggcgcacacggcaagcagtccctgaccatggcgatggggtttggatgtaacgccccaccgattatgtcaacacgtattattgaatcgccgcgtgaacgtatgatggcgattttaacaaataactttgttccctgtaaccggcagatggcctaccctgattttgttagcttctttattaatggcaac

SEQ ID NO: 2290 - DNA, 246 bp, Myxococcus xanthus
cttgccagcttcaacttaagattcgccaaggggcggttttgcttattcttatgggacgtaacattgccgaaaaggtttgggaacaacttccggaataccctcccccggccaaaaaaggtacccccaaacttggcctttttttccacattttccaagggggacttgaccgaaaaaacaaagggttcggggggggccggttccttcttaaaaaggggggggttcaaaccctgcttcggcggggcaatg

SEQ ID NO: 2291 - DNA, 729 bp, Myxococcus xanthus
  unsure (1)..(729): unsure at all n locations
gacaatgcttcagctgttcaagaaatgaaaggaaattacgttgcgcttcaaaaagaagcggatcagcgcctgacgcgctctgttttatcaccaaccaaaacagaagatattcancaactaagcggaaagaaaaaagctgagccgcttggtgtgatgatgacagccgttataaatgaaggaaaagcgaaaaaaatagacgcctcgttttttgccataagcacaagcggctttttagctccgaacataacggaagggaagatgattacggacgatgcgaaacatgaagccgtggcggactcttcgctaaaagaagaaggagtaaagctaggtgatacgataaaagatacggcttcaggaaaaagctttacaattgttggttttacaaaaaatcagtcgtttagtcacgcgcctgttattcatatcaatcttacagagtggaagacaattgaaagcacaggtgcttttaatgcagtcgtattgaatatgaacagccagcaagcacagactcttcaaaaaaaagaagctgaaatcgatgtaatcagtaaggatgaagcgttaaaaggaattccgggttatcaagaagaacagggctcacttttaatgatggtcgcgtttctgtttatcattggagcttttgtcttagccgttttcttctatgtgatgacgcttcaaaaaatgaatcagtttggcgtgctaaaatcgataggagcaaacaccacctatttagcg

SEQ ID NO: 2292 - DNA, 303 bp, Myxococcus xanthus
tgtttatataacgttgagcgcgtcatttctaaacgagaagttcaaaatgctattttaacgggtattcaactagatgtcctcacggaaaaaaaagtgattgagccgcctctgttggatattcttgagaaagatgaaggtttatacggtatcgacgaaattttagcattatcgattgtaaatgtgtacggatcaatcggctttaccaattacgggtatattgataaacaaaagccgggtattttagaaagattaaacgataaatctactggagagtgccacactttcttagatgatttagtaggc

SEQ ID NO: 2293 - DNA, 255 bp, Myxococcus xanthus
actcaaacaaatccagtatttattggtaaaccagaaagtattattatggagcaagcccttgaagtcatcggtacgccaaaagaagaaacaatcatgattggtgattactatgatacagatattttagcagggatgaatgcaggcttagatacattattagtccatacaggggtaacaacaagagagttactagaaggatatgagaaaaagccaacttatacggtagattcactaaaagagtggatggagcgaatt

SEQ ID NO: 2294 - DNA, 441 bp, Myxococcus xanthus
atagcatcaaaagagattgccgctgaacttgcacaaaaaggaattctcatgctagaccctccggttagcggtggagagccaaaagcaattgacggcacgcttgcgattatggttgggggaaatgaacatatctttgaaagcgtttcatccattcttcatgcgatgggagcagaagtaacgcttgttggagacaatggaagcggcgtaacggcgaagcttgcgaaccaagtgattgtaaacttaaatatcgcagcaatgtctgaagcacttgtattagcagctaaagcaggcattgacgttgaaaaaatgtatcaagcgattcggggcggattagcaggaagcgctgtattagatgcaaaagtaccgcttattttagaccgcaactttgtagcaggcggacgtattgatattaacctaaaagatatgacaaacgtgatggaa

SEQ ID NO: 2295 - DNA, 378 bp, Myxococcus xanthus
ggaacgtcgctaatgaagaacatggttgctgtaggcgcttcaagtgctgtgcttcatattgacacagaagtatttgaagaagtagtgcttgaaatcttcggtaaaaagggccaaaaagttgtacaaaaaaacatggaagctattaaaaaaggtgcagattacattcgtgaacagctaggcgaacaattagaaacaatgaaactagatccagcggatggtaaaaaacgtatgtttatgattggaaacgatgcgattgcactaggtgctttagccggtggggctcgttttatgccagcatatccaattacccctgcttcagaaatcatggaatacttaattaaaaagcttcctcaattcggtggaactgttattcaaaca

SEQ ID NO: 2296 - DNA, 324 bp, Myxococcus xanthus
aatgtaaaagcacgtgaacgaatgattgcgcaatatacggtagcaggcatgtacagtggagtcgtacttggaacggatcactccgctgaagctgttacaggattttatacaaaatttggtgacggaggagctgacttagtgcctatcttccgtctaaacaagcgacaaggaaaacaaatgctaaaagaattaggctgtcccgagcatctatatatgaaaaaaccaacggctgatttggaagaagatcgtccacagcttccagatgaagaagcgcttggcgtaacgtatgagcaaatcgacgattatttagaaggcaaagatgta

SEQ ID NO: 2297 - DNA, 579 bp, Myxococcus xanthus
  unsure (1)..(579): unsure at all n locations
ttttggtatggaagattacgtgctttacntaatcaagagatggaaaaacgttttttagaaacttttccttattacctaggattaacggaaaatgctattcaatacctagtagacacggaaattgacgatttgccccggtcagttgacgctgcgacgatttgtcatcatcggttcggccaaaaaacatggggggaagaccacgtttacaagctcccggcagactgggttttcgatcaccctagcagagatatagctgaatatataagggaacaatatttattaacatacgctgtcgatgaaaggcacatgcatcagtttttaagtgaatacgaaaaggtaaatccactttcttctttttcatggagactgttatatgctagacttctttttcccgttcattattttgaggtcattgaaggatactacagtgtacaagatgagcgggaaaaacaaaagtattatgagaagcttgaaggagtattagctcattcttctcactacgaagcttttctgaagcgcttttaccagtcggtaggcatttcaacgtctcgttatcacattcctgaattaacatggatt

SEQ ID NO: 2298 - DNA, 327 bp, Myxococcus xanthus
tacaatgtggtcctcactgtcgtcgacatagcggagggctccatcagtctccatgacccaaaggtccagaagcaggtgttcaaggccatgggcatcaacgggtaggacgagcgccccaagttcggcttcatggtggacgccataaagttggcctctaccccccatgcgggcatcgcactgggcagggaccgactgtccattttgctcaggggcgcagagtccctgccagaggtcattccgttccccaagtcgaacacgtgctcccacttgaccatgggcgcccctggccaggtgcatggccgacagctgcgtcagatccacgtgcgg

SEQ ID NO: 2299 - DNA, 414 bp, Myxococcus xanthus
gtggcgctgctgcctggcctcatcgcggtggtgcagttgggccgcatccacccggatgaggtgtaccagtcgctggagcccgcctggtggcgagtccacggctacggcgtcctggcctgggagtggcatgacggcctccgcaactgggctgtgcccggcgtcctggcgggcttcctcaagctggcggacctgctgggcatcacccatccgcgggcctatcgcgtcgtggtggccattccgcaggtggccttgcacgcctggagtctctgggccgcgtaccgcttcgcccagcgccgagcggggaccgcgggtggcctgctgtcgacgttgctcgtggggctctacggcccactgctcgtcttcgcggggcgcaccatggccgagtcgatttccgcctcgctgctcatcgtcgcc

SEQ ID NO: 2300 - DNA, 603 bp, Myxococcus xanthus
agcttgcccagcgggtcctcgtggggccagcgggccttcgcgagcgactcgctgatgacggccacgtgcggcgcgtcgacggtgtcgcgtgcatcgaacagacgcccgcgcacgagcgggatgccgagcgcggcgaagtagccctcgctcgccacgcggtactcggcggagccggtgcgctcgggctcgcgcgccagccgcccgaagtcctcgaagttccccacctcgtcggggcggttgagcacgatgaaggtgccatctcccgccgggcttccctcgagcgggaagctgctcacggcgcccaccgcgcgcacgccgggcagcgccgccagtcgcgagaggaggtgctcctgcaactgcacgttgtgccgcccctgcgcctcgtcctttgccggggggagcacgaggctgagcaccgcgacatcctcggtgcgataccccgggtccagcgagagcagccccatcaggctccgcccgagcagcgccgcgcccaccaggaggaccaatgcgagcgcgagctgccccacgacgagggcccggcgcgtgcgctcggcgctccctcctccgctgtgcgtgcgccccgagcccgccagcgcggccccc

SEQ ID NO: 2301 - DNA, 315 bp, Myxococcus xanthus
gaggtccacacgctcctgggcaaggggagcgagttcgaagggaagctgaccttcgaagggcaggtccgtatcgacggcaagttccaggggcagatcatcaccaaagacgtgctcgtcattggggatggcgccaaggttcaggccgaaatccaggctggcaccgtcatcatcaacggccaggtcgaaggcaacgtgaaggcgacgcagatcatcgagctgaagacgcccggccgcgtgaagggcaacctcgagacgccgtcgctgtccatggaccgcggtgtcatcttcgagggctcgctgaagatggagaacctg

SEQ ID NO: 2302 - DNA, 1545 bp, Myxococcus xanthus
accccatccacgctccgcgctccgcgaatctcccactcgccccacaccgccatgaagccgctggggccatgcaccagcgccaggtccgggtccgtggccgccacgctgtccaacagttgcggcgcccccaccacccccgcctcggaggacaccacccagatgtccatcaggtccgtctgcgtggacggctggagatacgccaccaccaccccgttgtcgtccaccgccacgcggaccttcgtgcccgccggccccacacgcaccggctccatccacaccgtcccgtcgaactccgccaggaagagactccacgcccccgcgtcgaactgctcccacgcggcggccccatggccgtcggactcgaagtggacggccacgtcccgcacgctgccgacgagcgccggcgtcaccagctcaagccccgagtcccactggccgcctcccagatagccgcgcaccacgagccgccccggctgcacgaagagcgcacccgtgcgagcccccaccggcaccaacaccgaggaagtcgcctcccgtccacgaagctgtatgctcggctgccacccctgctacgtgagcgccgcgccccagatttcagccgtggacgacggctggttcttctgcatcaggaccagcaggtcatcccccgacgcccgcacgtcgagcacgctgctcaaccccgacgcgaccacggccttcgaggtcgagctccacgagcctcccgtctgcgagacggcgcgcaccagcgtggcgctgttgatgccggtccacaacgcgacgtagttgcctcggtggggcaccaccgcccagatgtcgcgaaccgccaggttgtccaccagcgatggggcctgccatgccccgttcgcgcgcaccgccgcgaaaagcccacccgtatcgccgaggaccgccgtgatggtgctgccatccgaggcgatgcgcaggctcgtcatctgctcggacgtgatgagctcccccagcccccactcgcgcgtgtcccggttgaagagcgcgaactccactccctggttggacacccacgcccgcccgaagctgtcccccacccggatgtactgtgcgtccaccgaggacgacaccgtggactccagccaccgcaccccgtcgaacacgaccgagacctccaacgtcgtgttccgccccgacgacaccagcacccggtctccattctgcaggaggaacacgggcgaccccaggttcgccgccgtgaagacctccgaccactgcgtcccagcatggacccggaaggtcttcccattgacggcatagagatggttccccaccccgaaaagccggccgctgatgccgggcgtcacgggcgagaagtccgtcccatcgaagagcgcgacggcgccccccgcgagcgagcggtccgaccagcccaccacgaagcgctcgccccacgcggacacctgcggcgccagcgtcatcgagcgcccctcccccaccaggacggagtccccgaagcccgagccgctgtcgaaggccgcgcggacctggatggctgtccccgtgtcctcgttccacacg

SEQ ID NO: 2303 - DNA, 654 bp, Myxococcus xanthus
ccgaaaacaatgtcgctgtcccaggtgatgaagctgctcgagggccatggtgacgagaaggtgcgccagcgctacgtgcgcgacggggtggtcgacaatgtcttcggtgtgctgctcggaaaaatccgtggcctggcagcgacgttggggacgaaccacgggctcggactggagctgtgggggaccggcaatcacgatgcgcgcatcctcgcgtgcatgctcctcgaccccgcggcgctcactgagaaggaggcacgcgggctcctcgagccactctcgaacccgactctggtcgacgaactcgtcggtcgcgtgcttgtacatgcgcccgtcgccccgaagcttcaggagaagtggatggacggcagcaaggagctccctcgccgcgccggatggaagcttcttgctgggcgcattgcgagaggccttgagaaggaactcgacgtaggcgcgacgctcgagcgcatcgagcgtgagcttccggatgcaccataccgggtgaaggagggcatcaacttctgcctggtctggatcggcctccacctgcccgcgtacacctcggaggccatcgccatcggcgagcgcctcggtcgctgggacccgcgaccgattccgaagggatgcacttcgagctacgcaccggattggatctcc

SEQ ID NO: 2304 - DNA, 684 bp, Myxococcus xanthus
gtgaacctgctgctcctcctggacgaagacttcctgcccgacggcaccgcgcgcctcaccggacggcgggcccagcacgcccgcgaggtgctgcgcgccgagcccggcgagtccctccgcgtaggacacctgggaggcctcaccggcaccggcgaggtgctggagaacagcgccggcgtgctgcacctgcgcgtcaccctcaccgagcctccgcccccgcgcgcgggcatcgacctgctgctggccatcccccgccccaaggcgctgaagaaggtgctgcccgcggtggcctcgctgggcgtggaccgcatcgtcctgctcaacgcggcgcgcgtggagaagagctacttcgattccaaggtgctggaccccgcctttgtccacgagctgctcatccagggactggagcaggcccgggacacgcgcctcccagaggtgctggtccgagagcgcttccgtcccttcgtcgaagacgagctcgacgccttcttcggcccccagacgctccgcctgctcccccacccgcccgcgaggcagtcgctccgagcgctgggcgtgggtctggcccagcgcgtcgtactggccattggaccggacggcggctgggtgcccttcgaggccgacctcctggaagcccatggtttccacccgttttcgttggggccccgcattcttcgcgtggag

SEQ ID NO: 2305 - DNA, 492 bp, Myxococcus xanthus
gccttgcctgctggcgttctttatttccacgttcataatccaatgatcaacagtactaaagcattacaacctgatcaaattgaagccgaaatcttcaagaagtttaaaatgaaaggactacttttaggggacgaggaagcagtacgattaatggatgaaacgttagaatcagggcactcacaagttatatcggcgggcattaaaaagacagggggcttttattccaattcttcggttgcgagcgaagaagattttacacatctccgtcagtatgtgcgaggtaagtttgtggaggcaggtacagagattacaaatggaaaaattgatatttcgccttataagctaaaagataaaacaccatgcgcgttttgtgaataccgctcaatctgtcagttcgacgaatcaatggaaaacaatgaatatcgtcagcttagtacagagagccaaaatgttattttagataaaattcgagaggaggccaaacgagatgag

SEQ ID NO: 2306 - DNA, 1396 bp, Myxococcus xanthus
ggagacttcccggagcgcgagcggctgctcaaggcgctgcgctccatggcccggcagacggagcggctgacgcggctggtggatgacctgctggacaccgcgcgcatccagggcgggcggctggagctggagcgcaagcgtctggacctggtccccctgctgggcgaggtgctggagcgcttcgagctgcgcaccgagtccggcgtcaccttcgagctggacgtccccgcccacccggtggagggcgactgggacgcgctgcggctggagcaggtgctcaccaatctggtcagcaacgccgtgcgctattccccccacggcggcgcggtgcgcatgtcattggaggccgcggagacgcacgtgctgctgagcgtgcgcgacgagggcatcggcatccctccggagaacgtggcggacctgttccggcccttcgcgcgcgcgtccaacgcccaggcgcgccacttcggcggactggggctgggcctcttcatctgccgcgaaatcgtggagcgccacggcggcgccatctgggcggagagcccggggccccagcgcggcagcagcttccacgtgcggctgccccgccgcgccgagcccgcggcatccgcgagcgcggcctagcgcgtcaggacgacgacggctccggcgcgccgtgcgccgtcagccattcctcggggatgtcgccgcgcggcagctccagcacgaagagggagccctgccccggctcgctggtggcgcgcaccgtgccgccgaaggcctccacaatctgccgggtgatgtagagccccaggcccaggccgccgtagtgcctgtcacacactgcgcgatagaagagctgtaagatgcgcggcaaatcctccgtggagatgccgatgccgccgtcgcgcaccgtcaggcgggcggtgagcccctccgccttcaccaccacgcgcacggggtgtcccgcgccgtacttcagcgcgttggacagcaggttggtcaccacctgctccagccgcagccggtcccaccggcccatgacgggcaccggcgcgtgcagctccagctcacacttcaactgcgaggcggagggcgcgaatcggtagaggatttccgccgccacgctggccaggtccatctcctccacttccagccgcaggcggcccgcggtgattcgcgacacatcgagcaggttgtccaccaggctcgtcagcttgcgcacctgccgctgcaccacctccagcgtctccgacacgcgctcggcggacaccggctggttgtgggccgccatcccatccacctgcttctgcagcaattgcaccttgaggtgcagcggcgtcagcggcgtcttcagctcgtgactggcgattcccaggaactcgtcgcgcaggcgcaccgcctcgcgcgcctcctggag

SEQ ID NO: 2307 - DNA, 231 bp, Myxococcus xanthus
gattggagtacagaagaaattattgatgtagtgaagttttttgaaagcattgaacgagcttatgaaaaaggtattgagcgtgatcacctaatggcagtctatcgccgatttaaagaaattgtgccaagtaaagcagaagaaaaaacaatctgtaacgattttgaagaccaaagcaaatactcttcttatcgaacgattcaaaaagcaaaggctgcttcttctggagatatc

SEQ ID NO: 2308 - DNA, 210 bp, Myxococcus xanthus
ctgacggagctggccgaggcggtgggcgtctcgccgcggacggtgcgctactacgtccaacgcggcctgcttcccgcgccccccttccggggacccgacaccgtgtacggggaagagcacctggtgcggctcaaggccatccgcgtcctgcaggcgcggttccttcccctggatgccatccaggcggagttgcagcgcttgagcctcgat

SEQ ID NO: 2309 - DNA, 702 bp, Myxococcus xanthus
gaggaaagagcaagctattatgaccattcaggagccattcgagatatggttcaaaatcatatgctgcaaatgctgatgatgacggctatgcacttaccggcccgcattagcgctgatgatattcgaaacgaaaaaataaatgtgttaaaagcgcttcgtccgcttgtaaaagaagatatggatctagacgttgttcgcggtcaatatgaggctggaaaaataaacggggcttcagtgccgagctacataaatgagcccggtgtatcaccatcttctcagacggacacgtttttagcagccagactatatatcgataattcgctttggaacggcgttcctttctacattcgtacagggaaaagaatggcggaaaaagcgacgcgaattgttattgaattcaaagactcgctaaaagagttgtacttagacaaaggagaaacaacatctccaaatctgttgatcattgaaattaacccgcacgaaaatattacgctgcagttaaacagcaaaaatccatttaatcatggtcatattgagcctgtacaaattaatttttcaggtcagcaagaaggagcaccggaagcatatgaacgccttattgcagatgcatgcgccggagattctacattttttgctcattggaaagaagtagagctagcttgggaatgggttcagccgcttcttgaagcatttcaggaaaat

SEQ ID NO: 2310 - DNA, 192 bp, Myxococcus xanthus
ctcatccgcttggtgatgcaacgctggagaaccgagcgcgtctacgaggaactcaagggcgaactgggtttggaccattatgaaggccgccgcttccctggctggcaccaccatgtttcggtagcactgtgctgctacgcgttcatcgtggctgaacgcgtgcggcgttttcccccctcggcccgaggggcg

SEQ ID NO: 2311 - DNA, 1248 bp, Myxococcus xanthus
gcagctgaaatgagaaatcgaattgcccaagcattagaaagagagttaaaaaagaatccatcttctttacacttgcgcagacagcttaatttattaaaccgtgcgtctatttctacgcttcattctttttgtttagaagtcattcgtacgtattattatatgattgatgtagaccctggttttcgaattgcggatgatacggaagcagagctccttcgtgaagaagtattggaagaactgtttgaagaacagtacagtattgaacagaacgagcgattctttgatttaattgatcgttatacaagtgaccgaaacgatttagatattcagcttatggtaagaaagctatatgactttgcaagatctaaccctgacccaaacggctggcttgaaatgatcgtgagtcaatatgatgtcacagaggactcttctattgattcacttccgtttctatcttttcttttacaagaagtaacaacgcagctgattggcattgaatcgattttaaaacaatgcttagagctagcaaagctgccaggagggcctgctcctcgcgctgttaatgcagaggaagacttggctcaaattcatcggctgctcagcgcttctaagcattcttttgatgatttgcatgaagaaatgcagagtttgaattttactcgtttaaagccatgtaaaggagaagcatacgcccttcagcttttagatgacttcggagagcttcgcaaaaaagctaagacaagccttgaaaagcttcatgctgatctgttttctaggcctttgcaaggctacatggctgattttgaaaaaatgaagccggttattgaaacgctaatctttttagttcagcgcttcggtgaacgatatgaacacattaaaaaagagaaagggttagtggacttttctgatttagaacattattgcttgcaaatcttgagtgtaaaaaaagacggtgtgcttaagccttcgtccattgcccaaaaatatcgcactcagtttgcagaggtacttgttgacgaatatcaagatacaaatatggttcaagaaacactaattaaattagtgacgagagatagtgaagaacaaggaaatttatttatggttggagatgtaaaacaatccatttaccgctttcgtttagcggagccatttttattcttaacaaagtacaagcgctttacacaagatggtcgccagttcggaaaacgtatcgatttgaataaaaacttccgcagtcgttctccttta

SEQ ID NO: 2312 - DNA, 462 bp, Myxococcus xanthus
gtctacgtcgggttgggttccaacgagggcgagcgcgagaatcacctcgtcgccgccctgtccgcgctgtcccgcatcgacgcggtggcggtgctccactgctcctcgcttttcgacagcgcccccgtggggccgccgcagccgcgcttcctcaacgcggtggtggccctggagtgtggcctgccgccgcagcggctgctctgcatccttcagcagattgagaaggacctgggccgcacccgggaggtgcgctggggcccgcgcaccatcgacctggacatcctcttctgggagggacaggtggtggccgaccccacactccaggtgccccacctggagctgcacaagcgccgcttcgccctggagccgctcgttgaactggcgccccacctgcgtcatccggtactggggatgtcggtgaaggagctcctcgggaaactcgccccgcaggatgtccgcagg

SEQ ID NO: 2313 - DNA, 525 bp, Myxococcus xanthus
tccacgctccccgatgcatacgtcggcgacaactacgccgcgcaactcgatgcttcgggcggcacgacgccgtacacctggacgctcgcggagggcaccctcccgtcgggcgtgcgcctcgatacacaggggcacatctccggcgttcccgccagctccggcaccttctccgtcaccgtccacgtgcaggacgccaccgggctttcgagccaacgtgtcctctcgctctccactttcaccgcgccctatctcgcgagcgacacgctcccctccgcctcgctcggagcggcctactccacggagcttcacgccgttggagggcgaccaccgctcacgttccgcatcacctcaggtgccttgcccacgggcctccaactggatgccagccgtgtccgagggacacccagcgaaccaggagccgcctccttcacggtcgaaatccaggacgccaatggccgtgcgtcgtccgccacgttcaacctcaccgtccagggcggcatcaccctcacccccagcgcgctaccg

SEQ ID NO: 2314 - DNA, 249 bp, Myxococcus xanthus
atgcccatcattcctccccgactcgacgacaggagcttcccggacctcgtcgaggagctgctctcccgcatcccgggccataccccggagtggacccatgcccgcgtgggcgacccggggcgcaccctgctggagctcttcgcctggctggcggactccatcctctaccgcgccaacctcatccccgagcgccagcgactggccttccttcggctgctgggcgcgagcctgcgccccgccgaggccgcc

SEQ ID NO: 2315 - DNA, 1398 bp, Myxococcus xanthus
gtggcattcccctcaccccaatcgaccagtccctgtcccgggggcagggccgcgtcattggagacatcgcgctgaaggcagctcaacttccgcggcagcgtctggacttcccgcaggtgcccgcctcgcgtgaagagcacccgcaccgggacgggccggttgcacgagtatccctcgcccggaaaggcatagtcctgctctccgtcctggtcgaagtcacccggtacgcacggccaaccgttcttttgcagggcgtccaggtctacgccgatctctcgaaggtggggcgccgcgtctccgacgttccctacgcacaagcaccggaagttcgtttccgggtcgcatccgccatccacgagcgcaatcgacacgctcggcggcgttgggtcgccgcggaggggggcctccgcacaacccacggccattgccagcagagacgccccgatgcaggtccaacgcagccgaatcacgtgtcgatgcctcctgggaggagtccagtgcaagcctcgtgcacaccttggagtggccgggctgtggccctcaggcaccagaagtgcggtcctggagccacgcgctcagcgccgctccacctcccaccacccgaaccacatggtccgctgctccgtgagctgaacccagccgggtgcatgcgcgtacgtgcgtgggagcagccctgcttccgcgacggcccgggcggtctcctcgaatgagtacaggtgcagcgtcaccgccggccccgccgtttgaatcggctgcacgggcgcctcgtgcccgtccaaccccggccgtcgctccagcacggtgaagagcagcttgccgcccggctccagcgcctccgcgaggtgcttcagcacgcgaggcaggtcgtcgcagaagtccagacagccaatggcgagtgcgacggtgaagcggccccagtcgggaggaatcggctggtggtagctgtgtacatgccacgcgccacccggccgcgctgtccgagccagcgcgagcatgtcctcggagaggtcggtgccaaccacggcgatggaggcgtccagtccgcgggtgtgaagccccggcccacaccccacgtcgagcacgcgggcgccgggcgccaccaccgccgcgaggaaccgctccacccgttcctcgtaccggtgcagggcggggaagagcacctcgtaggccgaggcaatctccccgtacacctgcttcacgccctcttcctgtgcatcccgcgacacggttcctccggctcgtgcgagcgccctggcggcggacctgcttcgcttaggcaccggcatgccgcacccgccggggaaggcctcggcggggaaccctagcatgcggcatctgcctcagtccgcgacctgccggaacaccgcgagcgagcggccgatgagctcgaacgtctca

SEQ ID NO: 2316 - DNA, 1155 bp, Myxococcus xanthus
gtcatcgaggagcacttttccgaggcggccttcctgtactcgcaatgggagcgagcactgcggggagcgaactacaatctggaagagacagcgcagttggaggagcggctgctggcacatctggacggactggtgctcgggggggagcccgtcgccgaggctctgctcagtcccgccctggacggtggggaacctggggaggtgttttgctcagtgttcgcctccatcgccgaatccccacctgctgcgctggaagtggtactcgcgctggcgccggtcgcgcctccagaggtactggcttcgctgcggcgcgcgctggaactcagcgggcgcaccgggttggatgcgtcgctggttccgttgctgaaggcacccgaggcatccgtccaggcactggcattggaggtgctttcgttccgcggagccgtaccacgcggagttgctctgaaactgctcgaccaggcggatggccgggtggtggcggcggcactgcggggccttggcacgctggaaagagatgtcgggcaccgggagttgcggcgactgttggacgacaatcgaccgcaggtgcgactggcggccatcgagtctggcctgctgtctggagtacgcgcggcatgggacgcatgccggcaggaggcgcaaggctgcggcgagggcgcacctccggcccgactgctccaggcgatatgcggggatgacgaggacgtcgagcgcctggtggcgctcatggccaatgacgtcgtccgcgcggacatcgtgtgggcactgggcttcacagggcgggttgctgccgtggaggcttgtctggagttgatggggcatgtgccatcggtggcacgactggctggcgagtcctttagcgccatcaccgggctggtgctgaaggacacttacgccgtggagttagaggagggggattcgctcccgccactggaggaagatgacctcgaagccgacctttcttccaaggaagaggacaatctgccggtgccggcccgtgcagcagtcgctgactggtggcagcgagcgcgtcaggattactctcggagtggacgctacctgggcggcaagccgttcagtggcgcggcgctgttggacgtgctggcgagggggcccatgcgtcgacgtcacgtccacgcacgagacctggca

SEQ ID NO: 2317 - DNA, 1029 bp, Myxococcus xanthus
atgagcacctccctggaggtcgttgcagtcggcgcgcgaacccccgtcgggtatacggcggagagcagcgcggcggccgtgcgtgctggcatctctcgctacgccgagtttcccttcgccgacgcccggggggagcccgtggtgattgcatcggacgggatccttgacccagcgctggaggggcggaatcggctcttgccgctgctcgagagtgcgttgggggaggtcgaggccgaactggggcctgaagcgctgctgcggagtcggctcagcgtgctgctgtcgtgtccggaagcccgccccggtttcttggaggaggatgcgagctggctggtcgacgccatggaggctcgctatcgagggagaagcgcaggcacgcgcgtcgtgctcgcggggcgcggccacgcgggagcgctccgggcggtggagcaggccctgcgggagtgtgtcgatggcggggaccacctgttcctggtggcgggtgcggacagctaccaccacgcggagacgttcctctggctggagcaggctcgtcgcttcgcgcagccggggattcgcggtggcttcacgcctggcgagggcgccgcctgtctggcgctgatgagcgccgggacgcggcgccgtctggggctgtcagggttggccgtcgtgcggggagcgcacaccgcacgagagcgccagcttcgcgaaagcagtacgggctctctcggcgtcgggatgacccaggcagtcgagggcgtcgtcgcgggactcaagttgccccatgaaggggtcgacgacctgtatacggacatcaatggcgagcgctatcgaagcgaggagtggggcttcgtcgtgctacggacgccatccgtctggaagtccaccagctacagggctccgagcacctgttggggcgatgtcggtgctgcatccggagtgcttgggggcgtccttgcagtccgggcattcgcccgggggtatgcgcgaggcccgcgggccctggtgatggccggttccgatggggggctgcggggggcgatgctcctg

SEQ ID NO: 2318 - DNA, 348 bp, Myxococcus xanthus
gtgaaggtcctacgtatcgtcaccaatgtgggcgcgacgacgccagccgccgccaagcgattctaccgggacgtcctcgggctcgacgtcctgatggatatggggtggattgaaacctacggctcaagcgaaacgatgactgtgcagatcagcttcatgtcgcaagggggctcaggcgcaccagtgccagacatgtccatcgaggtcgacgacctcgatgcggccctcactcgggtgaagaaggcgggaatcccgatagagtatggaccggctgacgagccttggggcgtgcgcagattcttcgtgcgcgaccccttcggaaggctggtgaacctgctcacccatcac

SEQ ID NO: 2319 - DNA, 690 bp, Myxococcus xanthus
ctctggacatacgacgggcagctcgcccacggcttcgagcgcatgctgccgtctggccgtatgcagctcctggtcaatctgcatgaggacacgttccgggactacaggctcgacggccgccttgcacacaagactcgtggtgtagcgattcagggcgcctacaccgcaccgagagtcgtcgacactgcctgccagcgctccatctgcggggtgagcttcgcccccgcgagtgcgtcgccgtttctgggcatgccggcctcggaacttaccgggaaggtcgtcgacctctacgaaatctgggggcgtgacggcaccatccttcgtgagcgcctgctgcaagcctccactcccgcggcccggctcgacgtgctcgaggcggcgctgctcgcacgggcacgctcgtccaagcctcgcgacgaagcagtggcggtcgcgtgctcgctgttgatgggcggcgcgagcgtccgtgccgtaggagttcgactcggcctttcgccgcgccggctcattgagcggtttcaagtacatgtcggcatcaagcccaagctcttcgcgcgcatcgccaggttccagcgcgtgctcgaatcggccgggggggagatgacctggaccaccttggccggtgagcacgggttttcggaccaggcacatctggtccgcgagttcagggcattctcgggagccactccc

SEQ ID NO: 2320 - DNA, 753 bp, Myxococcus xanthus
cttggaaacggagggtttgcagtcgtctacctcgtcgagaagcacggtctcagatgcgcgctcaagttggcgcgccaccgggattcgagtggggacgacaagcagactcacgcacggacgcttcgggagctttcggccctcctcctcctggaccatccgaacatcgtcaagcaccgtgggtatggatactctgagcaggggaatgtctatctcgcgcttgagtacgtagatgggtggacccttgccgaatgggcggagcgtaaacaccccacggttcaggaggttttgcatgtcttcgacaagatttccgccgcgctttcgtacatgcacggccgtggtgtcctgcatcgggatttgaaactgtccaacgttctgattcggaagagcgatggagagccggtcatcatcgactttagctgtgcaagctactcgttggccgaagagctgacggattggggcttgccgccgggaactgaccgctttcgtgcgccggaacagttcacatggctccgggagcacaaggccgaacagcgagcgaagtacgccttccaagttgcggacgagattttcgccgtcggggcgatgctctatgagttgctgaccgacccccgaccgacggaggttcaagcgcgagttacgctcaacagcaccgtcatgaagccgcctcctgcgcgtgcgttgaacgtgcgtgttccggaagcgctgaacgacctcgttgattgcatcctgtcgcgtgaaccggcaaggcgccct

SEQ ID NO: 2321 - DNA, 636 bp, Myxococcus xanthus
gctaaagaaatcatggtgcctcgtacagaaattgttagcgtatcagcagatgaaacgatagaagatttcttaaaaatggctagagtagagcaatatactcgctatccagtagttatagatggaaacaaagatcaagtggtgggattagttaatattaaagaaatattagcggattacataaaagaagatgatatcaaaccacgtcccgtgcaaacgtatatgaaacccatcattcaagtcattgattccatcgccatttacgacttattgcttaaaattcaaagggacagaattcacatggccatcttaatagacgagtatggaggaacaacggggcttgtaacggttgaagacattttagaagaaattgttggagaaattcgtgatgaatttgatgatgatgaaataccggacgtacacaaaattaatgaaaatcactacgtactagatgcgaaggtgttgattgaagaagtaaatgatttactcggaacaactattgaacaagaagacgttgataccattggcggctggatgctgaccgaaaagtttgatcttgctaaaggtgatagcatcaaaaacgaaggtttttcatttaaagtcattgatattgaacatcaccatattaaacgaatcgaa

SEQ ID NO: 2322 - DNA, 279 bp, Myxococcus xanthus
ggacggccgctaaacatcgttcatcgagccgttgacgttgagcacatcttcgtcaactgggacgggacggttcagctcgccgacttcggcctcgcgctgtccgacttgccggggcgcgtagcttcatccgcgcgcggccctttgggggaccacttctactcatcaccggagatgctgctcggagggagcgtcgacgcccgcgccgacctcttcacgctgggcgtcgtgctgctcgaactggcaacggggaagaacctgcttttctgcccggacgacatc

SEQ ID NO: 2323 - DNA, 409 bp, Myxococcus xanthus
ctcgtcctggtccgacacggtcagtcgctgtggaatcaagagaaccgcttcaccggcctcgtcgacgtccccctcaccgaccaggggcgccaggaggcccggcgcgcggcggaggcgctgagcgggatgacgctcgacgtcgcctatatcaacagcgctcatccgggcgcaggagacgctgctcattctgttggacacgttgggacagcaggtccccaccatccgggacgccgccctcaacgagcgcaactacggcgacctgcaggggctcaacaaggcggaccccgcgaaacgttggggggccttgcgaccaaggagtggcgccccatcttagacgggccgccccccaacggcgatcacctggagaatgacaaccgacgccgagttggcgatctatgagcgcaccata

SEQ ID NO: 2324 - DNA, 231 bp, Myxococcus xanthus
gcgggggcgaactcaggaggcgggcgcaaccaccatccgacggtgaagtcgctcgcgctgatgcgctggctttgtcggctcatcacgcccccgggcgggacggttctcgacctgttcgcgggtagcggctcgacaggtgtcgcggcgctcgccgagggcttcgatttcatcggcatcgagcgcgagcccgcatatgcggagattgcgcacgcacgtctgtgtcatgcgatt

SEQ ID NO: 2325 - DNA, 435 bp, Myxococcus xanthus
agtaactaccgtccttctatagaagctttaattcgacggataggaaaacaaacgtatcttccttctatcaattctgctgcggacattaataactttttttcattgcaatatgaagtaccaattggaatttatgattcttctaatttagagggccacgttgaatttactatcggtaaaaaagaagagtcttacgaagctctaaatgaacgtaacatttctttagaaaataaaatcatttcaaaagatgccctaggagctttcggaagcccttatgtggattctaaccgagcgtacgtaactgaaaagacaacacaagctgtacagttcatctatttaaaaccttcactttcagaagaacaggcttataaactaactaaatccttaagtgacatgttcattcaaattcacggcggcgaagcaacctatcaagtcatt

SEQ ID NO: 2326 - DNA, 342 bp, Myxococcus xanthus
aaattatttgtaagcgacttagatggaactcttttacacgaagaaaaatacgtagaacagcataatgcagacgcacttagtgaacttcagcgccaaggagtagaggtttgtcttgcttctggacgaatggatacggaaattctaaagatttctactgatattaataatacatttcatcgcattagccaaaacggaggatttgtgtggaccaaagaaaatcaagaacttcatggaaaagtgtttgaagatgatttagcggttcaactttataaaaaaacgatagatcctaaccgtattacgcttgtctgttcaaacgacacgaattatgtagagcagcgaaat

SEQ ID NO: 2327 - DNA, 363 bp, Myxococcus xanthus
  unsure (1)..(363): unsure at all n locations
atgcgcaccatgggcctggacctgggcaccaaaaccattggagtggccgtctcggacggactgggcctcacggcccaaggcatcaccaccgtccgccgcacgtcgctcaaggcggacctcgcggcgctggccaccgtcgcgagcgaacatgaggtgacccacgtcgtgctgggcctgccgctcaacatggacggcagcgagggcccgcgcgccnnnnnnnnnnnnnnnnnnnnnnnnnncctggcccagtcgctgggggtgacggtggagctatgggacgagcggctgtccaccgtggccgccacacggaccctgctcgaggcggacgtcagccgggcccgccgccgggaggtcatcgatcag

SEQ ID NO: 2328 - DNA, 318 bp, Myxococcus xanthus
ctcgaaacgggaggcattcttgttggccggtattccgacgcgctcgactgcgccttggtgagtgctgcatcaggacctcccccggattcgaagcgggggcctacgtggtttcagcgcggcacccgagggctccaggcgtggctggagcgtcgttgggcgtcacgtggagatcactacctgggggagtggcatttccatccccatgccgagccgacgccaagcgcgacggacctgcggcagcttgatgccatcgcgctgtccacccaataccgctgtccggagcccctgctgctcatcgtgggcggtgaccctcgcgat

SEQ ID NO: 2329 - DNA, 4127 bp, Myxococcus xanthus
gctcagcgtccggacgaggaagcctatcaggaggggctgcgggcgcaggcgaagcacctggggatcgaggggcggctgcgactcctggggcaacgctcggacgtgccgcggctgctgcgcgccgcggacatccactgccagcccaactcgaggccggaggcgttcggtctcgtcttcgtggaggcgctccaggcgggtctgcccgtggtgaccacgccgatggggggcgcgctggaaatcgtggatgcctcctgcggggtgtttgtccgcccggagccggagtcactggccctggccctgggacggctcatcgaggacccccagacgcgtgcccggctgggcgcggcggggcccgcgcgtgccgcggcgctgtgcgatgcgggaggcttccttcgcggcatggaggaggcgctgcgcgcgctgtccgagcaggaggtgccggtgtgagggcgccccagcttcagggccccggcgtgctgaatcgccggttcgtgcgccgcgcaccgggggccgcgctggaggcggttccggagggggcctcgcccaccgcgcccgtcgctcgcggtgcgcgcatgggcggcggcctgctggcgtcgagccgcctggtgccgctcttcgtctgtctgctcatctgctgtcagctcgcgctgctggtggaagccatcgcgccgctccgcgtggcggtgcgcgtgctggccttcggcgtcagtctgctgctgctggcgctggtgcggggacggagtctgaagcacccggcgcttcccttcatcctggccgcgctgggcatcaccgcgctccagctcttcaatcctggcaccggtgccccgttggcggcgctggcgcagttgggcatccagcttgccatcgccgcgccactgctgtgggtgacccggctggccatcgacccgaagacgttccgtcgcacgctcgcgctgctcttcttcttcaacacggccagcgcgggcgtgggcgtgctgcaggtctacttccccggacgcttccagcccgcgctgtcagccgcggtgcagggccagggcgaaggttatgtgagcagcctcaagttcgagacctcggacggcgtgcgcgtgttccggcccatgggcctgacggacattccgggcggcgcgtccactggcggcttctatgcggtgctgctgggcggcgggttcctgctgtcatcccgtcgcgggctgacgcgcgtgttgagcgtgggcggcattctggtggggctcttcggtatctacctgtcgcaggtgcgcgccaccgccgtcatgctggtggtgtgtctggtggccctggcggcggtgctcctggtgagtggccgcgtgggacggttcctggccctgctggcggtgatgggcaccgcgggggtggccaccttcggttgggccgtggcggtgggcggcgacgcggtgatgagtcgctggtccacgctcttcgcggccagccccgacgaggtgtaccaccgcaaccgcggctacttcctgacggggaccttcgcggacgtgctgcctgagtatccgctgggcgcgggcctgggccgctacggcatgacgaatgcctacttcggcgacaacagcgaccgcgagcgcccgccgttgtgggcggaaatccagtggaccgcctgggtctacgacggcggcatcctgggcgtgctgttctacccgctgggcgtgctgatgtcgttgctgtgggcctttcaggtcgcgcgcagccgtgacggtccgcaggacgagttctggctgtggggcagcgtcctcttcgcgtacaacctgggcgccttcgcgctcaccttcagctatccgttcttcatgagccagacgggcatggagttctggttgctcaacgcggcgctcttcggcgccctggcccatgcgaagaccgtacaccctcatcgccggtgacttcgtggacaccggaggcatggaccgggccaacctggcgctggcgctctggctggcgaagcaggggtaccccgtccggttggtggcacaccgcgtggcggaggtcctcctgcgccatcccaaggtgcgcttcgtgcgagtgcccaagcccgccaatgcgtatctgctcggcgaaccgctgctgagcgcggtgggccgggcctgggcgctgcgtacccgcgccgagggaggccgcgtggtggccaatggtggcaactgcccggtggcgtccgccaactgggtccactacgtccacggcgcctatacctccgagcccagcggcggcgtgctgcgccaactcaagggccgcgtgagccaccggtactacgtgcgttcggagcggcaggccctgcggcgcgcgcgcgtcatcatcgccaactcggagcgcacgcgggatgatgtggtggctgccacgggcgttcctgcgtcccgggtgcgcgtcatctatctcggtggagatgcggagcgctttcgcccggtaacagccgaggcgcgccgtgaggtccgcgcgtccctggggtggccggagtctcggcccgtggcgctcttcgtgggcgcgttgggcgaccgccgcaagggcttcgacaccctcttccaggcgtggctgcggctgtgtgcacgtgcggattggggcgtggacctcaaggtcgtgggctccggcgcgtcttcggtatgcgtgggagcgcgaagccgcggacagaggcgtgggtgagcgcatccaattcctcggcttccgtgacgacgtggcgcgcttgctgtcggcggcggacgtgctggtgtcgcccacgcggtatgacgcatatgggctgaacgtccacgaggcgctgtgtaccgggctgcctgcgttggtgagccgctcggcgggcgtggcggagcgctacccggaggcgctgtcgggcctgctgctggacgcgccggatgacgtggacgcgttggtgcggcgcctggaagattggcgccagcacgccgcggcctgggcgcctcatgtggccgcgctgtcggagacgctccgggcgcagacatgggacaccatggccgaggccatcgtggacacggtggagcgagagggctgaggcgcctgtttcgtcagccgcgctgctccaggacttcggtgaagaagtccaggtgtgccttcgccaccaccggccacgagaagcgggtgacggcgcgctctcggccccgtgtggccagttcttctctgcgctggggactctccaacaggttggcgatcgcctgcgtccaggcggacacagacgcctccggcagcacgatgcccgcgtcgcccatggtgcgcgggacttcgcccgagtcactgccgagcacgggcacgccacacgcgaagccctccgccaacatgcggccgaactgctcccgccattggcgcgtcgtctgactgggggcgcacagcatgtccatggcgttgagcgcacgtggcacgcctgcgtggggcacgccggtgaggactcgcaccgagtgggtgtgccgggccgcccagtcacgcaacgcaccttccatcgggcctccgcccacgaagagcgcgcgccacggagtgtcgagcgcgtcgagcgcatccatcagcaggggcacgcccttctccgggacgaagcggccgagaaaccccaccacgggtgggcctgatgtctcccacccgagctcgcgccgcaaggactcgcccgcggcgcgatccggttggaacaggtccgcgtccacgcccatgggaatggcgcgcgcgggacgctccgcatagccgggacgggtgaggaggttgtccctcacggtttcaccccaggccacccagccggaagcgcgctggacgacgaagcgctccgcctgggcgaagggcggcgggtaacgcttggacaggttctgcgcggtgctgaagacgagcgggacgtgacgcggtgtgagcaatgccagctccaggccggccagcacatagggctcttcccacacgtgcaccaggtccgcgccgcgagcgaggtgagcatgcacctccggaccgtaaaggaaggtgtggagcgagcgactgaagaaggcgcgcacgccttccgtcctggcgggctcgtccgcttcgagttgcagggcgagcgggctcaggtcgccgtggaagaagcggggtgccaccgtggtgacatcccatgcgcccgcgcccacgcgcatcatctcgttggcgaggcaccggat

SEQ ID NO: 2330 - DNA, 339 bp, Myxococcus xanthus
accaccggacaggaatggctggttgacgccagcggctgcgtgcctggcagcctcaaggacgcggcggcactggcggcgctcttcgaggagctcatcgtcgtgctggacctgaaggtcgtgggccagccgcagtggcacgtgttcccggagcccggtggcatcaccgggctgacgctgctggccgaaagccacctgggtatccacacgtttccggagcacgggttcgccgcgctcaacgtgtactgctgccgcgagcgccatcgtccggacttcgaggcgctgctggcgcgccatctgggcgcgacggcgtgcgtggtgcgtgagctgaagcgaggggtg

SEQ ID NO: 2331 - DNA, 1050 bp, Myxococcus xanthus
tcgaggttgaggcggaactcctcgaagtactcctctccgtccatgaggaagacgacgtcgttgtctcccgtctcagtggggacatccacgtaggtgaacgcattcgccaagggcaggctgagcggttcgcccgggttctggacctggacgtcacacgccccggcgacgtgcgcgggtacgcgcgcccggagaagacccgcgttgaccacggcgacatccgtgcagtccactccgccaatgcgcacctggattccgtccaggaaccgggccccggtgatgtcgaccgccctgccaccttcgagcgctccttgcgcgggggtaatggcggcgagcgtgggcagttgacggtaggtgaagccgttgacgagcgtcccgctgggcacgccgtggacggtcaccatcacattgaccgtgccatggagctgggccgcggtcgtcgcggtgagcgtcgtcggcgacagcacccggacgtgggtcgcgttgacgccgttgagggtgacggtcgcgccgtcgacgaagccggtccccgtgagcgtgatggaggtccctcccgcggcggggccggccggcggagccacgctcgcgatggtgggcgcggcgcgaaacgcgaacccgtgggtgacctgctccgcgccacccaccgcccgcgtcaccaccacgtcaaccgggcccgcgattcccgcggcggttgtcgcgtggagctcctgcgcggattggaatgcgacggcggccgcgggcgtccctccgaacgcaaccgtggtggtgtccgcgaaggcgtccccgcgtatcaccaccacggtgttgccagcgacggggccttcggcggggagaatgctcgtcacggtggcgtaggtgaacccgttggcgagcgtcatcgccggtgtgttggggttcgtcaccacgacatcgacgaggcccgcgccatgcgccgccgtcctcgcgcgaagctcggtgtcggacacgcgattgacgtgggtcgcggccgtccccccgatgctcaccgtcgcgcccatggcgaacccgtggccacgaatcaccacatccgttcct

SEQ ID NO: 2332 - DNA, 231 bp, Myxococcus xanthus
gtgtcacaacgtcgagtcgtcgtcaccggaaccgggcttgtttcggctctgggaaccggaaccgagaagaactggcaggcgttgatcgccggcaagtcgggtattgcccaggtcacgcgctttgacgttggcaaaatcgacacgcgcatcgcgggcgaggtgaaggacttcgagcccgaggcgttcatcgaaaagcgcgaagtgcgccggatggacctgtatgcgcagttc

SEQ ID NO: 2333 - DNA, 759 bp, Myxococcus xanthus
cctttcatttggttataaaacagttcttctcgtttaataacagggttatttggtctaaagcctgcttcagaaaatgagcttgcacacagtgaagaagagcttcgcatcttgttatcagaaagctataaaagcggtgaaatcaatcaatcggagtttaaatatgtaagtaaaatttttgactttgatgatcgcgttgccaaggagattatggtgccgcgtacggaagtcgtttcaattgaccaggaagatacggtcgaatacatccttgagatggtccaagaagaacggtttacccgctatccggtcatcgatggagataaagaccatattattggaatggtcaatatgaaagaaattttaaccgagattgtcatgaacaacagcaaggaaaaaatagatttaaaacagtatatccgtcctgttattgaagtaattgaatcgattcctattcatgatttattgcttaagatgcagcgtgaacgcatccatatggctattttaattgatgaatacggtggaacagcagggattgtaacagtagaggatattttagaagaaattgtcggtgaaattcgtgatgaatttgatgcggatgaacttccattaattcagaaagtcaaacccgatcattatattgtagatggaaaattattagtaagtgagcttaacgagctgcttggcacgacaattgatgatacggatgttgatacaattggaggctgggtcttaacggaaaaatatgacgtcaaacaaggagaa

SEQ ID NO: 2334 - DNA, 564 bp, Myxococcus xanthus
  unsure (1)..(564): unsure at all n locations
cgcggcaaggttcgcgagacgtaccgacaggatgaccagctcatcctggtgacgacggaccggctgtccgcgttcgaccacatcctcaccaccatccccttcaagggcgaggtgctcaaccggctgtccgcattctggttcgagcgcacgaagcacatcgtccccaatcacgtgctggacgtgcccgacgccaacgtcaccgtggcgcgtgcctgtcagcccttcgccgtggaagtagtggtgcgcggctacctcaccggcagcctgtggcgcgactaccagaagggcacgcacaccgcctacggactgcccttcccggacggcctgcgcaaggacnaggccttccccgcccccctcatcaccccgtccaccaaggcggagtacggcctgcacgacgagcccatctcggagaaggagcttctggcgcggggcctggccacgcctggtgactgggcgcgcatctccgaggccgcgctgggcctcttcgcggagggccagaagtgggcgcgctcacgcggcctcatcctcgtggataccaagtacgagttcggcaaggtgggcgac

SEQ ID NO: 2335 - DNA, 294 bp, Myxococcus xanthus
gtgcggcgcccggctggccggcccaggccggaagttcagaatgcggggtcaggtccggtccggacgtgcgtcggatgcgggtcgcggcgacaacaggcggaactgacccggttcgtgatagggcccggaggcgccatcgaggtggacaggaaaaggcggctgccaggacggggcgcctacctgtgcggtgccggttgtctgacggcagcgctgaagcggaaggcgtttggtagggcctttcgcggaaaggcgggccaggttgacccgtcgcagctcggacaggcatgggagcag

SEQ ID NO: 2336 - DNA, 1122 bp, Myxococcus xanthus
atgtcgaagaagcgcgtccacgaaatcgccaaggaactcaagagccacgggattgagctcgacaacaaggaggtcgtcaccgagctgtcgagcctcggttacgacgtcaagagccactcgtcgtctctcgatgacgaccaggcgaccgctgccgtccagaagattctggacaagcgcaagccgaagcaggccacgccgcccgtgacggcgaagggcttcgtcgtgcgccgcaaggtgggtccgcccgccggtgcgaccgcggacagcggggccgaggcttcacaggccgccgagcccgcctatgagccgccgtcggcgcccgagcccgccacgttcgccgccgaggagccagtgcaggcacctccgcccgtcgaggcgccccgtgcgcccgtcgaggcgccgagcgccccggagccccagcgcgtcgaggccccggtcgccgccgccacggagcccacggctccggctgctgtcacgtctacgccccccgcgcaggtcgccgaggccaccaaggcccctgccgccgccgaggtggcttcacccccgcccgccgccgaggcccctcaggccccggtggaggctccccgcgctgccgtgccggctcccgccgccgcgcagcctcgtccctctgttcaggagagcaccaccttgccccaaccccccccacgctcaccggtaccgccggcagtccggacgccttcgagcacttcttcgtccgcgaccgtcgtctcccggggccccgcgcctggctaccagcagcgtggtgggcccggtggtggtcgccccggtggtccgggtggcccgggtggtcgtcccggtggtccgggcggcccgggtggtcgtcccggtggtccgggcggcccgggtggtcgtcccggtggtccgggcggcccgggtggtcgtcccggcggtccgggtggacgtccgtcctaccagggaccgggctcgtatcagggcgccggccgtcctggtcagggaccggtgcgtccgacctcggcgcccggcacgggggtgcaggcctcggcctcggcctctccgattccgcagggccccaccatcatggtcggcggcgtgccgcacgcccaggtatcgcccacgggcacggcccgtcctgacagcaca

SEQ ID NO: 2337 - DNA, 450 bp, Myxococcus xanthus
cacacggtgctcacccccgagtacgtggagttccgcttcacgctcgcgggtctgtactcgcgcttcctggcgtggctgctggacgccgtcatcgtcacgctgctcaccggcaccatcctgacgacgctcagcctggtgatgttcgccttcccgggcttcgccagcgcgctgtccatcgtcatctacttcctggtggactggggatacgcgataacgctggagacggtgtggagcggacgcaccgtgggcaagcgggtgatgtcgctgcgggtcatccaggagagcggcgtgcgcatcggcttctaccacgcggcgctgcgcaacctggcgcgtccggtggaccgggtgcccctgttctacctggtgggagggctcaccgcgctcgtgtccggctcccagcagcggctgggggacatgctggcgggaacgctggtggtgcgcgagcggcgc

SEQ ID NO: 2338 - DNA, 450 bp, Myxococcus xanthus
gacgaagctttcatgcagcaggcgctatcgctcgcgcgggaagcagcggaactcggagaggtccccgtaggtgcggtggcggtgctcaacggtgaagtcgttggcgctggattcaatcgccgcgaagtggaccgcaatccgctcgctcacgcagagatgttggcaatggacgccgcagcccggaagatcggtgcctggcggctctcgggcgtcaccctgtatgtgacacttgagccgtgtgccatgtgcgccggaggtctggtgcagtctcgcgtgacacgactcgttttcggtgccttcgatccgaaagcgggtgcggtgggttcgctgtacaacctggtcgaagagcctcgacacaatcaccggctccaagtcacgagtggtatcctggcggacgagagccgcctgcttttgaagacgtttttcgggcgcttgcgtgcgaagaaacgt

SEQ ID NO: 2339 - DNA, 111 bp, Myxococcus xanthus
atggctccggaccgcgccttggccgcccaggcccggccggagcaggagttcttttgcttccgggtgggcgacctccgcctgggcgtgcccagtgagaacgtgctcgaagtg

SEQ ID NO: 2340 - DNA, 495 bp, Myxococcus xanthus
acgctctgcttcgtcgacctggagacgacggggttggatgcctcccgtcacgaggtgctggaggtggcggtgctgcgcgtcgacgcccgcagcctcaaggtgctggcggagtacgaggcccgcgtgaagcccacccggctggccgacgcgcaccccgaagccctggccgtgtgcggctactccgacgaggagtggcgggacgcgctgccgctccaggaagtcttggccaccgtgacgccgctcttggcgggcaccctcgtggccggccacaacaccagcttcgactggggcttcctcgtcgagtcgtatcgccggtccgagttggccctgcccagcgtcgactaccaccgcctcgacaccgccagcctcgcgtggccgctgctcgccaccggcgaggtggagtccctctctctcaacgccctggccaagcgcttcggcctccatcggccgacgcctcaccgtgccatggcggacgctcgctgcgcgctagaggtg

SEQ ID NO: 2341 - DNA, 927 bp, Myxococcus xanthus
ccaggcggattgtcccccgccgtccaccgcacgcccgccaactgcacgtcatccagcagcgggtgccccttctcggagaagaacggccccacgaacgtgcgcggcgagccgcccgcccccaccgtcacccgcgcatccgtccccggcgggcccagcaccaacaccacgtccatcgccgagccctccactccgcgcgccacctccggcgataccgcgaggaaccgctccagcgcggtctgctcgggagcgcccagtccctgcgccaacgccaccgcgatgggccgcatgggcgcgggcggcagccgcacctggccgtcctcgggcaacgcgtcgtcaggaagcgacacctccacatcgcccgcttcctggaacgtcagccggaccgtcgcggtgccctcctccggcagctgcacgcgttccacccgctccgtgccggccttcgcaccggcccctggcaacgcgcggacccgaacatccacctcctccggcgcctccccgaaacgcgccaccctcagcgtcaccgtggccgtgggcccctcatcgcgccgctgtgcggagaccagcgccacgttgcctcgcgcggcccccagcgccgtccaccgcacggacgcgggcaccagggccgcgttcactggaggaacatccgtgaagaaggccacgcgccgtcccgcccccgccaattcctgcgcccagatgagcgtgggcatcgggtcatggtccgcgccctgcgcctggaaggactccagcgcggccaacgcccgagaaggctccgcctctggccccgcgagcatgcgcggcgtgccgccactggccagcagcgtcacctgcgtcgcctcctccgactccacccgcgccgccgcctcgcgccgcacctgctccaacaccgtcacaccgtccggcccacgcgcggacatggacaggctccca

SEQ ID NO: 2342 - DNA, 2096 bp, Myxococcus xanthus
ctcggacagggcctcgtagacttcctcggccgtctggaaccggtcgtccggctccttgcggatgaggcggtgggcgacgcgcgcgagctgcgggtccccatgaaggttcagcgccagcacggggggcggctccgtctccagcacctggcgccagagctcgtgcggcgtcttcgcgtcgaaggggggccgcccgctgagcagctcatagaggatgacccccaggctgtacaggtcggcgcgtccatccaggggctcgcccagaatctgctccggcgccatgtaccggtaggtgcccaccagcttgccggcctcggtgatggccgcgtcgtccgccaggaacttggcgagcccgaagtccatcagccggacctgccggtcatcgtccaccatgatgttggacggcttgaggtcgcggtgaaccaggccgtggccgtggatgtaggccagggcttcgcaaatctggagcatggcgtccttgagacgtcccatgcgttcgggccggttgaggtcctcttcgcggaccacgcgccccggctcctcctcgggctccgcggggcgcggcatggggggcggcaggtcgaagccctccagcgaatcatccgagccgatgcccacgtgcgggctggcactggaggcgaagctctcgaggtcctcgctgggtgcctcctccgcgaaggcctccaggccgaaggtgccgtcaaacgggctgtcctccgagtcatccatcgaatcggagaagctccggctcaaggggccgaagtcgtcgtccgcggtccggaggacggacaaggggctgcgcggcgtgtggctgcccggaggggtttgccggtcgccgctgctcaggtcgaggtagtggcggagggtgaggccctcgatgagctccatggccaggtacggcactccctggtgcacgccggactcgaacaccttcacgacgttggggtgagacaggtccacgagtgtgtcgaactcacgggcgagtctgcgcgcggcacgagcatcccgcgcggggccggctgaaagcagcttcagcgcgacctcgtcggtggtgcggcggtccagggcccgataaacggttcctgccccgccactgccaagcgtctccagaacgcggtagggaccgatgaccttcaggggcatgggatgtcgaaatcctacggaccacgtcacgtcagggtcaacgttggcaacgcctgattgctcggcgcacggcagaactggcggcaagtggttttacttttccgacaaacctgggagaacccgagtcaatgcaaatcgggaagtaccaactggtgcgaaagcttgcgtcaggcggcatggcggaggtcttcctggcgaaggccgcggggccacgcggcttcgagaagacgcttgtgctcaagcgcatccttccgcacctggcggaggacgcggcctttgtagagatgttcctgggcgaggcgcggctggcggcgcagctcgagcacccgaacatcgtgcaaattttcgacttcggtgaggccgagggcagcttcttcctggccatggagttcattgacggcccgaacctgcgcaagctggtgaagcgggccgcagaggaagcgctgccccccgccttctgcgcgaaggtggtggcggccgcggcggaggggttggcgtacgcgcacgagttccgtgacgtggagacgggcgagccgctgggcttgattcatcgcgacgtgagcccggacaacatcctggtgtcgcggcagggcgcggtgaaggtggtggacttcggcatcgcgaaggtggcggggcaggggcaccggacgctgacgggcgtggtgaagggcaaggtggcgtacatgccgcccgagcagctccaggcgaaggccatggatcggcgggtggatgtctacgcgctcggggtggtgctgtacgaactgctcacggggaagcggccgttcgatgcgacgacggacgtgagcgtgatgcaggcgattctgttcgagtcgttcatcccggtgtcggcgcggcggccggatgtgcccgtggcgttgcagcaggtgctcgacaaggcgctcgcgaaggaccgggagcggcggtacgcggactgccgggcgttgcaggacgacctg

SEQ ID NO: 2343 - DNA, 525 bp, Myxococcus xanthus
gattccctacccggaggagggcaggcccacgccaccatcaccaagcctcccgaactggtgcagcaggtggaggcgcagtacccgcccgaggcgctagcacaggggctcaccgcgtccgtgcggctcatcatgaccatcagggatgacggctccgtcgccgaggtgctgcccaccgagccggtgggcaacggcttcgacgaggcggccatcgcggcggtgcgccagttccgcttctcgcccgccgaggtcgacggcgtgcccgcgccggtgcaggtggagtatgtctaccacttcaccctcaccgcgccggagccggaggcgggcgccgaggccgtggaggccgagcagcccaaggccacgctcaccggtcagctcatctcccgcggaagccgttctcgcgtgcccaacgccaccgtgagctgcggcgaccacgcggacgcgcccgaggtgatgtccgacgaggacggccgcttcacgctcgaggtgcccgcgggcacctgcgaagtgcgcgtggtggccacgggc

SEQ ID NO: 2344 - DNA, 1902 bp, Myxococcus xanthus
atggcgaccaagcgcgcactcattacgggcatcacggggcaggacggcagctatctcgcggagctgctcctttcgaagggctacgaggtgcacggcatggtgcgccgctcgtcggaggagaagttcgagcgcatccagcacctgcacgggaagattcagcttcaccagggcgacttgctggaccagttctcgctcgcggcgttgctcaacctgacgaagcccgacgaggtctacaacttggcggcgcagtccttcgtccccaccagttggaaccagccggtgctcacgggtgagttcaccgcgctgggcgtgacgaagatgctggaggccatccgccacacccgcccggaggcgcgcttctaccaggcgtcgtccagcgagatgttcggcaaggtgctggaagttccgcagacggaggacacgcccttctatccgcgcagcccgtacggtgtggccaaggcctacggccaccacatcacggtgaactaccgcgagtccttcaacctgttcgcggtgagcggcatcctcttcaaccacgagtcgccgcgccggggcctggagttcgtcacgcgcaaggtcacctacaacgtggcgcgcatcaagctgggcctccaggagaagctgcccatgggcaacctggacgccaagcgtgactggggcttcgcgggcgactacgtggacgccatgtggcggatgctccagcagccgcaggccgaggactacgtggtggccaccaacgagacgcacaccgtgcgcgagctggtggagattgccttcgcgcgcgtgggcctggactgggagaagcacgtcttcatcgacccggccttcgtgcgccccgccgaggtggacctgctcatcggtgacccggccaaggcgaagacgaagctgggctgggagcccaaggtccgcttcaaggagctggtggagatgatggtggacgcggacctggagcgcgtgaaggcggggcagcggtagatgcgcattctggtaacaggcgcggatggcttcgtcggccggcacttgtgcgccctgctgcgcgccgccggcgacgaggtagtggaggcccacgggccgcgcggtgagggcatcaacagcaacgccctgcacttcgacgtggccaatgaagcctcggtgaaggcggcggtagccgaggtgaagcccgagggcatcattcatctggcgggcttcagctcggtcgcgaagagccaccacaacccgtcccgggtgttcgcggtgaacaccatgggcgtggtgcacctgctcaccgcggtgcgcgagagcgtcccgaaggcgcgcgtggtgctggtgggctccggcgaggtgtacggcccggtgcccgaaggcacgcgcgccaccgaggacacccccgcggtgcccctgagcccctacgctgcctccaagtccgcagcagagctggccgcggtgcagttccaccgcagctacgggctggaggtcgtcatggcgcggcccttcaaccacctgggcgcggggcaggaccccaccttcgtggtgccctcgttcgcggcgcagattcgcgccatcgggctgggcacggtggacccggtgctgcgcacgggcaacctggatgcggtgcgcgacttctcccacgtccgcgacgtggtggaggcctaccggctgctgctcgacaagggtgagccggggcaggcgtacaacatcggcagcggtgagggccgcaccatccgcagcctgctggaggagatgctgtcgctggcgggtgtcagcgcgcgcatcgagctggaccccgcgcgcctgcggccctccgacatccccagcctcgtcggcgctcccgacaagctgaaggcgctgggttgggtcccgaagctgaccgtggcggacgcgctgcgcgatgtgctcggcccccgcgtgcccggcgcggcgtga

SEQ ID NO: 2345 - DNA, 681 bp, Myxococcus xanthus
atggcggacgccaggaacgtgcgcatcaccgtcctctatttcgccgcggctcgcgagcgcaccgggcaggtgcgtgaggccctggacttgcccgagggctcgcatgttcgggacgtgttgcggctgctgagcgcgaagtacgcggcgctggcgccactcctgccgcaccttcgtgtggccgtggaccaggagttcgtcggtccggatgccccggtgcgggatggggcggagatggcgctgattccccccgtggcgggaggcgcacctgggaagttcctggtggtggaccgccccctgcggctggaggaggtggtggaggctgtcaggggggagtcatacggcgggctggtgacgttcagcggctccgtgcgcaaccagacgaagggccgccgcgtgttgcgcttggagtacgaggcctacgcgcccatggcggagaagaagctggcggagattggcgcggaggccgcggagcggtttcccggcgtgcgcgtgtccatcatccatcgcgtgggaacgctggtgcccggcgagctggccgtcgtcatcgccgcggcgtcgccgcatcggaaggaggcgttcggtggctgcgagtacgccatcgagcggctcaagcaggacgtccccatctggaagaaggagttcttcgaggatggggaggtctgggtcggcctggggccctga

SEQ ID NO: 2346 - DNA, 1839 bp, Myxococcus xanthus
atgaaccagagcaccacgtacctgctgtgtctcaccgcgctggccaccgtctccagcggctgcttcctgcgcacgggctacatcctcgacgcgctgaacacacccggagacccgcaggcggcgccgctgcccgtgcccatccaggagcgcgcggcgcgcatcacccgcacgcacctggtggacgcctacgccgaccccaccgaagccgcgcgctggatgtccgcgatgggcaacgcgccccagcccatcctcgagcaactggactgcctgaagcagagcgcgggcggcagcaacagcgcgtgctacgagcgattcctcaagaccgccatggagccgccgcagtggggcctgccgtcgctgcccaccacggtggaccccgccgcgccctcaccgcgcgaagtggacgccgcgcgcttcctggccaacacgctgggcatcgccgcgtcgctggtggccctgcgtgatgcccagggggaccgcgtgcccatccaggtgctcacccgcggcatccgcgaaggcgccgagtccgccgcgcagtacgtcagcgtccgcaagtggaaccgcacgctgggacgcccatccaacgccattgtcctgagcggcggcggcgccaatggcgcgttcagcgcgggggccatctggcgcctgctcggcgtgctggagcagtgccgcggcaaaccggcgccggagggttgtggagacgcgcgtatcgacctggcggcgggcagcagcaccggcgcgctcatcagcacgctggtggacctgttccacacgccgggccacgaagaggccgcgcgccagctcctcgtcagcaactacacctgctcggtggagtcggacctgtactgcgtcaacaacacctggatttggaagattgcctccaacctgcgtggcctggtccagttcgacggcatctacggcaagctccgcgcggcggtggtccccgagcagctcaccaacggcacggagctggtggccgtctccgtggacttcgacaccggtgacgtcttcggcatcagcgaccaggacccggcgaacttcgacccgaacgccaccgaacagcagcgcgtggagggcatcatcaacggcgtcgtcgcctccatcgtggagcccgtgctcgccgacccggtgccgtggctgccgtcacacaccgggaggatgaagggctccttcttcgacggcggcgtgcgctccggactgccgctgctccaagccgttcagcgcggtgccgagcgcgtgctggtcatctccaccggcggcgtggagccgtcaccggagaacccgccggacaacgccgtcagcgtgctgatgcgcaccatcgaccttttcgtcgcccagccgcgcgtgggtgaggtgcagcagggggagatggccgccgtgggccggcgcttcgcggagcacaacgtctgcgtggagcgcctggcgaacgtggccgacgccgccagcgtcaacgccttctgccgccgcacgggcatgggcttcgtcccgcgcgagcccgcggccctcaaggcggccaccagcatgtggctgggctccgcccgcttcgaccaggtggcctccagttggcgttcatcgtggatgttccgtccggactcgcagctccagatggccagcggctacggcttctcgccggaagtcatgcggccgctgttcaaggaaggcgtgaagcacttccagcagcgttgccgtgaagtgctgcgcctcttcgagattcaaggcacgctggccgccgcggagtgcgacaagccggtggacgacgcggtgtcggaagccgaggcgcggttcgctccactggcccagtgcatgaagggcaagcccgagcagcgctcgtgcaagtga

SEQ ID NO: 2347 - DNA, 97 bp, Myxococcus xanthus
atgtccgaccggtcgtccctcatccgttggctcgtcattcccggcgtgagcctgggcgtgctcatcctgagcgccgcccatacctacgagcgggaga

SEQ ID NO: 2348 - DNA, 291 bp, Myxococcus xanthus
atgacgaacgcgggcacctcgcagttcagctcggcctacatccccaaccccgcgctgggcggcaccgtggagtgggatgcggaccggcgcatcatcgtctacacgacgaccagcctgcggccgggcgaggacggcgaggtgcgcgtcatcaccttcgacaggaactacgacgtcgccacggcctacagcctgggcacgggcttcgggccggtctggacggagcgcggcaccgtcgtctactcgcggaacgagggtgagcgggtcgtcagcgtcgaagtgcgcgtgaagtag

SEQ ID NO: 2349 - DNA, 1332 bp, Myxococcus xanthus
atgttcgtggaggccgcggccatctacgacgacctcatccggcagagcccctatgaccaggagctcctcctggcgcgcgagggcctgcgctcgcgcgcgctggcgcagttgctgagcaacgcgcgggaggcgcgcctggaaggggatgacgaagaagcggaggcgtggctcctgcgcttcctgaaccaccggacggcatggaacgcgaagctgaatggcggcttggagagctccctgcacgaggaggtggatggcacacgccgtcatctccagcggctcgtcggcaaccccgcgcgccagggacacgcgctcacggcggagcaggcattgcggcgcaagcagccgctgctggcgcaccgcgagctggccctcatctcccgcgacatggagtggctggtgctccagagcggcaagacgtcctgccagcgcctgcgggacaccagcacggatgacagtccgcactggcgcgagctggtgttccgctactgcggccactggcgggagtacgcgcctcgccccgcgacggcgcccgagctgttcggcccgccttcctggacgggcaccgtggagggcctggacgaggcacaacaggcgcagttggaggcccggctcacccaggccttcgagtcctcgccctggttcgcgccaggaggctcggcgcggccggtgttcagcctggagggacgcttcgtcacccagcgcgacagtcaccccgtggagctgaccgcgccgtggacggagagcgtgccgtacacggaccacgaggaccgcacggagaccatcgaggagccctacgaggcggaggaggagtacaccgactcgaagggcaagacgaagacgcgcaaggtgacgaagtacaccaagcacacgcacacctactccgtgcccgtcacgcggtaccgcgacgtccccaggaaattcgagtaccacgcgctgcggctgtcgcaggcgcaccacgtcacggtggcttcgtccgtggtgttggacgcccggcgcgggcccttcaccgtgacgttgcaggaccagctctccgagtccggccacgagcacgacgtcaccttcaaggaaggcaacgtgaggccccagcggccgaacttcaccctggccgaggcctggctcgaggcgaaggtggaggccctgcgcgtggccttctcccggcggctcgccgagcactggcgtgagtcctactgttccacgccttcgctcaccttggacgaagccgcgcggtgcgcgcgcgctggtatcgccgtccccattcaggcgtcccgggtcctctcagacatccttggcgcggacgcgacccaggttcccgcacttttcgcgttaccgtga

SEQ ID NO: 2350 - DNA, 1491 bp, Myxococcus xanthus
atggggatggccatccatcaggaggaattccgtccggaggaccacgagcgtttctcccggcggctggcggagagcctggaggcgctgcgggcacttttggcgcgcccggggttcggcgtgggtgcgccgaccgtgggcgcggagctggagctgtacctcgtggatcgcctgggtttcccactgccggtgaaccgagcggtgctggcgcgcgcggaagacccccgcgtgacgctggagctggatgccttcaacctggaggtgaacctgcgtccgtgcccgctggccggcaggtccttcagtgcgctgcgccaggaggtggagagcgcggtgtccgcggtgcgccgggccgcgtccatgctgggcgcgcgcgtggccgtcatcggcatcctccccaccttgcgcgaggcggatttgggcagcggcgcgctcacgagcgagccgcgctatcgcgccatgtccaccgccatccgtcagcgccggtccgcgccgttccatgtatcgattcggggcgaagaggaggcgctgtcgctcacctggaaggacgtgacgctggagggcgcgaacacgtcgctccagtaccacctgcgcgtggcgcctggggacttcgcgcgcatgtacaacgcggcgcagctcgccacggcgccggtgttggcggcggcgggcaactcgccgctcttcctgggacggaagctgtgggacgagacgcgcgtggccctgttccggcaagcggtggatgaccggggcgagcccggagaaggcggctttcagccccacgcgcgcgtgtcgttcggccatggctgggtgcgcgagggcgcctaccagttgttcgccgaagcggtggcgctgcatccaccgctgttgccggtgtcgggcgatgagcccctccgcgagcgcgtggcggcgggcgaggtgccggacctggaggagctgcgcctgcaccagagcacggtgtggagctggaaccgcgccatctacgacccgaaggctggaggccacctgcgcatcgagttccgcgccttgcccgccgggcccacgctggtggacatgatggccaacggcgccttcctgctgggtctcacgctggcgctggccgagcgcgtggatgcgctgctacccgcgctacccttcgtccacgcgtacggcaacttcatccgcgccgcacggcagggcctggacgcggagctgctgtggccctcctccacggcgcccagtccgcggccgatggcggcgacggagctggtgaagcggctgctccccgacgcccgggagggcctggttcgcgcgggcgtggacgcggaggaggcggacacgctgctgggcatcctcgaacagcgcgtcgtgctgcgacggacgggcgcgacatggcagcggcagatgctggcgcggctggagtcacaaatgccccggcgggacgccctggcggcgatgttggagcgctacctccagcgctccgaatccggagcgcctgtccatacatggccggtcgagtag

SEQ ID NO: 2351 - DNA, 1596 bp, Myxococcus xanthus
atgaccgacatcaccctggaggagtacaaggcgctgcgcaccctccagcgcgcggtggatgacgccttggaggacagcctgcgcgggcgtgagacgctgacgcagaccttcaagcgctgcttcccgttggtgctctcgctcaccggcgccaaggccgtggccatcaccacgcgcgacgaggagctggtggagcagacgtggaacgagggggactggagcgaccgtcaccccggcgcgctgctggaaggtgccgtgggcgtgcgccggttgggggcggacaccctggtcagccagcccctggacgtggcgggaacgcgcgtgggcgtgttcggcctgctcttcgcgaacgacgccaccgcgccggactcctccgcgcgcctgctgcgcgtgctggacaccgtggcggagcagctcgacacggtgttgtgcctggtgcacaccgcgtcggagaagcaccagctcatcctccagtgcaacagccatctggccaaccccgtcttcgaagcgggcatggacctggccgtgctgacgctggcgcagcgcgtgcgcctgccaggcttcctgctgctgtaccgggacgcggtgcagccgcatgtgctgcactaccgcacctatcgcaacgggcacctggagttcgaaagcggcgagcagccccatgcggggttggaggctgccatccgtcagcacggcccccggctgctcctgagcgaggagtccacgctgcggcggctcttctccggccgcaccaccgaggccgtgctcatctccggcgccgccgcgcagggcccgctggggaagattgtcgtgtggaacgacagcggcttctcctcctacgccatggacctcatccgggtgctggcgtccacgctgagtcagcggctccaggactacaaccgcgagcgcatccacctgtcgcagttcttccccaacgccatcatcgacgcgttgttgcacgaccccgcctacgcccagtacctgcgggcgcaggaccaggaggtgggcatcctcttcgcggacatcaacggcttcacccgcatctgcgagcagggcttcgacagcccgcgcaacatcggccgcttcgtggatgagtggagccagcgcgccgtgggctgcatctgggagcacggcggcgtgttcgacaagatggtcggtgactgtgtcatcggcctcttcgggccgcccttcttcaagggcacgccacgcgagcgcgcgcaggcggcggtgcgggctgcgtgtgacatccaggccttcaccgcgtcgctgggcgcgcgcgaggaagtggcggcgctgtgtgagcgcgtgaagctgccgggcctgggtgtggcggtgggcgtcaacctggcgcacgccaactgcggcctcttcgggcccaaccgtcagtacacggccttctccagcggcatgaaccaggcggcccgcctccagtcactggcgggtttccgggagacactggtgatggagcgcgtgcatgacgcgctggtgggctcggatgagcccttcttccagggcctgcgcttcgggcccctgacggagacgcccgtgaagaacgtggcgcagccgctgcgccactaccggctggagccgctcacgccttga

SEQ ID NO: 2352 - DNA, 855 bp, Myxococcus xanthus
atgcgcatcgcccactgctccgacgtccacatcaccgaggactacttcgcgcttccgctgcaccggttgggctggcgacgttggatggccctggcggagctcaccgtgggaggccgcgcccggcggtatgcgcgcgcgccccaggcgctggccgccattgcccgggacgcgcaggccgcgcaggtggaccacttcatcctctccggcgacctgacggcgtacgcgctggacgccgagttcagcggcgcccgccagtccctgggcgcgctggcggaggacccccgtcgctgcaccgtcatccccggcaatcacgacgtcttcacgcccgggagccaccgcaccggacgcttcgcgaaatacttcggccacctgctggagagcgacctgccggagtaccgccgtgagggcgcctttcccttcgtccggctgctgggcaccgaggccgcggtggtgggactgctgtccgcccgtgtgccgcgcacgccgggcctgtcctacggcgtcatcggcgaggcccagcttggaggcctggccgcgctgctgaaggacgcccggttggaggggcgcgccatcctggtggtggtgcaccacgcgccgctcaatccccatgggcgaccggaccgctggcaccatggcctccgggacgcggacgccttgctgaagctgctgccgggcccgcgctacgcggtgttgcacggccacatccaccggcgctaccaccatcccgccaccgccgaccggccccatgtcttcggcgcgggctcctccaccgaatccggacacgaggggtactggctcatcgacgtggcggacggacaggtgtccggcggccagcaacagacgcccgcgctgtga

SEQ ID NO: 2353 - DNA, 96 bp, Myxococcus xanthus
atgaactcccaactggagctgtcggcgcaccccgaagaggacagcgcctccaagcccgtggccgccgacgagcaggcccccgctgaaatcctttag

SEQ ID NO: 2354 - DNA, 192 bp, Myxococcus xanthus
caggcactggaggggcccaacaagctgctcgcggcgatgcggcccatgccggacatcctggccgccttcagcaagcgcctggccgcgctgggcacgccgccgccccccccgccggtgcaggcggtggactatgtctccctcatccaccacgcgctgccccggaaccacaaggggcgcaccaagccgcagtag

SEQ ID NO: 2355 - DNA, 189 bp, Myxococcus xanthus
acggaggagcgtgtcttcaagggccgcgtccccgcgcgcagcgtggtgattcccggcatgcgggagaagcagttcccggccggcaagtacatggtgccgtgcgcgctcatcatcggtcagcggacgaagtccaccgaccagaagaccagcctcaatgcggcgctgcgcgacttcgcggtggcggtgtaa

SEQ ID NO: 2356 - DNA, 138 bp, Myxococcus xanthus
atgggacatctggacgcggcgcgcggcaaggcgctcggcgccaacatcttgttcggtgtcgcggcgacagcggcggcgggagcggtcatcacctacttcctgggtaacgaagccacggcgcagcgggaggcgcgatga

SEQ ID NO: 2357 - DNA, 630 bp, Myxococcus xanthus
atggcgcaccatctggacgacatcctgcccgaatgggcactggggatgctggaggccccagcccgggcgtccgtcgagcagcacctcgcggagtgcgcgaggtgccgcgaggtggcggaccggctggtgtccacgcacgcggcgctggcgtcgctggtggtgccgccgcccgcggtgctggcgcggttgatggaccagatggaaggtccggggaggcttgcccgcttcgcggaccgggtggcggccttcttcgacctgtcgcgcgagcgagcgctggcgttgctggacgctgtgagcgacccggcggcgtggatgcccggaccggtggagggctcggagctgatgccggtggagacgggccccgcgcgcgaaggcacgatggccgccatcctccggctccacccaggggtgcgctacccccggcacacgcaccacggccgggagtggaacctggtgctggagggcggcttccgcgaggatgatgggcacgaggtctggcccggcgaggagctggagaagacggacggcagcgcacatggcttcacggcgctgacggaagggccggcgtgtctgtgcgcctccgtcctggagggcgtgacgagcttcgaggaagcgttcgcggacggctga

SEQ ID NO: 2358 - DNA, 1089 bp, Myxococcus xanthus
atggcttccatcgacctcgccacgcggctggctcgcaccacgctcgagctgtgccgcatccccagtcccatcacccaggaagggcccatcgccgaccatgtggagcgctgggcgctccagcacttcccgcgggaagaggtgttccgagtcggccacacgctgctgctcggcaagctggaggatgcgcgccccacggtggccctcatcggtcacctggacacggtgcccgcgcaccccagcgacgcgggccgcgaggcgcgcatcgagggcgagcgcgtcttcgggctgggcgcctcggacatgaagggcgggttggcggtgatgatggcgctcgcggaggatttgcgccgcgacacgctgcccgtgaatctggccttcctcttctacgagcgcgaagagggcgcttacgccgaaagcggcctcatccccctgtatgagaagcggccggacctggcgaaggtgcggttcggcatcgccatggagcccaccgacagcgtggtgcaggtgggctgcgtcggctccatgcaggtcaccgtgcgtttcaccgggcgcagcgcgcactccgctcggccgtggcagggggagaacgccatccacaaggcggggccgttcctcgccgagttgctcgggcgtcagcgcgtggaggtcaacgtcgcgggcttcccgttctacgaggtcatcaacgccacgctcgccaagggtggccgcgcgcgcaacgtcatccccgaggccttcgagctgaacctcaactaccgcttcgcgccgggcaagagcatcgaacaggcgaaggcggacgtgcacgcgctcgtcgccgggcgggccgaggtggagttcaccgatgcgtcgcccagcggcccggtggtggcgggcaacccgctgttccagaagttgatggccctcaccggcctgcccgcggcctccaagcaggcctggacggacgtggcgcgcttcggcgagtggggcgtggatgccatcaacttcgggcccggtgagacggcccaggcgcatcaggccaatgagagcgcgcccatcgcgccgctcgcggacgcgtacgagaagctcgcggccttcctcaagggcgcgagctga

SEQ ID NO: 2359 - DNA, 1281 bp, Myxococcus xanthus
atgcagcgcgagggcacgccccaggacgacctggcgctgggcgcggcggtggatgccagcggcgacctcctcacgctgtcgctgcatgacatcgatgacctggacagccttcagcccacggatgaccgggcgaagctggtgctgacgcggcgcgcgcccacgggcgagccgcgctggcagaaggccttcgacgtgagggccccggaggcgccgccggagcggcgcgcgttcgtccggggccgcatcgccgcggacccggcgggcggcatcgtcatcgccggcaccacggagggcgtcctggacctcctcagccacaagctgggggatggcaccttcgtggtccggatggacgcggacggcaacgtcctgtggacgaacacgcccgtgggcaccggcctcgcggtggcggacctggcggtggacacccagggacggacgctggtggccttcaacgcgccgggcagcacggacttcggcaacggcgtcaccggcgctggcgcggtggtggtgacgtacgcccacggagggctggccgaatccgccgtgtccgtgggcgagccccaggggggcgggcgcgtggcgctcacgacgatggcggtggatggcgccgggcgcatggcggtgggcggccagtacgagggcgcggtgcgcttcggcagtcagcaggtgagcgccgccgaaagcggcagtcccttcgtcgcgctctaccagcaaggctcgctgacgtggaccaaggccatgagccaggcacgcggcaccatgcgcgacgtggcgatcgacggcgagggcaccgtggtggccgcgggcccattcctgggcaccgtgcgctggggtgacatgcaggtgccggggcatgcgttccgggaaacccccttcgtcgtctccgccaaggcggaaggacaggagacatgggccaagggcctgggggacgggctccaggtggacgcgctcgcgctggcgccctccggagagctgatggtggcgggcttcaccttcaaccgcatcgagaacggcgtggcaggcaaggacggcatgggctcggcgcagcccgtggccctgcgctacgacgcagcgggcacgtcgcttctcacgacgatgttcctggcggacccgccccggccgagaggcgagctgtatggcctggaagccattccctccatgggcgtgctgcccgacggggatgtcttcctcttcggccacacggaccgcgagacggacttcggcaccggacgccagagcttcgcgcgcggcgatgtcttcctgctgcgactgaagcgctga

SEQ ID NO: 2360 - DNA, 1110 bp, Myxococcus xanthus
atggtggcgatgggcggcgcgtacgtgggcatcgccgagggcgccgcggggctgcccagcaacctggcctcgctggcgcaccggggtccggccttggagaaggactgggatttgggcgtcaccctgtcctggttggacctgcccttcaccggctcgcgcaagcgggacgtggacaacgacgggcagcccgacgagtcccacgacagccggcaactgctgggcggcctgctgctccagtacaagcgcttcggcatcggcttcgcgatgcgcaacagcgtggtgtcctactgcgccacggccgcgtgcgcggggcccggtgagcgcatccgcgtgtcgctcacgcagtcggtgctggcgggggccatgtcctttggccaggacgacttcatcctcgcgctgggcatctacgcggcgcaggcctccttccggctggactccggaggcacggacctgcgctacggcgacacgggcgtggcggtggacatcctgtaccggccgcatgggcgcccctggcgcatgggcgtgacggtgcggccggaggtggtgggagactggcggcgcgagccgaaacagctcccggagctcgcggggcgtaccctcttcggcgcggtggtgtcccccgccgtgctgtcggtgggcgccagctggcggctgggcgaaggcgcggagcgctacaaccggctgtcccccgcggcacggcgacagctcctcgtggagggagacgcgctaccggtgccggaagccgagcccctggacgcgcccgctggccgctggctcatcagcgcccaggtggacctcatctccagcgtggacaacgcggtgcccgcgcgcaccttcgcgtccacggcggacgaggccatggtgggcaagggcacctccttcgcgccgcgcatcggcgtggagcatgacacggtgccgggcatgattcggctgcgggccggcgcgtacgcggagccgtcccccttcgacaagcggcccgcgcgcccccacgtcaccggcggattcgaggtgttcgtcttccgctactgggaggactggtccgtgacggcctccttcgacctggcgcgccgctacaccaacgtgggcctgtccgtgggcttctggcgctga

SEQ ID NO: 2361 - DNA, 312 bp, Myxococcus xanthus
atggcttccaaacccacgctgctcgcacccgaggcgctccagtccttcctctcgcagcacaccgagtggaagcacgagggcgggatgattcgccgcaccttcgaggcccccaccttcctcgccggcatcgccttcgtggagcaggtggcgcaggcggcggagaaggcggaccaccacccggacatcgacatccgctggcgcaaggtcacgctggcgctcgtcacccacgacgccgggggcctcaccgcccgcgacaccgcgctggccaccgaggcggaccgtctcttcacggaggccacgcgcgctcggtga

SEQ ID NO: 2362 - DNA, 1242 bp, Myxococcus xanthus
atggtcggcgtgggccagccgcaggcgctcaccgtccacggcgtcttcagcaggtgtgactcctcgcaggaagaccgggcgcaatccgtctccgtggaggtgagggacccgcagaaccgcgtggtccccgccaccgcgcagctggcggtgcatgggaggtccgccatcgtgcggttcacgccggagcagacggggcgccaccacctcgtcgtcgccttctctccggtgggcagcatccgccagtcctccctctacgcggtggaggaccacagcgcccaggcgcccctggcggacttgtccaccgtgctggagtgccgtggcgtggaccggacgtcgtcgggaacgtggctgtgcggcagccaggcgctgcgcacgccggaccaggagccccagcccctgggcgactacttcgcccccgccgtcgtggccggcgacgtggtgtgggtgacggaggccgcccgggtgcgccgctatgtcgacctgggaaacgggcccctcgcgacctccgccgatgcgcccttccccgccacgggcgcgcccgccgatgcgccgccccatgcgcggctcgccaccgcgacggagttgctgctgctggatgaaacgcatctgcaccgctacgccttctcggaggaggagggactgcgcgccacgggctccccccccgttcctccctcgcggctggccacgttcagcgatgacatcccctcgctgctgatgcgcgcgggcgagcggcttctggtggtccgcatcgccgatgcgccagcgcccgccaccatggccatcgaggcctgcccctaccagctcgacgccgcgggcgcgccgcagcccgtccccggcgagccctgccatagcgtccccggactgcccgtgggccatgaggagggtgtgctgtgggtgcgcgccgcctccggcccgcagagcctggcgctgctccggtactcggcggcgagcggccgcctgcgcctggacggcgtcatggagatgacctcctccttccatttccagggcgccgagcgtctgcggacaacgggcttcggcgtccccgtggtgtcgccggccacgggttcctcgaggccctacgccgtgccccgctggagcgcggagacgggcaccgtcgtcctggagctgctgccgtctcctgacgggcgccggccacccttcgtcggtcggcgctacttccacctggagcactggaacattctgtacggcgtgaaagtgtacgcgcggccgtccaccccgtga

SEQ ID NO: 2363 - DNA, 1494 bp, Myxococcus xanthus
atgccgaaggcgaagtacgtcctggccctggaccagggcaccactggaacgcacgtctccatcctcgacacgaagctgcaggtggtcggccgctcctacaaggagttcacccagcacttccccaagccgtcctgggtggagcacgacctggatgaaatctgggccagcagtgaatggtgtatcgcccgggcgctgaagagcgcgggccttcgcggcaaggacatcgccgccatcggcatcaccaaccagcgcgagacgacgggcctgtggatgcgcggcagcggacagccgttgtcccacgccatcgtctggcaggaccgccgcaccgccgagcagtgccgccggctcaaggagcagggcgtggagccgcgcgtgcgcgaggtgacggggctggtggtggacccgtacttctccggcaccaagctcacgtggatgttcgaccacctgaagggcgcgcgcgcgaaggcggagaagggcgacgtgtgcttcggcaccatcgacacctggctcgtctacaagctcaccggcggcgcggcgcacgtcaccgacgtgtccaacgccagccgcacgttgctcatggatttgacgacgctccagtggagcgacgagatgcgcgccatgctgtccgtcccggccgcgtgcctgccgcagattcgcggctccgcggaggtgtacggcaccacgcgtggcatgcgcagcctgccggacggcatccccgtggcgggcatggcgggagaccagcaggccgcgctcttcggccaggcgtgcttcgagcccggcgaatccaagtgcacctatggcaccggcgccttcctgctgatgaacaccggctcggagccggtgcgctcgtcggcgggcctgctcactaccgtagcgtggcggctgggcgggacgggcaccaccacgtacgcgctggagggcagcagcttcatcgccggcgcggcggtgcagtggatgcgcgacgggctcaaggtcatcaagcgcgcgccggacatcgaagcgctggccgccagcgtgaaggactccggggacgtggtcttcgtgcccgcgctggccggcctgggcgcgccacactggcggcccgaggcgcgcggcctcttcgctggcatcgaccgctccaccaccgtggcccacatggcgcgcgcggtgctggagggcatcgcgctgcagattcatgacctggcggaggccatgcgccgcgacagcgggcgggacatccccgtgttcaaggcggacggcggcgcggcggccaacaacctcctcatgcagttccaggcggatgtgctgggcgtgccgctggtgcgcccgcgcaacctggagacgacgagcctgggcgcggcgttcctcggcggcctgggcgcgggcatctgggacagcccggaggccatccgccgcgcatggaaggcggagaagacgttcaagccgaagatgaagccggatgcccgcgagcgacacctggccaagtggaagcgggccgtggagcgcgcgtgagac

SEQ ID NO: 2364 - DNA, 699 bp, Myxococcus xanthus
atggagcacatccatcccgccatcgcgatgggggacggcaccagcgaggacagccggctcgccggagacgtctggggcgtggcggtgcggcccgacggcgacgtctggctggccacgcacatccggaccacgcggttcaagatcatgaccaacgccgtgggccacgtaggcaccggcgctccatggaacttcgagatggcgcgcaagcagagcgaggagaagaagcacgtcgccaaccgcatcgacctgtggccggatgccgtggccgaaccccagttccccacccatgcgcagcgcaaggacgacctggtgagcgacctggtgctgatgccggacggcaccgtctgggtgtccagcttcgcgtggggcctggcgaagatgagcgacgccggactggtgacgggctacctgctggagggcgacggcgaccgcaacatctcctcgctggagctggacccgcgcgacggcagcctctggattggccaccgctggggcaagggcctgaggcgcatgcacggcgagggggagttcgtcagccacaacccggcgctcggagggctgtccgccctgcccgtctgggacatccagatggtgggcagcggtgacgcgcgcaaggtgctggtggccttcagtgcccagcgggacgcggcgggcaccatcgtccgccctggggccatcggcatctacagcgggaagtag

SEQ ID NO: 2365 - DNA, 510 bp, Myxococcus xanthus
atgcacgtggacggaggtgagtacacgtcctggttccccgacggacgcatccagcgccggggattgaagggggagctcgtctacggcctcaacacgcgggacgacggccacctgcgggagctggtgctgcgggacgcgagcttcctggacatggagatattgagcgcgctgacgccgacggaggagttccagatgctcggcggcgcggtcgacacggcgatgctgcacacgctgcgggagcagacggacatcggcgccgtcccaagactccggctggtgcagacccgcgtgggcgcggagggcgtcgaaatcctggccgccttcaagaacctgcgggaggtctggttcgacggcaacccgggcctgggactccaggaggcccggaagctcgagcggctccggcccggctgcgtggcgcaccacgtggaccccgacgcgctcccgcccgtgcgcaggcctcgcgtcctgtcctccgcggccaacggacacacggcacgcccccgagggtga

SEQ ID NO: 2366 - DNA, 1239 bp, Myxococcus xanthus
atgagcaacggccggggactcgtcgtgggaacggtggtggtgttggtgggactggctgcggcggtggtggccatcacccgcgagcaaccactgcccgcgctgcgccagggcggcacgctgaccgtggccagcgccatgagcggcagcacggagggctacgcgcgcgcgaaggaacctcgggacttccacttccccgaggaccacggcccgcatccggagtaccgcacggagtggtggtactggacaggcaacctggagacggaggacgggcgcgccttcggctaccagttcaccctgttccgcaacgcgctggcccccgaggccgcgccgcgtgactccgcctggggcgccagccaggtctacatggggcacttcgcggtgacggacgtggccagcggcggattccacgcctcggagcgcttcagccgcgtggcgctgggactgtccggcgccacctcgcaacccttcaaggtgtggctggaggactgggaggcggccagcgcgggcccgtccacctggcccatgcggctgcgcgcgcggacggacgcggtgacactggagctgctcctggagccgggcaaaccaccggtgctccagggcgaccggggcctgagccagaagagcgcggagcgcggcaacgcgtcctactactactccatgacgcgcatgccctcgcgcggcacggtgcgggtggacgggcgcacgtacgcggtgaagggccatagctggatggaccgcgagtggagcaccagcgcgctcggcgcgacccaggtgggctgggattggttctcgctccagctctccgatggcagcgagctgatgtactaccagctccgtcaccgggacggctcgccggacgcgttcagcaccggcctgtgggtgccccccgaaggcacgggtgaagcggtgcacgtcggccgcgacgacatgaagctcacggtgctggacacctggaagagcccacacagtggcggtgagtacccgtcacgctggcgcatgcaggtggattcgctgggcctggacctcaccgtgacaccgcgcctggcggaccaggagctccccgtcagcgtgctgtactgggaaggcacggtagggctggaggggacgcgcgcgggccagcccctcacggggcgcgggtatgtggagctgacgggctacgcggacacgcaggggcctcgacgcagggagtcccaggcgcgaggcgcgccggatgcgcaaaccacgcagaacatccggtag

SEQ ID NO: 2367 - DNA, 978 bp, Myxococcus xanthus
atgcgcgccgaccgactcgtcagtttgacgctgctcctccagacacgcccaaagatgacggcgggcgatctggcaagggagctcgaggtctcctaacggaccattcaccgggacctcgacgcgctctccggagcgggcgtgcccgtgtacgccacccgaggctccgcgggcggcgtggcgtttatggaaggctggcgtacccaactcacgggcttcacccgggcggagctgcatgcactggcggccgtggcggcaccgggggccctggatgacctgggcctgacgtcggcgctgcgttcggggctggtgaagatggcggcctccctgcccgcactccagcaacccgcgctggagtacgcacgccagcggcttcacgtggatgcgtcctcgtggtttccagaacgcgaggccgtgcctcatctggcgacgctgcgcgacgcggtctggcaggaccgccgcgtgtccctgacgtaccgggacttcgaaggcaagccgagccgcaaggtggtggacccgtacgcgctcgtcatcaaggcggaccgttggtacctcgtcgcgagcacgggcgaggatgaaccgcgtgtgtatcgaggctcgcgtgtggacggtgcacggatacgcccggagaccttcatccggccggcgcgcttcgacctgcccgcattctggaaggcgtggtgctcacgcttcgcggagaagcgcgcgcagtacgaggtcacgctgcgcttgactccggaggcgctggaggcgctgcggaagattcggccgcgagcggagggtgcacggcttgattccgcgccgtgctcagcggatgggcgcaagacagtggttgtggacttcgagcgagaagcgattgccttcagtcagctctgcgacgtcggctcggaattcgaggtgctcgcgccggaagcactgcgaacgaagctcctgaaactggcgacgggcatcctcgacacgcatcgaagtgccactccttga

SEQ ID NO: 2368 - DNA, 1969 bp, Myxococcus xanthus
accgacgtgtccaccgcgcaggagctgctggggcacaccggccggctgacgcgcgtggacctgcggctgaccggcggcgacgcgcaggaacgagccgtggcggccacgctgccgcaaggcctggagttggtgcgcgccgccgcgcgggcgggcacggtggagcagatgacgcgggccttccgcaccaacctcaccgcgctgtcgctgctggcgctcgtggtggggatgttcctcatctacaacaccatgacgttctccgtggtgcagcggcgcgggctgctgggccgcctgcgcgcggtgggcatcacccggcgcgagctcttcgcgctggtgctgggcgaagcggccgtgctgggcgcggtggggaccgtggcgggcttgctcttgggcgtgttgctggcgcgagggctggtggagctcgtcacccagacgctcaatgatttgtatttcgtggtgagcgtgcggcggctggcgctggagcccttcaccctgttcaaggggctggcgctgggactgggcgccacgctgctggccgcgctggtgcctgcgtgggaggccgcgcgttcgccgccagtgacgacgatgcgcaggtccacgctggaggacgtatcgcgcggacgggcgccccggttggcgctgctgggcctcggggtgctggccgcgggcaccgtgctgctgcggtggcccacccaggcgctgcttcccgcgtatggcggcctcttctcggtgctgctgggcgcggcgctgctggtgccctgggccacacagacggtgtccgcgctggcggcacgaccgctgggcatggcctttggtctgctggggcgcatggccgcgcgaggtgtgcacaccagcctcagccgcacgtccgtggcgctggcggcgctaatggtggcggtggccaccacggtgggtgtgggcctcatggtgtccagcttccggggcacggtggtgtcgtggctggacacctcgctccaggcggacgtgttcatctcgccgccctcgctcgtggcgcggcgcggaggcgcgacgctgctccccggtctggcggagacgctgcgcgccacgccgggcgtcgcgggcagcagcacccttcgcgtggcgaacgtgcgcgtggacggcgtgcccacggacctgatggccgtcgacttctcgcgcacgccggtgcgcccctacaccttcaagcagggtgacgcgaagacggcgtggcgtgagttggagtcctcgcccgacacgattctcgtctcggagcccttcggcttccaccggggcgtggagctgggggactccgtgcgactggccacggacaagggcccccgcgacttccgcgtgggggggcgtgtactttgactacggctccgacgtgggcacgctgctgatgccacgcaccacctacgagcactggttcgacgaccggggcatcagcggcgtggcgctgtacgcggcgcccggccaggacgtggacgcgctggtggcctcggtgcgcgagcgcgccggagacacccaggcgctactggtgcgcgccaaccgctcgctgcggcaggcgtccctggacgtcttcgaccgcaccttcacgattacgcaggtgctgcggctgctcgccattggcgtggccttcgtgggcgtgctgagcgcactgatggcgctgcaactggagcgggcgcgcgagttcgccgtgctgcgcgccaccggcctgacgccggagcagctctggggactggtgtcactgcagacaggactgttgggactgctggcggggctgttctccgtgccattgggcgtggggctggcctacgtgctggtgcacgtcatcaaccagcggtccttcggctggacgcttcaactggccctgacaccccagacgctggtgcaggccgtggtgctggcgctggtggcggcggcgctggcgggcctctaccccgcctggaagatggcgcgcgcccatcccgcgctggcgctgcgggaggagtga

SEQ ID NO: 2369 - DNA, 711 bp, Myxococcus xanthus
atgttctgcctctttggcgcccaggccctggcgagctacgccacggtgctggacggcactgtgctcctcagcgctgacaacaccagccgctacctggtggcgggcggcgcgaggttcttcatcccctccacgcagtggagcctgtattccagcgccaacctggtggtgatgtcccagtcctccattgatgccatcacccagattccccgggacggcacgctggctcgcgagaaggggcagatcgccatctacgtcttcgtgggaggcatgccctggtggattcccaaccccacggagctggacttctgggatgactggaagaccatcaacgaaatcccgagctactgggaggcgcccttccaggactacagcatccagcaggtgctgttgcgcgagcgcacggggacccaaatctacatctggaccacggggctgaagattcccatcaccaacgcgtcggacctcgcctactacggtggtgagtccaacgtgaagacggttccgctgggcacactggccaaccacagcgacagcgagccgtactgcggagcgattctgcgcgagcgttcgagcagcacctcgtattacctcgggtattccgccggcctcatgaggaggtacgccaccacgtcagcccctcacgccgtggttccggatggcgcgctctcctccttcccggtgaccacaagcgggccgtactgcatccagtaa

SEQ ID NO: 2370 - DNA, 414 bp, Myxococcus xanthus
ggcggtttcgacagccgcatgcggacgagggtcgtgtccaacctcatcatgggcgcgtgcaccgtggccctcggcgtggtgccccacttgggggtgtacctggcggccatggggatcttcggcgtggcactgccgctctacaacacgcccgccacggtgatgctccaggagcgcgtggagccggcttacctgggccgagtcttcagcgtgatgaccatgctctccaccgcgctgatgccgctatccatgctgctcttcggccccctggcagaagcggtctccatcgagccgctcctgcagatcaccggcgtgttggtgatcttcctcgggctgctcgcgccgctccaccgccggctgatgtccttcggcgagcccaagcgtcccccagtcgagtcccaggacctggccagttga

SEQ ID NO: 2371 - DNA, 1311 bp, Myxococcus xanthus
atgcgtggaccgtcaaagcaaactcgtggctggagcgctttgctcctcgggggactactctctctggcgtgtggcggtgaagcggaggtgctcgaaggcaactccccttcgagagaggacgtcgaggccgggcttcatggtccggggagccaggggccctacccgaactgggcgacaccgaccttcgcgacggatgcccaggtggccgaggacggaaaccagttcttcgtggcctggtccgacggccgccccggccgcttctacgccgcgcgcgtctcgaagaatggccggctgctggacccggatgccatccccctcaaccccgggcttcgacccgacgcctactaccatgcgaccgcgttcgatggccggcagttcctcgtcgtctggaccggagacacctccatcttcctgacgcgtgtcaaccggaacgggacattggacggcccgccggtcacgctctttacccccaccgaccaccagcccgcgggctccccgggcatcgcctgccacgagcgcaagtgcctggtggcgtggattggcttcggcggaaccgccactggcgcggtccgcggcatcaccctgaacacggcgaagccgggcttcgacgtccaggaggtcttcatctccaaccaactgtccgccatcaactcctatggcgtcgcggtggcctggtcccatgaccggtacctggcgacatggacggactctcgcttcggcggccaggacatcttcgccgcgagaatccggcgcacgggcgcggtgctcgacccggacggcttcgtcatctccgctgcgccgggcaatcagaacttctcggcggtgacggcgacgaagcagggcttcttcgtcgcctggagcgacgcacgcaatggcacccccgacatctacggcgcccgagtgaaggacgggacggcgaacgtcctggaccccagcggcatccccatcgccacctcgagcacgaacgacatcacgcccaaggtcgcctccgagggccaccaggtgctcgtcacctggagcgcgctgacggccgacaccggccgcgtccgtggcgcccgcgtgaagctgaacggggacgtccgtgaccgccacggctttgccatctcccggggcgcggcggctcgccagctcgtgtccggcaacgtggcctatgccaacgacaagtacttcgtcgtctatgggcgtgcccccgtgctcgatgaaccgccctaccaggtcatcgtggggacccgcctgaagcaggatgatgtcttggacatcccagccatccgcatttcgcacgcgccttcggtcgaacagctcgcgccgtga

SEQ ID NO: 2372 - DNA, 855 bp, Myxococcus xanthus
gacgccttcgacccgctgcgcccccgcttgctccgcatcgcctaccggatgctgggcatcgtcgcggaggcagaggacgtggtgcaggaggcgtacttgcgctggcaccagaccgaccgcgccgccgtgcgcgacgccgaagccgtgcttgtccgcacggtgacacggttgtgtctggacgtcctgaagtccgcccgcgtacgccgcgaggaatacgtgggcacctggcttccggagcccatcgtcgatgcggtggagggtgatgacttgaccctgcccctgatgatggccctggagcggctgtcccctctggagcgagccgccttcctcctgcacgacgtgttcggcatggacttcgaggaggtggcgaaggccatgggtcgggcccctgccgcgtgccgccagctcgccagccgcgcacgggcccacgtgcgcgaggctcggccgcgatttcccgtgtcggaagcacaaggcagtgagctggcctcggccttctacgccgcgtcccggagcggggacatgggcgcgctccaggcgctcctggcccaggacgtcgtcgtgtactctgatggtggcggcaaggtgaaggcggccctcaaccccatctacggtcaggagaagacggtgcgcttcttcgagggcttgctgcgcatcacgggcgtgaacgcctcgcagcttgtgcacgagggattcatcgacggactgcccgccttcgtcaccctggagaaggacggcacgctccagacgacggccctggacatcgaagatggccgagtcgccacaatctacgtcactcgcaaccccgacaagctccagggtatccgcgggctcgtgggggacaagctgccgtcctga

SEQ ID NO: 2373 - DNA, 465 bp, Myxococcus xanthus
atgaagccccggatgaacgcgttcgccgtcgcccccgatgcgatgaagttgacgctcgattacggccagaagctgctggagctgggcctggagaagagcctccaggagctggtgaagatccgagcatcgcagctcaacggctgcgcgttctgcatccacatgcacagccgggacgcccgcgcgcatggggagaccgaggagcgcatctacctgctggacggttggcgcgagtcgcccctgtacaccgagcgcgaacgggcggccctggcctggacggaggccctgacgcacgtctcccagacgcacgcgtccgatgaggactacgctgccctcgcgccgcacttctcggagcaggaaatcgtgcatctcacactgctcatcgggatgatcaacacctggaaccgcatctccgtggggttccgctccattcaccccgtcaccactccccgcaccgaggccgcctga

SEQ ID NO: 2374 - DNA, 999 bp, Myxococcus xanthus
atgcgctacgacttcgcgggcagcaccgccggtttcctgagcagcacctgggcgggcgtggacctctcccgccactgctgcacgtacttcctgtggggcgtgccccgggtggagctggtggcggcgctggccgcgacgttccagcgcgtctacatggtcatcgacatcggttgcttctccgaacagcagcggctggagcagatgggccggggcctgctcaagccctgcgcgaaggaccgcgagctgctggaagtcatcgacgcctgccgcaagtaccccaacctggacatcgaaatctccggcatcggaggcctgcccttcgcgagcaaggccaccctggcggaggaattgcggctcgtggagcgcatcatcagcctggactgcgtggtgggctaccagcggctcgaagcgcagcccggggcgctggtgacgcagcaccccgcgcgcttcgacatggtgacagaggcgaagacgttcgcggagttcctcgactacttcgagcgccgcgagcccggtgacgtgtccgtgccgatgattcgattccgcgacgcgggcctggaggcggcggtccagcacacctccgaccgggtggacgcgctggcctggaagcaccgccacacgcgcaagagcgtcgccatccagggcaggacgcggctgcgcaacaccgctccctggacccagcgcttcaccctgggagagtggctgggcagccaccgcgcccccgcgaagctcgcgggtgaggcggtgacggtcctccgctccgtggatggcatcacgatgagctgcgccccttcagtcagcccgaaacggttctccgaccccacgctcacgcagggcgaggacggcgccatcctcctggccgccctggccgccttcgagcaccccacgacggtctccagcgccgtgtcgaagctcggcgcgaaggcacggctcgacccgcattccgcgcgagaggtcatcgaccacctggtggacggacgcttcctccagccggcgtga

SEQ ID NO: 2375 - DNA, 1339 bp, Myxococcus xanthus
atgcgcgccacggtgctgacgtcccccgccctggatgcgtgggcggaccgcttcgtctggctcgcggtggacacggacgccgacaccagcatggccttcctccagcgatacccggtggacacgtggcccaccttcttcgtcctggagccggaacacggcgccgtcctcgcgcgctcgttgggcgcggtgtccctcccccaattcctgggcttgctcgagcaatccgagcggaccttccagcaaggccgcctgggcacggaggcgctggtccgggcggatgcgctcgccctctccggtcagcacggcgaagccgcggtggcctatcagcgggccctggagcagttggcccccgaggacgcgcgccgcgcgggcgccctcgtgtcctggagcaagtcgctggccgccacgggcgcctccgcggactgcatgcgggtggccgcgagcgagctgccgaagctctcgcgcgtggacgatcgcacgcggctgctgtacgtgggcatgggctgcgcgctggacactaacaccgatgaggcgcgagcggtgcgaggccagttcgccgacgaggcaaaccgggccctgggtgctcccgagaccgagctgactccgctgcaacgctcgtcgctctacgagctggcttgcgaggcccgtgaggcgtccggggacgaagcggggctgcgcgaccaggcgcgaacctggtgggcgttcctccagctccaggccactcacgcgaatggggccgaggagcgcgcggcgctcgattcgcatcgggtgatggccaccgcgctgttggaccagccggacgccgccattcccctcttggagcgcagcgagcgggagctgcccggggactacaacccgccagcccggctcgcgacgctgtacctgatggccgggaggaaggatgaagcgctgacggcgagcaagcgggccctggccctggccaagggagtctcccgaggcaccgtgctcgcgggccatgcgcgcatcctcatggcacatggcgagcgggcacacgcggagcgactgctgaccgaggccttgagcgagatggaccggacgccaggcattccccaggaccatctccagcgaaaagtgctcgagcgaaccctcgcgaggcttcgcgcgagcaacggtgcgtcgccgaagtgaatggcgaacggaaggccgccatgactcggcgcggagggctccgccttttcgggctggggacgggcagccaggcggacgggccccaccatttcgcccgagcctggcctgtttcgcctacgctgcccgccgtctcctgaaaggccggtgtccgtcgcatgggtggtcgtgtcctctctccagtcctcctcgt

SEQ ID NO: 2376 - DNA, 1092 bp, Myxococcus xanthus
ccggccttccccggacagacacgcgtcccagccatccagacgcagacgcccatcgaggtcaccgagattgcctcgggcttcaggaatccctgggccatcgccttcctgcccgaccagcgcatgctggtgacagagaagcccaccggctcgctctacatcgtcacgccgcagggcgcgaagtctcccgccgtcgtggggctgcccaacgtggatggccgtggacaggggggcctgctcgacgtggaggtcggccccgactacgcgcagagccagctcatctactggacctattccgagccacgccagggcggcaacgggctcgcggtggcgcgtgcgaaactcgtggacggtgcgcagcctcgcgtggaggacgtccaggtcatcttccgcatgatgcccacgctcgagtcgacgctgcactcggggggacggctggtattcacccccgacggcaagctgttcgtcacgctcggggagcgctccatcctcgcgggccgggtgcaggcgcaggaactgaacagccacttcggcaaggtggtccgcatcaatcccgacggctccgtgccccaggacaacccctacgtgaacaccgagggggcgaagccggaaatctggtcggtgggccaccgcaacgtcctgtcggcggcgctcgacagccagaaccggctgtggacggtcgaaatgggaccgcgcgggggtgacgagctcaaccgccccgaggccggcaaggattacggctggcccaccattgggtatggcgaggagtactccggcgcgcccatccacgagagccctcgtggcccaggcatggagcagcccgtgtactactgggacccggtcatttctccctcggggatgaccatctactcggggaccctgttccccgagtggcggaacaacatcttcatcggaggcctgtccagccaggcgctggtgcggctcatgatgcggaatgaccgcgtggtgggcgaggagcatctcctcaaggacctgggcgtgcgcatccgcgaggtggtgcagggccccgacggagccctctacctgctcaccgacgccaccaacggaaagctgctcaaggtcacgccgcgctga

SEQ ID NO: 2377 - DNA, 690 bp, Myxococcus xanthus
cgagctctgcaaggccctatgcttccccccgcgatgaacaccaaggcaggcggtggactcttctgtgagctgtactggggcaacaatctgtccgaggcgtggagctatgggccggagcattcgaacgtccacgccgccccggacgagacggcaccgctaccgctctacggcttcaccctgcccgaagagccgttcctgctcgccgagcgcaccgctcagggctggcgcatccatctgccgcccgctgcccgtgccgagcgcgccgtcaaaggcaacgcctatgccgccgtgccgcagacggacctgcgccagcacgacggacgcacgacagtggagctcgcagagggcatgacgcttcgcctctcggaaggccagctctcgctgcgcatccaaggctccgtcgtcaaggaacaggtcaaccggctccagtggaaggacttcggctggctcatcatcgtgagcatcctcttcctcagcctccccgtgggcttcctcatcgcgggccccacgccccagcgcatcgaggaatccaaggtccgcgccatgaagatagccgccgacaaggaagccgcgcgccgcaaggccatgggcctggacacgccactgcgtccgctcacggatgaagagctcggcatgcagcccgacggcggtgacgacgtcacggtccccgccttcctgcgcgtccgctga

SEQ ID NO: 2378 - DNA, 132 bp, Myxococcus xanthus
atgctcttccccgtctacatcgcgacgctgctctggctggggctctggctgcgcgatgcgcggctccgcgccgtcctgccgggccgggccacgtcgccaaagtcttcaggccgccctggcgtggaaccgtag

SEQ ID NO: 2379 - DNA, 495 bp, Myxococcus xanthus
atggccatctggaccacgttcgctggctacacgctgggcgagaacacgctctcccgtgaggtctgggtcacacccgcgcctcagctccagacgttctgcaagacggttcccgaagagaagctcgtgggtcgcctcaaccagtacctgggattgcccccgcccacggagaacgacaacgctcgctacgtcgtcgagctatgggtccggcccgagaacctgttccggccctgcccggacgcggagattgacgacgcctcgtgcggtcttcagttccctgcctccgccacctccgagcacaggaattggatcaacgcctactacgcctacagctatgggttctggcagagcacgcactacccctggaccgggttgggctacacgtatgattggtgcaacgccgacacgcgtgtgggtgccagtgagtacgtggttcgcgctgactccatcgtcgaagtgacgggcaagttcgaacgcgccatctactgcgcgccgtag

SEQ ID NO: 2380 - DNA, 474 bp, Myxococcus xanthus
atgcggcaggcctatgacggggttcgcccctacctgggcttcctcctcacggtggcgcgctcgacagccatcgacctgatgcgcgcgtcggggcgcgtgtcccgcgaggccgtccccatggacgacgcgcccgagctgccccacttgcccaccgagggccggacgccggaagaagaggccctcagcaccgaagtgcgcgacctggtccgcgccttcctcgacacactcacggacgaaggccgcgccctggcgcaactgcgtttcgtggaaggactttcgcaggaatccgccgcccagcagctccagctcacccgaggcgaagtccgggtgcgcgagcggcggatgcggacgcagttcaccgagcatttgaaggactcgggctggctggacgcatcggccgagcccgggcggatggagctgggagtcctcctggcctcgctcgccctgtgcgcaatagggagcatgccctcatga

SEQ ID NO: 2381 - DNA, 1032 bp, Myxococcus xanthus
atgggcgccgcggacatcaacggcgacggcaaggtggagtacagcgagctgggcgccttcgtcaccgcgtcgctccagggcgtgaagggcctccccgcgcgcctgtcgctccacgccttcgcccccacccgcgagccacggcgtccgctggtaggccccgcaccgaagggtcccagccttccgctgcccgcagggctcgagcactcgcgcatctccgtcgaggattcagacggacggcggttggccgacgtgcgccgttcgaaagaacagtacgtgctgctgcgcctgcccgaacgcgacgtgtattggattcgcacgcccacgcaggaagcccgcatcaccctggccaagctgtccaccaacggcatcatcgacatgggcgaccgggagctccaggagcgaggccccgccgaggaggccctgcgcaagggcttgttcgcggtgccgctcgacaaggatttctacgagcgctacgtggcggtcaccgggctcgcgcccgtgggcgtatcccaggcgtttcctccgagcgcgggcggcaccttcccgcggttcatggcgcagcggcccgacacaatggggggttgggacctgggttggacggggcagcaggcaccgctcggattgagcacgctggccaccggccccacggtgacgtggcggcgcgaggcgcccctgccgtcgctctactacggcgcgcgcgcctcctatggcctgacgcccctggccaccgacgacatccgcacccaccggggtgcgctcctgggcctcctgggcgcacaggcaccggcacacctgcgcgtgccgctgttcctggaggcgggagcgggctggggctttctgggaatcactcgcggacaggtgcgcatgggcgaccccaccgtgctctccacatacaccgccgcgggggtgacgggagcgctggcgggtgtgcggctgcgtctggcggccacgctcacttatgaccgcgtcaccctggaccagcgcaattactgggaccgcgcgttcggcttcgagctggcgctgcgacgctga

SEQ ID NO: 2382 - DNA, 1848 bp, Myxococcus xanthus
atggtgatgctcgtgctcgtcacggggtgtgacggcatcgacttggaccggctcgtccggcagcacccgccgctcacccggctggagcccgagcccgcgggtgccaactgcgcccagggtggtcatttcgtccgcacgggcctggacctgaacgacaacggcgtgctcgacgacggcgaagtgaccgtcacccagtacgcgtgtgtcaccgccatccccggcgtgctgatgcgcgtgcaggacgagccccccggtgagaactgcaccgagggcggcagggtgtaccgcgcgggccaggactcgaatcgcaatgacgagttggaggacagcgaggtcactcgcgaggtctacggctgcgccagctcggaggccgtggtcacccgcgtgcgggcccgggagccgttcgtcttcccctgcggtaagcatggcgccgtggtcgaggccgggcaggaccaggacggcaacggcgtgctcgacgactcggaggtccgggcgacgtccaacctctgcgtactcccctccgaggtccgggtgcgccagtcaccggctccggctggcgccgcgtgccccacgcccagcacccaggtggacgtgggcaccgacgcggacgcggacggcctgttcgaggacgaagaggtgatgtcatccatgttcgtgtgccagcccctgcacacgctggatggcacttaccgcgtgcgcaacgcggtggacctcgtggcgctggagggcatctcccgcgtccgcggcagcctctacttcgactccgggtccgtcacggaggcccgcctccccgacttgatgatggtcgaaggcgcgctggagatcatcgacacgtcgctcgaacgcgtggagatgccctcgctgcgcctcgtggccggcccgctcaccgtagccagaaaccccgtgttgaccacgctgaccctgggcagcggcagccgcgctccactccgggtctggggagacttcagcctggtgtccaatcccttgctccccacgctcgcgggggtgagcgcggtccttcctggcagcaacatcgtcctgagagacaacgatgccctcgaaggaggctacttcacattcgtctccgcgctcctcggcagcatcaccctggaaggcaacgcgaagctctccacccttcccttccggcacctcgaatggctgggcggctccctgaacatcatcgggaactccgccctgagcaccctgagtggaactgtgctgcatacggtcgtgggagacctggtgatcgaaaacaacgaggtcctctccgggttgtggggcatgccagcgctgacgtccattggcggtggcctccgcgtgcgggacaacgccaatctgcgctcggtggaaggcatgaatgaactcacccaggtggggacgctcgaattcgatcgcaaccccgcgctggaagccgcgggggagttccccaagctggcgcgcgtcacctccggcatgcggttcaatgccaacgccgtgttgaaggacctgtgggggctccagaaggtgcagaacagcggcttcctgttcatcggcaacaacccacagctctcccggctgatgggcttcgaccggctgctctcactgaaggtgctgaccttggagaacaacgcgagcctcatcgacctgtcggacctcgccctcctccattcgctggaagagctgcatgtgatctcccatgagaacctgctgcgcctggacctgaacgccctggagaacgtcaccctcatcttcaccgtcacggagaacccccggctccccacctgcctggccgtgtcgctcgccgcacgggtcaacacgggcggcgcgccggagattcgcggcaacgacagctcatccccctgcgattga

SEQ ID NO: 2383 - DNA, 1098 bp, Myxococcus xanthus
atggagagtgtctgcgtggagccgacccggctcatggtcgtctacgtgcccgagttcgccggagcgacctgcccccagggtggcacgggcatccggctaggcgtggattcgaatgacgatggcgtgctcttggggcccgaggtctacaagaccgccttcgtctgcgaggccctgcacacgctccacggcgactacaccgtgcagacccccgcggacctcgccgcgctccagcgcatctcccgcatccaggggtcgctcctgatcaacgacgcgtccatcaccgagctgagcctgccggggctcgcggtggtggaccgcaccctgcgcctctggaacaaccaactcctgacctgggtggacctgcccgtcctgcgcttcgtgggcgacgacctcgatgtgacagccaaccccgcgctggacaggctgcaagcgggtggcgcggaccatcaacggctcttcgtgggccagggcgtcgtcgtgagcaacaacgaccggctgcgcagcctgagcgggctcgtgagcgtgtcgcctcgggagagcctgctggtggtgggcaatgatgccctggcgttccaccccaaagaggattccgtgctcgtcaacgtcgacaacctcatgggctcgctcaccatcgccgacaacaacgcgttgcaagcgcttcccttctcgaacctcttccatgtcggcggcaacgtccgcatctcggggaacccggcgctgcgctccctagaaggactctccccgcggagcatcggcggcgcactcgtcatcagcgaaaacgaggccctgcagacgctctccagcctcgagccggtccgtcacttgtccgagctgcgcgtgatgggaaactccgccttgacgaccctggagggcctgagcggcctgagtacactcgcttcgcttcgcgtgtcggacaacacgagcctcatccggctcggcctgagtagcctgtaccaggtcggccaggccttcgacgtcacgaataatctcgaactccccacatgcctcgcgacgtcgctcgcgaccgccgtgtacacgggcgacgccgggcaactccacatcagcggcaatgacgacaccgccacctgcggcgagtga

SEQ ID NO: 2384 - DNA, 794 bp, Myxococcus xanthus
atgttggcgctggtcctggccaccgggtgtgacggcatcgacctgcgccggctcgtcggtcagcacgaggcgcgcacccgcgtggccgacgagccctccggcccgaactgcgagcacggcgggaaggccgtgtgctcggggctggaccgggatgatgacggcgtgctcgatgacgacgaggtgacgggcaccgagtacatctgcaccacgctctcgccaggcgtgctggtgcgcacgcggcagctccctcccggcgagccctgtgcgctgggcgggcagctcaccctggcgggggcggacctggatggcaacggcctcctttcggatgatgaggtgacgcgcgaggtccacggctgcatggagccggcgcctgtcctcgcccgcgtgcgcccgctgctggcccagcccttcgtctgccggtacgacaacgcgctcctggaggccggcgtggacctcaatgggaacggcgtgctcgatgacaacgagctccgggcggccgcccgcttctgcgcggaccccgcggtgacgctgctgcgccagcggccagagcccgcgggcccgaactgcaccacgggaggtacccaggtggaggcaggcgtggacaccaacctggacaaggtgctcgacgagaccgagattctctcgtccgcattcgtgtgccagttgtcggcgacccatgacgggacgtatgcggtggagaacgcggccgacctggaggcgttgaagtccctctccatcattcgcggtggactcgccatcgagcacacggatgtcaccgacggtggtgctgcccg

SEQ ID NO: 2385 - DNA, 1272 bp, Myxococcus xanthus
atgcgagccgtgctgattcgcatcagcgaggctgtgtccgtgctgcacctcacgctgcaccacatcgcctcggacggatggtctgggggcgtgctcttccgcgagctggtggcgggctacgaagcgctcgcggcgggccggccgtcgccgctgccggaactcccgattcagtacgcggactacgctgtgtggcagcgcggctggctggaggggccgggcatggaagctcagctcgcgtactggaagaagcagctcgcgggcgcgcaggtgttggagctgccaacggaccgtccgcgtcccgcgcgctggacgggccggggtggccgtctccaggtctccgtggacaagcccgtgatggacgcggtgtgggccgtgggccgtcgcgagggagccacgcccttcatggtgctgacggcggcgtttcagacgctgctgcaccggtactccgggcaggacgacgtcatcgtcggcacatccgccgcgggccgcaaccgtccggagctggaagggctcatcggctgcttcctgaacacgctcgccatcagaggtgacctgtcgggagcccccaccttcgtggagctgctgcgccgggtgaaggtggcgtcgattggcgcgtatgcccaccaggagattccgttcgagcggctggtggacgagctgcgcgtgccgagagatccgagccgcatgccgctggtgcaggcgatgctcacgttccacaacacgccgccggtcgaggtccgaacgccagggctgggcgtgaagatggtggagctggacatcggtgccaccaaggtggacctgtcactggagttgcgtgagacgccgcagggcctcacgggcgcattggagtacccggcggatctgttcgacctgtccacggtggagttgctgtgggagcgcttcgtccggctgctccagggcatcgccgcgaatccgtcgcagcgggtgtcggagttgccgctgctgtccgacgcggagcgccagcggatgctggtggagtggaacgacacccgcgagcccttcgcaggggacgcgacgctgcatggcttgtttgaggcgcaggccgctcggacgccggacgcggtggcggtggtggccgagggccagcaactcacgtacgcagcgctggaggaacaggccaatcagctcgcgcaccacctgcgcacgctgggcgtaggtcccgaggtccgcgtggggctgtgcccggagcgctccgtggaactggtggtggggctcctgggcgtgctgaaggccggcggcgcgttcgtcccc

SEQ ID NO: 2386 - DNA, 6975 bp, Myxococcus xanthus
atgcagggcgaggactcgagcagcgacatcgcggtcatcggcatggcggggcgcttcccgggcgctcgcaacctgggtgacttctggaacaacgtccgaggctgcgtggagtccatctcgttcttctccgaggacgaactggagcgctcaccgctcatccccgaggacctgtggcggcacccgcacttcattcgcgcggggggcatcctcgaaggtgcggacggcttcgaccacggcttcttcgacatcccgctgcgcgaggcgcagtggatggacccgcagcagcgcgtgttcctccagtgcgcctggacagcgctcgaggacgcggcgtatgacccgtctcgttacaaggggcgcatctcgctctacgcgggcgccggttcgtccggccacctgctgaacctgctgagcgaggcacggaaggacgcgggcgcgggcctggagttggccaccgcgggcccggagagcctggcgatgaaggcgtccttcaagctccagctccggggcgagagcgtcgccgtctacaccgcgtgctccaccggcctggtcgccatccacatggcctgccagagcctcctgacgcggcagtcggacatcgcgctcgcgggcgcggtgcgcatcgccagtccgcagcgcacgggctacctgcaccaggatgggctcatcttctcgccggacggccactgccgcgccttcgaccaccgcgcgggtggcaccgtggcgggcaacggcgcgggcgtggtggtgctcaagctgctgtcggatgcgctgcgggacggtgaccacgtccacgcggtcatcaagggctcggccgtcaacaacgacggtcaacagaaggtcggttacacagcgccgagcatcgagggccagacggaggtcgtcgcggacgcgctggcctattcgggcctgggcggtgacgacatcagctacgtggaggcccacggcacgggcacgtcgctgggcgaccccattgaaatcgccgcgctgacgcgggcgttccggaagacgacggagcgctctggctactgcgccatcggctcgctcaagacgaacctggggcacctggatgcggcggccggcgtggcggggttcatcaaggtggtcctgtcgcttcagcacggcgagctgccggcgagcctccacttcgagcgcgccaacccggagattgacttcgagcgcagcccgttcttcgtcaacaccgcgctcaaggcgtggccgcgggagaatgggccgcgccgtgcgggtgtgagctccttcggcatcggtggaaccaacgcccacgtcgtgctggaagagtcgcccccggaggcggagaaggcgcgcggccaccggccattgcacgtggtgacgttgtccgctcggacgccttccgccctggaggtgatggcgcgcgagctggcgacgcacgtggagtccgcgccgggactggcgctggaggacgtggcctttacccggaacgtgggccgtcgttcgttcgagcatcgccgtgcggtggtggcggcggatggggctgaactggcggagcggctgcgcaagcccgcggcggtggaggcggggcggaatcgccgcgtggccttcctgtttccgggccagggtgcgcaggcggtgggcatgggccgcgagctgcacgcggtggagccgggtttccggaaggacgtggacgcggcgctggcacggctggagctctcgcttgccgccgaggtgcgcgcgctcctgttacccgcgcaggggcaggaggccgtcgcggcccagaagctggcggaccctcgcgtcgcgctgcccgcgctcttcgtcgtcgagcacgcactggcccgactctggatgtcctggggcgtccggccgcatgcggtgctgggccacagctttggtgagtacgccgcagcctgcgtggcgggggtgctgtcgccggaggacggcctgcggctcgcggtggtgcgtggcgcgctcatggcgcggatgcccgtcggcgcgatgctcgcggtggggttggaggaggcggaggtccttccgttgctcggcgagggtctctcactggcggccgtcaacggcgagggccggtgtgtcgtctcgggcccggtgcaagccattgaagcgttgcaggccacgctgtcgagccgcggcgtgggcatggtgcggttgccgtcggcccatgccttccattccagcgccgtggagccgctgatggtggacctggcgcgggcggtgtcctcgctgcgcctccaggcgccgacgctaccgtatgtgtccagcctcacgggcacgtggattcgcccggaagaggccaccgaccctacgtactgggctcggcagatgcgacagccggtgcgcttcgccgcgggcctggagacgcttttcggggaggggtgcagtgtcctgctggaggtgggaccagggacggacctgacgtcgctggcgcggggacgggcgcgcaaggagcggcagttggtcgtggcgccttcgctgcgccgccgtcccacggagagcgatgcccgtgggctgttgcaatccctgggagacctctgggcggccggggtggacgtcgcctggcagaagttccatggcgcggagcctcgccgccgcgtgtcgttgcccacgtatccattcgaggagaagtcctgccgtctggagtcgtcaggcgcgccgctcgtattgcccgcggcctccgggccggtggcaggggccgcgctggctggcaccagctccgtgcttcccctcgccacccctggcgcatcggatcccgtcaccgtgggggagatccagcagcgcgtcatggatatctggcgcgagcgtctgggcgcagtggaggtcggcccggatgacgacttcctggagctgggcggcaactcactgatggcggcgcagatgctgacccgtctgcgtgagacgttctccgtacagctcccgctgagcgcgctgttcgaggcccccaccgtggcgggcatctccgcgcgcatcgaggcgatgctccaggcggcgggtcccctggagggcagggcggcatccgaggtgatgttccgcatcgaccgcgcgggtgagctgccgctgtccgtggtgcaggaacgcgtctggcggatggagcagctcgacccggggaacccgtccctcaacatgcccctggcggtccgcatctcaggcgcgctggatgtcccggtcctggagcggagcgtcaacgaggtcatccgccggcatgagatgctccgcgcgacgtaccgcgtggaggacgggcgtgtgcgccagcggttctccgccgaggtccgcatccaggtgcccgtggtggacctgcgttcccatggcggtgaccggaaggcggaggcgctgcggctggcattggacgaggcggtgcggccgttctccctggagcacgggcccatcgtccgcgccagtctgctgcgactggccgagaccgagcacctgatgctgctcacggtgcaccacatcgcctcggacacgctgtccatggtggctttctttcgtgaggccgcggcgaactatcaggcgttcctcgcggggcagcccgctccgctgccggagctggctgtgcagtacgtagacgcggcggcctgggagcgccgctcgctcgcgggtggaacactggcggcccaggaggcgtactggcgcgaggtgctggcggacctgcctccgtcgttggagctggcggcggaccggccgcgaggggccgagctgcggctgcgtggtgcccgcttcccggtggccttctcgcgcgagctcagcgcggcgttgatgggtttcagccagcgcgagggggtgacgcccttcatgacgctgctggcggccctggcgtcggtgctcgcccggtactcggggcgcgaggacatcgtggtggggacgccggtgggcaaccgtgcccgcggcgagctggagcccctcatcggcttcgtggcccatgcgatggcgctgcgcaccgacctgtcgggtgacccgtcgttccgagagctggtggcgcgcgctcgtgagacgacggttggcgcgtccagtcaccaggacgtccccttcgagcacctgctgccgttggtggcctccggcagggacccggcacgctcgcggctgtgtgacgcggcgctggtgctgcacgcgcacgtcaccacggcgccgccctccgtggcgggcctggacatgcagttggtggaggtgccgggaacgcccgcgcagttcggcgccacgctcggtgagctgacgttgctgctgaacgagagcgagagcggcggcttccacggtttcatcgagtacgccaccgacctctacgacgagccgcgcatcgcgcgcctgtcggcccacctccagacgttgctgggggcggccctcgcgaaccccgaccttcgcgtgtcacggatgccgctggcggcaccggaggaacggagcgctgccgcgcgggggcctgcgtcctcggtgcagagcctccaggccgagggcctcgcgatttccagcatgccgcccgccggtgggtcatcgagcatcgggcatcgggacctcgcggatgcggctgtgctggctcgattcgcgtcgtgggtgaagcggacaccggacgcagtggccatcagcatgggtgagcgccgcctgtcatggcgggagctttcggaaagggcccgaggtctcgcggcccggttgaagcaggagggcgtgggccgggacgtgccggtggcggtgcgcatcactccatccgtggagtcggtcatcgcactgtggggcgtgctggaggcgggaggcgcgtgcctccccgtgtcggccggtgaggtcgcggagctggcgtccctgctgcccgcgcaaggacctcggttgttgctggtgcctcgcacggaggacgtgccggcgttgccaaagggaatccgcgccgtcgcggtggactctgtcgattcgagcgcggattcgatggagcccgtgcccggggagcggctggccttcatcgttcctgcgcccgacgcgctgggagggtacggccgggtcatgctgagccaccggaacgtggcgcacgtgttggcctcactggatgcccggacgggcgcgggtgggggagacgtgtggttggcggtgggggggccttcggctgacccgtcgggactggacctgctgtgggcactcgcgcgtgggatgcgtgtcgtccttccgcccgagcagctcgccgcgtgcttcgctgtcctgggccgcaagccggacacccggcggcctctcgacttcagtctttcgtacttcgccaacgatgaggattcgctgggcgaggagaagtacgagctgctcctcgaaggcgcgaagttcgcggacgcacatggtttctccgcggtctggacgccggagcggcgcttccactccttcggtggtttgtatccacagccttcggtggtcggcggcgcgctggcgatgctcacgcggcacgtgcagattcgcgcgggcagcgtggtgttgccgctccatgaccccatcgaagtcgccgagcagtggtccgtggtggacaacctgtcccgtgggcgcgtggggctgtcattcgccacggggtggcacgcgaacgacttctcgctctcaccggggaccttcgaccggcggcgcgaggtgctcattgaacgcctggaggaagtgcggcggctgtggcgcggcggcacggtgctgcggcgcaacggcgcgggcaatgaagtggagctggcgctgcgccccaagccgaagcaggcggagctgccggtctggctgacgtccacgggcaacccggagacgttccggaaggccggtgaggtgggggcgggcatcctcaccaacgtgctcggtctgggctccaacctggacgagctggcgacgaaggtggcgctgtaccgcgagacgtaccgcaaggcgggacatggcccaggccaggggcacgtcacgttgatgctccacaccttcctcggccaggacctggacgaggtgcgcgaggccgtgcgcgagccgctgctgcgatacttccgcagctcggtggacgtgttcgccaacctggtggccagccagggccttcaggtggacgtgcgcggcctcacgccagaggacgtggaggtgatgctcgcccagggggtggagcactacatcaaggaaggtggcctcttcggctcggtggaggactgcgtgcgcgtggtggagcgcgtgcgcgccctcgacgtggacgagattgcctgcctcgtcgacttcggcgtggcgctggagccgatgatgtccagcctccgtctgctggacgtggtgcggcagcgcagccaggtgcaggccctgcccgcggatgcggtgctggccgaaggcgatgctggattcggcgcactgctgtcgctggtgcaagacgagggcgtcaccacgctgcgctgcgcgccgtcgcaggcgcgtgccctggcggagcttcctggcgccgaggcggcgctggggagcgttcgtctctgggtgctcgggggcgaatcgcaggacctcaccagttcggcgcagcacgtggcgatagcgtcctccttggtgggcgcggcgtggccgtctcccacttcggcgcccgtgtacgtgcgggatgcgtccggcgagccggtgccggttggcgtggtgggagagctggccctggccggcgcggcggttccgctgggcttctggaatgacccggaggccacgcgggcgcgcttcatctccgtccccggttcggatgagcgcttcttggtgacgggccagcgagcccgtttccgcgttgccggcgaagtggagtgcgttgcccccgcgcgtgcgacaaaggcgcggcgtcctacctcgcagccagcccgtggcaccgtgggcaccaggccccccacgcggcagacggtgagcgcggaggtttcctcggcgactgccacgcccgtggtgcgggtggggcgggacaagccgctgccgctgtccttcccacagcagcgcatctggtacctccaccagttggacccggcgggcatcgcgtacaacaacaccgtcaccctgcgtgtcgatggtccggtggcctaa

SEQ ID NO: 2387 - DNA, 8829 bp, Myxococcus xanthus
tgctctaaaggcgggcaccgggagcccgcgtatctgacggacaccatcgctcgcgagcgcatcaccacgttgcacttcgtgccgtccatgctccggcccttcctggaggagacggagctggcagtgtcctgcgccagcctgagaagggtgttctgcagtggcgaggcgctgcctcccgagctgagggatcgctacttctcgtgcctgctcgccgagcttcacaacctctacggcccgacggaggccgcggtggacgtgacggcgtgggcctgcgcacgtgaggaccgtgggcatgtcgtgcccatcgggcgccccatcgccaacgcgcggatgtacgtgctggatgcgcggctgcgtcccgtgccagcgggtgtgccgggtgagctgtacatcgggggtgcaccgctggcgcgcggctactggcagcggccggacctgaccgctgagcgattccttccggacgccttcgcggcgcagccgggggcgcggatgtaccggacgggcgatcaggcccgcttcctggcgaatggcgccatcgagtacctgggccgcctggatgaccaggtgaagctgcggggcttccgcatcgaattgggagagattgaagccgtgctgtccctgcaccccggcgtgcgtgcggcggcggtggcgattcgagaggacgtcccgggagaccggcgcctcgtggcgtacgtggtcgcgccttcgggggacgtggcatcggagcttcgggccttcctcggtgagcgactgcccgagcacatggtgccgtcggccttcgtcacgctggacgcgctcccgctgtcgcccagtgggaagctcgaccgtcgtggcctccccgcaccggtgcgggcagtgcaggggcgtggtgcggcccacgtcgagccgcgtaacgcgctggaacttgagatcgcgcagatctgggcgggcgttctgggcgtcgagcgggtaggcgccgaggaccgcttcttcgagctgggcggtgactccatcctcgcgcttcaggtgattgcgcgggcgcggcaggtgggcatccacctcaccgcgcgccagctcttccagcatccgacggtggcagggctggcacaggtggcgacgagccgtcgtcgcttgggagaccagggcccggttgtagggcccgtgccgctgacgcccatccagcgctggttcgtcgagcgcgagcttcccgaagcgcatcacttcaaccaggcgttgatgctggagccccgtgagcgcctggagtcggacgtgctggcctgcgcactgcgggccctcgtggaccatcacgatgcgctgcggctgcggctgtcgcggagtgatacggggtgggcgcagtcgtgcgcagagccagggcgcgacgtgccactgcgtctcgtggacctatccgggttggatgccgccgcgcgggccgtggcgatggagcgcaccgccacggaggagcaggcgggtttggacctgaatgcggggtgcctcctgcgcgccgtgttgttcgacccgggaccaaatcggaggggacggctgctgctggtcatccaccacctcgcggcggacggcgtctcctggcgcgtgttgttggaggacctggagacggcgcttcggcagcttgcccgcggagagccggtggcgcttcccgcgaagacgacgtcgttccaggcctgggcacgacggttggaggtgcatgccgcctcgggggtgctcgcggaggagggggcctactggcgggacgtgctgagcgcggatgtggccgcgcttcctcgggatgtgccgggtggggtgaactcgcagggctcggagcgcgtcgtcacagtggcactggatgccgacgtgacgcactcgctgcttcgtgcatcggcgacgatgtcacagccgggccttgaagacgtgctcctcacgggtgttgcgagcgcgctggcccgatggagtggcgagcgccgactgcgcatcgacctggagggccacgggcgcgacgagctgttcgacgacgtggacctctcacgcacggtagggtggttcaccgcgttgttccccgtgcgtctggagttgccggaggggttggcgtccgcttccgtgctcgcgtcggttcgcgcggcacgcgagcatcggaagggcagaggtgttggatatggcctgctgcgctaccttcgccatgatgccggcgcttcgtctgaggtcctcttcaactacctcgggcagctcgactcgggtactcgggactcggcgctgttctcgctggcgcccgaatccacgggggcctcgcaggggacgcgtgggctccggagccatgtgttggaggtggtggctcgcgtcgtgggcggacgcctggagttggcctggcattacagcgaggcgctgcattcgcgcgcgcgcatcgaagccctggcgcgtcactgtgtcgaaacgttggtggaactcgcgggcgcgacggaggagtgtcatgcgctctctcccctccagcatgggttgttgttccaggtgctgctggagcccggcaccggcgcgtacttcgagcagcgaagctggacgctcgccggtccgctgaacgccggagcactccggcgggcatgggaggcggtgtccgaacggcattcctcactgcgcacctcgttcctctgggacgggttggaggcccctgtccaggtggtccatgcacgcgcgacccctgtgtgggctgagctcgactggcgcgggcgctcctcggaggaacaatcccagtcactggccgcgttcctgcgtgaggaccgggcacagggctttgtcctgtcgcaggcgccgctgatgcggctggcgctgattcgactggaggaccatgcctggcggttcgtctggagcttccatcacctgcttctcgatgggtggagtctggcgcgcgtccttggcgaggtgcttgatgcttacgcggcgattgccgcaggggcagattggctcccgcccgccgcctcaatggatttccgcacctacgtggaatggctggggcgccgccgacctgagcaggacgaagccttctggcgggagcagctcgagggcatcgaagcgccgacgccattgcctgcggcaggaggctccaccgcggcgcatgacacgggtgagcacgcgctggatttgggcgaggccgataccgctgcgctccaggagttcgcacgcagccatgggctcacgccgagcaccctggtccacggtgcgtgggcgttgctgttgtcccgctatgggggcgggcaggacgtcatgttcgcgacgacgctcgcgggccgtccgccggagctaccgggcatcgaggaagccgtcgggttgttcatccactcgctcccggttcgcgcccgtatccagcatggcgccgggttgctgccctggctgagcgagcttcagtccctgctggtggagttggggcaacgggagcacgtcccgctcacccggcttcaggggtggagcgacattccccgaggcacgccgctcttcgagagtctcctcgttttcgagaactacccggtggatgccgcgctcgtacgcggtgcgtccgggttggagctgcgggacttcgcggccttcgagcgcacgcactatccgctgaccgcggtggtggttccgggacgctccatgcggctgaagctgctgtaccggcaggagcgaatctcaaaggtcgctgccgagcagttgctgacgcactggcgcggtctgcttcaggcgatgtggagtcgtcctgagcagcgactgggcgacgtgtccctgctgtcggaggccgagcggcgccgcgtgctggtggagtggaacgccaccgcgaccacgtacccccgcgaagccacggtgcattcgctgttcgagtcccaggccgcgcgggcgccagagaccgtggcggtgcggtatggcggaacgtcgctgacgtacgccgagctgaacgcgtgggcgaaccaggtggcgcgccggctgggggccttgggagtccgacgagggactcacgtgggcctctgcgtggagcgctccgccgagctggtcgttgggatgctgggcatcctcaaggcgggggcggcctacgtgcccctggatccggcgtacccgcgcgagcggctcgcatggatgatcgcggatgcgggggcacccgtactgctgacgcaggagcggctgcggggggcggtgccttcggagggcgtgagtgtcctcacggtggaggaggtctcggcgcaaggggacgtcgctgaaacggcggcgcttggagccggagtcggcgcagcggatgccgcctacgtcatctacacctccggctccacggggactcccaagggcgtctgcgtttcccatcaggccgtggtccggctggtggtggagacggacttcatccgcgtggtgcctgaggatcgcgtggcgcaggcatccaacgcctcgttcgacgcggccacgttcgaaatctggggtgcgctcctcaacggtgcccgagtggttggcgtggagcgggagacagcgctctctccgagtgccttcgcgtcctggctgcgggaggagggcattcgcgtcctcttcctcacgacggcctggttcaaccaggtggccgcggaagtgccggacgccttcagcgggttgcgacagctccacttcggaggagaggccgtggacccgaggccggtccgccgggtccttcgtgaaggtgctcccgagcggctgctgcacgtctatggccccacggagaacaccaccttctccacgtggcacctcgtcacggatgtgcccgagggcgccgtatcgattcccatcgggaggccgctggcgaacacggttcagtacgtgctcgacgaggacatggcgccggtgccgccaggaggcgtgggggagctgtggcttggtggcgacggactcgcctggggctatctgggacaacccgcgctgacggcggagcgcttcgttccgaacccgttcagcgagcgtcccgggacgcggctcttccggacaggtgaccgggtccgtctgttggcggatggggcggtgacctttgagggccgcgtggacgcacaggtgaaggtgcgaggcttccgcgtggagccgggcgaggtcgaggccgcgctgctgcgtcacccggacgtccggcaagccgtggtgttggcgcgagaggatgaagcagggggctcgcggcgtctggtggcctacgtcgtaccgaccgcggaggccgccgcgactcccgagccttcgctcctgcggaccttcctcgccgcgcacttgccggcgtacatggtgcctgccgccttcatggtactggggcgcctgcccctgacgcccaacggcaaggtggaccggcgtgcgctgcccgcgcccaccgtcgaatcggaggtcatcgcaccgagaggccccgaggaggaattgctcgcgcaactctttggcgaactgcttggtgtctcccgggttggagcgtccgacagcttcttcgatttgggtggacactccctgctggccactcgggtcgtcacgcggattcacgccacctttggcgtcgccttgtcgctgcgggagctcttcgacgacccgaccgtggcgaggctggccgggcgcatccgcgaggcccggcagtcctctggcacggcgcgcccgccgcccatcgtccccgtgtccagggacaaccccttgccactgtccgcgatgcaggagcgcttgtggttgctggagcagctccagccaggcacggccctctacaacgtcccctgggctgcatggctcgccggtccgctggacgtgcctgccttggagcgggcactggcggggctgttcctgcggcacgaagccctgaggaccaccttctccagcaacgcgggagagcccgtccaaatcatccatccgagcgccaacgtggcgcttctcgtggtcgacctcgaggggcttccggaggaggcgcgtgaagcacaggccgtgatcgccgcgtcggaagaggctcgccgcccgttcgacctggtgaatggaccgctgtgccgggcattgctgattcgaacggctgatgattcgcacctgctggtcctcacgctgcaccacattgtctcggacgggtggtcactgggcgtcgccgtgcgggagctgtcggcgctctacgccgcggagctgcagggccggccttcctcgctgccagtgcccaccatccagccagcggaccatgcggtgtggcagcgccagtggatgcagggagaggcactcgcggcgcaggtcggatactggagaaggcagctcgccggagcgccgcccgtcctggagcttcccaaggacttcccccggccgagcttgcagcgcttccggggtgacacgctggcggtgcgtttccccgccgagctgtcggaggcgttccgtgcgctctgcattcgtgaaggcgtcacgcccttcatgggcctgctggcggccttccagctcctgctgtcgcgggtgtctggccaggaggacgtgtgtgtgggatcgcccatcgcgggccggcagcagcctgggctggagaacctgattggcttcttcgtcaacacgctggtgctccgcgcgcgtctgccgcgctcgagctccttccgtgagctcctgcggcaggtgcgggagacgacgttggacgcgtacgcccaccaggacgttccgttcgagaagctggtcgaggcgctgcaaccacctcggagcttgagccacgcgcccctggtgcaggtggtgctcgcgcttcacgaagcctcgcgccaggacgtcgcgccgcaagggctggctctccgcccagtggaactggcctcggggacagcgaagttcgacctcacgttgtccctgacggacgcggcagaagggttcaccggaaccttggagttcgacgcggacctcttcacgcgggagacggccgcgcggctgatgaaggggctccgggtgttgctggagagcgcggtggcggatgcgggccaacgcctgggcgagctgccgatgatggactcggcggatcgtcaacgcctgctcgtggcgtggaacgacaccgcggtggagtacccccgagaggcatgcctcgcggagctcttcgaggcgcaggcggcgcgctcgccggaggcagtcgcagtggtgtgcgaggaggctcggctcacctacgcggagctggaccggcgggcgaaccagcttgcgtggtacctgcgcaatcgtggcgtgggaccggggacaccggtggggctgtgcgtgcaacgttcgctcgacctggtggtggggatgctcggcatcctcaaggccggtggcgcctacgtgccgttggaccccacgtacccccgcgagcgcctggccttcatggtggaggacacgcgcctgcccgtggtgctggcgcagcaatcggtggtggctttgctgccttcgggcagtgcggacgtggtgctcctggattcggcctgggatgaaatcgcgcgtgagcccacggtttcgcctcgcgtgacggtgccggcggagtcgctggcgtatgtcatgtacacgtcgggctccacggggcggcccaagggcgtctgcgtgccgcagcgcgcggtggctcggctggtgctgggctcccgattcgcgcgttggggcgcggacgaggtcttcctccaactggcgcccatctgcttcgacgccgccaccttcgaggtgtggggcgcgctgctgcacggcgcgaagctggtcctcttcccagcgcagcctcccacggtggacacactcaaggacgtgctggcacgtcacggtgtcaccacgttgtggctcacggccgcgctcttcgaggcgctctccgccgcgaggccggacgccctggatggcgtgcggcagctcctggcgggcggcgacgtgctcccaccggcagcggtgcgggagcggcttggacgcggcggcatcctggtcaacgggtatgggcccaccgagggcaccaccttcacctgctgccatgtgatggagggcgccgtcgcgccgggggccattcccattggccggcccatcgccaatacgcgggtgtatgtggtggacgcggcgttgcgccccgtgccggtgggcgtaccgggtgagctgctcattggtggagacggcctggcctggggttatcagggtcggccggagctgacggcggagcgcttcgttccgaaccccttcggctcggaggcgggcgggcggctgtaccggacgggcgacagcgtgcgctaccgcgaggacggcacgctggagttcctcgagcggctggacggtcaggtgaaggtgcgtggctaccgggtggagccaggcgaggtggaggaggcgttgcgcctgcacccgtcggtggccgaggcggtggtggtggcgcggcccgaccccgcgggaggcaagcggctggtggcctacgcggtgcctcgggcaggggagacgttggacccccgcggccttcgcggcttcctggcggagtcgctgcccgagttcatggtgccttccacgctggtcccgctgatggcgctgccgctcacgcccgtgggcaagctggaccggcgcgcgctgccggagccggaggtctcgcgtccagcagggagtgccttcgtggagcccaccaccgcgctggagcgtcaggtggcggcgctctgggcgaaggtgctcggcgtggagcgggtcggtgtggaagaccacttcttcgcggacctgggcggcagctccatgtccgtggtcaaggcgtgcgcattgctgcgcgacgagctgaagcgagacgttccggcgacgcgcttctttgaacatcccacggtccgcgcgtttgtcatgtccctggagcgggacggcgagacggcggcagacacccaggacaatgaggcccacgtggatcgcgcccagcagcggcgtcaggcgatccgccggcagggtcggcgagggaatcacggcaatggctga

SEQ ID NO: 2388 - DNA, 791 bp, Myxococcus xanthus
atggctcgcaaggtcgccgcatccgctgattccgcgctgagcatcaccctggcccgcgcccgtgcgcactggctgcggacgcaggggctcgcggagccgctgaaggggagcctggaagaggtggtcgccacgacgggctgggtgcggacgctgggtggcgtggacgtgtacctggcggtgcgggcccgagtgccggggctgcggcgggcggacctggacgcggcggcggaggcgtcccagctccaggtgattcccgcggtgcgtggctgcatctacctggtgcctcgcgcccacgtgcccctggtgatgcgcgttgccgaggaggcgtaccgcaagcgggccgaccgcgagcacgagaaggtgggcctgggcgcgaaggaactggcggacgtggccgaggccgcgctggtggcgctgcgcaaggggccgctgtccacggacgcgctgcgcaaggcgatgcccgcgggcgtggtgcgcagcctgggcgaggtgggcaagaaggtgggcctgtcctcgacgctgccgcccgcgctgcgccacctggagttcgagggcaaggtggaacgccgcaccgagggcgggcggctggatacggagcgctacctgtggcggctgacggctcgcaaccccttcaccggggccaaggtgcccgccgcggcggaggagcgcaacgcgcggctggcggccctcttcttccggcagttcggtccggcgacggtggaggacttcgcggcgtggtcggccttctcacagcgggacgcgaaggcggccgtggcgcgggcggggctggt

SEQ ID NO: 2389 - DNA, 1956 bp, Myxococcus xanthus
cgggtcctgttcggcaggcccattccgaacgagcgagcggaagaggagaggattggtccgctgacaggcatccccgtgctcgggctggacgcgttggcctccgcggcctacgggcccgaggccgcgctcaccgccatgctcgtgctgggcagcgccgggccgcggtacatcggcctgctcaccggcatcatcgtcgcgctgctgctcgtggtgcagttctcctaccggcagaccatcgccgcgtatcccgacggcggcggctcgttctccgtggcccgcgccaacctgggcgtgaggcccgcgctgctcgcggcctccgcgctggcgttggattacgtactcaacgtcgcggtggccatttccgccggcgtgggcgcgctcgtctccgccatccccagcctgtttccccacaccctgctcctgtgcctgctgctgctcggcttcatcatggtcgtgaacctgcgaggcatccgcaccgcgggctcggccttcctgctaccgacctacctgttcgtcggctgcctgggcatcaccctgctcatcggcatctggaaggtgctcacgtccaatggcagccccgtgcccgtcgtcgccccgccccggctcccggagagcacggccatggcgagcctctggctgttgatgcatgccttcgcgaacggctgcacggcgatgacgggcatcgaggccgtcagcaacggcgtgcccatcttccgcgaaccccgcgtgcgcaacgcgcgccggacgttgctgggcatcgtgagcatcctggtgatgctgctctgcggcgtggcgtggatgagccacgcctatgacattggcgcgaccgcgccgggccaggccggctaccagagcgtgctgtcccaggtcgtggccgccatcaccgggcgcggcgtcttctactacgtggcgctggcggccatcgtctgtgtgctctgcctgtccgccaacacgagcttcgcggacttcccccgcctgtgccgcgcgctggcgctcgacagcaacctgcctccggccttcgcccacgtgggccagcgcctcgtgtattccacgggcatcgtcaccctgtccctgctggccgccgtgcttctggtcctgttcaacggcgtgacggaccacctcatcccactgttcgcggtgggggcgctgtccgccttcaccttgtcccagctcggcatggtcatgcactggcggcgcatgagcggacgcggcgcgcggaggttccagtgggtgaatggcgtgggcgcggcctgcaccgccctggcgctggccgtggtggcgacggccaagttcgaggagggcgcctggctgaccgtcgtcttcattcccctgacctacgtgctgctccggacctcgcggcgccacgccgagcgcatccacgccgccaccgagacgccccaccccattcccgtgcagccgctcgccgcgcccgtggtggtggtgcccctccggcgcctggaccgggtggcgcagaagggcctgcggctggccctgtccatgtccccggatgtgtacgccgtgcaggtccgaggacaaccggacgcccaggagcaattggtgcagcgctgggagtggcaggtggccgcgccccttcggaaggccggacggccggtgccacgactggacgtgctcgtgccgacctaccgccaggtcgtggacccgttgctgggctacgtccggaagctcgccgcggagcatccgggccggttcatcgcggtgctggtgccagagctcgtcgagcgccgatggcaccacttcatcatccccagccacaccgccacgctgttgaagatgatgctcctggttcgcggagggccccacatcgtcgtcatcaacacgccctggtacctgcgcgagccgtcgggccggaagagacgcctccgacgaggttctgcatgcggacgaccaggttcttgtcgcggcgccccagcgtgctcgcatcatccgtgggaatga

SEQ ID NO: 2390 - DNA, 1134 bp, Myxococcus xanthus
atgaacctcaggctcatgttgaaagggctcacggacgtctgcgacacgggggatgacgcgctcgtgggcatccggttcgacaatgcgacgggctccgtcatcaacacccagattttcaacatccgccagggagacggaaccggaggctgccaggagggcaccggcatcctgattcgcaaccagggcccgttgagcccgacgcaacacgtcggtgtccagaacaatctcctgctgggataccagaaggccggcgtcgtggcggttggcgatgtcgtggtggacatcaccaacaaccgggtggtgggctcggggcccatcggcaacgtcgcccagtctggcatccaggtcgggctcggggccaccggaagcattgtcaacaacctcatctccgggcactcctacaccggcgagggcgtcgccagcggcatcctcgtctacggagggccgatgtacggaggcccgctgtccacggacgtcctcattcaaggcaaccaacttttcaacaacgacatcggcgtctacctgtcccagggcaacgcggatcaaagccctccggcggtgctgacgaacatccaggtcgtggacaacgtgctccacttcgacggggtgacgaatggctacgtctaccaggccggaatctcggacctgggaacgggcaatgtcattcactccaacatcatcaccggcgcggggtatgacccggccaccctccccggctccaccttcgccgtggatgtgctcgcgggtccggcagcaagcctcgccttcctcaatccgcctcggcaggtccccgtgggcctctgctccggcccgctcatcgtccagacccaggacgtgagcgggaacctggtcgttcccaccacgacgggcttcaacatcacctcagcgggtccggcctcccccggcatccagttctacgccgaccccgcctgcgcgggccccgcggtgacgacgctcgacctggggaacccccaggctcagggccgcttctacttccgagcccccacgccgggcagcgtcaccgtcttcgtctggaattcggactggacacaaggccagacgcagcaggtcttcatccccctggaatcggcgccaccgcccgccggcgccctacggctggagctgcaacactga

SEQ ID NO: 2391 - DNA, 945 bp, Myxococcus xanthus
acgcatcgaaccgtaaagacgaatggcatcaacctgcacctcgcggaggcgggttcagggccgctcgtgttgctcctgcatggttggccggagtcctggtactcgtggcgccatcagcttccggcgttggcggcggcggggtaccacgcggtggccccagacgtccgtggctacggccagagcgacaagccggaggccatcgaggcgtacagcatgaagcagttggtgggtgatgcggttggcctgctggatgcgctgggggagaggacggccatcgtcatcggccacgactggggctcggcgattgcctggaactgtgccgccctgcatcccgaccgcttccgcgcggtggtgggaatgagcgttccccatctggggcgcgcgcccatgccgcccatgcagttgtttcagcgcatgttcggtgagaagtggttctacatcctctacttccaggagcccggcgtggccgaggccgagttcgaggcggacgtcccgaggacggtccgggcgattctcacgggcacccccggcttcgatgtgacgaatcccgccgtgctggcgaagaagaagggggaaggcttcctcgcgaggctcgacgtacctgagacgttgcccggctggctcaccgaggcggacgtcgcgtacttcgcgaaggagctcgccggcagtggattccggggcgggctcaatcgctaccgcaacatggaccgggactggcacgaactgccggagctggcgacggcggtcatctcgcagccggccctctacatcgtcggagagaaggacccggtgcgtgccttctctcccgttgacccgatgaaggccctggtgccgaacctggccgacatccacgtcattcccggcgcgggtcattgggttcagcaggagcacgccgccgaggtgaatgccgcgctgctggccttcctgaagaagctgccggcctga

SEQ ID NO: 2392 - DNA, 546 bp, Myxococcus xanthus
atgaagaagaccatgttgtccacgtgtgtttgcgcggccctcgccctgacagcctgcggtgggggcagtgatcggctcgactccgtccagggcgagccacccgctccgtccggtccggtccagacggaggatgggcagcgcttcgagctgcggctccgcggctcggcggcggaaggctacgacaagctggagctccccatcggtgctgttcgcgtcaccgcgaatggggctccgctcaaggtggagttggtgcaagacagcgcggatgtggcccgtgccgaccatgcgcacctggtggcctacttctacgtgccggaaggcgcggatcgcgtccgcgtgacgctccaactggaggggctcggcggctatgcccgggcggagggctccggcttcgtcgacgccagcgtcgccccggtgaccttcgaggcgcccgtgcacgaactggcgctgcgtggccgcgcggtggtgcagctcgatgtggctcgctccatcatggacatggggagccaccgcctgctgctcccgaacggcgtcgtcaactactga

SEQ ID NO: 2393 - DNA, 954 bp, Myxococcus xanthus
atgaacgaggtcggaacaatgcggatgaagcagaagaagcagtgggtttccgcggtatgtgcggtggtggtcggcgggagcggagtcgcgaatgcccacgacctgatttgcgaaaagaaggtcaatggcgagtcggtggtggtggcggatgattatccctacaccgcgaactacaccttcaaggtcaccaacgtccacccgacgttgccgtccatcttgttgacggcgaccgatgacgtgctgtcgagcgagggcttcacgttctcgccgccgccgccggtgagcattcctgtcaatggttcgctgacgtcggacttcgcgctgcatatcggcagctatgacgagtgcgtgaccattgccgcgcaggatggcgtggcggacaaccacatcgacaacacgttcacggtgacgttcgacttgggctccgccatgtgctcggcgcgcctgacgtgtgagcgggaagagccgcctcccgtcgagtgcaccggcccgacgcggacgctcggcttctacaagaaccgtatcctgacggtcacgcagtgcctggcgcaggggcccatcgacctgggcgccatcgggaccatcaccacgctgcccgccgcggaaggcatcctgtggggcagcccggccatgtacccggcgggagggatgcgcagccagctggaccggctccgcttcctgctcgcgcgccagacgctggtgggcatctgcaaccagcgcctgttcggcgcgacgcccgacccgacgtcgctcctgacggatgcggttgcggccctgaacaccacccagtgcgatgtcatctcgggcctcatcgaccccgtggacgccttcaacaacggttgcgactcgctcccgctcccgcccggcttcatccccggtccgtcgacgccccaggccgctgaggcgatcgccgtcgacccgacctccaactccggccagagctgctcgccctga

SEQ ID NO: 2394 - DNA, 1773 bp, Myxococcus xanthus
atgatgcacgtggtgggcgtgacgccgctggcgttgcggctggcctcgctcctggggcacctggccgcggcggtgtccatctacctcatcgcgcgcaggcccgccgggcgcttctgggccgtgctgggggcggcgggcttcctcgccatgccctttggctggcagctcgtccaggggcgcatcttcggcgatgtgacggattgcaccctgacgggctgcaacgccgtcgcggtggcgctcctgttccacgccacgcgccagggctcctggcggtgggggctggcggcaggggcggccgtggggctgggcttcctttgcaagacggggctcgcgctgacgcccctgggcatcgcggcgacgctgtgggcgctcggccggctgcgcttctgtccggggccgaggttcagcacggtggtggccatggtgggcatggccgtgctcctggccgcgccgtggagcttctactccgcatggcgctggccggagctgcatgacttggaggcgcgggtgacgcgcgcccacctcttcgccgacccgacggtggacgtggggccctggcaccggccggtggatgccctcttgaatgaggtcaacacccagagcctggcgccgctgcccgcggtgttgccgctgctcgccttcgtgtggctgctggtgcgcgcggtgcgccggcgggagctggaggtggtggggctcgcgttgtgggtgggggccacctggctcgtgttgtcactgagcgtggtgaaggtccccgccattgcctggggcgcggtgcccgccgtcctggccgcattggccatcgcgggcgcggatgcccggcgccaccctgcgctcgcggcggcgctcctggcggcggtcgccacgccgtggttcgtcaagcacctgccggtgctcggtgctgtccgcgccgtgctccccacggtgctggtgcagacgcgcgcccggcccgggctcgccgaggggctggtcgtggccgccgcggcggcgctgctcgtcgcgctcgtgtgctggcgcctgccgcggaagctgtcctgggcgcccctggggctggggctcctggcctcgggcgtgctcgcgtggctgctggccgtcacctttccggtggcgaaggcagactaccaggccaggcatctggatgacctgtacgtcacctactcccgcgaggtggggcgcgcgctctaccagcagacgccggcgcgcagtgtcctcttcctcgcgcaggactcggacgtgcccggctccatggagtacctgagcctcatgttctggagcaaccgcatggcgtaccggcggccgcccgacgtcgtgagtgctcgcaagcacggctatcacccctacctcgtctcgccgctcgcggagcactacgcccccgttcccggtgtgcctccggatgccgcgctgcgagcctatgacctggaggcaccccggtccgaacccgcgccactgcctgatggggtcatgccgctggccttccgtgagaaggacatggaggtgctgggcgtcgcggcgggccacgcgggtgggggccgtgaccggtatgccttctacgtccgcgcccagggcgtgcctcgcgcgctgcgcgtcgtcttccacggaccgggcggaagcgtggagcgcatgctggagcccggcgccgcgctgcggcagcccgccacgctgcggcgcgccaactggttcatcgtgcccgtgctggggcctcccagcgccggcgtgacgcatctggaactgggcgccaacggccagcgggtgacgttctcccgcccgggcgcctga

SEQ ID NO: 2395 - DNA, 1065 bp, Myxococcus xanthus
aggacggtcatcttcggcggcgccggcttcatcggctccaacctggcggaccactacctgtccgcggggcggaccgtgcgcgtcgtcgataacctgacgcgccccggggtggtgcacaacctgcgttggctccaggcccggcatggcgcccggctggaggtggtgacggcggacgtacgggacgcccatgcggtgaagcaatccgtcgttggcgccagcgaggtcttccacttcgcggcccagggggctgtcaccaccagcctggagacgcccgtcaccgacttcgaggtcaacgcgggcggcaccctgaacgtgctggaggcgctgcgcgccatggagcggcctgcctcgctcgtcttcacctccaccaacaaggtctacggttgcacgccgggcgtggagttcgtccagaagcccagccgctacgcgcctcgggacgcgggcctgcgcggtcacggcgtgggggaggactgcccggtggacttcgagagccccgatggctgctccaagggcgcggcggaccagtacgtgctcgactacgcgcgggcttacgggctgaggacggtggtgttccggatgagctgcatctacggcccccggcagttcggcaccgaggaccagggctgggtggcgcacttcctcctgtgcatgctcgaaggccggcccctcacgctctacggagatggcaagcaggtacgcgacatcctcgatgtgggggacctggtgcgcgcgctcggcctggcgcagcagcacatcggacggctcaaggggcaggccttcaacattggcggcggcccgtcgcggacagtgagcctgttggacttgctggggctcatctctcagcgcaccggtctgcggcccgcgctccagttcgaggatgggcggacgggggacccgcgctactacgtctccgacccccgcaagttccaggcagccacggggtgggcgccccaggtgggaatcgccgagggcgtggaccggctccacgactggctgcggaccctgatgctcgagcggccagtggcgtccgggcagggaggggcgcgtgaagtcctcgtaggctag

SEQ ID NO: 2396 - DNA, 183 bp, Myxococcus xanthus
atgggcgacatccgtcactgcttcgcggacatctccctggcgtgtgagttgctggggtacgcaccccgggtttccttccacgacgggctcgcggagctgtcgtcgtggctcgaggaccaggtggcgacggaccgcgtggcggaggcgcgcgcggaactcgagacgcgagggctgaccgtatga

SEQ ID NO: 2397 - DNA, 96 bp, Myxococcus xanthus
atgctctggaccctcctggcggaggactaccgggccagccccgccgccgcgagcgacctggaagcgttcgacgtgctggggcagaagctgctgtag

SEQ ID NO: 2398 - DNA, 1866 bp, Myxococcus xanthus
atggtggagctgggctccctcccttctggcgaggtccagtatggcgactccctgcaactccaggcggaaggccgggacgaagacggagacacgctcacctacgcatggacggccagttgcgaaggcaccttcgatgacgcgagcgcgcggtcgcctcgcttcacgccgtccacgccgccctcgggagcctgtggcgcgtgccagttccacgtcacgatgcgggatggccgaggcggtgagcacgtcggcttggtggacgtatgtgtggtgcagcggctgccgcccatcatcgtctccacggcccaatctcggacggaggccgtgagcgcggagcccgtcctgctccaggcggtggcggaggacccgcgcggcgaggctctcaccttccagtggtccgcgaacaccggcctcctgggaaccgccacccaggacgggacgcggagcgaggtgccctggtccgcgctgtcctgtatcccggcgggtgtggagccctccgtgcggctcaccgtcacgaatgtctcggggatgagcgcgacgcacgtgttccggattcggtgggatgaccggcgctgtggggcgtttcctccctgctccgcccggtgggagaacgaccgcgtgacgttgacggcggactgcacgacggagggcacgctgtacatcccggacggagtcaccttcgacggcgccgggcacgtggtgactgcggtggaccccgaaggcggccgcttccagggtgccgtgcttcgcaaccggggagacacggcccacgtccacgacgtgacggtggcggcgcgcggcctgtcggacctggcgtgtgatgcgggcgaggccggcttgagtggcatccgattcatcggggcgagcggttccatcaccgatagcgaagtgcgcgcgctgcaccagggcgcgggcgagagcggttgccaggagggcgtggccatcgaggtacgaaacgcccaggacgcgtcccgcgtggttcaggtggaggtcctgcgcaaccacgccgtgggctaccagaaggggggcatcgtggcctcgggccgggtggacgtggccgtggagggcaacgtggtggagggcggcggtccgtcggccgtcatcgccaggaatggcatccagttgagcttcggcgccacgggacaggtgctgggcaaccgcgtcaccggcaacgtctatacggggaccggctatgtggcggccggcatcctcgtcgcgggtggggcctactacggcggcccggtgtgcgaggacgtcctcatccagggcaacacgctggaggcgaacgacattggcatcgacctgtcgcaagcggaggcggacggcgggccgctggcgcaatcctcacggttgctcgtggtggagaacacgttgagccacggcgtggtggcgaacggcgtgccgtaccaggcggccatctcggacctgggcggggccaacgtcatcagccgcaaccgcatcagtggcgcgggctatgccagggagaccctgccgggctccacgttcgacgtggacgtggtggcggctgcggcggcgcaggtggccttcctgacaccccagcaagacgtggcggcgggcgcgtgctccgaggcgttggtggtgcagagtcaggacgccatgggcaatctgtccgccctggcttcgtccctgctggtggtggaggcacaggggaatgttggcggggtgaccttcttccgggacgcggcgtgtacgcaggccctggtgcctctgaatggcagcggcgccatggacctggagggaccgcagcaggaagcggtgttctatttccgcgcggaacagtcaggagccctggaggtacgggttcgaggcgacggggtgagtgcctcccagatgcacgtggtgcggtag

SEQ ID NO: 2399 - DNA, 951 bp, Myxococcus xanthus
gagctctcagtcccgctctgcgcggcactgttcgcctccggtctggccaccgctgtccccgccgctgcgttcgagctgaagcatgagactggcacgctgagcgtgcccgccacgccgtcccgcctcgccgtctatgacctcggcgtgctcgacacgctgaacgcgctcggcatccgtgccgtggccgtgccgaaggccaccttcccggccacgctgtccgcctacaacagcaatggcgtgccccaggccggcagcctgttcgagcccgataccaaggccctcgcggagctgaagccggacctcatcgtggtgggtgggcgctcgcggaagcaggccgagtccctgagcgcgctcgcgcccaccgtgaacatgtccgttcgcgccgaccacttcgtggaggacgtgacgggccagacgctggcgctgggcaaggccttcggcaagcagacggaagccgacacgctggtgaagaacttcgagaaggagcgggcggcgctgaagaagctgacgggcggcaagtccgccgtgatgctcttcaccctgaatggcaacgtcatggtgcacgcgcccggtgaccgcttcggttatctccacgaactgacgggcttcaacgccgtggtcccgaaggcggagggcagcaacgacggcccgcgaccgccggccgggtcgcccgaagcgaaggcccgtcaggaagccgcggccgccctgctgaagaaggccgtggccgccaacccggagtggctggtggtgctggaccgtggcgccgcgaccggcgggggtgagaacaaggccctggagacgctggccaagcacccggagctcagccagacccgcgccttcaagcagggccgggtcatcgtggtcgacgccccgagctggtacatcgtcggtggcggtatcgcgaacgtgacccgaatcgtccaggacacgacccgcggcctgaagaagtag

SEQ ID NO: 2400 - DNA, 696 bp, Myxococcus xanthus
cgagcgggaaggtcatcagctcgcattccagagtcggctcgggtcctgctggagacggcgcaagtgccgctgcggcgcccgggagagctggtctcggaccatgtgcgcgccatcctgcgtgtccgcgctgcggacctgctggggctgcaggacgtccagggactgctggagggactggaggcgcaggcgcccgtgctcgtgaaggaggcgctgcagaaggtgccgctgccgctgctcacggatgtgcttcgcaagctgctccaagagggcgtcagcatccgggacttgcgagccatcctggaggcgcttgtgtcgccgacgacggaaggggatgccgtcgcgctcgcggagcgctgtcggcaggcgctgcggcggtacctcagccacaagttcgcgcccaccgggccgctgtacgcgtacctcgtggacccggaggtggaagaggtgcttcgcggcatgggcccgcgagggctggcgcccgacccggagcgggtggcggaaatcctcgaaggcgtgcggcaggtggccaccgagggacgggcggtgctgctcaccgctccggatgtccggcggcccctgcgcagactgtgcgagggcgcgttcccggatgttgcggtgctcacctatggcgagctggatggggccctccagattcgccccatcggccggctgtcgccggtggcggtggggcgctga

SEQ ID NO: 2401 - DNA, 1263 bp, Myxococcus xanthus
atgcaggtcatcaagctcaatgacctgaagcggatgaagatcaccgacctctcgaagatggcccacgacgtgggcatcgaggggtaccagggcctgaagaagcaggacctcatcttcgcgctgctgggcggcatcgccgacaagcgcttcgaggtccacgcggagggcgtgctggagctgctcagcgacggcttcggcttcctgcgcagtgcggacagcgactaccagcccagcccggacgacatctacgtgtccccgtcgcaggtgcgccgcttcaacctgcgtcccggcgacacggtgacgggccccatccgccagccccgcgagggcgagcgcttcttcgcgctccagaaggtggacaaggtcaacttcgcggacccgatgtcggacgcggcgcgcgagcgcatcctgttcgacaacctcacgccgctctatccgacgcgcaagctcaagctggagcatgagtcgtcggagatgaccacgcgcatcatcgacatgttctgccccatcggcctgggccagcgctgcctcatcgtggcgccgccgaaggccggtaagacggtgctgctgcagaacatcgcgcacgccatcagccgcaaccacccggacgtgtacctcatcgtgctgctcgtggacgagcgcccggaagaggtgacggacatggagcgcagcgtgcgcggcgaggtggtgtcctccaccttcgacgagcccgccacgcgccacgtgcaggtggcggagatggtcatcgacaaggccaagcgcctggtcgagcagaagtacgacgtctgcatcctgctggactccatcacccgtctggcgcgcgcctacaacaccgtggtgcccgcgtccggcaagattctgtccggcggcgtggacgccaacgcgctccacaagcccaagcgcttcttcggcgccgcgcgcaacatcgaagagggtggctcgctgaccatcatcggcaccgcgctcatcgacaccggcagccgcatggacgaagtcatcttcgaggagttcaagggcacgggtaactccgaaatcgtcctggaccggaagctgatggagaagcgcatcttcccgacgctggacatcaacaagtccggtacgcgcaaggaggagctgctgctcggcccgggcgacctggtgcgcatcaccgccctgcggcaggtgctccacccgttcacccccatcgacgcgatggagttcgtgctcaaacacatgcggcccaccccgtcgaatgcggacttcctcgggtcgatgaaccggtag

SEQ ID NO: 2402 - DNA, 1269 bp, Myxococcus xanthus
cgcggcaagtacatctccctggagaagttcctcagcgccgccaaaggcggcctgggcttctgtgacgtcgtcttcggctgggacttgagcgacgacttgctcgacaacacccaggtgacgggctggcacaccggttacccggatgcccacgcgaaggtggacccgtccaccggccgcgtcattccctgggagccggacaccgcggcgttcctgctcgacttcgaaaaccccgacggcacgcctttcgaggcgagcccccggcagttgctccagaaggtggccgcccgcgcgcgctcgctggggtacctgccgcgcttcggcgcggagtacgagttcttcatcttcaaggagcagccgcagagcctgcgcgacaaggacttccaggggctgacgccgctgacgccaggcatgttcggctattcgtggctgcgcacgtcgctcaacgcgccgctggtgcatgcgctcatcgacgggtgcaacgccttcggcctgggcatcgagggcttccacacggagacggggccgggcgtcttcgaggcggccatccgctacgacgacatcgagaagtcggcggacaaggccgcgctcttcaagacggtggtgaaggagatttgcgcccgccacggcgtcaccgcgtgcttcatggcgaaggtggacgcgaagctgccggggtgctcggggcacgtccaccagtcgctgtgggatttggacggggagcagaacctcttccacgacgcgaaggcgccccacggcatgagcaagctgctgcgccactacatcggcgggcaggtggcgctgatgccggagctcaccgcgctctactggcccaccatcaacagctacaagcgcagcgtggagaatacctgggcgcccaccaccgtgacgtggggcctggagaaccgcaccaccgccatccgcgtcatcggtgagagcgccaaggcgatgcgcctggagtaccggcagttgggcgcggacatgaatgcgtacatcggcatggcggtcagcctggccgcgggcctgtggggcatcgagaacgaggtggagcctcccgcgccctgcgagtccaacgcctacgcgaagaacgacgcgccgcccttgccccgcaacctcaaggacgcggtggcgctgctgaagggcagcgagcgcgcgcgggagttgctgggctacggcttcgtggaccacttcgtgcgcacgcgcgagtgggaggtgcgtcagtacgagcgcgccgtcaccaactgggagttggagcgttacctggagctcatctga

SEQ ID NO: 2403 - DNA, 466 bp, Myxococcus xanthus
  unsure (1)..(466): unsure at all n locations
atgaagccgttcgacattccctccgagccgcgcgtcaccgagatggcgtggcccacgcgcatcgtcttcggcgccggcgcgctgctgcgcctgcccgcgcaggcccagcgtctgggcatccagcgcccgctgctggtgacggacgcgggcgtggtgaaggcggggctggccgcgcgcgtggcggacgtgctcaatacggcgggactggcctgtgaagtcttcgaccgcgtggagcccaaccccaccgagcgcgacgtcttcgcgggcctggaggcgtaccggagccactcctgcgacggcatcgtcgcgctggggggcggcagcgccctggacgcgggcaagctgattcagctcctcaccacacacgagccgncgctcagccgctatgacgacgcgaagggcggngaccagtacgtgcgcgacgacctgccgccgctcatcgcgattcccaccaccgcgggcaccg

SEQ ID NO: 2404 - DNA, 354 bp, Myxococcus xanthus
atgctcaagtccgatctgatcaacatcctcgtggccaagaggggcgtgacgcagaagcaggctgaggccaccatcgagacgattttcgagtcgatgaaggatgccctctgccgcggcgagaacatcgagattcgcgggctcggtgcctttcacgtgaagaactaccagggctaccaaggccgcaacccgaagacgggacaggtcatcccggtgaagcccaagcgcggcctgctcttccgcacgggcaaggagctgcgcgaccgcgtgaaccgtccggcgccccagcaggcccagacggagctgcccccgcttcccgaaagcaaggggccgggcaacacgggcacggggctctag

SEQ ID NO: 2405 - DNA, 1260 bp, Myxococcus xanthus
gcgaagactgtggcccagggctttcgcggggagaatctccggcttcgggccgccgcgctgacctacgtcagcatgttctccctggtgcccctcctgacggtggcgctcgtgctgctgaccgccttccaccaggacgagttcaaggagaagctgcgctttttcttcagcgaagtgctcaaccccggggtgcgcggcaagtcctcccagttcctcgaccggttcctgaaccccacgcacaccgtcgccattggcagcgtgggcttcctggcggtgctcctgtccgccggctcgctgctgcggcagctcgacggcgccgtcaacgagctgtggggcatccggcggcaacggccgtggcgcatccggctgctcatctactcgggcctcctgctcgtgggccccttcttcctcgcgctgtccttctccgggacgggcaaggtccgcgtcttcctgcagagccacgcgccctacgccggcgccttcatcctgctgggcaccacgctcgtcaccgtggccagcctcaccctgctctactactggacgccctacgcgcatgtccgcgtccggtccgcgctcgccggaggactggtggccggcttggggtggacgttcgccaagcaggtgtacgccgcattcgcggagcgcagcttccagtacaaccccctctacggctcgcttggcgcgctcccgttgttcctggcgtgggtctacgtgagctggctgttggtactctttggcgcccggctctcctatgccgtggaacacaccgccttccggcactccctcttcgcttttggaagccacccgcgcgcgcacgaactggtcgccgcccgtgtcgcccaggaggccaccctggcctgggtggacggactgccgcctccctcgccgcgcgagctggcgacgcggctgcgcgtccccgagtcgctggtccacgaggtcgtcgaccgcatggtgaccgccgagctgctggagcgcctccgcaaagggggcctgcgtcccgcgaaggacccggctgtcctcacgctggcggataccacgctcgccgtgcacggcgtgatgctcaccggcggcgcggagggatggaacgggccccgggcgcccggattcgaacagatggagcccatcttccaggcagctgactgcgccggtgtcgacctgctacgtcgcacccgatggctggacctggtggtgccgctccgcccagggctggccgagcctgctcccgccccaccacccagggtggccgcagggggaaatccgtag

SEQ ID NO: 2406 - DNA, 2811 bp, Myxococcus xanthus
atgagcagcatcctggtcatcaacgccgcgggccgagagacgcgcgtcgcgctcgtcgagggcggacacatcgcggagttctacctcgagcgtaagaaggacaagggcgtcgtcgggaacatctacaagggccgcgtcgtccgggtgctcccgggcatgcaggccgccttcgtggacattggcctggagaaggccgcgttcctctatgtcagtgacgtcgtctacgaccctgacttcgcgcgcgcgcagttcgagctgaccgaaggtgagcacgaggatgcgccggacgtcccggacgagtccgaggccgaggccgcggaggccgccgcccggcacgcgcccccccgtcacctggagccggagccggaggacgcccatttcgagcctgtcgcggcgcccaccgagtccctgccgcgcgataccgccctggagctggccgccaacgccccgacggtgacgccgccgggcgcggagacgccggtggcgcccgcggaggaagcgccggccgccgggtcggagctggtggtggccgccgaggtggccgttcagcccgtcacgcccgagcagattgtcgcggtcgagccgtccacggcggcgcccgtggaggccgcgcctgctccggcaggtggagaggccgaggccgcgccctcctccgagcctcagatggccgaggccgccgtggagcccgacgcgaacgtcgagtcgcccgaggcggcgctggccgttgccgcggcgtccgagcccgacgcggccggggtggcggtgcccgctgaatcggccatggaagcggccgagggcgaggccaccggtcttcccgtcgagccccctcccccctcggccgccgcgctgggagacatcatcccctcgcccgctgaggagggcgcgcaggctgcgaagccgtccgaggtctccggcgagcgccgcacgccgcgcgaggcccgtgaggcgcgtgagccccggaacagggagaaggagcgcggcgagaaggacaagggccgccggccacaggaggagaagcgccggggcgacaagcacgaagacaaggagaaggccaagccgcgccgcaccgacaagattgaggacctgctgaaggtgggccaggaagtcgtcgtccagatttccaaggaccccatcggcaccaagggcgcgcggctcacctcgcacatctccatccccggccggcacctggtgttcatgcccacggtggaccacgtgggcatcagccgccgcatctccaacgagaaggagcgccggcgtctgcgtgatatcgtggaccgcctgcgcccgcccgggacgggcttcatcgtccgcaccgtcgcggagaacgtgccgcaggagaagctcgagagcgacatccggttcctcatcgaggtgtggaaccaggtggtgcgcaagaacgagaagcgcggcggccctggtctgctgcaccccgacctggacctcatcctgcgcgccacgcgcgacctcttcgcgcacgacgtggagaagctcgtcgtcgatgaccgcgaggagtacgagcgcatcctcggcttcgtcaccgcgcaggacccggcgctgcgagacagggtggccctgcacgagggcgacgacaccgtcttcgacgcgtacggcatcgagcaggagctccagcgcgccacccagcgcaaggtgtggctgaagagcggcggctacctcatcatcgaccaggccgaggcgctcaccgccatcgacgtcaactcgggccgctacgtcggcaagaagagcctcgaggagaccatcaccaagatcaacgtcgaggcggccaaggagattgtctaccagctccggctgcgcaacatcggcggcatcatcatctgcgacttcatcgacatggagaaggcgcagaaccgcgacaaggtcttcaaggcgctgcaggaagcgctgggccgcgacaaggccaagacgaacgtgctgcgcatctccgagctgggcctcgtggagatgacgcgcaagcgcgtgcgcgagtccattggccgcatgctccacgaggactgcccgtactgcgacggcaacggcttcgtgaagacggccaccaccgtggcctacgaaatcttccgggagattcgccgcgaagcgccgggctacaaggactccacgctggtcatcatctgcaaggcggaagtggcgcgcctgctccaggtcgaggagcgcaacgagctgcggcaccttatggaccggtacaacaagtccatccaggtcaaggcgcagcagaactacctccgcgagcagtacgacatttacggacgctcggcctcgggaccggagcacaaggtggcctcgtcgcctggctcgggtgatggcgagctggccatgcagcagcgcaagcccgacagcaatggcggaggctacggccgccaggagcagggccggcgcggcggtggtggcggcggtggtggaggcagggaccggggtggtgagcggggcaacgaacgctccgagcgcggtgagcggggcggagaccgtcgcgagggccgccgcgagggccggagtggcggagaccgccctcggggtgaccggggtggcgagcggggcgaccgttccgagcgcggtggggagcgtggagagcgcggcggcgaacggggcgaacgctccgagcgcggcggcgaacggagcgagcgtggtgaacgctccgagcgcggcgagcgtggcgaccggcgtggcgaccgcggcgagcgtggagagcgcggcggttcgcagaacacgtctggtggaggcgagaacgcgggtggctcgacgccgcctccgcctccagcctcgggtggtgggtcggagccttcgggcggcacgacctga

SEQ ID NO: 2407 - DNA, 444 bp, Myxococcus xanthus
atgacgccctacgcgctggcctctctcccggccatgctgggtatccgggccgggtccaaggtctccgtcatcaacccgccgcggggcttcgtgcagaagctcaacccgctgccggatggggtggagttcctcatcaccgcggtgacgggcctggatgtcatcctcttcttcaccgaggacccccaggagttggtgcagcggctgccggccctggcccgcgccatggccctcactggcggcatctgggtgtgctggccggggggcgagggtgcccgccgggacctctccgaggacttcgtccgccacgcggccctggacatcggtctggtggacaacaaaatctgcatcatcgacgccacctggacaggcctccggctggtgaggcggccccgagggcgaccggacaagccaggggagcgcaagcgagccaccgcccaggcctga

SEQ ID NO: 2408 - DNA, 288 bp, Myxococcus xanthus
atgagtggcacgcggcgagcctcgctgcgcatcgaaggcaaggtgcagggcgtcttcttcagggagagcgcccgcgttgaagccacacgcctgggcctgacaggctgggtgcgcaaccggccggacggggccgtggaggccgtcgtggaaggggagcccgccgtgctcgaggaattcatccactggtgtcatcgcggtccggcgcaggcccgggtttcgggcgttcagcgcacggacagcaaggccaccggcgagttcagtcaattcaacgtggagcgcacgtcatga

SEQ ID NO: 2409 - DNA, 1953 bp, Myxococcus xanthus
taccgttactacgtcctcgactcgcccgaggtcagcgacgcgcaatacgacaagctgatgcgcgagctgcaggacctggaggcgaagcacccgagcctccagacgccggactcgcccacccagcgcgtgggcggcgcggcggccgaggagtttggcgaggtggtgcaccgggcgcccatgatctcgctggccaacatcttcgaggaccagggcctcactgagttcgacgagcgcatccgcaagctggtgggcctgccgggcatcgcctacgtctgcgagcccaagctggacggactcgccatcgcgttgcgttacgaaaagggcgcgttcgtccagggcgccacccggggcgacggcaccactggcgaggacgtcacctcgaacctgcgcaccatccgaagcctgcccatgtcgctgttcccccaggacgacgtgaaggtgccggacgtgctggaggtccgcggtgaggtcttcatccgcaagaaggacttccagaagctcaacgagaagcgcgaggaggaaggcgagccgctcttcgccaacccgcgcaacgccgccgccggcagcctgcgccagttggacccgcggatgacggtcgcccggcccctctgcgtgttcctctacgaatgcgtcccgggcgaaggcgtgcccgtcttcaagacgcacatcgagaagctggagtacctcaagacgctgggcctgcccatcaaccagtaccgccgcgccgagggcctggagggcgtgcgccaggcctatgacgcctccctcaagggccgccacgagctgcccttcgaagtggacggcatggtggtgaaggtggatgacgaggaccagcgcaagcgcctgggccaggtctccaagagcccccgctgggcggtggcttacaagttccctccggaggaggagtccacggaggtgatggacatcggcatccaggtgggccgcacgggcgcgctgacgccggtggcacacctcaagccggtgaaggtgggcggcgtcacggtggcgcgcgccacgctgcacaacgaggacgagctgcgccgcaaggacgtgcgcaagggcgacaccgtcttcgtgcgccgcgccggtgacgtgattccggaaatcgtctccgtggtgctgtccaagcgccccgcggactccgcgcccttcgagttccccaagcactgtcctgtctgcgatgcggtggcgaccaaggacgaggacggcgccatcatccgctgcacgggcgcttcctgccccgcacaactggtggagaagatccgccacttcgccagccgcctggccatggacatcgaagggctgggcgacaagctggccgcgcagttggtgtccaccggcagggtgaaggcgttcgcggacctctacgcgctcaccaaggaggacctgctgacgctggagcgcatgggcgacaagagcgcggacaacctcatcgcgtcactggagcgctccaagcagaccacacagcgccgcttcctctattccctgggcatccgccacgtgggtgacgccaccgccaaggcgctggcggaggccttcccccggtcagagatgctcttcgaggccagcctggaggacatctcccgcgtaaaggacgtaggccccatcatggcccaggtcatccacaccttcttccaggagccccagaatcaggaggccatccgcgcgctcctggcggcgggggtccagcccgcggcgccccaggtcgccacgggaggccccttcgtgggcaagtcggtggtgctcaccggcgcgatgacgggtatgacgcgggagcaggccaaggaagaggtcgagcgccggggcggcaaggtcgccggaagtgtctcgcgcaagaccgatttcgtcgtggccggtgaggatgcgggcagcaaactgaagaaggcccaggaactcggggtaagaatcctggacgagcaggcgttcctgcagatgctgcagacgaacgcctag

SEQ ID NO: 2410 - DNA, 507 bp, Myxococcus xanthus
atgagcaacgcatacagcaaggacctggagcgatggatgccgcggctcatcgccgtctggcgcgcgtcacgcggccggggcggtggcggcgggccggagacgcgcctgacgccccaggaggtgaaggaggtggccgcgggtgtccgccagctctccctgggcctcacgcgggagcggcagctcgccggtgcgcggtacatggacgacccgaagctcctgggcgcctatctcctcttctactggccggtgtcctatgcgcaggcccggcaggtgctcggtgagctgccgaaccgcccccggcaggtgctggacctgggcagcggtccgggcccggtggccttcgccgccctggacgcgggcgggggccaggtcaccgccgccgaccgcagcaaggccgccctcaccctggcgcgaaacctgccgccgaggccggtgaggccctggccacccgcgactgggacccgacgaagaagggcgccacgctgcccgacggccagttcgacctga

SEQ ID NO: 2411 - DNA, 1119 bp, Myxococcus xanthus
tcggtggtcatgcccttcgcgggcgccgcgctcatcgcctacctggtgcagccgctggtggggcgcatctcccgggtgaaggtggccggccggccggtgccgcgatggacggcgctgctgctcatctacgccggcttcttcgtgggcgtgtacctcttcatcgtcgcgctggtgccgcagctctaccgcgaactgtcccgcgtcagccgtgaggcggtgacgttcgccaacacgctcaccccggagcacgtccaggagctcgcgcagcgcgcggagacgtggctcagcacacgaggcattccggtggcgctctccaaccgcgcgctggagggcgcggacgctggaagtagcaacggcaccttcggcttcgcgctggatttggagcagttcctgggggacgcggtgaagcgcgtgtccatcctggtgcaggagaacctgggcgacatcgtcaacgtgtcccgcagcatcgtcaccagcgtggccgcgggcgtcttcatgctcttcttcgtgctgatggtggccgcgttcttctccatcgacgcgcacgccatccgccgctacttcggcacgctgattccgccggagtacgccatcgacgcgcggcaactgctggagcgcattgaccgctcgttgtccggcgtggtgcgcgggcaggtcaccatctgcatcgtcaacggcatcctgacgttcatgggactgctgctgttcggcgtgaagttcgcgttcctgctggcgaccatcgccaccttcttcagcctcatcccgattttcggcaccatcctcagctcggtgcccatcgtcctcatcgcgctggcggacggcttccagaaggggctggcgattctcgcgtggatcatcggcatccacgcggtagaggcgtacttcctcaaccccaaaatcatggggcaggcggcgcacctgcaccccgtcatcgtcgccttctccctcatcgccggagagcggctcttcgggctggtgggcgccctcttcgcggtgcccgtggcgtccgtcctggtggcgtgcttcgactacgcgcggctcaaggcccagcccgcgcccgcggtggccctggccacgcccggaccgctgcctgctgaacgtcagccgcccgccgcctga

SEQ ID NO: 2412 - DNA, 459 bp, Myxococcus xanthus
atggcgtctcgctgggaccacctcttcgacctcaaaccgacttccctgctggagcacctcctggaggaggtggcgaagctgctgcacaaggacctgctgcagtggccgccgcccgtcgaggagctggacctggacaccggtggccacttcgcgactctcttcacggagccccggccgcggccgtcccgggccgtctacacggaggcgttccggctggcgcagtgggagctggcgcgcgaaacggacgcctacgacgactacatgcgcaacaagcgctacctggagcgaggcctggtgccgagcgaccggctgcccctgctgctcctcagccgctggctcaccgagcagatgctgggcctgggcgaggccaccgagggccgcgtcaagcgcaagcacatgcgcgactgcctggagcggctccagtcaaagctcggcgccttcccggtgcctggcgtctga

SEQ ID NO: 2413 - DNA, 897 bp, Myxococcus xanthus
atgctcagcctggggacgaggaatgagaaggtgagccaacaggcgccggtcatgtgggtacctcgaagcacacgggcgcgttccactgcgactggccaggaacggacacgcggggcacgacacggtaggaatggggacgcaatgcggcaacctacggcggtgaagaacgtcctcttgctgaaagccggtgaggcggccgaggccgtgcgcgtctccgtcggcgattacgaccggtggtttctgcaagccatcggactgtccggctaccgcttcgacatcgtgctggcacaccgggacgcccccttgcccacgcgcgcggatggctacgacgcggtgatgatgacgggctcgccgctgtcggtgacggcgctcgagccgtggatgaagcgcgccgcggacttcatggtggaggccggtgagcggggcacgcccgtgctgggcgtgtgcttcggccagcaactcctggcgcatgcgtatggcggccgcgtctcgcgcaatccccaggggcgggagacgggcagcgtcgaggtgacgctcaccgaggccggcaagcaggacccactcttcgacggcgtgccggagcgcttcatcgcgcaggcgacgcacgaggacatcgtctcgcacctccccgacggcgcgcaggttctggcgggcaacgcgaacacggccgcgcaggcgctggccttccgccccaccgtgcgcggcgtgcagttctatccagaggccagcgtggacaccctccgcgccgtcatcgaggcccgctgggagggcctcgagcgggactccgtggcgcgaggcgccgcgcccggcgaatacgtccgtcagctcctggcgggcctcacaccctctcccgcgggccgcagaatcctgctgaacttcctcgagcgattcacctga

SEQ ID NO: 2414 - DNA, 609 bp, Myxococcus xanthus
atgctgtccccgtacgtcgacggagagctgagctccggcgagcgcgtcaacgtggagcggcacctggcggcctgccgggactgtactggacgggcggcggaccttcgcgcggaatccgggctccttcgggtgggcctggacatggccgtggacgacgtggacttcaaggacttcacccagcgcgtcatggcgcgggtgacgccggacaagccgcccctcatggagcggctgaagctggcagtgtccgaaatgtttctctaccagcgcaccgcgatgatttcgtcgctggccaccgcggccgtgctgctactggtgggggtccccctgctgacgagcgaccgggcgccggtggggtacgcctccgagcgcatgacggtgaagtccatccagccctaccgcaacgcccaggtggcgccggtggtgatggagacggacaatgggggcaccatcatctggctggtggacgaggactcggacgtcctgtctcccggcgcggagaagggtgagcggcaggaccagacaggtgtcggtcagccagacgcaagcgggcgcaacgtccccgcgcgcccggcccccgacgcccccaggccgtcgggaggttccttgtga

SEQ ID NO: 2415 - DNA, 429 bp, Myxococcus xanthus
atgctgtgggcgctgctggggctgggcctgttgctgcccatggccgccagcgcacaagacgcgaaagtccaggtccaggtcgaggtagtgctcgcctcgaagaagggcaccgaggtcgacccgcccgagctggagaagatgaaggagcagttccagaagcagaacttcagcttcacctcgttcaagcgcctctcgaatgaggtgctgacggtgagcgcgaagagcgcctccgaggtgaagctgcccaacggcgccaacgcgacgctgcaactgcagggcatcaaggacggcacggccacggtgcgcgtggccattccccgtcagcccacgctggacgtggagctgggccgccagggcgccgtctaccagaaggccggtaagtacgtgggcggggagctcatcctcgtgctctcccctcccgcgcggtag

SEQ ID NO: 2416 - DNA, 240 bp, Myxococcus xanthus
atggcgaagactcagaagcgtggacaggtcatccgtcgtgaggcccagcagatggaggtgtcggcagcgagcgcggtgaagggggctggccggggcgcccgccaggtgcaggtgacgctgggcgacctcatcgcggcggccttcgacacggtgggcggcgaggtgaagaaggtggcgcaggtgatgtcctccaaggacatggcggtcgccacgggcaagcacatcgtcttcgtcggctga

SEQ ID NO: 2417 - DNA, 1395 bp, Myxococcus xanthus
taccgggagctgtaccgggccgcgcagaaggcccgtcgttacatcgcgatgaccggctggcagttcgacagcgacgtggcgctgctgagaggcgaggaccttcgcgaggcgcgcggcgagtcacggctgctgccgatgctggacgagctgtgccgggccaacccggagctgcgcgtctacgtgctggcgtgggacttcagcctgctgctcgccatggagcgcgagtggatgcagcggctcatcttcaattggacggcgaacgggcaggtgtgcttccgcttcgacgcctccagtccgttgtatggcgcgcatcaccagaagctggtcgtcatcgacggcgcggtggctttctccggcggcatggatgtctgtgattgccggtgggatgaccgggaacaccgggtgcactcggagctgcgctgtgacagtgggagggatccgcacggcccctaccatgacgtgcagtccgtgctgacggggccggtggtggaccgcctggcggagttgttcgaggcgcgctgggcgcactcgggcggcggtgagctgcggctgcccagggtgtctcgggatgacgtggacttcacgccgagcctgccagcgccgctggggccggtggccatcagccgcaccttcggcaagacgctcctcccgccgcagcccccggtgcaggaggtggccatgctgtatctggacgccatcgcttcggccgagcgcttcatctacatcgaaaaccagtacttctcctcgcgggccatcttccaggcgctggtgaaacgcatgcggtcctcctggcggggacggctgcagattgtcctggtgctgccgcggcagccggaggcgctgcgcgaacagttggccatgggcatcgcccaggtgcggctgctgcgcacgctggagcgcgtggcgcacgagacgggacatgcctttggcgtgtactgctccgcggggcacgacgcgcgcaccggcgaggacatctacacgtacatccactcgaaggtgatggtggtggatgaccgcttcctcacgctgggctccgcgaacaccaccaaccgcagcctcgggttggattcggagctgaacctgagctgggaggcggaggcgccgaacgacgcgacgacgcgcgccatccgccgcatccgcgtgtcgctgatggctgagcacgcggggctggagggcctggcggccctgcgcctgctggcggccgcggacagcggactggtggagtggctggacgacgtggctgtcatggggctgcggcgcctgcgcgtccacccgatgtcgacggtgttcgaccagagtccgctgctcaagtcgctggagcccgagcagctcatcatcagacccggagcagtcggtggtgagcgagtccctcttggaggcgctccaccgagctga

SEQ ID NO: 2418 - DNA, 495 bp, Myxococcus xanthus
atgaagcttcctctcgcgcccgcagtgacggcgctggccttctggggttgttcgagcaactcggcgaacacgcgcgcggatgacagtgccatcggtggttcgggcacggagacgacggcgcccgagtccgtggacacgtcttctgaatgggatgaccgcagcgcgggtgaggccgcggacgtgacgaaaaacgagcgccgggacaggcaggacgcgcccaccgtctacgacggcgaggccaccggtggcagtggccccggcatgggcgcgggcacctcggtgacgacgccggatggcgagaagtacgacgtgcaggacggcccgctcctgggtggccagcagagtgaagaggcccgcaaggatggcgtgggcggctccggcaacatccagcgcgagccggtggacggcaagtccgacgtcaaggagctcgacgccagcgacgtggagacgcgggaagtggaagctgacgaggttgaagtcgacggcaaccgttga

SEQ ID NO: 2419 - DNA, 498 bp, Myxococcus xanthus
atggccagtggcacgcaggtgagcgtgacggtccagggccgcaagcagggggggcgcttccgcttcggcatgttcggtcccgactacgagctgggccgcttctccggtgtcggtatgtcggagacgcccatcgcggacgaggtgcttccgtcgggcttcgctggctacgtggagctgagcgtcgcgaaggggaatcccaacgagctgctcctgctgggcagcgtggcggcgcagtacttcggctttggcaggacggacacggatgtgtccgctggcttcgaattgccgggcggcaggacgcgggcgttggggcgcgtggtgctgacgggcctgggggacaggccgcgttactcggcgggcgtggagctgcgccagcgcatcgtcaaccacgtctatgcctggggctccggcggaaccgttcattttccacagccggacggcacgctcgtgcgaggtgtcaccgcgggcgccggcgtcggcgtggacttccagcgctga

SEQ ID NO: 2420 - DNA, 612 bp, Myxococcus xanthus
atgggagtcaaccaactcggaagcctcccgggggacagcgtcttcaagaccaacggacgcaacgtcatccggtcgcccggtgggcaggtggaccgctcgcagacctgggtcaacgttggcgtcccctacgtcatggaggactccgtctatgtcgatggcgcaaccactccgacgctgacgttgagcccgggagtcacgctgcgcttcggtcgcctgagctacttcgagatcggcacgggagagggtggcaacctgcgtgccgagggaacggccgaggcccccatcacgctgacggccgacgcggagttccccatgtctggccattggcagggccttgcgttcggcgagatggcgacggccgccagcaagctgacgcaggccgtggtcgagtacggtggcgcgcccgcgagcgatgggaacccaaacgcgaacgtcagggtcattgttgacaaggggcccatcattacccagaccacgcttcgtcactccatggggtgtggaatcactcgcgcgacgacccccaactatgacaccttcaccacggatttcaccgcgccgagcttggggaacgtgttctctgataactcaggttccgcgcagtgcggcccttga

SEQ ID NO: 2421 - DNA, 540 bp, Myxococcus xanthus
atggtggccaagggctacgccgtccgcgcgccctgcatgtaccgcggcccctgccccgccctggtgaaggagacggactggtgccacgccgagcgcgcctggcccatgcctcgcgtggtggaggagctggcgcgcgcggcgagcctgcacaaggaatcgctgaagatgagctacctggtgctggcccccaaggacgaggcgtggccggagctgacgcccgggcggctgttccgcatcgtctccgagcccctggagggcaagggccggcaccgctacatcggctgtggccccgagggccgcgtgggcctggcgatgcaggagcgccaccgcaacgagcgcaacgagcgcttcctcaagctgaaccggggcgacgtcatctccgtgacggagacggagcccaagggtgacgggctcgcgctcgacgagcgcaccgaggtgcgggtggtggctcccgcgggcaagggcgttccacccccgcctccggaggaggacgcgccttcgagcccgggaaccggcccgcgcccgggcgcgccctcctga

SEQ ID NO: 2422 - DNA, 1128 bp, Myxococcus xanthus
atgggacagacccaggacgcggtgaagagcttccagaaggggctctccattgctccgaatgacgtggattgcctcctggggctggttcgagtgcacctgagcaccggcgcggcggcggatgcggaggccgccgtgctccgcctgctggaggcgaagccggaccacacggaggggcaggcgcacctcgccatgcttcgcgcccaggcgggcaatccggaggcgctggagtccctcaaggcgttggccgccgcgcccaccgcgggctacttcgagcgcttcaacctgggctcgctgctgttcgagcgcggggacctggcgggagcgcgcgccgccttcgagtccgtgctccagatttcccccggcagcacccacgtccatttcgaactggggcgcatccgccttcagcagaacgagccggatggcgcggtgtcgcacttcctgcgggccgccgagggcgcgccacaggaggccatgccgctgctgatgctgtcgcgggcccatgccgcatgcggccaattggggctggccatccaggccgccacgcaggcgctggagaaggcgcggggtgggctccagcgcgcggtgctggaggacctcttcaaactgtacctgtccgccggcagctcggatggcgccaagcgcgtggctcaggagttgcgcaagctggacccttccagcatcacctatctctacctgctcggcctggcgacgatgagcgctggcgccttcgccgaggccaaggacgtcttcgcggaggtgctacggcaggcgcccggaagctggcaggcccagcacgcgctggcgcagatgcacctcgccctgggcgagcgcgccgaggcggtgaagctgctggaggcggctgtggccacggtgccgacggaccccggtcccaccaacgacctcgcggtggtgctgatgcaggacaacgaacactcgcgggtcgcggcgttgctggcgcccgtgttgggcgcgcacccgaatgacgcgggcacgcacctcaacatggccctggggaccttccccgcggacaaggagctctcagcgcgccacgcgaagcaggcgcaggcgctgggcgccgaggacgtgcgcgcgcgtgccgagcagttgttgaagcagctcggcgcctga

SEQ ID NO: 2423 - DNA, 744 bp, Myxococcus xanthus
gctctcatcacggggggaagccgtggactggggcggaacatggcgctcaagctggcggcccggggcaccggcatcatcctgacgtaccgcaccggcgcggacgaagcggcggcggtcgtgaagcagattgaagcagcaggcggcaaggcggtggcgctcccgctcgacgtgggggacacgcggggcttcggcgccttcgtggaagcggtgcggacggagctgggccgtcacttcgggcgcgagcggctggacttcctggtgaacaacgcgggcatgggcatccaagtcagcttcgcggagacgaccgaggcccagttcgacgcgctgatgaacgtccacctcaaggggacgttcttcctcacgcagcggctgttgccggtgctggcggatggggggcgcatcctgaacatctcctccgggctcgcgcgcttcaccttccctggccacgccgcctacgcgaccatgaaggcgggcgtggaggcgctcacccggtacctcgcgaaggagctgggggcccggaggatttccgtcaacgtgctcgcgccgggcgcgaccgcgacggacttcgggggcggcgtcgtccgtgacaacccggagctgaacaagacgctggccgcccaggttgcgctcggccgtgtgggtcagcccgacgacatcggggatgcggtcgccatgctgctgtcgccggagagcgcgtgggtgacgggccagcgcatcgaggcctcgggcgggatgatgctctga

SEQ ID NO: 2424 - DNA, 786 bp, Myxococcus xanthus
atgaaggaagtgctccaacacatcgccgtgcgcgaggcgcgcttcgcagcgcaccccttcttctccgacatgcggatggaccgccccattgaacaggtgatggccttcgcgccacgcctgaccttctgggtgatgacgttccaggacgtgctgcgcctcaacgcacacttcatccaggacgcgcacctcaaggcgctggccacgcggcaccatgccgaggagggcgggcatgaccagtggttcgaggacgacatctccgcgctcacgggcggctcgctgagcatcggcaccatgtacggccgcgcgcacgtgaagacgcgtgacgcggcctacgccatcatcagcgaggtgtaccgcccggtggatgaccggctgcgcatcgtcctgctgtgggcgctggagtccaccagccatgtcttcttcagccgcaccgccatcatcagcgcggcgcagggcgcggacgaccggctgaagtacttctccgaccaccacatgcaggccgaagcgcagcacgccatgttcgaacaggagctggcggcggagctggaggccatgcagttgtccccggaggtgcgcgcggacgccctggccatggtggaccgcatctacgcggcgttcgacaccatgttcgacgggctgcgcgtcaacctggagcgggagcacgccgaggcccccgcaccgggcctccaggcgcacaccgccaccgccgaagtcctccccctggagatggaagaggacctggaaatcatcgtcctggaggaggacggggaagcccgcgccgcctga

SEQ ID NO: 2425 - DNA, 528 bp, Myxococcus xanthus
atgtcgttccagggcatcgaagtcatcggccagtcgattctcgccatcgtcaacggcatggagctcgcccagtcacgcgcgttgcgcatcctgggggagaacggcatcgcgccgctgaaggcggatgcctggtaccccatgcccgccctgctgaagtcgttccggctggtgttcgacaagattggtcccagcacggtgagaaccattggccggaagattccagacagcgcgcacttcccgccggacatcgacacgctggagaaggggctgcgcgcggtggacatggcataccggatgaaccaccgcggcaagggtgccatcggcggctaccgcttcgagccggtggataagcgaaacgctcgcatggtgtgtgacaacccctatccgtgtgacctggacctggggctcatcgaagccattggcgaccggttccgtcccaaggattcactttgggtgcgtattgaacatgaggccaagagttgccggcggcgcggcgacagtgcctgcacgtacagcatcaattggtag

SEQ ID NO: 2426 - DNA, 1014 bp, Myxococcus xanthus
aacgtcgaggtggtggcgcggggcctggagacgccgtggggcatcgcgtggctccccggaggcgacgcgctcgtcaccgagcgcccgggccgcatccgcctgctcaaggacggcgtcctccagccgcggcccgtggcgacggtgcccgtcgcggacgccgcggagggcggcctgctcggcatcgcggcccacccgaacttcgcgaacaaccgccagttctacatctacgtcaccacggacgcgggcggcaccgaggagaaccgcatcgagcggtggacgctgtcggaggaccacaccacggcgacgcacgagcgcgtcatcttcggcggcatcgcctccgccaagtatcacgacggtgggcgcctgcgcttcggctcggatggcatgttgtacgcgggcaccggtgacgcgagagacccggaccgctcgcagaacgcgaacgacccggccggaaagctgctgcgcctcacgccggagggagcggtgccccaggacaatcccatccctggctcgcccgcgttcctcaccggcatccgcaacctccaggccttcgactggcgcgatgcctccacgctgtacatcgcggaccacggccccagcggtgagacgctgcgccggggacacgacgaggtcagcgtcgcccgccgcggtgacaacctgggctggcccggcatctactcgtgcgagacgcgcgaggggcaaatcacaccgtccatcacctacaaggacgcaatgcccccaggcggcgccgccatctacaccggaacggccatccccgaatggaagggctcgctgctcatcggcacgctgggctcacgccacctccagcgcgtggagttcgcgccggattcgagccgcgtgaccaggcacgaggtgtacctgcgcaacacctacggccggctgcgcgaggtcatcatggggccggatggccacctctacgtcaccaccagcaactgcgacggacgcggtgactgcggcccggacaaggacgtcatcctccgcctgaagcgctga

SEQ ID NO: 2427 - DNA, 678 bp, Myxococcus xanthus
tctaaagcttccccgcgggcaccgcccccgaagctgggcaccttcacacggcagggcaacaccgcgcgcttccagcccgcgcctggcgtcaccttcacccgcaacggccagcccttcacgggcggagcgctccagtcggacgagcagggcacgccggacgtgctcaagctcggcaacgtcagcttccagctcatcctccgaggcgacaagctgggcgtccgcgtgagggactccggcgcggcggcgcgcaagcagttccagggcatccccacgtacccggcgagcaacgactggcgcatcgaggcgcgcttcgagcccgcgcagacgcctcggatgctgcaggtccccaacgtgctgggaaccatcgacgagatgaaggcccccggcacgctcgtgttcacggtggcgggcaaggagcaccggctgacgcccgtggaggacggttcgggcaagctcttcatcatcttcgcggatgagaccaaccgcgacgcgacctacggcgcgggccgcttcctctccgcggacatgcccaccgacgggcgcgtcgtgctcgacttcaaccgggcctacaatccaccctgcgcattcacgaagttcgccacctgcccgctgcctccgcgcggcaaccggctcgccacgcgcgtggaggccggcgagaaacgctacgcggaccactga

SEQ ID NO: 2428 - DNA, 309 bp, Myxococcus xanthus
tctaaagcgcccaacgcgctgaagtacagcccggcggagagcaccgtgagggtgggcgccgagggctccgagcgcgaggtggtgctgcgcgtccacaaccgtggcacgcccatccccgcggaggacctgccccacgtcttcggcgcctggcgccggggccggcgcgccgccagtgacgcgggcgcgcccagcggcctggggttgggcctcgacatcacccggcagattgtccgggcgcatgacggggacgcgcaggtggcctccagtgcgacggagggcacgaccttcctcattcgcctgccacgatga

SEQ ID NO: 2429 - DNA, 600 bp, Myxococcus xanthus
atggcgtcagagaagctcatgttcgctcagtccgtggaagcgctcttcgtgcgggcgctcgggccgtatctcacccgggatggacgccagcgcttgaaggcggtggggctcgacctgtcggagccgctgcgcccccagtacacattggagcagtggcgcgccttccttcgcgtggcggcgcaggatgtcttcccggccctgccgccgcacgaggccagcttcgcgctgggcgcgcgcttcctccagggcttccggcagacgtcggtgggccgggccagcctgtcgctcgtcacccagttggggccgcggcgcacgctggagcgggtgccgtacaacgtccgggccggcaacaacttcaatgaggtccgcgtggaggagtccacgcaggacagcgccacgctgtggatgaaggacgtcacggcggacacgccggacttcgcggcgggcttcctggcggagacgctgcggtcggcgggcgcggggcatgtggaggtgaagcccatcgccttcgacggcacggcggccaccttccgcgtcacctggtcgaaggccgccagccgggcgcccgtggccggtgccggtccccgtcgcgtccactga

SEQ ID NO: 2430 - DNA, 1056 bp, Myxococcus xanthus
atggcccggttgttcgtcgaggacctccacgtccggctcggcgcgaatgacatcctgaagggcatcaccgccgacttccgagatggcgaggtggtggcgctgctgggccgctccggcagcggcaagtccacgctgctgcgctccgtcgccgggctggagacgccggtgcgagggcgcatccacattggcgagcgcacggtgttcgacgcggcggcgaaggtgaacctgccgccagagcggcgtgacctggggctggtgttccagtcctacgcgctgtggccacacaagacggtgttcgacaacgtggcctacggcctgcggctgcgcaagcagccccgcgagcaggtggagcgggccgtgcgcgaggtgctccagggggtgggcctggaggggtacggcgaccggttccccagccagctctccggtgggcagcagcagcgcgtggcgctggcgcgggcgctcgtctacgggccgccgctggtgctcctggatgagcccttgtccaacctggacgcgaagctgcgggaggaggcgcgcgtgtggattcgcgcgctcatcaagcggctggggctcaccgcgctcttcgtcacccatgaccaggtggaggccatggccatcgccgaccgcatcatgctgctggacggtgggcggatggtgcaggacgggacgccggagcagctctacacggagccccggagcctgttcgccgccgacttcatgggggtgaacaacaccttgtccggccgtgtggtggagcggcgcggcggcgaagcgcggctccaggtgggaagccagtcattgtggggcctgcggcgtggggacggctccggtggcgacacggccaccggcgtcatccgcgtggaggaactccaactggcatccgggcccggggagaaccggctcccggccgcgctggtgaactccatctacgtgggcgggcgctgggagcaccagttccatgccgcagggcagacactgcgcgcctcgacgcgccaggtgttggccccgggggcctacacgctcgcgttccccaaggagcgcctctggattttctga

SEQ ID NO: 2431 - DNA, 4329 bp, Myxococcus xanthus
atggccccgcaaatcagcctcgacttcgccacggagtacgcggcgcatccggcgctggcaccgttccatccggtggtgcgccgctggttcgcggagcggctgggcgagcccagccgtccccaggtcgagggctggccgctcatccaggcgggccaggacgtgctcatcgccgcgcccacgggcagtggcaagacactgacggcgttcctcgccgcgctggacgcgctcttccggctggcgctggaaggcacgctgccggactgcacgcaggtgctctacgtgtcgccgctcaaggcgctgggcaacgacgtgcagaagaacctgctccagccgctggaggagctgctcgcccgggcccgcgcggagggcttccgtccgcaggagctgcgcgtccaggtgcgcagcggagacaccccggcctccgagcgcgcccagatggtgcgccgtccgccgcacatcctcatcaccacgccggagtccttctacctctacctcacggcggagaaggcgcgcgccacgctgcgctcggtgcgcaccgtcatcgtggacgaaatccacgccctggcgcgcgacaagcggggcagccacttcgcgctgtcgctggagcggctcaaggcgctcacggacgcgaggccccagctcatcggcctgtcggcgacgcagaagccgctggacgccatcgccgggttcctcaccggcgcctcccaccgggagtgcaagcgggtggaggtgggccacctgcgcccgtgggatttgacgctggagattccagacgcggagctgtcgtcgctggccagccacgagatgtgggggcaggtctacgaccggctggtggagctgacgggggcgcaccgcacgacgctcgtcttcgtcaacacgcggaagatggcggagcgcgtggcgcacgacctgggtgaacgcctgggggaaggcaccgtggcggcgcaccacggcagcatgtcgcgcgaaatccgtctggccgcggaggagaagctgaagtccgggcagttgcgggccatggtggccaccgcgtcgctggagctgggcatcgacgtgggcaacgtggacctggtggtgcagttgggcagcacgcgcgccatctccgtgttgctccagcgcgtgggccgcgcgggccaccacaaggcgggcatctccaagggcatcctcttcgcgatgacgcgggacgagttgatggagtgcaccgcgctcctcaacgccgtgcgcgagggggacctggacgcggtgcggattccggagaagccgctggatgtgctggcgcagcagattgtcgccgcgtgcgcctgcgaggagtgggacgaacgcgcgctcttcagcctcttccaacgcgcgtactcgtaccggaacctcacctgggaggagtaccagggtgtgctggagttgctgtccgaaggcgtggcggcgcgccggggccgcgcgggcatccacctccacagagaccgggtgaatcagcgcctcaagggccggcgcggcgtgcgcatcaccgcgctcaccaatggcggcgccatcccggacaccttcaccttcaacgtcaccgccgagcccgagggcaaggtggtgggcacgctggacgaagacttcgcggtggagtcctcgcccggggacatcttcctgctgggcagcaccgcgtggcgcatccagcgcgtgtcgggcagcacggtgcaggtggaggacgcgcgcggcgcgccgcccaacgtgcccttctggcgcggcgaggcgccgggccgcacggacgagctgtcgctccaggtgggccgcctgcgcgaggaactcacgcagcgcgaggatgcgccggcgttcctccagaaggagctgcgcatgccgccgcccgcggtggacgcgctgatgggctatctgcgcacggggcagaagatgctcgacgccgtgcccagccacaccaccgtggtggccgagcgcttcttcgacgaggcgggcggcatgcagctcatcatccacgcgcccttcggcagccgcatcaaccgcgcgtggggcctggcgctgcgcaagcgcttctgccgctcgttcgacttcgagcttcaggcggcggcgacggaggacggcatcctcctgtcgctgggcgagcagcactccttcccgctggcggagattttcgacttcctccacccggaccacgtagaggaggtgctggtgcaggcggtgctccaggcgccgattttcggcacgcgcttccggtgggtggccactcggtcgctcgcgctgcaccggatgatggggggcaagcgcgtggcgcccaacctccagcgcgcccgcagcgaggacctgctggcgtcggtgttcccggagcaggtgggctgtcaggacaaccacggtggtggcgacctggagttgccggaccatccgctggtgacgcagaccatggatgactgtctgcgcgaggccatggacgtggacggcctgcgcgaggtgctgcgcggcatgcgtgatggccgcatccgcctgctggcgcgcgacgtgccggagcccagcctcttcgcgcacgcgatgattcacagccagccctacaccttcctggatgacgcgcccgccgaggagcgccgcgtgcgcaacgtggccctgcgccgcgccatgcccgccgaggacgtgacggccttcggagcgctggacgcgacggcgattgccacggtggtgacggacgccgccccgcccatgcgcgacgaggacgaactgcacgacgcgctgttgcagttgattctactgcccgcagcggaggtgccgcgcgggatggcgacgcccctgttcgagcagggccgggtggcgtggatggacctgcccgcgggccgcttcctggtgtcggcggagcggggcagcgcgctgcgggtgctcttcccggacgcgcccatgcagccgccgctgccggtgctgtcgcatgaccggcccgtggagcgggacgccgccgtgctccaggtggtgcgcggacgcatggagatgctggggcccaccacggtggcggagttggcccggctcatcgtgttggacgaggactccgtcaaccgccatgcaccagttggaggcccagggcaacgtctggcgccgtttccgccctggaggtcccctgcggatgggccagcccccgtggagtggtgcaaccggcgcctgctccagcgcatccaccggctgtcggtggggcgaatgcgcaaggaaatcgagccgatgagcgcgcaggacttcatgcgcttcctcttccgctggcaccacctggaggaactggacgcgctgcgcggctccacggggctgctcaaggcggtgcggctgctgcaggggtacgaggcgccggcctccgcgtgggagcgcttcctgctgcccgcgcgcatgcgcggctacacgccagacttgctggagcgggcctgctatgccggtgaggtggcctggggccgcctgacgacgaaggaggcgaagcccgcgccggggcctcgccggggcgcgccggtgacgccgccggagcccgcgcccacgcgctcgcgagcgtcgcccacgcgcaacgcgtcgttgaccttcacccttcgcgaggacctggagtggatgctcaccgcggcgcggcctcacgcggtgctggcggacggggacgtgtggacgccgccggacctgagcgcggccgccaaggacgtggtgacggtactggagcggcgcggcgcctgcttcttccaggacctggtgtcgcgcgcgcggcgcctgcccgccgaaatcgaggacgcgctgtgggagttggtggcgcgcgggctggtgaccgcggacgcggtgcagaacctgcgcgtgctccagagcccggcgcaccgcaagcggcagaagttgctccaacgcggtggtcctggccgctggagcctgctgacacccgcggagccgaagtcgcaagacgatgtgctggactcgctggcgcgcctcttcctccaacgctacggcattgtctggcgcgacctggtgatgcgtgaggcgctggcgcccacgtggcgcgagctgctcttcgtgtaccgccgcatggaagcgcgcggcgaggtgcgcggtggccgcttcgtgtcgggcttcgtgggcgaacagttcgccctgccggaggcggtggacatggctcgctcggtgcgccgtcagcctccgtccggtgtgcgggtgcagttgtccggtgtggatccgctcaacctcacgggcgtggtgacgcccgggccgcgggtgccggcgatgccgggcaacgtggtgacgtacgtggacggcgtgccgcgagatgtcggcgcactggacgatacggccgacggcaacgttggagaagacacggaagatggcggcgaggcgatggcgagctga

SEQ ID NO: 2432 - DNA, 948 bp, Myxococcus xanthus
ctgcgttcgctgtacccgcccctggagccctaccgcaccggacgcctgcgcgtctccggtgggcatgaggtgtacttcgaggagagcggcaatccggagggcaagccggtgctcttcgtccacggggggccgggcggaggaacggacccgcgccagcgccgcttcttcgacccgaccgcgtaccgaatcatcctgttcgaccagcgcggctgcggacgcagcaccccacacgcgagcctggaggagaacaccacctgggacctggtggccgacatggagcggctgcgcgagttcctggacatctcccggtggcagctcttcggcggctcatggggcagcaccttgtccctggcctatgcccagacacatcccgagcgcgtctcggagttggtgctgcgcggcatcttcctgctccgcaagcaggagattgactggttctatcagcgaggcgccagcgccctcttcccggatgcgtgggagtactacctggagcccattcctctcgaggagcgtggggacctgctggcggcctaccaccgccggctgatgggttccgacgtgaaggcgcagcaggaggccgcgcgcgcgtggagcgtgtgggaaggacgcaccagttgcctgtaccccaacgcggagctggtggcgcgcaacagcggggacaccttcgcgctcgccttcgcccgcatcgaatgccactacttcgtcaaccggggcttcctgcgcagcgacacccaactgctcgacgacgtgcaccgcatccgcaaaatccccgccgtcatcgtccaggggcgctatgacgtggtgtgccccccagagagcgcctgggccctgcacaaggcgtggccggaggcggagttcgtcatggtgtccgacgcggggcactccgcgaacgagccgggcaacacctccgcgctggtggatgccacggaccgcttccgcgggcgctag

SEQ ID NO: 2433 - DNA, 2298 bp, Myxococcus xanthus
atgccggggcttcccatcatcccgtcgcagccggccgccgcgccgctcgagcgggcctctcgcgaggaccccacgattcccggagacgtcatcctccgcttcgaggaagcgggcctgacaccggagcgcgtgctggcggcggtgcagcgcccgggcttccgcgcggtgcacaagggctacgcgagtgagtacgtgcacctggtgggctacgagccgctggacggcaaggcggtgacggccgcgaagacgcaggagtgggcggcgcagctcgcccaggtgccgggcgtgacgtatgcggtgcgcaacgagcggatgcgggcgacggcggcgccgaatgaccggggctacagccttcagtggcactaccccacgctcaacctgccggccgcgtgggacctggtgccggacgcgtccagcgtggtggtggccgtcctcgacagcggcatcgttccgcacccggacctgacgaatgtgttgccgggttacgacatgatttcggacccggagaacgcgggtgacggcgatggccgggacagcaatccgcgggacgaaggtggggacacgcccagcggcggctcgacgtggcacggctcgcatgtggcgggcaccatcgccgcggacacgaacaaccaggtgggcgtcgcgggcgtggcctggaacgcccggctgctcccagtgagggtgctggggaagaagggcgggagcagcttcgacatcgccgcggccatcacctgggccacgggcggccccgtgccgggcgtaccgcccaatcccaatcccgcgaaggtggtgaacatgagcctgggtggccgcgcgccgccgcaggcgctgtaccaggacgccatcgacgcggccttgggacgcggggccatcatcgtcgtcgccgcgggcaatgaggacgtggatgcgcgcaccagcacgccgtgcaaccagcagaacgtcgtctgtgtgggctccaccagtcttgcgggccagcgcagcagcttctccaactacggcgtggacgtggacgtggtggcgtctggtggggagatgcgcgaggacctgaacggcgacggctatccggacggcgtgctgtccacggtgctggatgagaacgggcagcctgcctatgccttctcgcagggcaccagcatggcggcgcctcacgtcacgggcgtggtggcgctgatggcggcgtcgcggccggacctgacggccgcgctggcggagcgcatcttgaaggaaaccgctacgccgctcaccaacgcgcagtgcccggagggctgcggcgcggggctcgtcaacgcgcgagcggcgctggcccgcatcgccaacgtggaccctggcacgttggaccctcagcttaacgtgacgacgtccacactgttcttccggggcagcgggacgcagccgctcattctcagcaacgtgggcgggaaccggggcggcgatttgacggtatcggccagcgtcagtgggcccaatgcctcggcggtgtcattcccgcagggcaacacggtgcgggtacccgccttcagctcggccccgttgagtgtggcggtggatgcatccgggctggccggaggggacaccgtggtgacgctgagcctggtgggctcggggacggcgggctcggcgacggtggcggtgaagattggcgtggcgggcgcagccaatgacctggacgccctgattgcgttcgtgtggcaggacgcgcgaggggagtggcaggcctcgaaggacgccatcgcggtcgcgcgcgcctcggcggactacgcgtacagcatctccctggcgccgcggacgtacttcgcgttggccaccatcgacgacgaccaggatggcaacttcttcgaggacggcgagcgcaccggctactggcgcaacgtggactccttcgagccgctggagctggaggcgggtgaccgcatcgagaatgtgagcttcgacctgattcccctggcgcccatcgatgatgacccggcgctggtggtgggcagtgcgtgcggctccaacgtggactgtcccgggggcgtgtgcgtgacggactatccgggcgggtactgctccatggattgcaccagctccgcgtgtccggcgggctcgcggtgttacatcgtggattcctcctcgggcctcaaggcatgtctggcgacctgcacgcggcaggtgggaacggggcagggggactgccgccccgggtacgtctgctacagcgacggcacgggttcgggagcgtgccagcccaactgccgcacctctggcctgacgtgtgggctgggacggacgtgcacggccagcggcttctgtcgctga

SEQ ID NO: 2434 - DNA, 1278 bp, Myxococcus xanthus
atggatggcgccaaaatcaaggcgttcaagcacccgaacccggactccaagccggcgctcaccgagctgaagcgctgcacgctggacctggagctgcgcaacggactcaagggcaactacggggttcagcgcggttgcgtcctgcgcgagggcttcgtgaacaaggccgcgccctactgggccaccgacaagacgccggagagcgtcaaggtgtgcgccatcgacgcgcaggagcgcacccacaatccgtggaacatggcgtcctgtgagacgtcccgcttctccaccgaccgcagctgcggctgcggcgtgggcatgcgccgctgcgagacgcccgccatcaccgcgcaggacatccgggacgtgcacagcctgcgcgtggccgccttcaacgacgagccgctgcgcatcgccgagtcggtggtgcagcgcgacgagccctacttcaacatcctcaccacgcgccgctcgttcgtgaacggcaccttgtccgagtacttccgcagccagcagggcgtgggcgtcttcaacgtgacgacgcccaccgcgcagggcgccgtgccggtggtggcctacaacgacacggaggcttgggcggagtacacgcgtgacgaggggcacgcgggcgtgctcaccacgccgtccttcctctaccgcttccccacgcaccgcgcgcgggtgaaccacttctacgaagccttcctctgcaagacgttcgcgccgccgccgggggcttcgtcgcccgcgccggaggacgcgtgcaaccgcgagaacaacctggcggtgcgctgcggctgcaactactgccacgccaccatggagcccaccggcgcgcactggggccgctacgcggagcgctccgcgcagttcctcgcgcccgaccagtttcctcgctacgacccgaagtgccgcgactgcgccctcaacaacgacaccaactgcggcggcgagtgcagccagtacatcatgcaggcctacgacggtgatggtgccagcagcctgggcatgctcaagacgtacctgtaccgcacggcggacgaagagcagaacatcgaggccggtcccgcgctgctggtgcagaagatgctccagtcgggtgacctggagcgctgcacggtgcggcgcatctggaccgagttccttggccgcccgatgacggcggaggagcagcgcctgtacctggtgcccttcgcacaggacttcgcgcgcaacggccaccgcctcaaggcgctcatcgagcgcgtggtgacgtccgacgcctaccggaggattgactga

SEQ ID NO: 2435 - DNA, 660 bp, Myxococcus xanthus
atgcgccgcctcgtcttgaccgccgcgctgctcgcgctggcctccggttgcacgaaggatgacacgcagcccgcggacggcatcatcgagcccatcgccaacccgcatcagcccggggacttcacgcccctgccggaccccgaggaccaggacggcagcgtgggccgcgccccgcgccggctcaccgtggcccaactggacgccgccatcgtcggggcggtggggcagcgctggagcgagctggactcgcgcgccacgtccatggggcgcgcggactatgccctggtggtgagcgagaacatcgagcccaacctggtgttcgccaagttcctggaggacggcgcgcgcaaggtgtgcatcagccaggcgtccgcggagatgcgcatgacggacgcgtcggcccgcaccatgggccggctgctgccggagaagtgggatgacctgacgaagctgaccgacgcggaggtgcgcgcgcagctcgtctacatgtccacccgcttctggggttcgccgctgtcgggcgaggagctcacgaagtgggcgtccttcttcacccaggccgcgagccgggtgcagaccctctcctcttccaagcgccatgagacgttggccgtggtgtgtatcgccatgctgacggacccgcgcttcatcacctactga

SEQ ID NO: 2436 - DNA, 233 bp, Myxococcus xanthus
atgggctccaccctgctgggtgggctgcccttccgcgccttcgcccaggcggcggagatggcgccggcggaccgctgcttcgtgttcgtctacttcaacggtggatgggaccaactgctggccttcgacccgagggacccgaccgagttcacggcggaccgtgcctcggagacgaaaatcctcccgggctacgaccagatcaacgacacccgcttcgaggcccggccgctcat

SEQ ID NO: 2437 - DNA, 1173 bp, Myxococcus xanthus
atgagcgaagcctcctacgacgtcgccatcatcggaggcggcccagcgggcgcggccatggccgtggcgctgcgagacctggcgcccttcctgtccgtcgtcatgctcgagcgcacggattacgacacgcaccgcccgggcgagaccttgtcacccgacctccgcatccccctgtcccggctcggtgtctggagcagcttcctgcgcgatggacacctggcttcgcgcgggacgtcctcgtgctggagccgcgcggagccccgcatccaggacacgcagatgtcgccctggggctccgcctggcacctggaccgggcacgcttcgacgaacggctcagcctggaggcagccaggcaaggcgtccgcgtccttcgcctgacgaccctgctggacgtcgagtccatcgcgaaggagggctatcggctacacctctcccaacgcaagacaggcgcgctcacgctgcgggcgcgcttcgtcgtggatgcgaccggatggaaagccaccttcgccatgacccagggcgcgcggcgccgcatccgcgaccgctgcttcaccgttcatggcgcgttccagctccggccaggcgaatcgttccccacggatgccctggtggaatcatgtccggaaggctggtggcactccgcgcgactgccctcggactgtgtcgccgtcaccctggtgggggatggagattccttgcacggactgcgctgggcgacgccggaaccatgggcggccctgctcgaacaagcccccgtcacccaggcgaggctggcggcctgcgacttcgccggagagcctctcgtcgcggcgcccgtgctcgtcggcgaactcgaccagatgcacggtgagcgctggctcgcagtgggcgatgcggcctgcacccatgacccgctgtccgcccagggaatcttcagcgcgctggactccgcgctcctcgccgccgaagccctggagcaatacctgcgcggtgaagaggatgcgctctgcgcctacgagcaaacgcttcatctgcgcttcaacgaacacctgcacaggcgaagccgcacctacctcgaggagcaacggtggcccgacgcgcccttctggaagaaccggcacaccgccttccccgccctgacgcccgccgcggggcagcgctccgcgccagcgcccaccgggctcgcgccatga

SEQ ID NO: 2438 - DNA, 507 bp, Myxococcus xanthus
atcttcaccgccgtggtgtccgcgctggcattggcgttcatcgggtggattctgctggtgcgcggcggcggcccggtggagggggtgaacctgcgcttcctcccagcggtgaacgcggggctcaacgccacggccgcggcgctgctcatcggcgggtgggtggcgatcaaacgaggcgcgcggcaggtccaccagtacctgatggtctcggccttcaccgcgtccgcgctcttcctggtctgctacctgtcctaccacttcgtgcatggcgacacgcgatacgtgggggactggcgcgggctgtacctgtgcatcctggccagccacgtgctgctgtccatgcccgtggttcccatggcgctggtggccttctacttcacgtggcgcaaggacttcgtgcggcaccgcaaggtgacgcggtggctggcgcccatctgggtctacgtgtcggcgacgggcgtcgtcgtgtacttcatgctgcgtggcagcgcgcccgccgtcctgtaa

SEQ ID NO: 2439 - DNA, 2082 bp, Myxococcus xanthus
cgggagggcacgtcctgggtcgaatccctgcggcccctgcccggagcactggaaggcaatgaccaggtcctgcggcacggcgcccaggtgttgtgcgcggccttcagtccttcgggcgactggctcgccacgggctcctgggaggacgagcggaacgtccgcatctgggacgtggccaccgggacactcatccgccaactggcggggcacgagggcgaagtgcgcagtgtcgcttggagcccggacgggacgcggctggcatccggctcacgcgaccacgacgcgcgcatctgggacgtcgagacgggcgagctcctccacgccatgacacgccaggagggccaggtcacgtcggtggccttcagtccggacggccgctggctcgccgcggcgaacctcgggtggcgggtgcggctgttcgacgtgacctcgggccggcaggtgcgcacgctcgaagggcacgaacagtccgtgttgacggtcgccttccacccctcaggccggtggctggcgtcaggcgcgtcggacgatacggtgcgcatctgggacctggagacaggcacgcagaccgcccacatccgcagcaccacctccgtctcgtccgtggccttcagcccggatggcgattggctcgtgctgacctccatggacggcctcatccgggtggagacggcaggctggacgcgcgtgcccggggcgctgggccagggtccctattcccaggtcgcctggctcgaaggcgcacggctgggcgcactcgccttcaaccgggtggagctgctcgacgcgaggaacggagaggtgctccgggcgcatccctacccttccgacggccgtgagcgcggcgccgccttccttccgtccggcaagcgcttcgcgctgaccgcggcgaatgggcgcacgcatgtccgcgacctggatgcggaccccagccctaccctcctggccgaacaggaccgcgtcatgaacctgtggggacatgccgaaggggcatggggcattacacgcctgcactcggagacgcgcgtcatcgattcacaggggcaggccacggcactgcctcccggctctccggcggcctacgcgcagacctggcaggtcagtcccgacggcgcatggctggcccaacccgagctgtcctcacacgagcggcgctaccggctgggcatcctgctgctcgacgcacggagcctcgcccccgtgcgcaccctgctggcgccccctggcgaacaggccgcgaaggcccagacgctcctcgtcaacaaacttccgattgccttctctcccgacgggaagctgctggcggccgccatcgaagagggcgcggtgcacctctggcgcgtggcggacggcaccttgctgcacaggctgcgcggacctggaggtcccatcacctgggtggacttcacgccggatggcacctgtgtcgtgtcgggacatgcggccagcgaacgcgtgtacgtccacgaggtccggggcggcaaggtcatcgtcaacaccgaagcggtggtcgagccttcccccgcctatgccgcggcggccagcgcgcccgtcatcgtcgtgggccgagcgtcgggagagctcgtgctcatcacgctccccaccggcgcccaacaggtcctgacggtgagccaggagcccgtcatcgccctgggactctccgcggacggcacgcgcgtggcggcctccagcatggatgagtgcgtgcgggtcttcgatgtgcggacaggcgcacgcctgcatgagcttccccacccgtccctgcccttctccatcgcgctgagcagcgaggtgctcgtcaccctggccgaagacatgcacacgcgcgtcttcgacctcgccacgggcgaactgcgcacggagctcgatggaagcgtcaccacggacgacttcgtgtcccagcgctactgggagacgctgggcgaaggcccggtcaccttccacctgcaacgagacaccacgccccgggcccactttcaggatgcgatggaaaagactctcatcctgaaggacgggctcgtcctgggacggggccgcaccgagcgggacttcttgtacgtcctgaagctccacataccctga

SEQ ID NO: 2440 - DNA, 750 bp, Myxococcus xanthus
atggcgacgcggaacaaggccggagcgacgggcgggcccaagcggggacgcccccggggccggacggagcagggccacgagacgcgccagcggctgtatgcgaccgcgctggggttcatctccgcgcggggctacgaggccacccatctgcgggacatcgccaaggaggcgggggtgagcgttggcctgctgtaccggtactttcccagcaagcgcgccatcgtcctggcgctgtacgacgagttgtcctcggcgtatgcggcgcgcgccgaggcgttgcccgccggctcctggcgggagcgcttcctgttcgcgctccgggcaagccttggcgtgctcgggccgcaccacgaggtgctcaaggcgctgattcccgtgctcgtgggcggagaagaggacggcctgttcgcgccgcagacggcgttctcccggcagcgggtccaggccgtctttgaagacgccgtcgcgggcgccacggacgtcccgagcaacgccacggtggcccatgcactgggccggttgctctacgtcgcgcatctggccgtggtgctgtggtggctgctcgacaagagcccacgtcagcgcgccaccgagggcctggtgtcgatgctggcgggcctactgccccctgcatcgctcctgctccggctgcctggtgccggaagcatggtcctgggcgcggacgccctctgccggcaggcgctcttcggcgaaccggcgcgtgcccaggcggaagaggtgacgcgatga

SEQ ID NO: 2441 - DNA, 903 bp, Myxococcus xanthus
atgaataccgcgacgctgggacatgccgaggtctccctgaacgggaaaggcacaggcgagccgcgcgcgagcaccgcatccctggtgcctcccgaggtgggccgcttgcgcttcgatgcggcgcggacgctgtggctctggggcatgctcatccccggtgtcaccgtggggctcgcggcggcgacgcccaccacggtggtggtgtcgctcctgctcaccttcgcgacgctctgcctgggacactcggtgggcctgcatcgcggcgtcatccaccgcacctacgaggcgggccctctcacacgcggcgtgctcgcgtacctgttcgtgctgagcgggctcggcggtcccctgtcgtgggcacgcctgcatgcggtgcgcgactactggcagaaccgtcccgactgtccgccctacttcgcctatgagcactcgatggcccgcgacttcggctggaacctgcacctgcgcttcgagcccgcggatgaccgggccctggcgcggcttcctccagacgtattgacggacccgtggctgtgcttcctggagcgcacctggccgctccacgtgctcgggctgacgggggtggtgctcgcggtgctgggccccgaggccgtggccctctgcgtttgcgcccgcacggccgccggcatcctcggacactgggccgtgggctacgcggcccatgtctggggagagcggcgctacgccctgccgggcgcggcggagagcggtacgaacatctgggtgcttggcgtgctgtcgttcggcgagggcttccacaacaaccaccacgccttcccaggctccgcacgcatgggccagaaggcacacgagctggacctggggtggtgggtcatccgagggctttgtcggctgggactcgtgcgtgatgtacgtacttga

SEQ ID NO: 2442 - DNA, 990 bp, Myxococcus xanthus
atggtcggatgtggtcccaccggctccgagtccgagccgtcttcttcgtccacggagcaccaggacgcgccgctcaccaccacggacgtggacgtggccccggagtgtcagggcctgctcaccttcgtcaacatggcgtctctgtccacgctggacgcctatctccccagtgacgtcgcccagaacctcgtcggctaccgcgcgacggcgcccttctccacgttggcgcaggtgtccgcggtccggggtgtcggcccggtgcgcctgactcaaatcgagggtggcgcccgcgcgctgggctacatcaccagcacctgcgccggcatcctggacgagctcgcgctctccaccgatgacgcggcggccctggtcaacctggtgaacaccatcgacagcagcgcgttgtacgccgtcctgccgtacgcttggaacggcgcaacgaacctcctcaacctgcggcccttcacgtcggcgcaggccatctccgaggtgactggcatcggcacggtcagcctgcgcaacctccgcaacgcggccacgcagggctacgccctgacggcgctcatcgccgtgatcaacgcgcaggaggagagcctgtggacgtcccgcctgagccaggacttcgacatccaggacgtgattgacggcgctcacggcaatggcgaattcaagagcgcgcagtgcttcggcatcgaccccagcctcttccccgcgggtcaggtctggactgtccgtcccgagctggccacgggcaccgaggtctacaacgagatcaagagcacggtcgactacgcggaccgcaacgagccgctgccggagacgctctacaccgacggtctggcggagctgcaggcgcgcaccgccgggcgcaccttcaagggctgcttcatcagctacgggaagggcccgtggggcggcatccaggtcaagttctacgtcgacacggtgaccggataccgcatcctgtcggagcagcactggtcggagtga

SEQ ID NO: 2443 - DNA, 1740 bp, Myxococcus xanthus
gcggaccggggcgcgtgggcgcccaacacctcgtacaccgtgggcgacatcgtctcccacggaggcaagggctacgactgccgacagtcgcaccagtccctcgtcggatgggagccgcccaacgccccggcgctctggctggagcggacagggaatccgccgccggatacccaggcgccctccgcgccgccgtcgctcacatccaccgcgaagacgcatgagagcgtgtcgctgtcctgggacgcgtccacggacaacgtgggcgtcaccggctacgaggtcttcaccaacgcgggcacgtccgcctccgcgtcgacggcgggcgccacccacgtcacggtgacgggcctggccgcgaacaccacgtacaccttcaccgtgagggcgcgcgacgccgcgggcaaccactcggcggcaagcagcgcgcacagcgtgacgacctccccgcgccccgcgcccgacaccgtgccgccctccgccgccagcgccctgcgcgccactggcgtgagcaacagcagcgtgtcgctgtcctggggcgcgtccactgacaacgtgggcgtcaccggctacgaaatcttcgtcaacgggagcgcgtccgcgtccgcgaccacctcgggcgccaccagcgccacggtgacgggcctcgccgcgaacacgacctacgccttcaccgtgaaggcgcgggatgccgcgggcaaccgctcggcggcgagcaatagcgtctccgcgacgacgacggggacgcagcccgtggggaacaaaatcatcgtgggctactggcacaacttcgacaacggctcgacgaacatccggctgcgggacgtctccgcgaagttcaacgtcatccaggtcgccttcgccgagcccgtgggtggcccgggctccggacgcatggccttcacgccgtacaacgccagcgtcgcggacttcaaggcggacatcgccctgctcaagagccagggccgcaaggtgctcatctccattggcggcgcgaatggcaccgtccacctggatgacgccaccgcgcggcaggacttcgccaccaccatgcaggccctcatcgacacctacggcttcgacgggttggatttggacctggagggcagctcgctgtcactcaacggcggcgacaccgacttccgcaaccccaccacgccgcgaatcgtcaacatcatccaggccacgcgccagctcctcaaccagaacggcccgggcttcatcctcaccatggcgcccgagacggcctacgtccaaggcggcatggccgcgtacggcggtccctggggcgcgtacctgcccgtcatccacgcgctgcgagacagactggcgtacctgcacgtacagcattacaacaccggcaccgtcatggcgctcgacggcagggcctacgcgcagagcacgccggacttccacgtgtccatggcggagatgatgcttcaggggttccccgtcggcggcaacaccggcgtgatgttcccgtggctgcgcccggcacaggtactcatcggcctgccgtcgtcaccgcaggcggcgggcggcgggtacacgacgccggccaacgtgcacaaggcgctcgactacctgctcaagggacagtccttcggcggaacctacgtgctgcgcaaccccgccggctaccccggcttcaagggcctgatgacctggtccatcaactgggacgcgttcacgaacttcgagttctccaacagccatcgcgcgtacctggacacctccccctag

SEQ ID NO: 2444 - DNA, 726 bp, Myxococcus xanthus
atggcgatcgagaaggcgcttctgctcatcgcggatatcggcggatacacccgcttcatgagtcaccaccgcttcagcctcgcgcacgcgcaggagacggtggcgcagttgctcgaggccgtcattgatgcctcgggcccactcaagctcgcaaagctcgaaggagacgcggcgttcttctatgccgtgggcgacgattttcccgccttcgcccggatggtcgcggacatccgccgcgccttcgtttcacggcgagagcagttcatcgccgaccgcatgtgcaagtgcgacggctgcatgcaggtcagctccctgacgctcaagttcgtggcccacgccggtgaggtcgccttccagcgcgtgaagcacctcaccgagctggcgggcgtggacgtcatcctggtgcaccggatgctgaagaacgacgtccccgtcacggagtacgtcctgatgaccgacgccgtgcaccaggggctcgcgccggagctccgccagctcacccagggactggagcacgacttcgagggcatggggcgcacggcgacgcactacctggacctgaacgcgttcgtcctcgcggcgcccgagcccgtgcgcccgagccttccgcgcaagctctgggccaagctgaagctggagctgagctcgatgaagtacgtgctgggcctcaagcaaccctgcgagaacttccgcaacgtcgaggtcgtggacgcccagaagccgtag

SEQ ID NO: 2445 - DNA, 507 bp, Myxococcus xanthus
cggggagacatcacccaggtccaagcggatgcgattgtgaacgcagccaactccacactgttgggaggcggaggcgtcgacggggccatccaccgagcggccggccccgggcttctggccgaatgccgaaccctgggccgttgccctccgggagaagctcgcatcaccggaggccatgcccttcccgccaaacacgtcatccatgccgtggggcccgtgtggcaaggaggaagcagcggcgaggagaccgtgctcgcgcgctgctaccggcgggccttctccctgatggaacagcacggccttggcaccatcgccttcccgtccatctccacgggcgcctatgggtaccccatcgagcgggcggcgcgaatcgccttgcgcgagattctggccgcgctccagcgcatgccgaccctccagcgcgtcaccgtggtgctgttcagcgacagggacctcgacgtgtaccaacgcgcacgtcaggcgctggagcccaccccttcggcctga

SEQ ID NO: 2446 - DNA, 420 bp, Myxococcus xanthus
atggaccaggcgcttggcggcgtgagcattccggcgccgcgctacgcggaagtctcgcgggcgctcgcgaaggaccgcttctggctgaaatacggcccgtgggccgcgctcgggtccttcgtggggcagggcgtgttcctgggccctctgttcgcaccggaggcgcccctgcggttgtgggccattgtctcggcggtcggagtgctcttcgctggcgggctcgtcttgaccctgcgcggccttcaacggcgggccatcgaagcggccagtgtcggcgtggacgcgtggatggcgcagcggcgggctcgcatcgacacggagctcaaggacctgaccaccctcctgtggctcttccccgcgatgacggtcgcgatggcggggactgcgtttctgatgcgcgacaaggggctcccgcggagt

SEQ ID NO: 2447 - DNA, 369 bp, Myxococcus xanthus
atgccccccgagcgaatcaaccgcggtgatgtgttctgggtggagcccgacgactcacgaggcccggtccccagctattcgcacccccacgtggtggttcaggacgacgtcttcaatcactcacgcatcacgacggtggtcgtgtgtgcgctgacgtcgaacctgcaccgggccagcgagccggggaacgtgctgctcgaagtgggagagggaaacctccccaagcagagcgtcgtcgtcgtgtcgcaggtgtcctcggtcgacaaggcgcgtctgggagagcgaatcggggcgctgtcggacgcgcgggtggaacagattcatgccgacctgcgcttccagcaggtgtcgttattcgcgaggccgtga

SEQ ID NO: 2448 - DNA, 285 bp, Myxococcus xanthus
atgggggcgctgttggctgtggggtgtggtggcccgctgcccgaggagtcgcaggagccgcaggagtccatcgccattccagagcagtacctggaacaggcggaccccagcaccgaggatggaacggtcagcgccctcaaggcctgctgcttcatccggtgctccgataaggtctggagaggtccctatcccaatgtcgtgtatggcaactgccgcaaccacggaaagtaccagtgcgcgaagcgggggctgggctatgcgggtgcggattggaaggactgctag

SEQ ID NO: 2449 - DNA, 357 bp, Myxococcus xanthus
atgcaggagctcgaacacgcccggaaggacgaagtcgaaagcctgcgcaccgccatcctggccgcccatccaggcatcgcggagcgcatcaagtggaacgcgccaagcttctgcttcaaggacgatgaccgggtgacattcaagctgaagcccaaggactgcgttcagctcatcttccaccggggcgcgaaggtgaaggcgacgcaaggcttctccttcgacgacaccagcggcctgctgcagtgggccgccccggaccgagccatcgtcacgcttcgcgacctggcggaggtgaaggcgaagaagaaggcgctgtgccaggtcgtggtccagtggatggaagcgacctcgcagtga

SEQ ID NO: 2450 - DNA, 1059 bp, Myxococcus xanthus
atggtcgaggagcaggcggagtcggtggcgccggcgaccatcgagcaggacatcgtcggtggcaccaccacgaccatcaatgagaatccgtggcaggtgtccctgcggtacggcggccactggtgcggtggctccatcctcaacaaggattggattctgaccgcggcgcactgtgtggatggctacgccgtcaccagcatcgtggcgggctccacctcgagcacgagcacgagcacgggccagacgcgcaacgtggcgcagaccatcattcatgaagattacggcgcttccggcaacgacgttgccctgctccgtctggccacgtcgctggacctcaatggcaccaccgtcgcggccattccccgcatctcggcggcggatgccgcgagcggcgccaccgacccggccgtggtcgcgcgcgtgacgggctggggtgcgacctcctccggtggttcggggtccgccaccctgcgcacggtggacgtcaacgtgatttcgaacacggaggcgcagcaaagctaccccaatgagtacattggcccggatcagattggcgccaaggcgccgggcaaggactcgtgccagggcgacagcggtggtccgctcaccgtcaatcacaatggcacccgcaagctcgcgggcgtcgtgagctggggctacggctgcgccgacgcgcgctacccgggtatgtacgcgcgcgtgtcgtacttcgagagctggatcgactccaagctcagtgggacgaccccgccgcccggcaccacgctgctgacccagacgaacctgtccggctcgtccagcacctggaagcacttcgccatcacggtccccagcggcacgacgtcgctcaaggtggtgcagtcggggggctcgggtgacgcggacctctatgtgcgcagcggctcgcagcccaccaccagcgcctacaactgccggccctatctggccggcaacgaggagacctgctccttctccaacccccaggctggcacctggtacgtgtccgtgcgcggctattcgtcctactcgggcgtgtccgtgacggccacgattccgtaa

SEQ ID NO: 2451 - DNA, 1572 bp, Myxococcus xanthus
atgaacgtcatcaagacgcctgaggtagccacgaaggaaggcaaggtgcagggcctggtcgaagggaagatttctgtcttcaggggcattccctacgcgatgcctcccacgggagcgctgcgctggaaggcgcccgagcgcgccactccatggcccggtgtccgcgaggccttcaacttcggcttctccgcgtaccagtcccgtcaggcctgcatcgaggccggcggtggcgaccccggtgagatgcacgaggattgtctcttcctcaatgtgtggacgcccaagctggatgcgggcgcgaagctgcccgtggtgttctggattcacggcggcgccttcgtcatcggctcgggccgtctgccgccctatgaagggattcatttggcgtcgcgcgacgtggtgctggtgaccttcaactaccgcctggggcacctgggcttcttcatgcatccggcgctggagaaggagaatccgggtgggcccgcgaacttcggcctgctggaccaggtgctggcgctggaatgggtgcgcgacaacatcgcgcggttcggcggcgaccccggcaatgtcacggtgatgggacagtcggcgggcgccaagagcgtcctgtcgctcttcacgtcgccgcaggtgcgggagaagaacctcttccgccggggcgtggccatgagcgcgtacgtgctccaggagaagcccctggcggacgcgcggctggccggcatggccttcgcgtggaggaacgggctggaccggctgctggccaccatgaaggacctgcgcgagctggggccggagaagttctggatgctccccgcggacaccgcgaacgcgcccagtcccatctacggagactccgtccttcccgagcctatccgcgagaccttcgcgcgcggagagcaactctccctgccgctcatcctcggcagcacgagtgacgactccagcgtggtgtcctcgttcggaatcgaccccgccaccatccttgaacgcctgggcgccttcgccgagtccatccgccagctctaccccgacgtggacgatgaccgggagattggccggcggatgtgtcgcgacttcgtcttcacggtcatgccccgcttgctggccacccgccacgcggagcgcggcgccgcggtgtggcgctactacttcgagtaccgcgcgaagatgcttgcccctcggcagcgtctgggtgtgcctcacgggggcgaggtgccctacttcctggagacggccgcggacgtgccgcccaccggagcgttgttcacggaggaggacgggacgttcatgcgtcacctggtggattcactggtccagttcgcgcgcacgggcgcgcccgggcccgtggcccaggtgagctgggaggggcacacggagacgcaagacaggctgctgaggctggatggctcaccgcagggggtgacggacttcgagcgagacatcctgcaagccgccgaaaacctcatgcccttcctggacagcctcgccaagccgcctccgccgaagctgccacgcgccacctcggccgcggccaccgcgagcagcaacacgcggcaggaaggccgcccgtag

SEQ ID NO: 2452 - DNA, 294 bp, Myxococcus xanthus
atggttcacaaccactcgttcggggatgccaccctgacgcgggagcaggtggagtggccgggtaccgcggactccgtgcgcgacttgatttcgcggcggtacacggagtggcgcgccgccatcgagcaactcagcgacgaggacctccgctccacggagcgcacgcgttggccgctgcaaggcaagcccttcggagacatcgtggcctgggtcaacctggagttgatgaagaacgcggcggagattggctacgcgcgcttcgtcctggccgttgcgccccggccgccagggtaa

SEQ ID NO: 2453 - DNA, 720 bp, Myxococcus xanthus
  unsure (1)..(720): unsure at all n locations
ggtatggtgccgcccatgcgcagcgcgtctggcagtgcgacgaagttcctcgcgncggtgggggtcgcggggncggtggggtcctccctcgcgctggacgtggtccgtgcggacgtccgggtggccgcgaaggcgctgcccatgctctgtttactcctgtggcagtggccgccgctcggacgctacgggcggtggatattcgccggcctggcgctgtcgctgctgggagacgtgctgctggacgtggggccagggctgttcctcccgggcctgggggccttcctgctggcgcacgtgagctacgtcgccgcgtacgtcacggtgtcacgccagccgcggtggggcagggcgctgcccttcgtgttcctggcggtgggggccagcgtctttctctggtctcacctgggtgagatggcgctcccggtgacggcctacgtcgccgtcatctgtgcgatgacatggcgtgcgtgggccatgctggggagcccggggctttcgcgtcgcgcgcaggggttcgcgctcgcgggggcgctgctattcgccgtcagtgacggactgctggcgctcaagctcttcgtacgcccgctgccgggctccggctacgccatcatgctgtgttactgggccgcgcagtggtgcatcgccgtctccgcgcgcgagccccgccagtctggcgcgtcgcgaacccttcaggccgaaggggtgggctccagcgcctga

SEQ ID NO: 2454 - DNA, 801 bp, Myxococcus xanthus
gtgaagcgctatctgcggctgctgggcattcaactcaaggcgtcggggctgctgtccctgcagtaccgcgcggacttcttcacggaggggctgacgtccctcttctggaccttcacggcgctggcgccgctgttcgtcgtctacggtgagcggcccaacatcgagggctggaatttcggcgaggcgttgctcgtggtgggctggttcacgctgctgcagggcatcctggagggcgccatcaaccccagcctcacgggggtggtggagcacatccgcaagggcacgttggacttcgtgctgctcaagccggcggacgcgcagttcctggtgtccacgcagcgcttccagccgtggcgggccttcaacgtgctgacgggaatcgggctgttcgtctacgccttcatgcacctgggacggtggccgtcggtgacggggctgctggcctccgtgctgctgctggggacgagtacgctcttgctctactcgctgtggattctgacagtgagcgcggcgttcttcgtcgtgcgagtggacaacctgacgtacctgttcacctccatcttcgacttcgcgcgctggccgtcctccgtgttccagggcgtggggcgcggcgtcctgacgatggtgttcacgtacgtcatcccgctggcgctgatgacgaccttcccggcgcaggccatgctggggcggctgccgccccagtcgctcgtgggggcggtggtgggcgcggggctcttcgcctggggctcacgtcaggtgtggctccgctccatccgccggtacacatcggcgagcagttga

SEQ ID NO: 2455 - DNA, 2275 bp, Myxococcus xanthus
gtgtggggcaacgttgcccctccgttggtgcaaagttacgattgctcctcattcgatgattcgcctgaacgacatcctccaacgggtttcccagtaccaccccgaccccgacctggacatcatcaagaaggcctacgtctattcggccaaggtccatcagggtcaactccggaagtcaggcgagccctacctcgtccatccgctcgaggtcgccggcatcctgggcgagctcaagctggacgaggcgtccatcgtcaccggactccttcacgacaccattgaggacacgctggccaccgaggaggagctgacggagctcttcggttcggaagtagcccacctggtagacggcgtcaccaagctgtccaagttctccgcatccgccagcctgtcgcaggaggagaagcaggcggagaacttccggaagatgatcatcgcgatggcgcaggacatccgcgtcatcctggtgaagctggcggaccgcacgcacaacatgcggacgttggatcacatgtcggaggagaagcaggcccgcatcgcgcaggagacgctggacatctacgcgccgctggccaaccggctgggcatctcgtggatcaagacggagctggaggacctgagcttccgctacgtcaaaccgcaggagttcttcgcgctccaggcgaagctgaacaagcgcaagaaggagcgggagaagtacatcgaggacacgtgcgacctcatccgctccaagctggccgagcgcgggctgaagggcgaggtgagcggacgcttcaagcacgtctacagcatctacaagaagatcaagtcacagggcatcgacttcgatcagatccacgacatcatcgcctttcgcatcatcgcgcccaccgcgccctcctgttacgaggcgctggggctcgtgcacgagatgtggaagccggtgccggggcgcttcaaggacttcatcgcgattccgaagcccaacatgtaccagtcgctgcacacgaccatcatcggtccgctcagcgagcgcgtggaggtgcagatccgcacctcggagatgcacaagatcgccgaggaaggcatcgccgcgcactggaagtacaaggagggcaaggccgtcatctccaaggatgacgagaagttcgcctggctgcggcagctgatggagtggcagcaggacctgaaggacccgaaggagttcctggagacggtgaaggtggacctcttcaccgacgaggtcttcgtcttcacgcccaagggcgacgtgcgctcgctgcctcgcggcgccacgccggtggacttcgcctacgccatccattcggacgtgggcaaccggtgcgtgggcgccaaggtgaacgggaagatcgtcccgctccgctacaagatgaagaacggggacacggtggaggtgctcaccagcccccagcagcacccgtccaaggattggctcaccttcgtcaagacgagccgggcgcagcagcgcatccgcggcttcatcaagcagcagcagcgcgagaagagccttcagctgggacgcgagctggcggaccgcgagctcaagcgcttccagctcaacttcaaccggttgctcaagtccggcgagatgaagaaggccgccgtggacctgggcttccgtgtggaagacgacatgctggtggccattggctacggcaaggtgacgccgcagcagctgtcgcaccggctcgtcccccaggagaagctcaacgccgcggaggccggggggcgcgcggatgccaaccccgccgcgacaacctccggtggagccggcaactcggtgctgccgggcctgtcccgggtcaccgacctggcgaagcggctggtgggccgcagcaaccgcagcggcgtacagattggcggcgtggacgatgtcctcgtgcgcttcgggcggtgttgcaaccccgtccccggagatcccatcgccggcttcatcacccgggggcggggcgtcacggttcacacggtcggctgtgaaaaggcactggccacggaccccgagcggcgcgtggacgtgtcgtgggacgtccggggcgacttcaagcgccccgtcaccctgcgcgtcctcactgcggaccggccgggcctgctggcggacatcaccaacaccttctccaagaagggcgtcaacatctcccaggccaactgccgggccaccggagatgaccgggcggtgaacactttcgaggtcatcatctccgacctcaagcagctcaccgacctgatgcgaaccatcgagcggctccagggcgtctactcggtcgagcgcatctaa

SEQ ID NO: 2456 - DNA, 396 bp, Myxococcus xanthus
gtgcgccgcatggctcgcaaggcaatccactccgaccaggcccccaaggccattggcccgtattcccaggcggtgcaggtggacgccgggaagatgaccttcctctccggccagattccgctcgaccccgccaccatggagatggtgcagggcgacgtcgtcgcgcaggcggagcgggtgatggagaatctgaaggccgtgctcgccgccagcgggctggacttctcccacgtcgtgcgctgcaccatcttcctcaccgatttgggcgacttcgcccgggtgaacgaagtctatggccgctacttcaccggcgctccgccggcccgcgccaccgtgcaggtgtccgcgctgccgcgtggctccaaggtggagattgacgccatcgccgtctcctga

SEQ ID NO: 2457 - DNA, 234 bp, Myxococcus xanthus
atcatggaagccgccgttcgcatcgacacccgcggggccttgtgccccatgcccatcctggaactcgccaaggccatgagagcactggcgccagggacgctcgtggagctcgtctccacggatcgcgggttggaggcggaccttcccgcatggtgcgaggctacggggaatccactggtgcgcatggagcgccgggagcgcctctacgtgggctgggtgcgcaaggcgggttga

SEQ ID NO: 2458 - DNA, 1452 bp, Myxococcus xanthus
atgcgcttccaccgccgtctcctgtccgccgccgtgctgctccccctggtcctcgtcattggagcgaccgagccggagcagcccgcgtccgccggtgcctccgaagacggaggggtgggggtcgccgcccctgacacgacgtcgcatgccgcccaggcggacgcggggacgtcgggggccgccacggcgtcccagggcgcccagcccgatgcggggacttcaggatccgccgccgtctccgccgccgcggtgctcgggggcgagtcgccggatggtggactggcggcgcttgccgcggagccggggatggtgccccccgtgcccgtgccctcgcgcgagaaggcgccgcccatcgccacggtgaagtcgcttcccaggtccgcggacctcatggcccgcgcggcgctggaggacgggaagctggtggtgaaggagaagggcggaaagaagaagcagctcaccatcgacccggtgctgcaagcgtcgctgacgcagatcctccgcaactacgagacgccctacggcgcggccgtggtgctggagccgtccaccggacgggtgctggcgttggcggagcactcggcggcgaggccggagctgcgagggctgccggttcgcgcggtgttccccgcggccagcatcttcaaagtcatcaccggcggcgcgctgctggaggccggcgtcacaccggatactgaagagtgcttccacggcggcaagcggcgcatctccgagaagcacctgcaggacagcgagcgggacagctcctgctattcgctggcgctggccatgggcaagagcgccaacgtcatcttcgccaagctgacgaacaagcacctcacggtggactcgctgcgccgcatggcggcccgcttccgtttcaaccgtgagattgagttccccgtgccgacggatgtgtcgctcgccgccatccccgaggagaccttcagcctggccaacacgggcgcgggtttcggggacgtgtacctgtccccgctgcacggcgcgctcgtcgccgcggtggccgccaacgagggccgctgggtggaccccatcctcttcgagcccgaaggaccggcgccgctgctcccggtggaaggcgagcccgtcctcacgccggaggttgcgaaggacctcacggcgctgctggaggagaccgtcaccagcggcaccgcgcgcgccgtgttccgcgagcgtggcttccgcgtggatgacgccgtgggcaagacgggctcactggcggaccgcgagcccttccgcgactactcgtggttcgtgggcttcgcgcccaaggacaacccgcgtgtcgccgtggccgccatcatcgtcaatgacccgaagtggcgcatccgaggcacctggctgggccgcgaggcgctccgcctggggctggagcgaatgcccgcgccggtggagatgacggccccggcctccgccgctggcaagcactga

SEQ ID NO: 2459 - DNA, 279 bp, Myxococcus xanthus
atgcgcgtcgatatctactcgaaacccaattgctctctctgtgacaaggcggccgccgtcgtggagtccgtgcgcgctcgcatccccttcgagctgcggatcatctccatcctggaggatgcggaggccttcactgcctggcgttacgacatccccgtggtcgtcatcgagggggtgccagccttcaagcaccgcgtggacgccgcggagttcgaggcgcggctgcatgaggtcaaaggtggcacaaccattgctaaatccgctgcccagcatgggtag

SEQ ID NO: 2460 - DNA, 999 bp, Myxococcus xanthus
gcctcgaaaagcggcggagaaaagttcacgcgggaaggtggaacggtgggtgtgcgaaggaagcgagtgggcaaggccggacagccgcccaccgtgctcgtcgtcgagccacgagcagcagacctggagcggacccggctgctcctggcggaggccggcttccgggtggtgcccgtgacacgcttcgacgcggcggtgccgctcttcgaggtcatccgcccggccgcggtgttgctggccgcgcaggcgcctgacttcgcggccgtccaggtcgcgcgccggttgcggcagctcagccatggcgcggtgccgctgctctacctggtggatgagcgggacgccgaggcccggcggtactgcctggagcgggggcagtgcgtggacctggtgccccgttcgggcagtggctcggagctggcgacgaagcttcacgcgcaactgaagctgaaggacgcggtgctgcgggcggccgcgggggaggaggccggcacggcccaggcgctgcatgacccggtgacggggctctacaaccggcccttcctgctggagttcatcagcctggaggcgcggcgggcggagcgctacggcggcggattctccgtggtggcggcggaagtggggggctggtcggcctttcgcaaggagtttgggcgcggcatggcggagcgtctgctggtgtacagcgcggtggtgttggggcagacggtgcgcgacgcggacgcggtggcacgggtgggggactgtcaattcgcgctgatgctcccgggaacgcccgcggagtcggttccggaggtggtatcccgcgtggcggcgcgcttcgacacggcccgcttccaggtggaggggaaggtggtgcgcacgtcgctggagctgggaacggtgagcttcccggattcggtgggcacgcccacgcagctgttgagcgcggcgcagcaggacatgcgacgcgcgcgtgagtttcgccggatggtcgggagcacgtcccggttgtcggtgtga

SEQ ID NO: 2461 - DNA, 1689 bp, Myxococcus xanthus
atgcagcgggcgagtggaggcgaggggatggaccggatcgcggtgctggtggtggatgacgaagaggcggtgcgcacgtttctgtccgagctgctcggaagtgcggggtaccaggtgcgctgtgccgcgagtggcacccaggcgctggagatgctctcagggggctccttcgacgcggtgttgctggacgtggtgatgccggagatgagcggcctggaagtgctgcgccgttaccagtccatgggcggcggcgcgcccgtcatcgtgctcagcgcgctggcgggggcggacgacgccgttcgggcgatgaagatgggcgccagcgactacctggccaagccgttcggcaacgacgagctgcaggacgcgctggcccgggccctggggacgcgggcgccggagcgtcaggccgtggcgcccatcctgccctcgcgcacggtgctgccggtggtggattcggcgcaggagcagcgcgtcctcatctccacctcgccggccatgcgccgcgcgcgtgcgctggtggagcgcatcgccgacacggacgtccccgtgctgctgctgggtgagtccggtacgggcaaggaggtcatcgcgcgggagattcacgcgcgcagccagcggcgcaaccgtccgttcatcaaggtgaactgcgcggcgctgcccggcgagctgctggagagtgagctgttcggccacgagcgcggcgccttcaccggcgccactgccgagaagcccggcaagttcgaactggcggaccagggcaccatcttcctggacgagattggcgaaatggccatccggctccaggccaagctgctccaggtgctccaggacgaggagttcttccgcgtcggtggcaagaagagcgtgcgcgtggacagccgcgtcgtcgtggccaccaaccgcgacctggagaaggaaatcgcgctgggcaacttccgcgaggacctcttctatcgcctcaacgtggtggccatccgcctgccggcgctgcgcgagcgccgcgaggacgtggttccgctgacggaccacttcctcaagaagtacggccgaggctacctcagcggcgtgtccgagctgcccacggaggtgctgcacgccttcgcggactacgactggccgggcaacgtgcgcgagctggagaacatggtccgccggctgtgcgtgctgaaggacccgacgctggtgctcgacgagctgcgggccgcggtccgcgctcccgcgagcgcgccgtccctgcccacgtcctacgccggtgacgacggtggccccttcggccgcgcgcacgacgagggcttccgcacgccgccgcccgccgtgcaggtgctggagatgccgtcgcgcggcgccgcctttgggctggcgtccgtcgcgccgctggcgccgcccgcgcacgcgcccatggtgatggagtccgcgaacgcggtggtgtccgcgccgcgctacgtcaatcccttcgacgtgccgcagccgccgccgccgcccgcgcccaccggggagctgtcgctgaaggacatcggcaaacgggcggcgatgctggccgagcgcgaggcgattctggccatgctccaacgcaccgcgtggaacaagcggcgcgcggccaccaagctgcgcatcagctacaaggcgctcctctacaaaatcaaggagtgcggcatcatcgacccgcgcgcgagcgcggagctgtag

SEQ ID NO: 2462 - DNA, 337 bp, Myxococcus xanthus
atgacgcctcctctcgtcctcctggggtctgggtacacgctcacgcggctcgccgtggcggaggcccgcgccgggcgcgacgtgctggcggccacgcgcgacgccgcgcgccgcgccgagctggagcgcgccggagcccgcgtcaccgacctggaagacgcgctgacgcgcacggcgggggctcacgtcgtcgtctcggtgccgcccgacgcggggttggacacgcgcatcgcctcggcgctggccggccaggttccagcgcggctcgtctacttgtcctccaccggcgtctatggccgcgcgcggggccacgtggacgctttagagcacactagat

SEQ ID NO: 2463 - DNA, 720 bp, Myxococcus xanthus
gtgttttacggccccgtagattcgcctccgcacatgtcacagctcctgctgtcctccctcgccgtggtctgcccgaactgtgacgggtacaactcgcctcgctcggctgcctgtgtgctctgcggccaggcgctgggcgagcccgctgccgcgccccgccccgccgccacgaagccgcccctcgccgtcgcccggcctggtacgccgcccggcagccggccggtcgcggtgtccaatttcccaggcggcaaggtggcggagccggtggttccgcccgcgcccagcgccattccgccgggcctgcgcccctcggcccggacgccgccccccaccgccgcgggcctgacagtggaacggccgccgcagcagcgcacccccacggcccccccgggcatcatggcccgtacgggcggcgcgtcaggcccggccaccacccgtccgcccccgccagttccggacagtgcgatgcccagccgggccggagcggcgaccacggcgccgcgccctgcccctccggccgcctcccggttcgggctcgcggtcatcgcgggctccacccggggtcagcgctacaagctgcctgtcaccggttgcgtcgtgggccgccagcgcggcgccatcctgttcgcggacgacgccttcgtgtcgcccctacacgccaccttcctggtgaaggatggcgcgctgtacgtgcgggacgagtccagcgcctcgggcgtc

SEQ ID NO: 2464 - DNA, 1971 bp, Myxococcus xanthus
atgaagcccaatgtcatcgtggccctgctggtcggcctggtgctcgggttcgttggcggccgcgtcaccactggcccgtccacgaagtccgaagtcgccaaggccgcaccgaactctcccgccgccccggcgccgggtggacgccgtccggtggatcccaccgtgttcaaggtgcccatcgagaactcgccgacccacggcagcgccgacgcgctcgtcaccgtggtcgagttctccgactacgagtgccccttctgcagccgggcgaacgtcaccatcgagaagctccaggagcagtacggcaagaagctccgcgtggtgatgaagcagaaccccctctccttccacccgcgcgccaagcccgcggccatcgccgcgatggcggctggcgagcagggcaagtactgggagtaccacgccaagctcttcgccaatcagaagaagctggatgacgtgtccctggagcagtacgccaaggagctgggcctcaacctggacaagtggaaggctgagctgggcaaccccaagttccaggacatcatcacccgcgaccaggccctggccggccagctgggcgccagcggcaccccggccttcttcatcaacggccgcttcctgtcgggcgcgcagcccatcgccaacttccaggccctcatcgacgaggagctggtcaaggcggagaacctggtgaagggcggcgtgcccgcctcgcaggtgtacgcgaagatcatcgagaagggctccgagcgcgccgcgcccaaggcgcagccgcagcagcccgccgccacggtccgcaaggtggagatcccctcggactcgccctccttcggcccggccaacgccaaggtgaccatcgtcgagtggtctgacttcgagtgccccttctgcagccgcgtgggccccaccctgtcgaagatcaaggagagctacgccaaggacgtgcgcgtagtgttccgtcaccagccgctgcccttccacccgaacgcgaagctggccgccgaggcctcgcacgccgcgcacgagcagggcaagttctgggagtaccacgacaagctcttcgccaatcagaaggccatggatcgcgcctcgctggagaagtacgcgcaggagctgggcctgaacgtcgccaagttcaaggccgccctggattcgggcaagttcaaggcgaaggtcgaggccgacatggccgccggcaacgccgtgggcgccaacggcaccccgaccttcttcatcaacggccgtgagttcgtcggcgcgcagcccttcgaggccttcaagcgcgtcatcgacgaggagattggcaaggcggacaagctgctcgccgccggcaccaagcccgaggagctctacgccaagctgaacgcggagaacgtcgccaacgccccgacggcgcccgccgcggcccctggcgctccggccgagcccccggtccagaaggtggacgtgggcaacgccccggtgaagggcgacaagaacgcgcccgtcaccatcgtcgccttctccgacttcgagtgccccttctgcagccgcgtggtgcccacgctgaagcagttggaggaccagtacggcgggaagatcaaggtcgccttcaagaaccagccgctgcccttccacgccaacgccaagttggccgccgccgctgcgctggccgcgaacgagcagggcaagttctgggagtaccacgacaagctcttcgccaatcagcgcgcgctggaccgcgcctcgctggagaagtacgcgcaggagctgggcctgaacgtggacaagttcaaggccgcgctggaccagggcaagttcaacgcgcagatcgaggccgacatggcgcaggcgtccagcgtgggcgcctccggcaccccgacgttcttcatcaatggccgcacgctcgtgggcgcccagcccgtggacgcgttcaagcgcgtcatcgacgaggagctgaagaagctcggcggcgcggtggccgactcgaagtag

SEQ ID NO: 2465 - DNA, 804 bp, Myxococcus xanthus
atgagcgcccggaccacactgcgcgcctttcccacgctgctgcgggtggggttcgcggaggcggtggcctaccgcgcggagatgctcatctgggtgctgtccaccaccatgccgctggtcaacatggtgctgtggatggcggtgtctcgcgaggcgcccgtggtccgcttcggcgaggcggacttcatcagctacttcctggccaccttcccggtgcggcagctccccacgtcgtggccggcgtgactcatcacctgggaggtgaagcagggaacgctggccatgcacctgctgcgtcccatctccccgctgtgggcctacgcggtggagagtatcgccgccttccccatgcgattgatggtcgcggtgccggtgatgctgctgagcgtggcgctggtggggcagaaggcggtgccccagcacgcgtggcagtggggcttcgtcgtgctgtcggtgattggcggctgggccgtggccttcctggccaacgtggccattggcgcgctgtgcttcttcctggagagcagccagaaggtgctggaggtgtggctggtgctcttcttcgtgtgctccggctacatgtacccggtggagctgctgccgcccacgctgcgcaccatcatcgactggttgcccttccgctatcagattggcgtcccggtggagatgctgacgggggcctatggctgggaggagtccctgcggctgctggcggcccagtgggcctgggtggcggtgctgggggcgttggcggcggtgacgtggaagcagggcgtgcggcgcttcgcggcgttcgggggctga

SEQ ID NO: 2466 - DNA, 1574 bp, Myxococcus xanthus
atgcgcaagggcgtgctgggattcctcaccagcaacgactccgcgatgatcgaggccctggcgcaggtgccgctggaggtgttgatcgtcttcaagatcaccctcttcttcctgcccgcgtacatcgcgctgatgggcttcgatcagattagcggtgaagtgggcccacgctccatgcgctacctcacggtgcgcgcgcggcgctcgtcggtgctgctgggcaagttcctgacgcaggcgacgctgctgctcggcctggtgctcatcatcgacctggccatcttcatctacgcccgcgtggccaacccggacttcagcttcgccgccatggcgctcaacctgctgaagttctggctggcggccatcgtcttctcgctggcctacgtggccctcacgacgctgtgctccagcctgttccgctcaccagcggtgagcctggtcttcaacttcatcctgctgttcgtcttctggctgatggacaccatcggccgggcctccggtgacacgggcaacctgcgcttcctgcgctacctgtccccgtcgtactacgccagcgatctgctgcatccgggcctggcgcagttcggcgcgagcggagccgcctacgcggtcttcgcgttcgtcttcctgatggcggcctacggcatcctgcgcgcgagggacctgtgagcgacgtggccattgaactgttcggcgtctccaagcgcttcggccccaaggtcgccgtcaacggcgtcagcttctccgtgcccaagggcgcggtgtacgggctcatcggccccaacggcgccggcaagacgaccaccttctccatgatgtgcggctacctctacccgtccgagggctcgctcaaggtcatggatgtggaccccaccaccccgggcgccctgaagggccgcctgggcgcgctgccgcaggacgcggtgctgccgcccggctgggaagtgggcgcgctgctgatgtactgggcgcggctgtccgccctggccgagccggagcgtgaggcgcgcgaggccctggacaaggtgggcctcatggaggcctggaacgtccagacacaggcgctcagccacggcatggccaagcgcgccgccatggcccaggccctcatgggcagcccgccgttggtgctgctggacgagcccaccgccgggttggatccgcgcgtcgccgcccaggtgcgccaggtcatccgcgacatgaagggccggcagacggtggtggtctccagccacaacctccaggagctggaggagctgtgtgacgcggccgccatcctcgacaagggcacgctcgcccaagcggggagcatgaatgagctcaccggccagggcgccgagttccgcgtccagattgcgcgcggcagcgtcatcatcccggagctcacggtgatgccccacatcacggacgcgcgcatggagagcgacaccgtgctgcgcgtgcgcttcagcggcggcgtggcgcccgaagaggtcatcagccaggtggtgcgtcacctgctgcagcacgacgtgctcatcctgggcgtcagccgcggccagcgcctggaagatcgcgtcctgcagatgctctga

SEQ ID NO: 2467 - DNA, 1125 bp, Myxococcus xanthus
atgcctctcaaggacctcgtcgtctatctcgggaaccggcgagcgacggggtccctgaaggtggagcgtggggacgtgcgcaagcaactcgaactgcgcgaaggccatgtggtcagcgccagttccaaccagccgcgcgagttcttcggtcagttcctcatcaatatggggcacctgaccgaggaccagttggagaaggcgttttcgacccaggcgcagacgcgcatcttcctggggaagattctggtgatgacggggctggtgccggaagccaccgtgcgcggcacgctcagccacaagttccgggagatgattctcgacgccttccattgggaggacggcgacttcctcttcgaggcggcggacacggcgccagaggtcgcgggactggaagtcagcgtggacctgctggacgtccaccgcgagggcgagttccgggagacggcctggcaggccatccacgccgtcttcccctccggcgcggtccggctctcggtggacgagcgcaagctgcccgagcgaaagcccgggagcatggacgagcgcatcgtccagctcatcaaggaaggcctcaccatcgacggcatcgcgctggcgctgcacgccacggacttcttcctctaccagcggctgtatgcgctctaccgcctggacgcggtgaaggtgtccgacgagccgcccgagtccgagatgtccgtggtggaggaggagaacggagagcggggcatcatcggctcggagacgtcgtcggacgaagtgctccaggccgcgcagctcttcctcgacgcgggcaacgcgcgggacggcgaggcgctggcgcggcgggcgcacgagatgtcgccctcccctcgcacggcggagttcgtcaaggcggcccaggagaagctcctggtgcacctgcggcgggagctggccgacccgcccagggtccccacgctccaggtcgcgcccgggcacctgaagacgctccagctctccgcgccggagcgctacctgctgtcacgcatcgatggacggcgcgacgtggccgccatcgtccacgtgtcgccgctgcaggagctggatgcgctgaagttcttcgccggcttcgtggacgcgacgctggtgaagctgacgccgcgctga

SEQ ID NO: 2468 - DNA, 696 bp, Myxococcus xanthus
atgcacacgaaggccagcaagcagggcctgtgggtgctggccgccgtggcgatggcgctggccctgttggtgaactgtggttcgtctgatgaagaccccaccccggtgcccgacgccggacagacggactccgggacgaacccgatgccggactctggaacggagcccgagccggacgcgggcacggagcctgagccagacgcgggcacggagcccgagccggatgcgggcacggagccgctgtgccagagcgacgtaccttgccgagagcagagcatcgaccggctgaacctgctcacgacgccgtcgacgacggcgatgtacgaggaggaggcgccggcgggcgagttccgttcgtacatcgacgcccgagcgggtggcctcacggtgaaccagtcctacacctacgctcgcttcacgcccgagggcctggcgcgggtcaacatcgacgaccagacgtcgctgggcgaccacggctgggacatcgcgttccgtcgctactacatccggctgaacggaggcacgtccggcccgtcctgcattggcgtggcgcggctgcccacgggcacccgcttcgagaccgtgacgtccgtacccgcggacctgaccttccagtccgacgcctggtacaccgacacgtgtgagttcatcccggacaactcggggctcgcccggccgacgatggcgctgagcagc

SEQ ID NO: 2469 - DNA, 93 bp, Myxococcus xanthus
atgctgtgcaaggagttgctcgactggcgcggcttcgcgaagcgcgacgtgcgcagcaaggcctactgggcggacggcgagcggggcctctga

SEQ ID NO: 2470 - DNA, 333 bp, Myxococcus xanthus
gtgtacagccacccggtgggcaaccagggccacgcgctgggcgcgagcatcgacttccgttcggccagccggcaggaagaggccaagacgttgcgcctcggctcgtacatcgccatcgagctgaacaccgccacgtcggtgccggagtgggacgggcagaaggtcttcgtgatgcaggaggacccggcctacctcaccgaggagggctggaagttcttcgtgtccaggcaggagtcgttctacctcctgggccgcgatgggcagggcgggcagcgaagtcagggcgcaaagggaggcaagggcgtgacgacgcgtggcatgcccatgctctga

SEQ ID NO: 2471 - DNA, 1236 bp, Myxococcus xanthus
atgagccgcatcaacgggaactacgaggtgctgtcggacgaggcgggccgccccatcaaggcgtggacggtgggggttccgttcgaggacgaggcgaagaagcagctccgcaacctgcgtggcctccccttcatccacaagtgggtctcggtgatgccggacgtgcaccgcggctacggcgcgacggtgggaagcgtggtccccaccgtgggggcggtggtgccggcagcggtgggcgtggacatcggttgcgggatgatcgccgttcgcacgacgctgcgggcggaccagctcccggactcgctgcgtggggttcgctcggcgattgagcgcgcggtgccgcatggccgctccgacaacggtggccgcaacgacgtaggggcgtggcgtgtggcgcccgcgcggcaccagaaggagtgggcgcggttggtggaggggtacgaccgcatcgtcgggaagcatccgcgcatcggccgtgggccggagctgtcgcacctggggacgctgggaacggggaaccacttcatcgagctgtgcctcgatgagtcggatggcgtgtggctgatgttgcactcgggttcgcgcggggtggggaaccgcatcgggagctacttcatcgagctggcgaaggaggacatgcgccgctggttcatcaatctcccggacggggacctggcgtacctggcggaagggacggagcacttcgaggactacgtcttcgcggtgagctgggcgcaggacttcgccgcgacgaaccgcgcgctgatgctgcaagaggcggtggatgcgctgcagttgagcggtgagctgcctccgttcgagctgaaggacgcggcggtgaactgccaccacaactacatcgcccgtgagcatcacttcgggaagaactgcttcgtgacgcgcaagggggcggtgcgggcacgagagggtgacctcgggatcatccccggaagcatgggggcgcgttcgttcattgtccgcgggaaggggaacgcggacagcttccattcctgcagccacggtgcgggccgggtgatgtcgcgtgaggcggcgaagcggcgcttcacggtggaggaccacgtgaaggcgaccgccggcgtggagtgccgcaaggacgtggacgtcattgacgagacgccggctgcgtacaagcccatcgacgcggtgatggcggcgcaggcggacctggtggaagtggtccacaccctgaagcaggtcgtgtgcgtgaagggctag

SEQ ID NO: 2472 - DNA, 1017 bp, Myxococcus xanthus
atggtgcgcatcgatggttcattgggtgagggcggggggcaggtgctgcgcacctcgctgtcgctgtcgctggtgacgggcaagcccttcaccatccagaacatccgcgcgggtcggaagaagccgggcctgctgcgccagcacctgacgtcggtgaaggccgcggaggccgtgggggccgcggaggtgtcgggcgcggagctcggctcgcgagagctgaccttccggccgagtgccctggccgcggggaactaccacttcgcggtgggcaccgcgggcagcgcgacgctggtgctccagacggtgcttccggcgctgctcctggcgaaggggccttccacgctgatgttggaggggggaacgcacaaccccatggcgccaccgttcgacttcctccagcgggcgtatctgccgctggtccgtcgcatggggccgtccgtggaggcgaccctggagcgtgccggtttcttccctgccgggggcgggcggttccgggtcgacgtgcgacccgcgccgttgaagccgctgcacctgctggagcgggggcgcgtggtccgtcgcgacctgaaggccgtgattgcgatgattccgttcgacgtggcgcagcgcgagctgggcacggcgggagcggcgctgaagtggcggcccgatgaactccggacggaggaactgaagcgtccgctggggcccggcaacgtgctggtcgccgaagtggagagcgagcacgtgacagaggtcttcaccggctttggtgagcgggggaagcgggcggaggccgtggccggacaggtcgctgaagaggtgaagcgctacctcgacgcggacgtgccggtgggcgagcacctgtgtgaccaactgctgctcctcgtggcgctggcgaagggcggcgtgttccgcacgctgccattggatgggcatgccgagacgcagctccaaaccatcgcccagttcctggatgtgaaggtgaaggtgcgggaggtgtctcgcgaggttcgcgaggtggaggtccgcgcctga

SEQ ID NO: 2473 - DNA, 2211 bp, Myxococcus xanthus
atgtggttcatcggggccttggtggatccgcacgcgcgtgtggacgaggtctcggaggagaacaacgcgcacgctggcgactccgtgacgttcgacgcgcttcccgacttcaccgtggagtcggtggctgtgccctcggtcgttcgcccggagtggcctttttatgtggctgcccgtgtgtgcaacagaggccaagggtctgagcaggcgacggtatatctctatcggtcgtccgacgcacatatcgacaccgacgacgtcgtcatgcgcgaccagtcgtggctctttctcgatgccggacgatgcgaacgcgtcgtgttcgtcggggtgctcggcgaaccgggcacttcgtacctcgcgttcatggtggatccgctgaatgagcggcccgaggctgacgagaccaacaacctcagtgtcgtcagtcctctcgaggtgggctcgattcccgactacgtcgtcgcggcgctgagggcgccggccatggagtcgatcaacgggagccttcctgtgcgcgcgacagtgtgcaaccagggcacggctcccgcgtccgccacgcaggtgcaattccagcttcgtgccagtgagccctccgctgaaggcgtgttgcgtgtctcatcgcggaacatcccggccttggaggccaaccagtgcatcgagtgggaggagtcgctgggctccatggcgaacgcggcgcgaagctggcggctggtggccacggtgaatccggttggtgcgcagacagaggctcattcgggcaacaacgacaggtccgtgaacgtcctgctgggctcctcggcggacctctccgtcacacgcatcgagccgctgacgcacgcgctcgttccgggggcctccttcaccacggaagtcacggtctgcaatacgggaacgctctccgcgtcggcgctggcggttcatgtggcgctgtcggatggcccggaccctcgggcaggcattcgcgtggggacccgggcctttggcgcgctaggcaagggttgcgcggtgcttcccgtggtggggacggttcccacgcaggggttgcccgccactgtccatgtgaaggcctcggtggagctcgttgcgcctgtcgggggagaggcacacctggagaacaatgcgctgacaggccccgtggtggggctggggaccgggcctgacctggtcgtgacgcggatcgtcgcccaggggcgtgcggcgtggcccgaagggaagctgcctgtctcggtgacggtctgtaatcagggcaatgtgcggacgccgcgagcggccgtccagacgctcttcgtgccggaggtgctcccggagatctcggcgggcatccagggggcgaagctgtctgtcgagtcgttggcgccaggggcctgcatcacgttggacgcggaggcgagggtgccctactacacgggggcgtttcgattggcggcgagagccgacatcgacaacgccatcacggagttggtggagtccaacaacgacgccctgggggacatcatccaggtgacccagctcagtggattggtcgtcacggaccttcaagcgccgacggcgatcaacacgaacgccaccatcaatgccaccgcgacggtgtgcaaccggagcccggtggctcagcctggcactgcggtcgggctcgcgctgcgcacggaggatgactttcccgtctccgcgctctccgagtatgtcgtggttccggcgctcgttccgggtgcgtgcgcacaggcgacgctgcggggctggtccaacgtgccgcaggagggcgcctacaggctggtggcttatctcggagacccatgggacgtgtatgcccccgagcagtggcgcgccctcttgttctccgtgcccatcgccgtggggggctggagcgacttcgccgtgacggccgtgagtgccccggtggtcgtccaagcaggtgacgcgtattcgacggaggtctccgtctgcaatcgaggctttggtcaggcgtcggcctccgtgagggcctacttgtctcgtgacgagcacctggacccggcggtggatgtgcgggtcgggcagatgagcgtgacgcttgcccgggggcagtgccggacagtgtcggtgtcgtcgcgggccaccgtcagcagcggggacgtctggtacgtggccgcggacgtgagtgtgggtagcctcccggacctggtgtccgccaacgatggtcaagtgggtgctcggatggtcgtgacaccctga

SEQ ID NO: 2474 - DNA, 1377 bp, Myxococcus xanthus
atgtccgcaccgcacccgttgctgctcgtggatgacgacgccgcgttccgcaaagtctatggcgggctgctgcgcgatgcgggttacgaggtagtggaagctgcggaccggccttccgctcgcgcggccttcgatgcacgcgacttccccctggtgctgctcgacctgatgctgcctcccgacgggagcgtctccgcggggctggaggggctcgcggcgttgctgagcgcgaagcccgggacgaaggtcatcgtcgtgtccggggcaggggacacgcggcacacgctggaagcggtgcgcctgggcgcgtacgacttcctcaccaagccagtggacccggatgtgctgctggtggtggtgcaacgggcgctcgcgcgggtgacactggagcggcaggtggagacgctgcgcagctcgctcacgcgcgcggcgggcggtgtctccctggtggggcagagcgcgtccttcctggcggccacgtccctggcggagcgcgtggcggccagtgagctgccggtgctcgtcactggcgagaatgggacggggaaggagctgctcgcgcgcaccgtccacctcaagagccgccgccacgacgggcccttcgtccccatcaactgcggcgcactgccggagtcgctgctggagagcgccctgttcggccacgtgaagggcagcttcaccggggcgaccaaggaccaccgtggcctcttcgcggaggcggacggaggcacgctcttcctggacgaactgggcgacatgtcgccgtccctccaggtgaaggtgctccgtgcgttggagacgggcgacatccttccggtgggcgcggaccggcccgtccaggtggacgtgcggctcatctccgccacccaccaggacctggggcgcatgcttcaggaaggcgccttccgcgaggacctctactggcgcgtgaagggcgttgaaattcgcctgccgcccctgcgcgagcgctccgcggaccttccgctgctggccaagcacttcctcaatcagtgcgcccacctgtgcccggacgggcgcgcccggctgttgtcggacgccgcggcggaggccctgctggcccatgcgtggccggggaatctgcgcgagctgcgccatgagatgcagcgcgccaccgtgctggcgggggagcggcgcgaaatccagcccgaggatttgtccttcaccggcagcgagcggctgcacgccacccgcgcgccaggtacaacgacgctggctcagaaggtggaagcgttggagcggcgcgaaatcgaggaggccctgcggcgcctgaatggcaaccgcacgcacacggcggaggcgctgggcctgtcgcgccagggactgctcaagaagctggagcgctttggactgacgtga

SEQ ID NO: 2475 - DNA, 705 bp, Myxococcus xanthus
atggcggagggccagggctggttcgccttccggcacggcctggtggtggacgccgtcttcaatggcgagcgcggcagcctggccttccggcggatgctctgcttcggcgcgggtgattacgcggtgacgctggggcccgagctgcacaagggctcgttcaccatggaccgcccgtacctgtgcgagacggtgctgcaggggctggagcgcttcgacgcgctgcgtgcccgaggcctgccgctggcatctcggctgacggtggacttcgcccggctggcggagatgctggcgtcgttgccggaggacgtgggcgaagtggtgcgcctcttcgacgggcgccgcacgctgcgcgccatgttgctggagtgccagttcccggaggcggtggcgtacgaggcgtccacgcggctgttcgcgctgggcatcctggtgcccgcgtgcctgctggaggagcgcgagcgggcgcactgtggctccacggtgcccggcttcttcgagcccgcgccctccgtggacgccgagccggtggatgcgcgggagccggcccccgctgcctgcggtggggatggggcctccgcgcccttcaccctggtcggaggctcgcagcctcccgtcatcctggacttccccaagaaggtccccggcgcgtcgagtggcgcggagggcctggagggggctgtccggtccgacgacgcaggcgtttga

SEQ ID NO: 2476 - DNA, 750 bp, Myxococcus xanthus
atgtccggtcacaatcggtggtcgaagatcaagcgccagaaggccgcgatgggcgcgaccaaggggaagctgtactccaaggtcgtcaaggaaatcaccgtcgcgtcgcggctcggtggcggtgagccctccggcaatgcccgcctacgcgtcgcgctggccgcggcccgcgaggccaacatcccgaaggacaccatcgagcgcgccatcaagaagggcacgggcgaactggagggagagaactacgaggaggtgacgtacgagggctacggccccggcggtgtcgccatcctggtggaatgcctcaccgacaaccgcaaccggaccgcggccgacatgcgctccaccttcagcgcgtacgggggcaacctgggcgccgagggcgcggtggcctggatgttccagaagaagggcgtcatcagcgtgaagtacggcccctccgaggaccaactgatggagcaggccatcgacgcgggcgccgaggacgtcatcatgctgggggacgaaggctccgaggtgcgcaccgcggcggcggacctgcacacggtggcgggacggctccaggagtcgggcctgccgctggggcagcagcggtgggtgttcctcccccagaacaccgtcgcactggacgtggacacggtgaagaagctcctgaagctgctggacgcgctcgaggagaacgacgacgtgcagaacgtgcacgggaactacgaaatcgaagacgcgatgctggattcgttgttgcagtag

SEQ ID NO: 2477 - DNA, 570 bp, Myxococcus xanthus
gtgcttggcgttgacccgggaagccggttcatgggcttcggggtggtggaggagaagcggggccggctggtgcacgtgggccacggtgtcatcaagggcgatccggcgttgccgctgtcggaccgcctgcgggacttgcacggcgcgctgacggcggccctggtgaaataccgcccggccgcggtggcggtggaaggcgtgttcaccttccgcaacgcacgcagcgcactggtgctggggcatgcgcgcggcgtcgcgctgctggcggcggcgcaggcggggctgcccgtcttcgaatacgcgccggcgaaggtgaagaaggcggtgggggcgggcggcgcggacgggaaggacgcagtggcgcggatggtgcggaccttcctggagctggatgcgtcggtgctggagcgcgcggacgcgagtgatgcgctggcggtggcgctgtgccacctcaaccatgggcgggccgcggtaccggcggcgtccgcgtcgggcaagaagcgcaagggcgcggcggcgctgctggcggaccggctggcgcccgcgtaccggcgtccggaggcgagatga

SEQ ID NO: 2478 - DNA, 609 bp, Myxococcus xanthus
atgatttcgcggttgcgtgggacggtgttggagaaggacctggaggacgccaccatcgacgtgggcggcgtgggttaccgggtgaacttctcctcactggcgctggggaagctgccggcggagggacagccggtggacgtgcgcgtgcgcaccgtggtgcgcgaggacgccttcgacctcttcggcttcctgacgaagggcgaggaagaggtgttcctgctgctcaacagcgtctcgcgggtgggaccccggctgtcgttgatggtgctgtccggcatggaggtgccggagctggtggcggcgctgtcgcggggcgaggtggcgcggctggcgaagattcacggcgtgggcaagaagaccgccgagcggctggtgctggagctcaaggacaaggtgaagacgattcacctggaagcggtgtcgcgcgggaccgcgccggccgccgtcagtggagcccatgcggacctggtctccgcgctgctcaaccttggctacaagcagccccaggcggagaaggccgcggacctggccagcgaacggctgggggcggaggccaccttccaggcgctgttccgcgaggccctcaaggcgctccgctcgggcggctga

SEQ ID NO: 2479 - DNA, 107 bp, Myxococcus xanthus
atgcccaaggagctggtcgcgctgggcggcgagctgtacttcaccgcggacgacggcgtgcacggccgcgagttgtggcggaccgacggcacggcgcagggcacgat

SEQ ID NO: 2480 - DNA, 1623 bp, Myxococcus xanthus
atggcgaaatcgcgcgcgcgcaagacggtggtcctggggatgctcgggacgacgctggacaacgggcaggggccgcagcgctgggcgcggtggcggcccacggtggcgctgtgccagcaggaggacctgttggtgcaccggctggagttgttgcatccaccgaacgcgacctcgctcgcggccacactggcgggggacatccgccaggtgtcaccggagacggaggtgcggggcaggcccctgcgcatccagaacccgtgggacctggaggagacctacggcgcgctgctcgactacgtgcgcggctatgccttcaaccccgaggcggaggactacctggtccacatcaccacgggcacgcacatcgcgcagatctgcatgttcctgctggtggagagccggctcatccccggcaagctggtccaggtgtcacccgacccccgggaccgcgcgggcgcgggtacgcacaccctcatcgacctggacttgtcccagtacgacaccctggccgcgcgcttccggcaggagcagcgagaaggcctggccttcctcaagtccggcatcgacacccgcaacgcggcgttcaaccgcctcatcgagcgcatcgaacaggtggccgtccagtcccgcgcgcccctgctcatcacgggccccaccggcgcgggcaagtcgcagctcgcgcggcgcatctacgcgctgaagaagtcgcggcgcggcgtggcgggccccttcgtggacctcaactgcgccacgctccggggcgacggcgccatgtccgcgctcttcggccacgtgaagggcgccttcacgggcgcgctgagcgacaggcccggtctgctgcggcaggcgaatggcggcgtgctgttcctggacgaaatcggcgagctgggcgcggacgagcaggccatgttgctccgcgcgctggaggacaagcgcttcttgcccgtgggcgcggaccgagaggtggagagcgacttccagctcatcgccggcaccaaccgggacctccaagtcgaggtcgagcgcgggcgcttccgggaggacctgctcgcgcgcatcaacctgtggacgttccggctgcccgcgctgcgcgagcgcccggaggacattccacccaacctgctcttcgaactggaccagtcctccgaggccgtgggcacgcgcgtcaccatgaacaaggaggcgcaggagcgctttctggacttcgccacgtccaccgaggcgaggtgggcaggcaacttccgggacctcaacgcggcggtgctgcgcatggccacgctggcggcgggcggacggattactcgggacgtggtggacgaggagctcgaacggctgcgcgagcagtggcggccctccggagcgaaggcggcggtcgtcgccggggacctggtcgcggaggtgctgggagagaacctcgccagcgagctggaccgtttcgaccgggtccaactcgcggacgtgctgagcgtctgccgggcatcacgctcgttgtcggacgcggggcgcttgctgttcgctcagtcacgcgcccagaagaagagcgtcaacgacgcggaccggctgaagaagtacctggcccgcttcggactcacgtgggcggacgccagcgggcgaggcgcgtag

SEQ ID NO: 2481 - DNA, 720 bp, Myxococcus xanthus
atgcgtcccggctgctttggcccactcgtgtccgcgctgttgctcgtttccctggagtccgccgcccaggcgccagcccctgctcccgccgacgaaacgccgcgcgtcacgacgtctgacacggcgcttcttcgcggcacgagcgaggatccgctgggcgcagtgctggcgccagtgacgctgccggacggagccacggcgctctatggcttcgtgggcgcaccggagatcggcgtgggcttccggcaaggcatctccggcttcgaactggaggcacgcgcgcggctccagtggttccagctctccgcctcgctggagctcgcggtgcggcgcaaggtgctggagcaaggcatcctgtccctggcgcccacgctgggcctgggcgtggtgctcaactcgggcgccacgtacatggatgaccggaactactccggcgtgctgttccgcgtatcgcccgggctggtggcgggctggcgcgtcgcggacacggtgtccgtgctggggctgttggacgtgccggtggacatcggtctgtccaatggccagtcgcggcgcatccaggcgctcggcggaggcggcgtggaggtgtacctgggcagcaacctgtcggcgctggcggcgggccagctcggcgtggagtccttccaggagcgctcgggggaaagccacacgcgcctgggctacagcgtacgactgggcctgggcgtccggctcttctga

SEQ ID NO: 2482 - DNA, 1812 bp, Myxococcus xanthus
atggcgctgtccaaggtgaacaacgaaaaggccaaggcgtacctcacgctccagtacggacggcggggccgggccacgcgtcaggtcatcgtccaggccctgaagaacgccaacgttccgggggccatggcggaggtggtcgccgctgaggcccgctcccagtgggaccgcaaccagctcgcgctgaccgaaggcgcgctgcccgagcgcgtgggcgccgccgaggagctgggcaagagcggccgtcccgacgccgtcaaccggctgctgcccttggttcgcgacagccaggtcatcctcgccgccgccgccgtgcgcgggctgggtgacgccggcgacaagcgcgcggtgagccccatcgcgttgctgttggaggagaacttcccggaactgcgcgagtccgccatccacgcgctgatgaagcttcaggatccggtggccacgcagcgcctccagttggtggcggtggagaagagcgccgtcagtccgctggccatcgacgccatcgtgtccttcccccggacgccgcagacggatgcttcgctgtgcgccatcgtcatggagggcgcaccggcggaggcgctcgtcgcgggccggagcatgcgcacacgcggcggctgttcggtggacaccattggcgagcggctggcacgtccggccacggccgccagtggcctccaggccgtcgaggggctgggacccgcggcgctgccgctgctcggcaaggtggtgccgtggctgagccattcggacgccacgctgcgcctgctcgcggtggaggccgtggcggaggtgggggatgcctccgtggtgcccgcgttgcagaagctctacgagcaggaggtcaagggactggaggcgctgcgcgccgactgggtgacccaagcgctcccggagaagttcggcgtggggttcgacccttcgaccatgccgcccaccccgtcgacacctggcctgaaggatgagcggccgtcgcggcacgcggacctgctggggcgggtgaaggagctcaatgccgcccgggtgcgtgagtccgggcgggacgtggtgcggcaccgtgtgcccaccgagctgtatgacgacgtggcgccggagcggctggtgccgctggcgacgctgctgcgcgcgttgggggcgctgaaggcgcccggcgccctggaactgctcaccggctacacccaggactccagcgccgcgctgcgcgtggcggccctggtggggctggcgcggctgggccccgagggcgtcaacgtggccaaggccgggctcgtcgagccggaccgcgacctgcagaaggccctggcccaagtgctggcggaggccggcgaggcggggcaggccgcgctcatcgagatgctgccgaagatggggagcgagaagctgctggtgttggatgcgctcacgcgcgccggcgccgtgccgggctccgcttccacgcagctccaggccgtggtgcgcgaaggtggaccggaagcggcgctcgcggcggccctgctgggacggattcaggcgaaggacgccgtgcccacgctggtgaaggcgctggacgagcccaacagcgtggcccgccgcgacgtgctgctggcgctggggagcatcggcgacgcgcaggcggcggacgcggtggccaaggacctgttccacgacctgcccgagattcgcgccgcggcggcttcgtcgctccggaagctgggcagcgccgcgcatgcggaccagttggaggccctcaaggcggactacttccggacggtgcgtgaggccgcgggcgcggcaccggcgtccgcgagcaccgcgtcggagggcgctccctga

SEQ ID NO: 2483 - DNA, 1452 bp, Myxococcus xanthus
atgacgtccgaattggccacgtctgtcgaggcatccacgatcgtggcggcctcaatcccgcccgcgatggccctccgtgagccagaagcgccgccgctcgcgacccggattcccgcggttcaacccggaggcgcgcgtccggcgacgagtgcgttgccgccaggactggcaccgcgcgcgtcgcagcggctgcccgcggtgggcgctgctcgcgcgcccgaacccgcgccgtccgcaccgccacggtccgtctcgaacagcggccgctggcaagccctgtcgtcgcccatcaccacgcaggcagcgcccgcagcttctgaagccgcggccgcctccgcgcccccaggactgcgggcgcgccgtgccgacccaccggtccccgcgggcgccaccgcgctcccgggccacgacctgtcacccgcgctgggcgcctccttccggacggcggcgagtccgtcctccttcaccgagttggagctggaagccgactccctgttgcacgcggtggagctggccgcgcaggcgggcttggatcggcaaggcctgggggccacgtccatcagcgacggcctcgaggaggagctctacagcctgacggaggaggtccctcccgacgcgggttccctggacgcgctgcccacgattccgctcttctcggacctgcctcgcgacgccttcatcgagctgttcgagcgctgcccgctgcggcgcttcggcccggacgagcgaatcatcgaccagggcagccacggcgatgctttctacgtcatctgcgagggcgcggtgcgcgtcttccggacggaggagggccagcgccaggacatcgcgacgctcgaaggaggcaccttcttcggagagatggccctgctgtccggcgcggcgcgcacggcctcggtggagtccgcgtccgacgacacccagctcctggagatctccgccagcgtgctcgccgagctctcgggaagccacccgcaggtggcccaggccctgaagaagttctgccgtcagcgcatgctgacgaacgtgatgaacacgtcggagctgttccgcctcttcgggcgaaaggaccggcgcgcgctcgtggagcgcttccgctcccgggacgtggagcgtgacaccgtcatcatccgtgacggcgacccgacggacggcctctatgtggtcctgtccggcgaggtggaggtgcgcaaggacggccacctgctgacgcagctccgggaaggggacgtgttcggagagatttccctgctccagaagacgcctgccaccgcgaccgtgaccgccacccgggacaccacgctgctgcggttgccgcgcgccgacttcgacgcgctcatgtgcagccacccgcaaatgctggccctgatctccgacctgagcgacgaacggctccggcgcacgcagcgcgtgctgaccgaagccggcgtcgaggaagacctcatcctcgtctga

SEQ ID NO: 2484 - DNA, 285 bp, Myxococcus xanthus
atggaccaggtggccgagggcaaggagcacctggacccgttcaaggtgggcaaggacccgtcactcttccgcgcggcgatgacgtccatgctggacgaggtggcgcgaatgttcgtgaaggacctgacgcccaccgaccgcgccggcgcgccgccgccccgggcttccgcggcggcttcggacgtggttcccggcaaggcgggcgccccggctccggcacccgaggcgacgaagcctccggaagacgagctggcgcccggcgagctgccggaccccgacccctga

SEQ ID NO: 2485 - DNA, 1008 bp, Myxococcus xanthus
atgatttccgttcgcggccttcgcaagcactacaaagtccataagcgcccgccgggcttgaaggcggccctccgctcgctcatccaccgtagctacaccacggtgaaggccgtggatgggatttccttcgacatccgccccggagagcgggtgggcttcctgggccccaatggcgccgggaagacgacgacgctcaaggtcctctccggcctgctctatccctccgacggcgaggtgacggtggacggccatgtcccgcagaagcgggaggaggccttcctcaagaaaatcatgctcgtcatggggcagaaacagcagctcctgtgggacctgcctccggcggagacgttcgaactcaaccgcgccatctacgacgtgccccaggcccagtacaagaagacgatttcggacctgattgagctcctggaaatcggggacctcatcggcaagcccacccgtcaactgtcgttgggggagcggatgaagtgcgagctggccgcggcgctcatccaccagccccgggtgctcttcctggacgagccgaccatcggcctggacgtggccatgcaggccaccatgcggacgttcatcaaggagtacaacgagaagtacggcgccacgctcatcctcaccagccactacatggatgacgtggcggcgctgtgcccccgcgtcatcgtcatcgacaagggcctcctgtcgtacgacggcggcctggacgcgctggtgcagcgggtgcggccggagaagcgcgtggtgctgcgcctgtcggaggaagtggacgccgggcgcctgtcgccgctgggtcgggtggtgacgcacgagcccggcaccgcggtgctccaggtccagcaggaggcggtcaacgccaccatcacccgcgcgctgtccacgttgccggtgatggacctcacggtggagaacgcgccgctggaagaggtgatgagcgaactgttcgcggagtcgaaggcgcgccggacggcggtgtcggagccggtgcccgcatga

SEQ ID NO: 2486 - DNA, 2286 bp, Myxococcus xanthus
gaggccacccccgcgcgggcgggcgtcttcgcgcccataccggaagaggtggcgccccaggtgcgcgacgcgctcgagaagcggggcatccagcagctcttctcgcaccaggcggaggcgtaccggctggctcgggcgggccagagcctggtcatcgccacgcccaccgcctccggcaagagcctttgttacaacctgccgctgctggaccgcttcgcgcgggagccccaggcgcgggcgctgtacctgtttcccaccaaggccctgtccagagatcaggaagagtccctgcgcgcgctgatgcgcgaggcgggcttgtcccatggcgccatcaccttcgatggtgacacgccggcggatgcgcgccgggccgcgcgggagcgcagcggcgtgctgctcaccaacccggacatgctgcacacgggcatccttccgcatcacgcgagctgggcgcgcctgttctccaatctgcgctacgtcgtcatcgacgagctgcacacgtaccggggcgtcttcggctctcacctggccaacgtgctgcgcaggctccagcgcgtggcgcgcttccacggcgcggacccggtgttcgtcgcggcgtcggccaccattggcaatccggaggcccacgcgaggcggatgctcgggcgggacgtgacgctggtgtcggagagcggggcgccttccggcgagcgccgcgtcatggtgttcaacccgcccgtggtgaacgcggagctgggcatccgggccagctatctcaagacggccgcgcggttgacggccgacttggtacgcgcgggcgtgtctaccctgctcttcggacagacgcgcaacaacatcgaggtgatgttcaagaccctccgcgaccgcttgttcgacgagaagttggatccgtccctcatccagggctaccgcggtgggtatctaccgggcacgcggtgcgccacggaggcggcgctgcgggcgggtgaagtccgctgcgtggtggccaccaacgcgctggagctgggcatcgacatcggctcgctggacgcggtggtgtgcgcgggctacccgggttcggtggcggcgctgatgcagcgattcggccgggcagggcggcgcggtgaggggagcctggcgctcctggtgacgtcgagcgcgccgctggaccagtacctcgccggcgacccgcgcttcctcgtgggctcgccggtggagcacgcgcgcatcgacccggacaacgtggagatcctggtccagcacctcaagtgcgcgtccttcgaattgccgttcgaggagggagagcccttcggggacgtaccgccggagtccaccacggaggcgctcgggttcctcgcgcagcacgaggtggtgcaccccaccgtgggcgaggcgggtcgtcgcgtgttccactggtccacggatgcctatccggccaaccacgtgtcactgcgcagcgtcggctgggacaacgtggtcatcatcgagaaggggacggaccggacgctggcggagatggacttccgttcggcgcacacgatgctgcacgagcaggccatctaccaacacgaggccgagcagtatcaggtcgagcgcttcgactacgagaaccacaaggccttcgtgcggaaggtggcgccggactacttcaccgacgcgatgacctacgtgcgcgtgcacgtcatccaggaggaccaggccgcgcccatgggcccggaccttcaggcgggcatgggcgaggtgagcgtcatcgagaaggtcgtggggtacaagaagatcaagtaccacacgcatgagaacgtcggttacggcgacgtggcgttgccggagatgcagatgcacaccacggcgctctggctgacggtgccggagacggtggtgcgcgccatgcgggcgccgcgaccggcggtcatcgacgcactgcgcggcctgaccacggcgctgcgcacggtggcgtgcgtggggttgatgatcgaccctcgggatatcggcaagacactggggagccgggatgacgcggaggggccgccacgcaaggatggtggcgtgggcttcgacccgacgctgttcttgtacgacaacgtgcccggcggagtggggctggcggcgcggctgtacgaccagcgggacgagctgctgagccgtgcgcgccgactgctggagtcgtgcgcgtgcgaggatggctgtccggcgtgtatcggccctgccgcgggggcgatgccgggacaagcgcccgtggacccgcatccgcgcaagcgactggcgctcgaagtgctatcggcgctgggcatcgcgggaatgcagtaa

SEQ ID NO: 2487 - DNA, 1239 bp, Myxococcus xanthus
atgctgtcggactggtcggagcgtcagggtctggccgccgcgcgccggggcacgccaccgccagccccccctggcccgctgcccgtggagtcccgtgccacggcccacggcacggtccacatctccgagcgcatcctctccccggaacaccaccacggctccgcgcctctcgccgcggccctggacgtggagggccccctggtcgccagcctcgcgctgcacgcggacctggcgggcgtggacttccaacggatgctcttcctggacacggagaccaccgggctcgcgggaggaacgggcaccgtgccattcctcgtggggctggcatggttcgagggccgctcgctcaaggtgcaccagctcttcctgcggcgcctgggagaagaggcccccatgttgcgctcgctcgccgagcgcatggccgcgtcctcctgcctcgtcaccttcaacggcaagagcttcgactggccgctcctgcggacgcgcttcgtcctcaaccgcgtccccgcacccgtggagctgccccacctggacctgctccactgcgcccgccgcgtcttcaagcaccggggcgccggcacgcgactggtccacttggaagaccaggtcctcggcttccggcgcgtcgacgacgtggacggctcgctgattcccgacctgtacttccgctacctgcgcggcggagacggctcggcgctgacgcccgtgctggagcacaacgtcaacgacctcctcctcctggcggccctgctcggtgagctggtccgccgcttccgagcagggggcgcagacgcctccgtgccccgggacgcggaccctcgcgacctgctcggcttcgcgggcgtggcgctccgggcccgcgactacgcgcgcgcccaggccttcgctcgggccgccgcggcgggggacaccggcgccgtgggcatcgaagccctggccctggcctcccggctgtcacgcaaggcgggtgacgcctcgaccgctgcggcgcacctgcaccaggcactgaagaccgcccagggcttccaggccgcgacgctgcacctccaactcaccaagctgtacgagcatggcctcaaggacctcgcgcgggcgctgcaccacgcgaagctggcctcggcggcggagctgcccgtggaccaccaccgccgaatccttcgcctggagacgcgcctggcccggagcacccgagcggcctcgctggacctgggaatggggagccctcgctcaggaacctga

SEQ ID NO: 2488 - DNA, 525 bp, Myxococcus xanthus
atgattgaggcacacgccacggccgtgcgctatgagggccccatgaaaattaccaaggacagcgtcgtctccatcgatttccgcctccacctcggcgacggcaaggccgtggacgagagcgagccgggggagccgctcgtctatctgcaggggcacgaggaaatcgtcccgggcctggaaaaggcgcttgagggcaagtcgcgtggtgacaccctccaggtgacggtgggtcccgacgagggctacggcgactatgacccggaaggcatcgaggaagtcccgaagacggagttcccggagggcctggagctggtggcgggcggcgtgctcagcgccaccgacccggacggggacgaggtggacttcttcatcaaggaagtgaaggccgactccgtgctggtggacttcaaccacccgctggccggcaagacgctgcacttcgaggtcaccgtgcgggacgtccgcgccgcgacggccgaggagctggagcacggccacgcccacgggccccacgactctcactga

SEQ ID NO: 2489 - DNA, 807 bp, Myxococcus xanthus
tttcgtggccggagtcaagacctggggttccgccagctcttcggcggccaggtgctggggcaggcgttgtccgcgggcagccagacggtgcccgccggccggcatgtccactccctgcacggctacttcctgcgcccgggcgacgcgacgcttccagtcgtctacacggtggaccgggtgcgggacggcggcagcatcaccacgcgccgcgtcgtggccgtgcagaagggcgagcccatcctgacgatgatcgcctccttccacggggacgaagagggctttgcccaccaggcgcccatgccggaggtgccaggcccggaggcgctggcctcggagcaggagctgctgagccgcgtgtccgcccgcatcccggaagccctgcgggagaagttcctgggggagaagccgattgagatccggcccgtggcgccggaggatccgttcaacccggaggcgcaggcgcccatcaagcacgtgtggttccgggccaacggcgacctgccggaggatccgcaggtgcatcggtacgtgctggcctacgcgtccgacttcaacctcatcagcaccgcgctcctgccccacgcggccagcttcttccagccccgcatcctgggcgccagcctggaccatgccctgtggttccacggagacctgaaggtgagcgactggctgctgtactccatggacagcccgtgggcgggcaacgcgcgcggcctgtcgcgcggcagcgtctacacgcgtgacggccggctggtggcctcggtggcccaggaagggctgctgcgcatccgcaagcccacggcctga

SEQ ID NO: 2490 - DNA, 1242 bp, Myxococcus xanthus
atgttccactccgcgggcgtcgtcccgaaccaatggtttccgacgaccgaaggcgcgaactacgcgctgacgcccacgctgtccccgctggccccggtgaaggatgacgtcctggtgctgagcggcatgcggctgggcgcgtgggactactatgagcgcacgcacgaaggcggcttctggatgatgctcaccgcgtccgagcgcatcgtcgcgggcagcacggactccatcgatcaggtgatcgcgcgcgccacgtcggcccaggtgcgcgtgccggcgctcacgctgagcgtggagaacaacggctactacaaccccggctaccgcgacgcgaacggggatggcttcatcgacccgaagacgtcgtcctatgacgacacgcaggaccattgcagcggcgaggaccactgcatggtgacgttttcccgcggccggcggctgcccaacgtctacaacccacgcgtcatcttcgaccggctcttcggttcgcttccagccgaaggacccacggacgcggagcggcgcctctggatgtaccggcgcagcgtgcttgaccggatgacgggccaggcgaaggcgctccaggcgaaggtgggccaggcggacaagctccggctggacgagtacctcacgggcatccgcgaaatcgaggtcgccatccagaaggcagagcagggtgctccggccgccgcgtgcaccacgggcgcccggcccgtgggcatccccatggatggcacggcctacgccaacctgatgtgcgacctcatcgtgaagtccttcgagtgcgacgccacccgcgtcgccacgctgatgctcggcatgtgcgtcagcccgatgatgttcaccgtcaacggccgggccttctcccaccacggcgatgcctcccaccacggtaacgatccggtgaagctggcggccaaggtggagatcgaccggtggcaggtggcccgcttcgcgcacctggtgcaacggctgaaggcggtgccggagggggagggcacgctgctcgacaacgtggcggtgttctactcgagcgacatctcgcacagtgactggcacaaccactacgacatgccggtgctgctcgcggggcgcgcgggcggagccatccggccgggccggcacatgcgggcacaaggcaagcggtgtggagacgtgctgctctccatcctccaggccttcgagattccacgaggcaccttcggaccgctggcacagggaccgctcgccgggctggcgtga

SEQ ID NO: 2491 - DNA, 677 bp, Myxococcus xanthus
atgaagacccgctcactgctcttcggcatcccgttgctgctcaccgcgtgctcggacgaactgcccgtcgcgcgcacccaggaccccaagcccgtcgtcgccgcgcagaactgctcggatggcgcgcattcgctgcgccggctgaaccgcgcggagtacgacaacaccgtgcgcgatctgcttggcgagacgggccggcccgcgacgaccttcccggcggaccccacgggccacggcttcgacaacgaggccagcctgctgggcatgtcccccgcgctggtggaggcctatgaggccaccgcgggccgtctcatcgaccaggcctgggcccgggacggcgccgccagcgccggaggtggcaccgttcgcatcgaggccgagtccgccagcgccaccaccggagccagcgagcagaacggcaccgtgtggaacctgtggtccaacggcgacctctccgccaccttcaccttcgcgcaggccggcgagtaccagctctccgtgcgcgcgtggggcacgcaggcgccgccggacccggtgcggatgcagtggctgctggatggcgtcgtggtggcgtcgctcgacgtgccggccaccacgcccacggtgtacacgcagccggtgcgggtggactcgccggggcagaagcgcttcaccgagcgctttaccaacgacaccta

SEQ ID NO: 2492 - DNA, 1248 bp, Myxococcus xanthus
gtggccctcgccatcttcctgttcacctacgtcttcatcgccggtgcgcgccttccgtacctgaagctggaccgccccgggggcgcgctgctgggggccgtgctgatggtcgtcttcggcgtcgtcactccggccgaggtcttcaaccacagcgccgacgcgaaccgtcacgccatcgacgcggacaccatcgtcctcctgctggggatgatgctgctggcggcgtacatgtcccaggcgtccttcttccgcaccgcgggcgcgtgggccgtgcgcagggcgcacacgccccggcggttgctgctcgccgtgacgttcatttcggccgcgctgtccgcgttcctggtgaatgacaccgtgtgtttgatgctcacgcccctggtgctggccaccgtggaggacgcgcgcctgccgccggctccgtacctgctcgcggtgtgcatgggcagcaacagcggctcggtggcgaccttcaccggcaacccgcagaacatgctcatccagggcgcctccgggctgtcctacgccagcttcgcggcgtacatggccctgcctgccctgctctccacagcggtggtcgccgccggactcctgtatctgttccggcatgacctgcccgtgaagcaattcgagcccaaccctccacctccgcccgtggaccggggcctgttggtgctcaccttgacggtgctatccggggttgtcgtggccttcttcgccgggctgcccatgagctggagcgccctggccggcgcggccctggtgatggccctggcgcgccgcgagccacgcgaggcgctggagcgcgtggactgggtgctgctgctcttcttcgcgagcctgttcgtggtcgtctatggcgtgaacaagcacggctacgcggaggacatccgcgtcctgttcgagcccctcatggcgggtccgccccttagggagacgctgggcttcgcggggctgacgctggtggcgtccaacctgttcagcaacgtgcccttcgtcatgctggcgcggacgtgggtgcccacgctgcacgacgtggagctgggctggcacgtgctcgcgctgggctccacgctggcgggcaacctcacgctggtgggaagcgtggccaacctcatcgtgttcgaggccgcgcgcgggaaggtcaacatgagcttcctccgcttcctccgcgtgggcctcccggtgacgctcgtcagcttcgtcgtggggctgagcgtgctcctggtggagcacgcgctgttctga

SEQ ID NO: 2493 - DNA, 756 bp, Myxococcus xanthus
atggagacccagaaccggctcatcctccagaagcggatgttcgacggcgagtccatgttgacgcgcgacaacttcgtcaacggcgcgttcgccatcaaggccaacccggcctcggtgaagattggccccgtcttcgagattcagccgctggccatcttcaacctgcgggcgacctatgagtacgtccggtacttcggcaccttcgggttcctccagtcgtacaacaacccgatgctggacttctccgacgacgcgcgcgacttgacggaggacgccgcgtacagcacctccggtcaccactacatggtggagcccacgctccaggcgcgcttcggctcgttcgtggtgcggagcaaggcgtccatcgagtactggaacgtggcgctgcgcgagggcaacggtgcgtccttctacgacgcgctgctggacacgctcatccccggccggggctgggtgttcaccaatgacaccgacctgatgatgctgacgacgccccagctcacgctgggggcccgcttcagcggagtgtggccgcgctacgagaatggctcgggcggagcgcagaacgtggacaacagccacacgcgcatcggccccatcttggcgtacgccctgaacacgcgcgagggctcgtcgttcaaccggccgacgatcctgctgaacttcgcgtggtacctgaaccacccgaaccgtggcggcgccctgccctacatgatgggcgccttcgccttcacgtccgacttcctgggcggctag

SEQ ID NO: 2494 - DNA, 924 bp, Myxococcus xanthus
atgcagtcgaatgtattcacggcggtactcatgccgctggcgctggccgtcatcatgctcgggcttggcctgacgctgacgctggcggacttcaagcgggtcattgtctatccgcgcgccatcctggtgggcctcggcagccagatgttggtgttgccggtggcgtgcctgctcatcgcccacgctttccgtctaccgccggagctggcggtggggctgatgctgctggcggcctcccctggcggcgcgacggcgaacctcttcagccacctggcccgcggtgacgtggcgctcaacatcacgctgacggcggtgaacagcgcgctgtcgctcgtcacgctgccgctcatcatcaacctgtcgctggcgcacttcatggacgagggccgcgcggttcccatgcagttcgcgaagatcgtgcaggtggtgctcatcgtgctggggccggtgagcctgggcatgttcatccgctcgcgcagcgcggccgtcgcgcagcgcatggacaagcccattcgcatcctgtccaccctcttcctcgtcgcggtgattgcagcgtccgtgtacacggagcgcgcgaatgcgctcagcttcttccgccaggtgggcccggcggcgctggccttcaacctggtgagcctcggggtgggctacttcgtgcccatcctgctgcgcctgccccggcggcaagcggttgccattggcatggagattggcattcacaacggaatgcttgcgattgccatcgcgctcagcccgacgctgctggcgaactcgaccatggccattcccccggccatctacagcctcatcatgtacttcaccgcggcggccttcggcttctatgtcagccggcgctacgcggatgagcaggaccccgctgtacaccgcacccccacgtcactccccgagaaggtgtctcgatga

SEQ ID NO: 2495 - DNA, 189 bp, Myxococcus xanthus
atgggcgccgacaagcactacctcacggacgtggccaccggcgcattgctcggctcggcgttcggcgtcgccgtgcccctgctgctccatggccggaagggcgaggcctcgccggacatccagtcagggcagatccagatggcgcccgtggccagcgcgcggatgatgggcatctccggcaccttctag

SEQ ID NO: 2496 - DNA, 189 bp, Myxococcus xanthus
atgaacatcgcttcgctcatccgtcctgcgacttctcctcacacgcccgcgccgcgccggctgcggctggtccgcgtgcaggccaccgtcctcgcgcagggcgcggtgggcgccatgaaggacggcgtgaaggccttccgccacatgtgcgacgtcctcacgggaggctatgcccaggcccggcactga

SEQ ID NO: 2497 - DNA, 1584 bp, Myxococcus xanthus
gacgccagcgcgtgctaccgcgcgatgcagacccgagatgcccgcttcgacggccggttcttcaccgccgtccggacgacgcgcatctattgccggcccatctgccccggccccggacgccccgggttcgagaactgcaccttctatccgagcgccgccggggcgcaggaggcgggctaccggccctgcctgcgctgccgcccggagacgtcaccggacctcgccttctggcgggggacctccaacaccgtcgcccgggccctggcgctcatcgccgagggcggcctggatgacgacgatgccggggtggaggagctcgcgggccggctgggcgtgggcgaccggcagctgcggcggttgttccagcagcacctgggagcctcgcccgtagccgtcgcccagacacggcgtgtgctgttcgcccggcagctcctgcacgagacgaccctgcccatggccgaggtggcactggcctcggggttccgcagcgtccgccgcttcaacgacgtgttccgcgccctgtatggacggcctcccagcgcgctccgccggagccgagccccggtgggcgatgccgccgcgggtgtcacgctcttcatcccctaccagcccccctatgactgggaagcgatgctggcgcatctggaggcacgggccctaccgggcctggaacacatcgaggccgggcgctaccggcggaccgtggcgaccgcgggcggtcagggcgccgtcgaagtcttccgagcccctggacgcgacgggttgctcgcgacgctccgcctcccccaggttcaggccctgcccacggtggtggggcaggtccggcgcgtcttcgacgtgggcgcggacatggacgtcatccgggaacacctgtcccgcgacccgcacctcgctccgctggtgtccctgcggccgggactgcgagcgccgggaggctgggacggcttcgagctcgcggtccgggccgtgttgggacagcaagtcacggtcgccgcggcgcgcggactcggggcgcggctggtcgcggcgtatggcgagcccgccggtgtcgcatcgacgggagacgcccggctgatgcgcacctttccccggccggagagactggcgcaggaggacttgagctcgctcggcatgcccgccgccagggcacggaccctgtcgagcctggccgcggcggccgcagcggacccgaggctgttccagccacgcgccacgctggaggaggccgtcgaacgcttcaaacgcatccccggcatcggagattggacggcgcagtacatcgcgctgcgcgccgtgcgcgaaacggatgccttcccttcggcggatgtcgcactgctgcgtgcgctcacgggcgaggatggcgtgcggccttctccagatgaagcgctccgccgctccgcggcctggagcccctggcgtgcctatgcagcacagcacctctgggccgcggatgccgcccggcccggacccacaccccacctttcccgttcctcctcgcgacagagagatgacgatgcccccaccgctgcgtttgctcatggaccgcgcccccacgcccatcggctcgatgctggtcgtctgtga

SEQ ID NO: 2498 - DNA, 528 bp, Myxococcus xanthus
atggaccgcgcccccacgcccatcggctcgatgctggtcgtctgtgacgaagcgggcagcctgcgcgcgctcgactgggaggagtacgagccccggatgctccggctgctgcggctccactacggcgtgaacggctacgtgctcgagcccgcgagcgaccccttcggcaggacgaccgcgatgcagacctatctgcgcggagacgtcagcgtcatcgactcgttgcccgtggccaccgcgggtacgccattccagcgagaagtctggcgcgcgctgcgtgacatccccgcgggcgccaccacgagctacggccaactggcccagcgaatcggccgccccaaggccgtgcgcgccgtggggatggccaacggcgccaacccgattggcgtggtggtcccctgccaccgggtggtgggggccaacgcctcgctgacgggctacggcggtggactggagcgcaagcagtggctgctcgaccacgagcgccgccatgcatcgcgcgggacgacgcggccaccaacgcgctga

SEQ ID NO: 2499 - DNA, 2325 bp, Myxococcus xanthus
atgtccgagcccgacgtcatttccctcagaggcgccaaggagcacaacctcaagaacgtctccttggacattcccaagaaaaagctcgtcgtcttcactggcgtgtcgggttcgggcaagagctcactcgccttcgacaccctctacgcggaaggccagcgccgctacgtggagagcctctctgcatatgcccggcagttcctgggacagatggagaagccgaagtacgacaccattcgcggcctgtcgcccaccatctccatcgagcagaaggcggccagcaacaacccccgctccaccgtgggcaccgtcacggaagtgcacgactacctgcgggtgctttatgcctccatcggggtgcagcattgccccaactgtggcgtgaaggtgggcaagcagagcgcgcagcagattgtcgatgaaatcctcaaggcccccgcgggcaccaagctccaggtgctggcgccgctggtgacgaaccgcaagggcgagcacaaggacctgctcgccgaggcccagaagcgcggcttctcccgtgctcgcatcgacggcgcgctcaagagcctggaggagcgcatcgagttggataagaagtccaagcacgacatcgcgctcgtcatcgaccgcgtggtgctcaagccggacgtgaagacgcgcctcaccgactccgtggagacggcgctgcgtgagggcaagggcacgctcatcatcaccgacgagaagggcacgcttgcctccgaccgggtgatgtccgagctcaatgcctgctccaagtgtggcctgtccttcggtgatttgacgcccgcgtccttctccttcaacaaccccctgggcatgtgcacggactgcaacggtctgggcaccaagccggagatggacccggacctcatcgtcccggacacgtcacgcagcatccgcgatggcgccatcgagccgtgggccggcagcatgaaccgcggtgagggctggacggccgacttcgtggagagcctggccaaggccttcaagattgatctggacgtgccctacgcgaagctgaccaagcgcgagaaggacacgctgatgtacggcgccagtggcaagtccttcaccgtcgcgtggggcgagggcggcaagtacaagatggaatgggagggtctggtcgagcgcatgatgcgcaacttcaagacgaccacctccgaggcgcgccgcaccgagctccagaagtacttcagcgacaagccctgcccctcgtgcaagggcgagcgcctgaagccagagagccgcgcggtgaaggtgcacgggcgcagcatcgtcgagctgagccggctgaccatctccgactcgctgggcttcctgggcgacatggccctgtccgcgcacgagcggaagatcgccaccgagctgctgaaggagattcgcagccgcttgtccttcctggtggacgtgggcctgggctacctgatgctggaccggaccgcgtccacgctgtcgggcggtgagagccagcgcatccggctggcgtcgcagatgggcagtgagctgacgggcgtcatctacatcctggatgagccctccatcggcctgcaccagcgcgacaacggcaagctgctgctgacgctcaagcgcctgcgggacctgggcaactccgtcatcgtcgtggagcacgacgaggagacgatggaggaggcggactggctggtggacttcggtccgggggcgggcgagctgggcggccaggtggtggcccagggcacgccggagcaggtcatggcgaacgaggccagctccaccggcgcgtacctctccgggcggcaggaaatcgagattccacaggagcgccgcaagccggacccgaagcgcaagctggtcatccagggggcgcaggagaacaacctgaagaacgtggacgcggagattccgctgggcgtcttcagcgcgattaccggcgtgtccggcgcgggcaagtctacgctcatcaacgagattctcttcccggccctggcgcggcacctctacgagagccgtgaatccccgggcaagcacaaggccgtgctgggcatggagcacctggacaaggtcatcgacatcgaccagcgccccatcggccgcacgccgcgcagcaacccggccacgtacaccaagctcttcgacaacatccgcgaggtgttcgcgatgacgcccgaggcgcgcgcgttcggctacgggccgggccgcttcagcttcaacatcaagggcggccgctgcgaggcgtgtgaaggcgacggcgtgaagctggtggagatgcacttcctggcggacgtctacgtgccctgcgaggtctgcgccggcaaagcgcttcaatga

SEQ ID NO: 2500 - DNA, 2592 bp, Myxococcus xanthus
gagccatccctcttcgcgttggagcgcaacctcgccctgatggcgggcgccggcgcgggcaagacgtacagcctggtcaccatgacgttgcacctgctggccggcgcgcgtgtcgccggcggtgcggtgcgcccgtcgcggctgtgcatgctcacgttcacggacaaggccgccgcggagatgcgctcgcgcgtccgccagcgcctggacgggctggcccagggcgatacgcgcctggaccaggaagtggacctgcgtgaatccctggcgcggttggacaagccgttcccgctgccggatgcctggcggcaactgcgcgaggagctgggcgcggccacggtgggcaccttccactcactgtgtggccagttgctgcggcgcgcaccgcccgcggtaggcatcgacccgaacttcgaggtgctggactcgctcgaggcgacggggctggtgcaggacgtctgcgagcgcgtggtgctggacgcgctggaggctggtgacgcgcaggtccgggagctgtgccaggagctgggcttctccggttcgggcttctccgacgggctggtggccgcgttgatggccgtctacggcaagctgcgcgaggaagggttgcgcgcggagaatgccgccgtgagtgacgccgccgaagcgcgcgcggagctggagtcgtccgtcacgcggtgcctggagctgtgtgccgaggcgcggggcctggacgcgaagggcgagtggagccggttgctgggcgggctggagcgcgcgctcaacggcatgacgcctgagaacttcgggcagggcgagcgcttcccgtggctgcgcgcgtgcttcaaggcggacggtcgcaacttcgcgcggctcagtaagggggccgcggggcccgtgcgagagttctactggcgcgtcttcggcaagagcgatggctccgtgccccggttggatgatgcctgggccgcatggcgcaccgcgcccttcgaggtgacgttccgcgagttgctgacgcgcgtggagacgcggcacgacacggagttgtcccgccgcaacgtgctggacttcacgtccctgctggtgaagtcgcgcgacctgctccgcgcgcatcccgagttccgccgccaggtgcaggagcgcatcggcgcgctgctggtggacgagttccaggacaccaaccgcctccagttggagctggtgctgctgctggcggagaagcgcgaggacggcccgcgcgagctggcgccggatgcggacctggtgacggcgctgccgctggagcccgccttcctctgcgcggtgggtgaccgcaagcagtccatctacgagttccgtggcgcggacgtgtccgtcttctccgtgctggcgaagaagctggtggacgagggcggcacgcgcggcttcctccagcacaaccgtcgctccgtgcccgggctgctgtcgttcttcaaccgcaccttcgcgggggtgctcgtcgccgcggatgcccgggcacctcggcccttcgaggtcatctacgttccggagcaggacgacctcgccgcggtgaggccgtcgctgtcggaaacgccagtggtggaacggttgcaactggaggaagcggacacggcggcggacctgcgctggctggacgcggacgcgattgcccgccggctgcggtgcctgctggcgccgggggcacctgcgtccgtcgcgcgtgaggatggcgaagggttgcgtcctgctcggggcggagacgtggccatgctgttccggaccttcacgcacctggaggtgtaccggcaggcgctcatccgccacggtgtcccgcaccgcgtgctgcgcggccgtggcttctacggcgcgcaggaggtgttggacctggcctcgctgctcgcgctgctggcggatgccgaggatgctttggccttcgcggcggtgctgcgctcacccttggtggggttgaaggacgcgtcactgttcctcctggcgggagacgcgcccctgtccttgtcgtcgccccggttgacggacccggaggtgttggtttcgttgtccgagcgtgagcggcagcgtctggagcgtttcctcgccgcgcttcccggcctgaggcgcgagcgcgaccggatgggcgtgagggagctgttggtagccgcgctggacgtgacgggctaccgcgaagcgctggcgggctcgccgtatgcggagcaagccagcgccaacgtggagaagctgctggcgctggcgtcgcggcgggacgagcgcggcacgggcggttgcgtcgccttctctcgcgagctgcggatgctggcggagaacaaccccacagaggcccaggaggacctgctggacgcgagcgaccctcgcgcggtgcagctgctgaccatgcacagcgccaagggactgcattagccagcggaggtggtgccctatatgggtgtccctatgcctaggacctacggccaaggccacttgtagcgcccgcatgggatgtacctgcgaccgagaggtgctgattctgttgaggactacacctgcatgccgttcgacacggtgcgcgcggttcttatagagcacgacgacccccattaccgccggctgctctacgtagcgctcacacatgccaaggac

SEQ ID NO: 2501 - DNA, 3114 bp, Myxococcus xanthus
atgctgcaggcgctgggcggcgcgcgggagctcaaccggcgtccatgcccggcggtggcggcgcgagcggtggtggcctccctgggattggagctggggcccacacctttcggcgactatgtgcgagagcccgccttcgcgcgcgccgcgctggacgtggtgctggacctgaaggccgggcgcctgtccgctcgggagcttcaggacgcggtggaaatcctgccccaggagcgcaggacgcgaatccgcgtgattgcgcgcctgtaccacctgtacgaacagcggatggcggagctctgtctcgccgaccgcgaggacgtgctgcgcggtgcacgcgaggcgctgggccgaggcgcgtggcccgtggggtgggaggggctgagcacgctcgtgctgcacggcgtgtacgacgtgaggccctcggggctggagttgttgctggcgttggcggcggcgtgcgagtcccgtcgggtgacgttgcgcgtggagacaccggtgggtggctcgcccgcggcggacgcggcgctgacggcgctgttccgcgccttcgagaaccgcggcgattccatgacgcacgtggacctcttcaaggcggacgtcaccttcgaaggccggcctttcatcgacctggggcgccacctcttctcaccccgggcgccgcgcgacgtgttgaaggacgcggtgccgtccctgcgcgtgtggaacgcggccacggcccgtgacgaggcgcgtctgttggcccgggacgtgcggcgcttgctggccgaaggcgtggcgcccggcgacatcgcggtggcgtaccgcgaactggggcccgaggccggctggctcgcggagtcgctgggagagctgggcgtgccggtgcgtctaccctggggcgagccgctggggctcgctgggcccgtgcgtctggcgctggacctgccgctgctggtggaggatggcttcccggtcgagcgcatggcggagttgatgggcagccgctacgcgccaaagctgtcacgcggtggaccggatgcgcccgcgacgctctttgcccaggccgccgtgcgtgatgaccggctgggcgcggtgcgaggccggggcgcctacgacgtgcgcttggacgggctggcccggcggctgctcgcgctcaacggtacgcgcaaggcgcaggacagcacccgcgtcgacgccgtgaagctgctgcgtgagcgctgtctgctgttggtggaagcctgccgccgcattcccgaagaaggcaccgccgcggagttgctcgcggcgtggtggcaggtggtggagcggctgggcctcgtggattcggagggcgcgttggcgccgcgcgaggagggtgggttgggcgcgcgcgcggcggatgcgcgggctcgggacgatgccgcgcgcgaagcgctccgcctgcgggtgcagggcctgacgcggatgatgaaggcggtgggcggcggaccgaagatgcgccgccggacgtttggccgttggctgcgtgacgcgatggcggatgcgcacctgcctccgcgcgggccccgtggcgccgccgtcgaggtgctcgacgtggccgagttgccgggccgttccttccaggacctcttcctcgcggggctgacggaaggccgcttccccgggcgtgacgcaccgtctccgttgctggcggacgcggagcgcgccgcgctcaacaagcatctgggccgcgacgtcttccggctcacgggcggcgagttcgacgagcgcgcggcgtggcgcctcaccgaagaccgcctgctgttcgccagcgcacttgctgccgccgaggcgaacgtcagcctgtccttcgcggtggagtccgcgggcggtcaggagcaggtgccatcggcgttcctggaagaggtgcgccggctcaccgcgctgaagtgggagccgcgctcgctgtcacccattccaccgctggacgaagtgctcaccgagtccgagctgcgccgctgcgtggcgctggaagccctgtcccagcccaagctgcgcgtcaccgaacccgatgcggcggccgcggtgcttcggcgccgcttcgcacccgaagcctggtatgcgggcgcgcgcgagctgtccgaagtggagatggagcgcctgttcttcttcggcgatccgaaagtgcagcccggcccgtactccggctcggtggacctcgacacgcagcgcgagtccctgcgcgagacgttccggttcgacatcacccggccgctctccgcgtctgcgctggcgcgcttcggcaactgcggcttccagggcttcctttcgtatggcctgaaggtggccgagccggacgtgccgggcgaggagttcgacgcccggggccgcggcaccttctggcacaaggtggtggaggaggtcttcgcggccctgaaggagaagcagttgttgggcaaggcgccggaggaggttccggacgaggtgctggacgccgcgctcaaggccgccatcaaggacttcgagcgcgtgcaccacgtgggacatccggagctatggaagctggcgcatgagcgggcccgagcgatggctcgccgcatcctcgtggacgagcggcgcggcctgcccttcgacacgatgacgccggagaacttcgagttccgcttcggccccgccgcccgtgacgacaagtggagcaacgtcgtccttcacgcgggcgaggagcccgtgtacttcgagggcaccatcgaccggctcgacaagtcgggcggcgaggtgggcgtcatcgactacaagtcgggccggctggacaagcgctcgctgaaggagcggctgctgacgtccgacttccagctcccgctgtacctctacgcggcgcgcgagagcggccatacggaagcgcggcaggccgcgtggttctccttgcgcacgggcatggccatccgcctgtccgaggtcatctccgacgcggagctggacgagctgctgtcgaaggaccccgaggtccgcgcgaaggtggcggagaaggaaggcctcaacctgcccaacgccgtggaggcgctggtgggcacgctgcggcagggccagttcgccgcgcggccccaggactgcgggacgtgtggctatcgcgcggtgtgtcggattacggacaggcgcatcacggaggacgggggatga

SEQ ID NO: 2502 - DNA, 822 bp, Myxococcus xanthus
atgcaattgacttccgcgtcggaactgccactgcgcaccctctccacgctgtttgcccgcgccttcgaggggtatttcgtcaccgtgcccgatgcccccggcctgttcgatgcacgcgtgcgcagtgagcacatctcgctcgaggaaagccgcgttgcgcgcgtggacggggagcccgtggggctcgtgttgatggcccgccggggacgggagagccgcgtggcgggcatgggggtggtgcccgcctggcggaatcgcaaactgggaggtgccatgctgcgcccactgctggaggacgcgcgagcgcgtggcgacacccggatgcttctggaggtcattgaacagaacgcccccgcggtgacgctctacgaacggttgggcttccagcgcgtgcgccggctggtgggcttcatggggacgcccgagccctgggtgggggcatccgcgctggaggaagtcgacccgtgggagtgcgcgcggctgcttcccgaaggattgccctggcaactggctcccgcgacagtcatggggttggcgttgcccgcgcgagcattccggctgggccccgcggtggcgatggtggcggatgtgtcggcgcccacgctggtcgtccggtccgtgggggtggagccctcggcccgagggcagggcgctggccgcaggctcctgggggctcttgccgcccggtggcccgggaaggcgctggccgtgagcgccgtcgtgccggaaggccccctggcgcgcttcttccagggggcgggattgggggcgactccgctcacacaactcgagttggagctgccactggaggtgcgctcatag

SEQ ID NO: 2503 - DNA, 915 bp, Myxococcus xanthus
gtcgcggccgtgggcgacatccatggccgcttccaccgtgtggagacgtggctggacgcgcttgagcaggctcgtggccgccgggtggacctggtgctggcggtgggcgacgtcgaagccttccgccgctcggatgaccaccggcgcaaggccgccaagcgagccatgcccgccgagttcgcggaatacgcggatggactccggcaagtgaagcggcccctgtacttcatcgggggtaacaacgaggacttcgaggcgctgcacgacctccaactgggcggcacgctggcgccgaacgtgacgtacctgggccgagccggggttcgcgagctgtgcggactgcgggtggcgtacctgtcaggcatccacgcgccgcgcttcgtcgaccagccactgaagccaccctccacgccggacatggtgaagcaggccggctacttccgcacgccggaggtcgaacaggtggcggagctccgcgacgtggacctgatgctggtccacgaatggccgcgaggcatcgtccagcgcgcgcgggaggagaacccgtcaccgccaaggccgctcccctcttattggattggcaatcccgtgacgcggcggctcgtggacacggtgttgccgaagtggatgctgtgcggccactcgcacaagggcttcgcggtgacgctggagggcccgggacgtccggccacccgcatcgcctgcctggaccaggcggccagggcccaggagtccatcttctggttggagtacgaggaccgtcaggccctgcgcgcgggctggggcctgtcgggcgccatctcgtggaccgccggccagcgctgggacatgaactcgctgcccccgctggccgcggagggagagggcgcccccgcggagttcggcctcggagaggcgatgccggcgcggaactag

SEQ ID NO: 2504 - DNA, 2946 bp, Myxococcus xanthus
atgcgcagggcgtttgggctggtggcattggtggcggtgatggtggcgggaggggcgtgtgaacggcccgcctctcagagggcaaagagcgccttcgtcgtccggcctgagactgtggacttcggtcccgcggcgctggggcataccaagacgttcaagctgcgaatcgccaatgcgggccgggcttcctatcgcgtggaaggcgctgtctccagcgtgcccaacgtcaacattcctcccttcgaacccttcatcctgtccgcgggtggcgagcaggacatcgaaatccacttcctgccgcaggtagagggcgagattcagggcgtggtggaaatcattaccgacgccgaggtcggtgggcgcgtgccggtgtccgggcgcggcgtgaaggccttcatcgaggtgtcctcggaggcgctcgatttcggcaacgtggccatgggcctggtggagatgcgcgaggtgacggtgcgcaacccatcggacgtggacagttcgctgacgctgtcggtgcagggcgcggacgccgaccagttcaccgccgggcagggcctgccctcctcgctggctccgggcgaggcgttggtggtgcctgtggcctacgccccgcgccggctgggcgcggccgaggcggcgctgcacgtggtggtgtgtgacgggtgcgcgccggtgatggtgccgctgacgggcacgggcgtggcgtccaggctggaggtgacgccgctgcgcgtggacttcgggcgcgtggcgctgggggccacggcggagcaggtcatcaccgtgcgcaaccagggcacgcagccgctgagcttctcgggctcgcagttggtggacagctcggagggcgtcttccgcatcgccagtgagccggtggtggccaacgggcagttggcaccgggcgcggcggtggagctgcgcgtcgccttcacgccggcggcggtgggcaaggtgcgtgacgggcgggtggagattggcgtgcgcgagcagggctccagcgcgccgggccccaaggtgtcgctggcgggtgaaggtggcggctcgtgcgtgacggtgctgccccggcggctggctttcggaacggtggcggagggcatgacggcgacgcgcgacgtcaccgtctacaaccgttgccgtgcggacgtgagcgtcaccgacctccaactcgacacgcaccagggcggctacttcaccctggcccaggcgcccgccagcgtgatggtgcccgcggggcagaatgcccgggtgagcgtcaccttccggcccaaggcggggagcacggacgccagcaagggacagctctccgtcacggtgcgtgacagcggctccgcggccacggaggcggtggcgctggaggggcgcagccgggtgttcgcgccgtgccagtacgtgctgccccagcaactggacttcggcaaggtgccggtgggcgcggaggtggcgctgggggtgacgctgcggaactcgggcacggaggcgtgctacctggcgtcgatgcagctcgtccagggttcggacagggtgttctccgcgtctcccgtgcgcaacggcgtgctggagccgggcgcgaaggcgacgctggtggtccgcttcaggccctccgaggaaggcggcttctcggggctggccgaggcctgggtgaacagccccacgcaagggcacccgctggtggagctgcagggcgagggcgtcgtgggatgcttcgcggtgcagcccaccacggtggacttcggcgttaccaagctggcgtgcggcccgcgcacacgggagttggtggccgtgaactcgtgtgtcgggcccatccaggtgagccaggtggcgatcgacgcaggggcgggcgagttcaccgtggatggtggcggcaacgccccgtggacgctggcgagccagagcgcgcgcgcgctgacggcgacctatgccccggtggatgacggcgctgacacggcggcgttgcgtttcaccctggcggatggctccgtctacacggtgggcatggtgggatggggcgtgacgcaggcggagcagacggaccgcttcttccaggagtcacaggcgaaggtggacgtgctcttcgtggtcgacaactcggggtcgatgatggaggagcagcagaacctggggcagaacttcgcggccttcctgagcgcggcggacggcgccgcggtggactaccgcatcggcgtcaccaccacgggcttggacccgtctccgggcggctggtccgagtgcccgggcggctcgcagggcggagacaatggccgcctgttcccagtggacggctcccggccgcgcatcatcaccccggcgacgccggatgccgcgggcgtcttcgccagcaacacccgcgtgggtgtctgccattggaacgagcagggactggaggccgcctaccgcgcgttggcggacccgctgctctataacgaggatgacccgcgcaccgcgcagcccaacgacggcaacgcaggcttcctgcgcgaggatgcccgcctggccatcatcttcgtgtcggacgaggaagacttcagcgcgcagccggtgtccttctacgagacgtacctgctggcgctgaagggcaatgaccgctcgaagctgagcgtcaatgccatcgtcgggccgtcggacctggccaggtgccccacgtccagcagctcgggcacccgctacatccaactggcggaggccacgggcggcgtggtggaaagcatctgcacgccgaactgggccagctcgttggagaagctgtccgacagcacctttggcgcgaaccgcaagttccccctgtccgagacgccggaagctccaggcagcatcgtcgttgatgtggacggcgtccgcgtgacgtccggttgggagtacgacgcccgcgagaatgccatcctcttcgaccgcttcacggcgcccgaggcgggttcgctggtagaggtgacgtacccgctgggctgcggctga

SEQ ID NO: 2505 - DNA, 168 bp, Myxococcus xanthus
atggagaccgctcgggagcaggcctatgcggaggcctcggcggcatgccccgcgggatactgcaacgcggtggagcaggagttgcgctgcgagcagacgccgtatggcgaccaccacgcgctctttcagttgacgtactcctgcaaggacccggtgacctgccagtag

SEQ ID NO: 2506 - DNA, 570 bp, Myxococcus xanthus
atggtgcggtgggagcagtacgccggctcgcgcgtgggcgcggtggcgctggacccggacgctccgcgcgccttgtcggcggccctcaccgacggtgatggcccggacgcagccacgctgctcgtgtccgtggtggggcgcggcttcagcgcgagcccctccgaccgggaagagttcgcgtccgcggtgatgcagcactaccagcgcgagctggggctctcgcttgcagcggaacgcgtggagcgcctgggcggggtgacaccgcgtgtggaggtgctggggacgctgcgcgaggcggggcaggtccgcacggtgctcgtcgcgggcctggcctcggagggggagcacgccgtggtgatggtcagtgcgcccgcggtgcggtggcaggcgctggagccgcaagtgcgcgcctcgctggagaccttccgccacgagccgccgagcgcgggtggccccgtcccacgccgggtgctgggcgcgctggcgggaaccctggctggagcgctggtcgtctcgtacacggcgtggcgccggcggcggctgcgtcacgcggcgggcaaccccacgtag

SEQ ID NO: 2507 - DNA, 1020 bp, Myxococcus xanthus
atggcgtctgcctttcggctgggggagaagctccacccctcagagagaggctccgcctgtttttcgggtcaaaaccggaaaatcctggcggttcggcgatttcccctggattcgggcggcgcttcgctggtgtcctcgaggctgggtttcaagagcctgtgcttcctggaggggagagaccgcgtggacgctgtggatacgaggctggtcgccagctacgcggtcgccatcaccttcgacgtgctgatgccggtgggcatggtgctgtgggcgcgccggcggctgggcgtggcctggaaggtggtgggttggggcgcggcggcgttcgcgctgtcgcagttgttcacccggctgcccatggtgcaggtggcgcagtacttcatgcgcgacgcgctgaagacgtcctcggtgcttctgggtgtctggattgtcgtgctgtccctcaccgcgggcctcttcgaggagacggcgcggctgtgggccttccgcaagccgctgaaggacttccgccgttggcgcgacgcggtgggcttcggcgtgggccacggcggcctggagtcggcgctgctggtgggcgggctgacggcgctggggctcgtcaacgtcatcgccctgtccaagttggacccctccaccttgccgctgaagccggagcaggtggcgcaggtggtggaagccaaggccaccatcgccgcgctggactggtggatgccgctgctgggggcctacgagcggctgggctccatggtggtgcacatcgcgctgtcggtggtggtgctccagcgcttcatccgtggcgaggtgaagtggtactggctcgcggtgggcgcccacgccttcttcaacgcgctgacggtggtggtggggaagctggccaccgcggcgtggggaccgcaggcaggggcgttcgcgggcgaagccatggtgacggtggccgcgctggtgagcctgtgggtcatcctctatttccgccgcgtggacgcggagcgcgacacggcggcggttccggcacgggagtga

SEQ ID NO: 2508 - DNA, 1323 bp, Myxococcus xanthus
atgttcgccttcatcctcgcagcggtgctcacgcagtcgccggtggtgccggcggcgccgagcccgcctcccgcacctggcacccccgaagccgtgcccgccgtgcccttgagcacgctgccacccgccacgcacgagctgttccagcgcatcgagggacaggtcgcgcaggtgcgcatcatcgagcggcgctctggcacgcgctcgtccatcggctcggccttcttcgtgtcggccgccgggcacgcggtgacgaactaccacgtgatttccgacgtggtcatccacccggaggactacacggcggagctggtcctgaagggcggcgcagagcccgtgccggtgcgcctggtggacgtggacgtcgtgcacgacctggccatcatccagacggccaccccggtgcagagcttcttcgacctggacgaccgcgagccgccgcagggcgcgcgcctgttcgccatgggcaatccgcgcgatctgggcaccaccatcgtggaggggacgtacaacggcttcatccacgacgcgctctatgagcggctgcacttcagcggggccatcaatccgggcatgagcggcggccccacgctcacgggagagggccgcgtggtgggcgtcaacgtggcgaccatgggcaaccaggtgggctttctggtgccggtgaagcacgcgcgcgcgctgctggcccgcgcgctggaagccaaggactccggcgcgcaggcgctgctggataccgtgcgcgcgcagctcctggacaaccagcagcgcgtcaccgaaaggctgctgggcgcgcccgtgccgcagcagacgctgggcagctaccgcgtgccggggcgctggggcacgtttctcaagtgctggggggacacgccgcatgaccccgaggtgccgtacacggtgacgaactaccagtgctcgtcggaggaggacatcttcgtgtcctcgcgccaccggacgggcgtggtggccttcctgcatcaacacgccaccagccagaagctgggggcgctgcgcttctccgcgctctacagcgcgctcttctcacaggacccggacgcggtggaggccacacggcaggacgtcaccaactaccgctgccagtcggagttcgtggacgtggcgggcctgcccgtccgtgccgcgctgtgcatgcgtgcctaccggaagttccccggcctctatgacctggtgctgcgcgcggccacgctcaatggcagcaccagcggcgtggacacgtcgctcacgctggctggcttcaccgcggacaatggccgcaagctggcgcgccgctacctggaggggctgtcgtggacgaagtaa

SEQ ID NO: 2509 - DNA, 213 bp, Myxococcus xanthus
atggcctgggggctctactggcacctgcgctacgtgacgcgctgggagccggggcggctcatccgggtcatcgccgtcgtcacgctgtcgtttggcgcgctgtcgcgggcggatgcatggctgggcaacgagtccttcagcacggagctgggcttccgccggtcgctgctgccgccggtcttccggctggtgggaaccgagcccctgggatga

SEQ ID NO: 2510 - DNA, 267 bp, Myxococcus xanthus
atgatcatcgcgctggggcccgtggcggcgcaggccttcttgggggtggggtttcgcatgcacctgagccgggggcagctgctggacacgcggtgggcggagggctggatggccacgtttgaccccgaagcggtgcttcggcttccggaaggccgggcgcgggcggaggcgcgcatccacttcgaagcggatctccggtcggcggcggcgtggctgcggcagcggctcacgggggacgcgcgggcccggcgcgtggagggtccatga

SEQ ID NO: 2511 - DNA, 4179 bp, Myxococcus xanthus
accctcgtggatatgtgtcgggctcgcgccgccgcgcagccagacgactggatttatacgtttctcgacgaggcgggggagcaggctgtctcctacgcggagttggacgcgagcgctcgcgcggtggcggcgctgctacaacgacacctggcgcccggtgagcgcgcgttgctgctgtacccgccgggccgcgactacacgttgggtttcctggcgtgtctctacgcgggcgtggtggcggtgcccgcctatccaccggacccgatgcggctgggccgcaccttgcccaggctccaggcgctggtggcggactgtggcgcccgggtggcgctgacgacttccggcatcgcggacatggtggagcccctcacgcaaggggcgcccgacttgcgggcgttgcgctggttggccacggactccgtgttccagcacgaagcggaggcctggcgcgcgccagtcctgcggggcgactcggtggcgttcctgcaatacacctcgggctcgacggggacgccacgaggcgtggtgctgcggcaccgtcatctgctgcacaactcgtggttgattgcccggggcttcgacacccgcccccacccggtggccgccctctggctgccgccgtatcacgacatggggctgattggagggctcatccaggcgctgtaccgcgacatcccgtcggtgctgctgcctcccatgtcctttctccatcgcccgctgcggtggctggaggcgatgtcgcgtttcggtgcgacggtctgcggcgcgcccaacttcgcgttcgacttgtgcgtgcgcaaaaccacgcccgaacagcgcgcggcgctggacctgagcaggctggaggtggcgttcagcggcgcggagcccgtacgcgcggacacgttggatcggttcgtggatgcgttcgccccggcgggcttccggcgcgaggccttctatccttgttacgggctggcggagggaacgctgatcgtctcgggagggacgcgctcggccgtgccggtggtgcggcgtttcgctcgtgatggcctgctgcgcggcgaggcgcgggcgcccgaggtggatgctccagcgacggcgctggtgggatgcgggcaggcgctgggcggccaggacgtgcgggtggtggacccggaaaccggccgtccatgtgcgccgggccgcgtgggcgagctctgggtgcgcggtccgagcgtggcggacgggtactggcagcgccccgacgaaacggagcgcacgttccatggccggctggcgggctcgggggagggcccgtacttgcgtaccggagacctggcggtcatcgacggcggcgaggtcttcatcaccggtcgcttgaaggacgtgcttgtgttgcgcggcctcaactactacccgcaggacctggagcacgccgcggatcgctgccatcccggcgtgcgtcccgggtgtggtgccgcgttcgcggtggacgctggcgacgaagagcggctggtcatcgtgcaggaggtcgccgcgaaggtcgccacgccggaagcggcggccgaggtcgtcgcgagcatccgcgcggcgctgggcgaagcgcatggcctggccgtccatgccgtggtgctcatcaccgccgggacattgccgaagacgtcgagcggcaaggtgcagcggcgcgccacgcgtgaggcattcctggcggggacgctggacgaggtgcacggatggaaggaggacgccgcggcggcgtccttggacatcaagcctgacgcggcacccgaagcggcggacgtgctcgcggtgctccggtcccggctggcgtcactgcttggcgcgaatggaccggcgctgagcgtggatgtgcccctgacgcaccaggggctcgactcgctgagagcgctggaggtgttgcacgccgtggacgaggcatggggcgtgtctccacccatcacggcggtgctccaggggcagagcctccgcgaactggcgcggtgggtcgagcgggcccggaccgagggcgccgaggcgcggcccgaggctccggctgtcatgcccggcgaccccgcggccttcgtttccgatggccagctggcattgtggttcctccagcgcatggctccgggcagcaaggcctaccacgtgtcccaagcggtgcgcttcgtcacaccagtggaccccggagcgcttgctcgtgcgttctccgtgctcgttgcccgtcaccccgcgttgtcgtccgcgttccccgaggtgcagggggcgccagcgaggagagcctgcgtcgcgccgccggagctggcgcgggtggaggcgtccacctggacggatgaagcgctgcgtgagcggctcgatgcggatgcgcgggaggccttcgacatggagcggggcccgctggtgcgcgcccggctctacaccggtgcgccacgcggggacgtgttgctgctcgccatgcaccacctggtcacggacttctggtcattggaggtcatcgcgggggaactgggcgcgctctacacggccgaggtccgaggcacgccgtccggcctgtcgccgccgccacccgtggctcccatcctcctgtcgttggcgcggcggtccacgggagcgcagggcgaagcgctcctggcctggtggcgtgagcacctggggggcgagctgcccgtgttggagctgcccacgtcgttccctcgacccaggctccagtcgttccgaggggcgcaggtgaccttccgtctgccgcgcgagacgtccacgcggctcaaggccctggcgcggacgcacggcgccacgccgttcatggtgctgctggccggttacctggcgttcctgcggcgctactcggggcaggaggacctcatcgtcggtacgccgaccacgggccgcccgcgagcggacctgtcgcgacaggtgggctacttcgtcaaccccgtggccctgcgcgcccgggtgccgcgcacgctgtccttctctggcctggtggcgcgggttcgaaccaccgtgctggaggtgctggagcatcaggatctgcccttcacgcggctcgtcgagcagcttcagtcgcggcgtgacccgtcgcgcgcgcccatcttccagacgatgttcgccttgcagtccccccgtaccgagaacgagctcctgggcgcgttcgccgtcggggcttcgggcgcgagcgcccggctgggcgatgacctgacggtcgaatccgtcccgctgagccatcccggcgccgccttcgacctcgcgctgatgatgacggagctggaaggggccttcgtggcgaggttggagtactgcgccgacctcttcgacgccgcgaccgccgaacggatggcgcgccacctgggggcgctgctggatgccgccgtggcgcagccggaggtgccgctgggcgacctgcccctgttcgctcccgacgagcgccgcacactgctggcgctgggacggaggacacaggacacgcggggcgcgctcgtgcccggcatcattcaccgaatcgaggactgggccgcgaagacgccgcaggcgcctgcgctcgtcgcgggcgcgtcgagctggtcctatcgtgaggtggcggcatgggtggcccggctcgccgcgcgcctgcgacgccacggtgtcgggccggaggttcgtgttggcacgctgctggagcgcggcagctccgagcaggtcgtcgccttcctcgcgatcttgaaggccgggggcacggtggtgccccaggagccttcgtatccccccgcgcgtgtggcgtggacgctggcggactgcggcgcgcgcgtgctgctggcccaggagcgctacgcgcagcgcctggcgttgcccgaaggggtgacgctgctgccgtgggaggcgcacggcgaaggcgacgacatgccggacatgtccctgtgggaggccggcgagccacctccggactgcgcggcctacatcacctatacgtccgggagcaccggcaagcccaagggcgtgatggtgccgtaccgcggcaccgcgcacctgtgcgagtcgatggtgtcggacctgcctgtcgggcccggctcgcgggtgttgcagttcgcctcgcccgcgttcgacatgtcggcgtgggactacttcctggcgctggcctcgggcggcgcgctgcacctgtcaccccggggtccccctgcgggtgacgcgttgtaccggatgttgcgcgagcagcgcatcacctcggcgacgttgccttcccct

SEQ ID NO: 2512 - DNA, 180 bp, Myxococcus xanthus
atggcccgcacggccctggcgctggcccagcgtcacctgcccgacgtgcccgtggtcgccatcatccaccgggacaatgaggcatccctccgcgtcgcggagcgcagcggaatgcgcttcgagcgcgtcatcgactacgagggcacacccagccggctctacgtgcccgccccgccgtaa

SEQ ID NO: 2513 - DNA, 306 bp, Myxococcus xanthus
atggtcccctacctggtgcttgccgggctcatggccgccgaggtgtcaggggccctggccgcggcactgctgctgtacgggctgaccttggctgtcgcgacggtgttcctgttccgtcgcaagcgctgggcatggagcctgtcgtccgcgctcgcggtggtggcgttcctggcgggagccggcgtggcgtggatgcctccatcatgggtggggggtatccacgccctgggtgcggcagcgatcctcggtgccctgtccgcgggccgcccggccatcgcggcgccaccggcgctcacggccggctag

SEQ ID NO: 2514 - DNA, 1170 bp, Myxococcus xanthus
atcatgaacaaggactttgcccgggtcggactggacgcatggcgaaccaacttcgaaatgggattcgtctgggacaaggatgatttcagtaccaatcagttcgcgcacccctaccacggcagcacgtacttcaacgccgcccgggaccatggcttcaactactggggcgccatgggcttcaccctggtgggcagcctccagtgggagttgttcgccgagaaccatctgccctcctacaacgacctcatcaacaccacgatgggtgggtgggcccatggagaggtcatctaccggctgtcctccatgctgctggaccagcgcgccacgggaacccggcgcgtcgcccgcgaggtgagcgcggggttgctcaatcccatccgaggcttcaaccgcgtggtgcgcggggatgcctggcgcagcgcgcccaccccaaaggactggcagccgcccgtgttcgccgtgctggcgcgcaccggctacctgaacatcgacgcgggcacgacgctgaaccagttcttcgcggagctggacctgcgctacggcgatgccgtgcgcttcccggtggacacgcccttcgacgccttcaacatgggcgtgcagttcaccaccggcgaaaaccgactcatcagccgcgccgaggtgaagggcgcgctggcgatgctcccgctggagaacagtgggaacgagcgcgtgctgctcggcgccttccagcacttcgactacaacgacacgcaggcctacgagctgggcggtcagtcgatcggcgcagggctcgtgtaccggtacctgacgcaggggggccgtgagctgcgcctggcgcttcatctgcgaggcgtggtgctcgcaggcatcacgtccgagtacgcggacaaggtgggccgcgactacgactacggcccgggcctgggcttccacttcgaggcgtcctacgggcgctggccctgggagtacctcaagctgcacgcgggcagcacgtggctgcacacgctcaacggcgcggacggcaaccacctggtgcatgagggcaccttgctgctggacgtgccgttgttcgccaacctgggcctgggcgccagcttcaccttcttcgagcgaaacagcttcttccgcgacttcgataccgtctcacgcggagtcccgcaggcccgggtgttcctctccgtgcactga

SEQ ID NO: 2515 - DNA, 981 bp, Myxococcus xanthus
atgaaatacaccaacctcggacgcacgggtcttcgtgtgtctcgtctcggcctgggctgcatgagctacggcacgcccaagtggcgcccctgggtgctggatgaagaagccgcgcagccgttcttccgccgggcggtggagctgggcatcaacttcttcgacaccgcggacatgtattcactgggcgcgagcgaggaaatcacgggccgtgcccttcgccgttacgcgcgcatggacgaggtggtgctggccaccaaggtctacttccccatgggggacgggcagaacatgcggggcctgtcgcgcaagcacatcgtccagggctgcgaggccagcttgaagcggctgggcgtggaggccatcgacctctaccagattcaccggatggacccgaacacgccgctggaggagacgctggccgccctggaccagctcgtgcgccagggcaaggtgcgctacctgggcgcgtcctccgcgtatgcgtggcagttcgcgcgggcgctgggagtcgcggacctgcgcggctggacgcgcttcgtgtccatgcagggccactacaacctcgtctatcgcgaggaggagcgggagatgctgcccctgtgcgaagccgagggcattggcgtcatcccctggtcgccgctggctcgcggcctgctcgcgggctctcgcaagtcgctgaaggaccgggacgccaccacgcgggcgaagtcggacacgctgtcacccatgctctatgaccaggccagtgactgggacgtggcggaagcgaaccggagcgtcgcggagaagcgcaacgtgcctcccgcgcagacggccctggcctggctcctctcgcgccccgcggtgacggcgcccatcatcggcgccacgaagctggagcacctggaggatgcggtgcgcgcggtggacctcaagctgaccgccgacgaagtgaaggccttggaggccccctaccagcctcacgccgtgcgtggactctga

SEQ ID NO: 2516 - DNA, 324 bp, Myxococcus xanthus
atggagcgcctgggcctgaagcccggggacaaggtccccgtcattgtggatgccatccaggaccacccgggcccggcgcgctacaactacagcttcgtgattgcgctgccacgcgagcagggagagcagcaactccccggcgcgcgcatcggtggccgcctgtacgtgacgaagcaccgcgtcttcggccggtatgaccgcatcttcctgccagagtccggggcgatgtcggtgcccttttgcggcatcctcctggactttgtcagggacaacgaccagcccgccgaccacgcacgccccgagtgccagcgattcaagcagcga

SEQ ID NO: 2517 - DNA, 873 bp, Myxococcus xanthus
atggactgggccgcggcgacgtggctcaacctgtcgctgtcctacgaagtggagaacaaccggctgcgctcgcgcgcgggcgtgctggagctgctcaaccgtgccgaccgggagcggctgcgctacccgttcggcgacttcgcgctgcattcgttgcgcccctctgtcacgctcgacttccgggatgacccggccaacccgcgcaggggcgtggtgctcgtctccagcgcggagttcacccgtggcttgagcgtgcgtcccacggacgtggcgggtaaccgcgtggatgcgtaccccatcgacggcgtgaagctgtcgggcagcctcagtggctacatcccgctgggacggcgggcgagcgtggcgctgtccgcgcgcgcgggcaccatcatcccgttggaggagcaggcgcaggccattggctcgaagctgttctacctgggtggttcgtccagcctgcgcggcttccgtgaggacggtgtgctaccggaggacgtccgcggcgcgttgcagcagcggctgcgtgactgccgtgcgctgatttcgccgtcggggtgctccgctgagctgaaggccgtgctcgccgggcaggtccccgcgagccagggtggcgagctcttcaccctgggcaaggcggagctgcgcctgccggccctgtcctccgtggacctggggctcttcttcgaggcgggcaacctgtggctggaccggacgcagttcgacccgggccggctgcgctacacggcgggcgcgggcctgcgctacgtgacgcccgtggggccgctggccttcgacgtgggcttcaacctggacccggacgagtcggtgaacgaggccaccacgcagttccacttcagcatcgggacgttctga

SEQ ID NO: 2518 - DNA, 420 bp, Myxococcus xanthus
atggatggctcgggactgcgctacatggcggatgccctcctctttctcgggcaggtggacgaggcccgtcgtcatgtggaccaggcgctcgtggccatggagcgggacctggggccttcgtcgtccgagcgcatcgaggcgctgctggtgctgggggacgtccatctcgcgcgaggtcagcccgccgaggccctggcgccactgcggaccgcgctggcggacctcacggcccggcaggtggtctccgcccgcgttcccaggctgcgccgccggctcgcgcgggcgcttcggttgacgggcgcggtggaagaggcctgcggagaggcccgccgcgcctgggaggagctgtccgtgtggcgcaaggcctatgtccaggagacggcggacgcgcggaccgagctggggcactgtcgcggatga

SEQ ID NO: 2519 - DNA, 1344 bp, Myxococcus xanthus
atgttccagctcacgcccgtgtcgcggctggcgcggctccgcttcgaaggcaactccgtgctgtcggacggggagctgctggaggccagcagcttgctggagggcgggccgctggaggcggaggagctgcagggcgcggtgtcgtccgtgctccaggcgtatcagcgcaaggggtacgactcgacgagagtctccgtgacgcaggagccggtgacggatggcatcgcggtggtgctcaccgtggacgaaggcctgcccacgcgggtgcggcaggtgaccttctccggcagccctggcctgccgctgtcccggttgctggaggtgctggcgctgcatccggggcaggtgttcgaccgggcgcgcctgtccagctcattggaggagttgcgcaccttgctgcgtggcgagggctactggcgcgcccaggtgggagcgccggcggtgctggtggagggcagcttcgcgtcggtggcggtgcccctgatggcggggcctcgctatgtggtgcgcttccacggcaaccgccacttcccccacggtgtgctggagcgcgtgctggcgcacgacgtttcggagcccatggacgaggtcgtcgctggccggctcgcgcgacgcatggaggccttctaccgctaccgcggcttccacgacgtgcgcgtgcggccccgcgaggtgctgcgtccggatggcgaggtggcggcgctggtgttcgacgtggaggaggggcacccgctgcgcgtggccgacgtgcgcttccacggcaaccgcgggctgccggtggagacgctgcgcgcgctgctcgcggagcaggtgctggcgggcatgacgcggccggagctggacctgcggatgctcgacgacccgctgaacaccgagggacgtcacggcctggagctcccgggcgtcgcgccgccgccgccagcgtccaccgtgtacgtggaggatgcgtggctggaggccgtggaggccatgaacgaggcctaccgcgagcagggcttcctctccgcggtggtggcgttccggggcctgacggtggatgtcgtggggcgtacggcggtcgcggacttcgacgtggaggaggggccccaggcgcgcctggtgaaagtggacttcgagggcgtgccaccgggtctgacggcctgggtcatgggccggcgcatgcgcgagggcgcgccgctgagcttcgacacggtggagtcctcgcggcaggcgctggagcaggagctggagcaggagctggggcggcagggctactcttcgcgcgcgtcaccacggagacgggcgtgggcgaggacggaacgcaggcgaccgtcatcttccgcgcggacgcgggcccgcaggtga

SEQ ID NO: 2520 - DNA, 3846 bp, Myxococcus xanthus
atgccggagacctgggaggtggcgtgcacgctgggccgccgacacctgccagacgtgctgggcctggacgtggggctcggccgctgcgagttggacccgctgggctcccgcgtggtggtgcacggcttctcgttgttcctccccggcacggattcgccgctggtggccgtggacagggcggaggtgcagctcggctttctccagccgcttcagggccggctgacgctggcccaggtgaaggcatcccggccgcgcgtggcgctggacttgtcgcagccctcgtcgccgtcggagcccaagtccaacttctgcttcctggagccgctcgagcacctgcgcgtggcgaagctcgacatctccggcgcggagctgcgcctggcgctgcctgagggccggcgcgtggaggtggacgaactggacgttcgctgggacgagcagtggggcgtcatcgagctggacgtggaggcccggcgcggccgggtgcgcctgggcccggacggacgtgagctggcgttggggcagctggtcatcgcgggcgcgttggacccggacgaggccctgctggagttggagcgcgccgaggtgtcgctggacgacatcaccaccacggtgtccggccgcgtggattcgctgtgcgcgccgcggctggccctggacgcgcaggtgttccttccgctgcgcgcgctctaccaggcgcggctgattcccagccccgcgacggggcacctctggtcgcgtgtgtccatcgcggggaaggtggcgtctcccgcggtgtcgctggagctgtcgggcaacagcctgggctacggggacttcggcccgacgaacctgcacgcgcgcctgtcgtactcgggtgaagacgtccggctggaggagctcaccctgcccgtgggcgcgggcaaggtgcgcgcgacggggcggctggggctcacgccgaacttcccgctggaggtgtcgttgacgacggaggacgcgtcgttgggccgcatcctggaccgggcgggggtgaagggctcctgggtggacttcccggcctcgctggacgcgcggctgtccggcaacctgctgccgcgcttctccctgtcggggccgttggacctgcggaccgggaagttcgtgctggccacgcatgcgttcgacacgcagccgaaggacgggctcacgattctggagttcgacaaggcccgcgcgcaggcgcaggtgaagctccaggcggaccgcgtggccttcagccacgtcaacgcggaggtgggccactcacgcgtgacgggcgacgtcgtgctcctgctggcgggcgggttgggcctggacatccatgggcagggtgacgtggacctggcggactttggccacatcgcgggcctgccctgggccggacggggccacgccacctacgcgattaccggacccgcgtcggacgtgaaggtggaggcggggctgtccttccgcgacttcgagttctggaacctgtcgctgggggtgatgcaggggaagctggcctacaaggacagcctgctcacgttccccgccttctccggtcagaaggggcgcacgcagtactacggcaaggcgggcgtgtccttcgggcggctgctcaacctgcgcctggaggtgaacgtcccgcaggggcgcaacgaggacctggtggacgtggtggcgggcctgagtccgtcgctcgcggtgatgcagggcacgttgggtggaacggccaccggccgcgtggaggtggacagccccgtggagaagctggaggggctggtggcgttcgacgtcaaggacaccacctacctgggccggcgcatgggtgacggcgcggcgcggctgcgcttcgtggatggcaaggcgatggtgctggagcgcaccaccctcacggggccgctgggccgcacctgggcagagggcaccttcacgttcgagggcgggctggactaccgcttcggcggagacggtctgtcgctggccgaggcggtggacccggagctcgccgagcgcatgggcatcgagggcaccatggtgatggacggcgtcgtgtcgggcaccgcggacgtgccggtggtggacgtcacgctgcgcgcgccgcgcgtcaccttcgccgagcggaacctgggcgccatggacctcaccgggcgcatggtggggaagaacttcgaggtgtggggccaccccttcggggacgccaccggccgcatccgcatgaaggtgcaggagaactggccctatgaagcccagggctcgttctcgttgccggagattcgcccgctgctgccggacgcgccgctgtgggcgggcgtcagcgggtccctgtcgggcacggtgagcgccaagggcctgctcttggagcccgcgggctcgcaggtgaacgccaccgtggagcggctggtcctctcccgcgacgacctgcgcggggagaacgcgggccccatcgtgctggcgtacgcggccgggcggacggatgtgcagcccttccgcttcacggggcagcacgtggacctgtcgctgggcgggtggatgagcccgcgcggcctgaacgtgacgctgcggggcgggttggatttgcgcctgctggagtcgttgatgcccgccatggtggagcgctcctccgggcgcatcaccgtggacgccgaggcctccgggacgctggagaagccctccgtggtgggctccgcggagctgttcgacatgcggctggcgctgcgggactggcccgtccaggtgcgcaacatggccggacgcgtggagatgacgggccagcgcgtgctcgtggagcacctgcagggccagctcaacgacggccgcgtgtccgcgcgcggcgacgtgcggctggagcgcttcctgccgcagcggctgggcctcaccatccaactggacgaggtgccttaccggctcacggaggacctgcccgcgaccttctccggcctgctccaagtgattggtccgcccaagggcttcaccgtcaccggtggcatggacatcgtgaagatgcgctaccagaaggcgctggacgtggatgcgctgctgaagacgatgcagaagcgcaccacccacctggcggcgggctcgttgtcgtcgtccggtgagcctccgaagccctgggtcatctgggatgtgaacgtccacttcggcgacgtccgcgtggacaacaacctggcgaaggcccgcctgctgggggacgtgcggttgacggggacggacctgcggccgggactgctgggccgggtggagctggccgagggcagccaggccttcttccggaacaaccccttcaccatcagtcaagggcagctcgaattccaggaccccacgcaaatcgaccctgtcttcgaggtccaggcccagacgcaggtgcgcgagtacgtggtgaagctgcacgccttcggcaagccggcggacccgcagattctcctctcctcggagccggcgctggtggagggcgacatcgtctcgctcctcactctggggttcacctcgtcagaccaggataccgcggcctcggcgagcgccggcctggcggccgaggcccttttcaacgtgtcgggcctggaccggcagctccagcgcttcctgcccagcaatccggtgttgagggatttgtccctgcagatttcgaccacctacaacgacgccacccggcaagcggagcccaccgcgcaactggagtcgaagttcctgagcgagcagcttaaaatcggtatgactcaacccgtgagcgggcgcggcacgcgggcgcgggccgagtaccgtttcgatgaccgactctccgcgcaggcccagtgggacaacgagaacaacgaagcctcgtttggaaacctcggactcgagctgaagctgagctgggaggtcgagtag

SEQ ID NO: 2521 - DNA, 939 bp, Myxococcus xanthus
atgactacgtacctggacttcttcgagctgacccaggagcccttctccaacgctcccgtcagccgcttctattacaactcggcgcagcactcgcaggcgctcacccggctgatgcacgcggtgagctacatgaagggcctgtccatcctcgtcggtgacatcggcgcggggaagacgacgctggcccgccgcatgctcgactcgcttccggagtccgagtacgaggccgcgctgctcgtcatcatccactccggcatcaccgccaactggttgctgcgccgcatcgcgctgcagttgggcgtggagaatccggcgcaggagaagctggcgctgctgtcgcagctgtaccagcggctgctccaaatctacgagtccggcaagaaggccgtcgtcctcatcgacgaggcgcagatgctggagactcgcgagctgatggaggagttccgggggttgctcaacctggaagtgccggagcgcaagctcatctctttcgtcttcttcggcctgccggaaatcgaaaagaacctgaagctggacccgccgctcgcgcagcgcgtggctatgcgctaccggctggagcccttcaccgccgagtcgaccgaggcctacgtcaagcaccgcctccggctcgcgggctgcccgcgcatgcccttcagcccggaggcgctgctggccgtacaccagcactcgtccggctcgccccgcgtcatcaacacgctgtgtgacaacgcgctcttcgaggccttcctcgcgcgcgagcagacggtgtccgcgcagctggtgcatcgcatcgggaagaacttgggcctgcttggggtgaacacgcccgccgggcaagcggccgagcggccgagcgcttcgggcgtcgacgctccccaggacgacgagcagcaaggtggacctcgcggagatcgaccgctacctcgaagggctgggtaa

SEQ ID NO: 2522 - DNA, 3198 bp, Myxococcus xanthus
gaagcccaccgctcgatggacaagaacaagatcatcgaagccgccgcgaagctcgtcgcgaagggcgcctacgacaaggccatcaaggagtaccagaaggtcctggaggtcgacccgaaggacatccgggtcctccagaagatgggggagctgtaccagaagaagaacgacaacccgcaggccgcccatttcttcaccaaggtcgcggagagctactcgtcggacggcttcttcctcaaggccgtcgcgctctacaagcaagtcctcaagctcaatccgaacctgctggaggtgaacctcaagctggcggagcttcaccagcagctcgggctgatgtccgaggcgatggcgtacttccagattgtcgccaaccactacgacaaggcgggcgacacgaagtcgtcgctcgataccttgaagaagatggtggatctcgacccggagaacgtggcgtcgaagatcaagctggcggagctgtacgcgcgcgagaacatgacgcgcgaggcggcccaggagttcaagcgcgccgccgagtacctcaagcgcaacagtcgcgcggatgactggctccgcgtggccgagcggctgtccgcgctggagccggacaaccttccgctgtcgaaggagctggccacgtcgtacctgcagcgcggcgaccagaagcgcgcgctggcgaagctgcaggtgtgtttcaaggccgacggccgcgacgtggagacgctcacgctgctggcgcaggcgttccagggcctgggccagacgtcgaagaccatctccgtctacaaggagctggccaagattcatcaggagcgcggccgcgtcaccgaggccgaggctgtctggacgcagattgaagtgctggaccccgaggacccggacctggtcgcgcgccgcgcgcccgagcccgctccggcggcgccccagcccgcggcggcacctcagcccgccccgcgccccgcgccccagcccacggcggcagcgccggcgccggcgcccgtggcacctcccgctccggcggggatggggcgcgagcagctctccaagctgctcacggagacggacgtctacgtcaagtacggactccacgacaaagcgctggagcacctgcgcaaggtcttctccgtcgagccggagaacctcgacgcccacgagaaggcgtatcaaatctacgtcgcgtccgggaacatggcccaggcatcggagcagctgctgaatgtgctccgcctgtgtacgcgcacggccgacgtgcagcgcgcgcagccgtacctggccaccatcctccaggagaatcccgcccatcccgaggtgcccgcgtttctgtccgtgctgcgcacgacggggcccgtggtcgccgcgccgacggtgtccgtggtggagtcggtgggcgaggacgccatcctggtggactccagcgacgacgagattctcgtcgcgccgccgccggaagacgcgctcctgcacccgcccggtgacgagctggcgctgacgacgctgccctcgagcgattcggacgaggtcatcgaggaggacagcgactccgccgtcatcagcgaagaggcgctggtgggcgaggccatcacttcgggtgagttcgaggtgtacggcacgccagatccggaggacctggcggcggcgtcggtggacgagacgctggtgacggacgacgaccagttggtgctgtccgacgagccgggcctcagcgtcaccgatgacgagccgctcgtcgcctccagcgatgatgacctggctgccgtggcggcgtactcgctcgacgacgagtcgctggtggacgacggcgccgccacgtccatggaagcgctgtcgctcggggacgacgacgagccgcagcccacgcagatgcacgcgcccacgcaggcgctgctcgacgaggcctcgccggacacgctccaggttcccacgctggactcgctggacgtgcctgcgctggacgacgaggcgcctccaccgctggacttggagaatgtgcccacgcgcgtgggcgccgcgccgttgacggctgccgacctggacgaggacccgttcggggcccccgcgctgggcgacccgatggagttcgaggagcccacggcctcgcacgccatcgtgacggtggacgacgagtccttcgtggacgacgcgccggacctgtccgcggacgagctgtccgagccggtcgcctacgaggagcccgcggtcgaggtcgagcccgatccggaacccgagcccgagccggcagtcgaggccgccgccgatgaagaggagcccgcggcggaggagtgcgacgaggcgtcgttcttcctcgaccaggggctgctggaagaggcgcgcgagattctcgagacggtgatgattgccttcccgggccacgcgcgcgcagccgagctgatggagcggctggaggcggcggaggcgggaggcggcgcggagcaggaggacgcggccgcggagccggcgcagattccgagcgtgcagcccgtcacggacggctacgaggacgccgaggagaccacgggcgagcgcgacgcgttcgacctcgcggcggagctggccggggagatcgacaacttcggcgatgacgccggggcctcggcgctgcctgcggaagaggacttccagtactcggtggaggaggtcttctccgagttcaagaagagcctggccaaggtggtgaagcccgaggacgtggacacgcattacgacctgggcatcgcgtacaaggaaatgggcctgctcgacgacgcgctccacgagttcgacgtggcccgccagggcagcgcgggcggcaagcgcgagctggactgcatcaccatgatgggcatgctccaactgctgcgcggcgacgcctccgcggccgtggaggccttccgcgaggggctgggcaacccccacgccacgggcgaggcggccaaggcgctcggcttcgagctggcggcggcctacgaggcccagggggaggcgggcaaggcgctcttccactaccagcgcgtggccgcgatggacgggaagtaccgcgatgtcgccgggcacgtgtcccggcttgcggcttccgtggcgccggtggaggatccgcttccgacgccttctggcaatggggcccaggccaccagcagtccgcccgcacccgcgggggccgcggcgcccaccactccgataccagcggctggcgcgtccaaggcgcgcaaggtcggctacctgtag

SEQ ID NO: 2523 - DNA, 1383 bp, Myxococcus xanthus
ttcaagaaggtgctgatcgccaaccgcggggagattgccctgcgggtcatccgcgcctgccgggagttgggcatcgccacggtcgcggtgcactccacggcggacgccaacgcgctccatgtccgcttcgcagacgaggcggtgtgcatcggcccgccggcgtccaaggagagctacctcaacgtcccgcagctgctgtccgcctccgaaatcacccgcgcggacgccatccacccgggctacggcttcctgtcggagaacgccgagttcgcggaggtctgcgagaactgcaagattcgcttcattggcccccggccggagatgctccggctgatgggcaacaaggtgcgcgcccgccaggccgcgcgcgaggcgggactgccgctgcttccgggcagccccggcaccgtgaaggacccgcgtgaggcggaggccttcgcccgcgagattggcttccccgtcatcctcaaggcggccgctggtggcggcggcaaggggatgaagatcgtccgcgagccgggcgcgctggcgcaggccttctccaccgcccaggcggaggccgtggcgtcgttctccaatggcgacctctacatcgagcgctatgtggagaagccgcgccacatcgaaatccagatcgtcgcggacgagcacggcaacatcgtccacctcaacgagcgtgagtgctcggtgcagcgccgacaccagaagctcattgaagagagtccgtcgccggcgctgacgccggagctgcgcaagcgcatgggcgaggtgtccgtgaacgccatgcgcaggctcgcgtacaacaacgtgggcaccatcgagtacctgctcgacgagcgcggcgagttctacttcatggagatgaacacgcgcatccaggtggagcacccggtgacggagctcgtcacgggcgtggacctggtgagcgagcagatccgcctggcctatggggagcccctgcgcttcacgcaggaggacgtccagattcgtggccacgccatcgagtgccgggtgaacgccgaggacccgattaccttcgccccctggcccgggaagattaccggctacagcgtgccgggcggctacggggtgcgcgtggactcgggcgcctacgagaactacacggtgctgccgtactacgacagcctcctgtcgaagctcatcgtccacgcggaggaccgggctacggccatccgccgcatgcagcgcgccctgggcgaatacgtcgtggaaggcatccgcaccaacatcccgttccaccgggccgcgctcgcggaagagtccttccaggagggcaattacgacacccgtttcgtggagcgcttgctcgcgagcgagacgggctcccggcggctgaagaaggccgtcgaggagacgccgtag

SEQ ID NO: 2524 - DNA, 600 bp, Myxococcus xanthus
atggcaacgaagcgcaagtcgacccgggcccaggcgcccgctcggacggaggccgcctcgagcggtcccgctgacacgggtggcacgtccctggacgtggatgccctgcagcagatcgtggagattctcgagtcctcggacgtcacgaggctggtctggaagcgcggcgaggagaagctcttcatccgccgcggccagggccccgagacgaccatcgtccaccacgccgcgccggctcccgtcgccgcgagtgtcggggtggagtacaccgcccctgccgctcctcgcgtcgccgcgccgccgccggccgctactcccgccgcgccggctccggccgccgagaagccggtggagaagcctggccaccaggtgacgagccccttcgtggggacgttctaccggacccccgcgccggaccagcctcccttcgtggaggtgggctccatcgtgaagaagggccaggtgctctgcatcatcgaagcgatgaagctgatgaacgagattgagtccgaggtctccggccgggtggcggaaatcctcgtggagaacggccggccggtggagttcggtcaggcgctgttccgcatcgaagtggcctga

SEQ ID NO: 2525 - DNA, 579 bp, Myxococcus xanthus
atggccggtgtcatcgatacgtccgagttccgcaagggtctgaagattgaaatcgacggtgagccgtttgaaatcgccgatttccagcacgtcaagcccggcaagggctccgcgttcgtgcgcaccacgattcgcagcctcctgacgggccgcgtgctccagcccacgctgaagtccggtgagaaggtgggcaagcccgacatcgaggagaaggacatgcagtacctctatgtccagggcgaggagttctacttcatggacacccgcaactacgagcagaccttcctcggtgagaaggtgctcggagaggcgaagaacttcctgaaggagaacatcaacgtcagcgtcctcttctacaatggcaaggccattggtgtgacgctgccgaactccgtggacctcaaggtcacccagtgcgatccgggtatccgcggtgacaccgtctccggcgcactgaagcccgccgtcctggagaccggctactccgtctacgtcccgcttttcatcgaagagggtgacgtgctgaagattgatacgcgcgacggtaagtacctgacgcgcgtggccaccaggggctag

SEQ ID NO: 2526 - DNA, 363 bp, Myxococcus xanthus
atgtccttccgcacgcacctcgagtcggtggtcaaccaggtcgaaggagccctcgcgtgcagcgtgatgggctttgacggcatctccgtcgacaccttccagaaggatgagagcgccgagctggacctcaacggcgcctgggtggagtacgccaacctcctcacccagttgcgcaacgccgcggagaccctcaagacgggcaccgtgagcgaggtcagcgtcaacagtgagaaggtgctgaccgtgatgcggctggtgtcaccggactacttcctggtgctcgcccttcacgcggatggtaacttcggcaagggccgctacgtgctgcgcgtcactgcacccaaggtgcgcgccgagctctag

SEQ ID NO: 2527 - DNA, 664 bp, Myxococcus xanthus
atgaagaacttctatctcgcggtgccgttggcactgaccatgactggatgcgctgacagtgctccagacatccaggttttcaacgcgttcattccggatgcttcctgtgcggtcaaccagtcctggctcgccagttcgggcgggtcactggacctatcgacgtcaggccgttacctcgctgcgttccacggtccggaacagcctctcgactcaggaggtcgtcgttggtgaagcccccgtaacaggtggtggcgacgagtcttccatctacgtcaacaacgtcgagttgaactacgaaacgcaaggtacggggccgacgctcaggagtgacgtctacccctactatttcaacctgccagcgaacgcgacgcagagcagcagtgcggtcctggatctgctgggggccaatgcgagcgctgacctcgccgcctatttcggcggtggcggcactgcgcccgtaagcgtcgtcgttcggctgaagctgatcggtaagaccgtcaacggcaagtcgaccgagtcgaacgaggccacgtaccccgtcacgttctaccattcgggcttcacttgccaggcaggaacgcagctcgtgcccaccgggccctgcgggcttccgggtgggcaggatggcttccctcccgagtgcaccgagcccgaggaaacgtag

SEQ ID NO: 2528 - DNA, 1689 bp, Myxococcus xanthus
gtcaagcatgtgcgcttccagcagagcagctcggggggccgcattgtgatgaagctgtcgggcacctccgggtgcaaggtggactggctggatcctcgcagcgcggtgctgacgctggacaacgcgcgccttccgaagaagttcgagcgcagcctcgacaccagcgcgttggatacgccggtgaagatgatcagcgccttcagtgtcccgggagcgggcggcaaggtgcgtcttgtggtggccgccgatggtgccattgaagaaaaggtatcccagagcgcgggaacgctgtcgtggcgtctgcatgtgaagggcgtgaacacggagcaggtgcccgtggctcagcgcaccgctggcttcaccaccgaggcgcctgcctacgccgcagagggcgcgccccagcaggcccgctaccgtggcaagcgcgtatccttcgagttcaaggacatcgacatccagaatctcctccgcgtcattgcggagatctccaagaagaacatcgtggtggcggatgatgtcagtggcaaggtgaccatccgcctgcgcaatgtcccctgggatcaggcgctggatctcgtcctccgtaccaaggcgctgggcaaggaggagttcggcaacatcatccgaatcgctccgctgaagacgctcgaggaggaggcccgactgcgtcaagagcgcaagaagtcgctccagcagcaggaggacctgatggtcaacctcctcccggtcaactacgccgtggctgccgatatggcggcgagggtgaaggacgtgctgagtgagcgaggttcggtgacggtggatcagcgcaccaacgtcctcatcgtcaaggacgtgcgttccaatacggagcgcgcccgctcgttggtgcgcagcctggatacgcagacgccgcaggtgctcatcgagagccgcatcgtggaagccaacacctcctttagccggtcgctgggcgttcagtggggtggtcaggctcgcgcggggcaggcgactggaaactcaacgggcctcatcttcccgaacaacctggccgtgacgggtggcgttacggggaccggcgcagggcttcctgataatccgaactttgcggtcaatctgcccacgggtactggacagggtgtgggcggagccatgggattcacgttcggttcggcgggcggggcgcttcagctcaacctgcgcctgtctgcggcagagaacgagggctcggtgaagaccatctccgcgccgaaggtgacgacgctggacaacaacacagcccgcatcagccagggtgtgtccattcccttcagccagacgtcggcgcagggtgtgaacaccaccttcgtggaagcgcgtctgtcgttggaggtgacgccgcacatcacccaggatggcagcgttctgatgtccatcaatgcgtccaacaaccagcctgacccgtccagcacgggtgccaacggtcagccttccatccagcgcaaggaagccaacacccaggtgctggtgaaggatggagacacgacggtcatcggtggcatctacgttcgccgaggcgcaacgcaggtcaattcggcgccgttcctgtcgcggattccggtgctgggcctgctcttcaagaacaactcggagaccgacacccggaaggaactgctcatcttcatcacgccccgcattctgaaccggcagaccattgcgcagactctgtaa

SEQ ID NO: 2529 - DNA, 1751 bp, Myxococcus xanthus
gatgcccgttcggaccagttcgccttctgcgtcgcgctctacgaggcgctcaacgggcagcggcccttcgcgggtgccacgcgcgaggagctcctggcatccatgcagcgccaggaggtgcggccggagcagcggggcgtgccctcgtggctcaaggccgtggtgcggcggggcctctccgtggacccgtcgcggcgcttcgagtccatgcaggtgctgcgagcccgcctcgcgcgggaggtgggggcctggaagcgcagcgcggccacggcggtgctcgcgggaggactggtgggcctggggttcctcgtgctggggccttccgcggcggcgccgagcgaagtctgccagggcagtgaacggcacctcgagggcatctgggacgcgtccgtgcgtgagtccacgcgtcaggcctttctggggacgggagaccccgcggccgaggcctcgttccaggccgtggcctccacgctggagcagtggacgcaggactggacgcgcgcgcatcagtccgcgtgcgaggcgacgcgtgtcttcggcgagcagtcggaagcggcgctggggctgcggatgacgtgcctggaccaacggctgggagagctgtcgcggctgacggcggcgctccagggcgcggacgcgcggacggtggagcggggcttcgcgctgggggcctcgctcggcggcgtgggcgggtgcgcggacgtgcgcacgttgcaggaggccgtgtctccgccggaggacccgaaggcgcgtgtggaggtggacgcggtgcgcgcggagctcgcgcgggcgaacgcgaagaggctcgcggggcatacccccgagggcctgcgaatcgcgcttgccgcccgagcgcgtgcgctcgccacccatcatcggccgctggaagccgaggcgcatcacctctgctcgcgattgcaggaggacgcgggggcattcgaggacgcgcgcgagtccctggtccagggtgctctggcggccgaggcagggcggcatctgggcgtgctcgcgcgggtgctgcacttccaggcctggctgcatgggtacggaatgggacggccccaggaggcatggcccttcctccatcgcgcccgggccctggcggagacgctgcgagacgccgagctggacatcctgctggaccaggtgcaggcggagctctggagcaggagggccgcttctcggaggccgagtcgctgctccgtgccttgctggaaaccgccagcgcccggggccagacgttcacgcgcgcggagctgaacggccggctgggattgctggctcggcaacagggacggttgctggaggcgaagcgttggcaggaggaggcgctgcgcgtccatgagaagcacttcgggccggcgcaccgggacacgggacgggccctgtcgaacctggggggcacgctggcccttctgggggagctatcgagcgccgaggccgtcctcaagcgggcgctgggcatccttcgccagacgctgggttcggagaacctgtcggtggcccggaccttgtccaacctgaccctcgtctacgtcgagtgggggcatgcggcccaggcgcgggaggccgcggaggagagctgggccgtggcgctcaagagcgtggccgccgacagcccggtgttgataggggtgaagtcgaatcggctgggggtgctgggcgagcagggcgagcgtttgccggagctggagtatgcccgaggcctcctgggcgcatcgcgagcgtgcctatggcgccacccaccctga

SEQ ID NO: 2530 - DNA, 705 bp, Myxococcus xanthus
gccatgccgcccccgtcggccgccgcaccggcccctggggctcgtccgctgattcaagtgcggcgcatcaccccgcccgggcgcgcgcccgcgcagagcgcgccctccatggatgccgatggcggcaccacggactggatgatcatgaggagcgagcggcgtgagcagggcaaggccgacgccatgaagaagaagcgccaaaagggaggaatcctctccaacttcttcggcggcggtcagtctccagattcgctgaaggaggcagagctcgaggaatccgacgcgtaccgcgacgaggctccggccgccgagggcggtgtcgacacgggcgcggagagcctgctgtcccggcagctcgccaacgggctctgggaaggcaccggcgagggttccgagcccgtgcgacaagcgcgtgccacggcgctggccttgctgacgctgctgcgcgagggcatcaccagcagccatccgctgcatggtgcgcaggtgaagaaggcggtggaggccctgctgtccctggccgccagcctgagcggcgatgcacaggtggcggagctggcgctgggcgtggcgtggctggccgcggcgggaccgcgcacccggggccgcatcgagcaggccgcgaagccgctcgccgggctcaacggccggctgggcaacgaggtggccctgcgcgagcacgtcgacacgctggccgcgcgctga

SEQ ID NO: 2531 - DNA, 1113 bp, Myxococcus xanthus
atgacgctcgccacgctcatcctgcttgccacgctctccgctcagccctcggaggctcctccctcttccgaggccacggcaccggagacagtcaccgcgccgcccctggtgtccacgcccgatgcctgtgcagcgagctccgaggcggattactcggcgggcttcgatgcgctcgtgagcggcaacgacgcgaaggcgctggagctgttcgagcgagtgctcgcggcctgtccacagcacccctatgccaccgagctggcccggctctcccggacacggctcgcgcctgggggtcggctggccaccggcgccgcgagcgagatggggcgagagccttactccagcgccgcgcgtgcctctctcgtcgtggtgcagacgctgcacggggtcgcacaaggcatcctcctgtgcgccatcggagattgtagcggccagggttacgccgcggtgtcactgctgggcgccggagcgggcgccgccagttcgctgctgctcacccggggcggggtgacggacggacaggccgccgtcatcaactccggcaccgtgtggggcttctggttcggtatcgcgacgctgctcgccttcgacctggatggtgaccatgccattggcgccgccatcctcggcggggcgggcttcaccggcgtgggcgttctgctggcgcacctggtgaaccccacctccggacaggtgtccctggccaactcgggtggcctctgggcgggcgcggtgacggcgctgttcctggcgacttcggacaacactgacttgaagcgtttcttcgccgtcgagctgggcgccacggccgcaggcatcctgtcgatggccatcctgtcgaagtatgtgccggtgtcccgaggccgcatgctcctcatcgacgcgggcggcatcctcggcgggctggtgggcgcgagcgccctctacctcaccgcgggcaatgacgcgggagacgccatcctcgtgggcagcggcgtcggtgtgctgggcggactggccctcaccacgtacctcacccggaacttcgacctcccggacgcgccccaggtggcgctggcaccgctcaccacgccacgcgggggcacgggcctgtcgatggtgggccggttctag

SEQ ID NO: 2532 - DNA, 330 bp, Myxococcus xanthus
atgattcccatccgccgcccgaaggacggcaaggggcctgcggccacgcccttcaccccggatgactatgccacctccgcctcggtggccttcgacaaacgggggttcttcgagaaggagacgcgccgacaggtgtctggctatggcgacatggtccaggtgctgagcgcgtatgagacgcgtgaaaccgcggacgggccggtgatgaccacgggcgtcaacagcttgcagctcgtcttcgatggccggcgctggtggattctcaacatcgcctggacggacgacaaggccgcgggggttcccgtgccgaaggacttcacccggaagtag

SEQ ID NO: 2533 - DNA, 837 bp, Myxococcus xanthus
atgggtgacgcgtccctgcgcgatgtgctggtggtggggagctactgccacgacctgctccggcatggccccgggcgggaaacacatgcgctcggcgggtcgacggcgtacatcgcgtccgtcctggatgcgatggggctggagtacgcggtggccgcggtggccggcgaggacttccgttacgcggaccaggtccggcatccgccgcgcatcgttccgggaacgcgcaccacgcagttcatcgcggacttcgagggagaggcacggacgcttcgcgtcagcgcgaaggcggagccgattcgccctgcggacatcaccgtggacgcacgcgtggcactggcgtgcggggtggcgggtgaggtgctgccggagacgctgctccatgtctctgagcgggcgcggcatgtgctggcggatgcacaggggttgattcgggcgctcgatgatgacggacgggtgctcaatctccgcctggaggacacgcctttcgcggggctgctggagcggcttcgggtgctgaaggccagcgaggaagaagcccgggcaatggacatcgagcgggtacgtcagcggacgtgcctggtggtgacgcgtggggcgcggggctgcacggtgttcacggcggatgcgcgcatcgacgtgcccacggttgcggtggaggaagtggatgccacgggcgcgggggactgcttcatcgcgggcttcacgctggggttgctgcgaggactgccgttcgaacgctgcgccgcgctggcgaactggtttggcgcgcaggcggtgacgcaggtgggtgtgccgaagctggatgtcagccggcttccaacggaactgcgataa

SEQ ID NO: 2534 - DNA, 135 bp, Myxococcus xanthus
atgtaccagcacaagcgcgcgggtgacctcgacagtgcccgccaggaaatgcgggacgtgttggccgccgaggaggtgccgcactaccgcgccgttgcgcagggccaactcaacctgctggatgatgagccttga

SEQ ID NO: 2535 - DNA, 1458 bp, Myxococcus xanthus
atggtgggcttcgcacggttcttcgcacgcacgccacacgacttcacgccgcgcgcgtcccttcccaccgggcgcgaggggatgatggcgttccttcccgaaaggactgctccccgcatgactcgcgtccggcacgccctgctctccgccctgctcctcgccacccccatcgccagcgccgcgcccgccgaccccatcgcgtcccaggacgactggccccgcctccgcaaggagcgcatccagaaactgctgccccaggccatggcccgcgccaacgtggacgcgtgggtggtcatctgccgggagaacgacaacgacccgctggccatccacgtcgggtgtgagaacgccggaggcaccgccgccttcctgttcctcaagcaggacgcggccgtgcgcggcgtggccctgtcaccggaaggcgaggccaccgcgctccgcgacgtggcgccgctcgatgaggtggtgccgctgccgcgcggaacgaatctctacgcgcagctggcctcgcggctggcggcggcgaagccgaagcgcatcgccgtcaattcgtccacgtcggtggcggtggccgatggcctgtccgccacgcagcgcgccgcgctggagaaggccctgacgcccgcgttgcgcaagaagttggtgtcctccgaggacctcgtctccgagtggctctccgtgaagctgcccgaggaggtggacatcctccgcaaggccgccgcgctgacgtcccagatggagatagaggcctaccgcgcggtagtgccgggcaagacgcgcgacgtggatgtggcccgcttcctccgccagcgcatggcggaactgggcgtgggcgacgcctgggcgccggaccagaaccccaacgtccagagcggccccacgcgcgggcactcccacgccaccgagcgcgtcatccagccgggtgacttcatccagacggacttcggcatccgcgtgggcggcatgtgggtgacgaacatccagcgcttcgcctacgtgctggcgccgggcgagacgcatccgcccaaggaggccctggagaagtgggagaagggcaagaaaggcagccggattgcattggccaccctgaaacccggcgtgcgcggctgggacgtggacaaggcccagcgcgactggatgcgggaagccggctccgcgcccgtcatgtggggaacggggcacccggtgggctactgggcgcatgacgtgggcccggcgctctccggcgcgcagcagggcaagcccgcggcgggacaggcggcgcgcatcgtccggcccgggcaggtcttcgccttcgacgggttcttcgcgtggccggacggcggcgagggcgagcagcgcatcatcgccgtggaggagatggccgtcgtcaccgaaacgggtgcggaatacctcatcccaccccaggaagatttggtgctcatcccctccccgggtccttcccgccccgtgccgtga

SEQ ID NO: 2536 - DNA, 408 bp, Myxococcus xanthus
ccgatgcagaacgtgctggtgattgacgacgacgccttcgtgctctcggtggtgagggacatcctccagagcgcgggctacggggtcgtggcggtgcagtcacccgcggaggcgttcaacctggacctgtccagcgtctccgccatcctctgcgactacaacatgccggacatgaacggctccgacgtgctcacggtgatgcgggagctgaaggactgccgggtgccgttcatcttcctcaccggacacgaggagctggatgacctcgtgtccgtggccatccgctacggcgcggagctgctgcccaagcccatccagcccgtggagctggtgcggctgctcgtcaaacagctcgcctccgcggcctgagcgcgatgtgtccacgcgctgcgccacagatgacaatgg

SEQ ID NO: 2537 - DNA, 828 bp, Myxococcus xanthus
atgtccggttcgcagggaagtgtcgttctcatcaccggtgcgtcgtccggcatcggcaaggcgtgcgcggagctgctgagcgcgcgtggccacatcgtctacggcaccagccgccgtcccgtggaggccgcgcctccgggctaccggatgctggagctggacgtcacccaagacgactccgtgcagcgagccgtggcgacggtgctgtcgcgtgagggccgcatcgacgtggtggtgaacaacgcgggtcatgcgctcgcgggcgccgccgaggacacctctatcgaggaagcgcgcgcgcagttggacgccaacttcctgggcgcgctgcgcgtgtgcaaggcggtgctgccttccatgcgcgagcggcgcgccggccgcatcatccaggtcagctccctgggcgggcaggtggggttgcccttccagtcgctctacagcgccagcaagttcgccctggagggcttcaccgaggcgctgcgccaggaggtggccgagttcggcatcgaggcgacgctggtgcagcccggagacgtgcggacgcagctcacccagaaccgcgtgtgtgtcgcgaaggcgggcgcgggttccgcgtatcgggagcgcttcgaggccgtgctgaaggccatcgagtccggcgaacgcggcggcctcgccgccgaggacgtggcgaagaaggtgctggaggtgatggagcgcggagcgcctcacgtgcgctacccggtggcccaactggcgcagcgcgtggcggtggtggcgaagaccgtgctgccctcacgcaccttcgagcagattgtcatgtccatctacggcctgcgccgccgctga

SEQ ID NO: 2538 - DNA, 198 bp, Myxococcus xanthus
atggcggtggtctacttcctgtcgcccgtggacgcgctgccggacgtcatcccggtgctcggctggctggatgacctgggcgtgttgtccgccgccgccttcttcatggtgcgcgaggtgcagcgccaccaggtcgtcatctccggagaggatgcgcagccgggggtcgccgctcaggcgcgcagcaagacggtctga

SEQ ID NO: 2539 - DNA, 1053 bp, Myxococcus xanthus
ctgctttcgctcgacgacgtcacccttcgttattcctccagcggtaccgccgcggtggaccgcttgtccctggcggtggagcccggcgaagtgttggcgctgctgggcccgtcggggtgtggcaagacgacgacgctgcggctggtagcgggcttcgagcgccccaacagcggcaccgtcacgttggacggccgcaccctggccagtcctggcgccttcgtgccgtccgagcagcgcagcgtgggcatggtgttccaggactacgcgctcttcccgcacctgtccgtggtggagaacgtggccttcggcctcaccgcgatgccgcgccaggaagcccgcgcccgcgcgagcaacatgctgaagctcttcggcctggagggcttcgagtcgcgcatgccgcacgcgctctcgggtgggcagcagcagcgcgtggcgctggcccgcgcgctggcccccgggccgcgggtgctgctgctggatgagcccttctccagcctggacagcgcgctgcgggcctccacgcgaatggaggtgcggcgggtgctgaagtcgctgggggccacggtgatgctcgtcacgcatgaccagcaggaggccatgggcttcgcggaccgcctggcggtgatgcgggcgggccaggtggagcaggtgggcacgccggaggctgtctacgccacgccgcgcacggccttcgtggcgtacttcctgggcggcaccaacttgctgccgggcgtgggcttcggcaatggcgcccggacgctgctcggcatccttccggtgacgggcgcgccagcgaagggcaacgtgctgctgtcgctgcggccagaggcgatgcgactggtgccggacacggacggcgtcgcgttgggcggcgcgctgcgagcggaggtgctggcgcgcgagttccagggcccctccgccgagttcaccgtggcgtgcaacggcctggagctcaccgtgcgcggcgcgccggacctgccgctgcgcgcgggtgaccgggcgaggctggaggtggtgggccgcgcgatggtgctggaggacatcccggactga

SEQ ID NO: 2540 - DNA, 1521 bp, Myxococcus xanthus
atggccacgctggcgctggttcccgcgatatacctgtgcgtgcgcgccgcggaagcggatgcggacgcatggggcctgctgctgcgagacaagacgtggggcctgttgggccgcacgttggggctcgcggcggcggtgacgggctgcgcggcactgctgtcgctgccgctggcctggctcaccgcgcgcacggacctgccggggcgccgtctgtggacggtgttgttgtgtgtgccgttggcggtgcccacgttcgtcagcggctacgtgctgctggcggcgtttggcgtgggcggcgcgctggaggaacccctgacgcgctggggtcttccggtgccacccgtgtatggctttcccggagcgctgctggcgctgacggtgtcgacgtatccgtacttcttcctcgcgctgcgcgccgggctcctgtctcaggacccggcgtggctggagggggcgaggagcctgggactcacacccgcccgggccttcttccgcatcaccgtgcccctgctgcgtcctgccttcgcgtcgggcgcgctgctggtggggctgtatgtcctctccgacttcggcgcggttgcgctggtgcagtatgacgccttctcgcgcgccatctacgtgcagtacgagggcgcgtacgaccgcagctacgcggcgctgttgggcctggcgttggtgtccgtgacggtgggcgtgctggccctggagttgtggctgcgcggccgtgcgggctaccaccgcagcgcgaagggcgcggccagggcttcctcgctcgtacaactgggccgctggcgcgtgccggcgctgctcttgtgcggcgcggtggtggcggtgggcgtggggctcccggtcggcgtgctcgtctattggggcgtgcaagggctgtcggtggagtcggggccgatgatggggcccgcgtggaactcggtgagtgcttccatgttgggcgcggtggcggcggtggtgggcgcgttgccgctggccttcctcgcggtgcgctacccgagccgcctcacggtggcgctggagcgcgtgtcctacgcgggttatgcgctgccgcccatcgtgctggcgctgtcgctcgtcttcctgggcgtgcagacggtgcccttcctctacggcaccctggtcatgctggtgctggcctacgtggtgcgcttcctgccgcaggcggtgggcgtggtgcgggcgtcgttgcttcagctcaacccgcacctgccggaggccgcggcgtcgctgggccagcctccgtccggcgtgctgcgccgggtgacggcgccgctgctacggcccgggctgctggcgggcgcggcgctcgtcttcctcacggcgatgaaggagcttccggccacgttgctgctggcgcccatcggcttcgagacgctcgccacgcgcgtctggggcgccacggccgagggccgcttcgccgaggccgcgctgccggcgctggtgctgatggccgtctccacgctgggtgtggggctgttggtgtcgcaagagggcggctcgtctccgagttaa

SEQ ID NO: 2541 - DNA, 984 bp, Myxococcus xanthus
atggtacgactcctcctggcctccctggtcctgaccctggcctcccccgcgctcgcggcggagacgctcaccatctactccggccgcaacgagaagctcgtgggcccgctcctcaagaagttcactgagaagacgggggtcgaggtgaaggtgcgctacggcgagacgccgcagctcgcggccacgttgctggaggagggggcgaagacgcccgccgacgtgttcttcgcgcaggacgcgggggcgctcggcgcgctggcgaaggcgggtcagcttcaggtgctgcccaaggagacgctggacaaggtggatgcgcgcttccgctcgccgcagggcgtgtgggtgggcaccagcggccgggcgcgcgtggtggcctacaacacgaagaaggtgaaggcggacacgctgcccaagagcatccttggcttcacggatgcgaagtggaagggccgcctgggctgggcgcccaccaacgcctcgttccagtccttcgtcaccgcgctgcggctgctcaagggcgacgaggccgcgacgcagtggctcaagggcgtccaggccaacgcgccgcgcgtctacaagaacaactccgccatcatcgaggcgctggggcgcggtgaaatcgacgcgggcttcgtgaaccactactacctgtactccgcgaagaagaacaaagcggacctgcccgtggccaactacttcgtcgcggcgggtgacccgggcgcgctggtgaacgtggcgggcgtggccatcctcaagggctcgaagaacacggacgcggcgaagaagctggccgcgtacctgctggacgccgacgcgcagacgtacttcgcgcaggagacgtccgagttcccgctggtgtctggcgtgaagctggctgagggcctgccggcgctcgacaaggtgggctcgcccgacctggacctgtccaggctggatgacctgcgcggcaccgtgaagctgctccaggatactggcgtcctctga

SEQ ID NO: 2542 - DNA, 2763 bp, Myxococcus xanthus
gagctcattcccgtcaacatcgaagacgagatgcgccgttcgtatctcgactactccatgtccgtcatcgtggggcgcgcgctgcccgacgtacgtgacggactcaagcccgtgcatcgccgcgtgctgtacgcgatgaatgacctgggcaacctccacaaccgggcctacaagaagtccgcccgcgtggtgggtgacgtcatcggtaagtaccacccgcacggtgactcgtcggtgtacgacgccatggtgcgcctggcgcaggagtggagccttcgctacctgctggtggacggccagggcaacttcggctcggtggacggcgactcgccagcggccatgcgttacacggaagtgcgcatggagcggctggcggaggacctgctggcggacatcgacaaggagacggtggacttcggtcccaactacgacgactcgctggaagagccgctcgtcctcccgtcgaagttccccaacctcctggtcaacggcagcagcggcatcgcggtgggcatgaccaccaacatcccgccgcacaacatgaccgaggtcatcagcggcacgctgcacctcatcgacaacccgggctgcacggtccgggacctgatggagttcatcaccggtccggacttccccaccggcgccatcatcaccgggcgcgagggcatcgtccgcgcctacgagacgggccgcggccaggtcaccatccgggcgcgctcggacatcgagacctccaagcggggtgaccgcgaggccatcatcttctcggagattccgtaccaggtgaacaaggcgcggctcatcgagaagatcgccgagctggtgcgcgagaagaagctggagggcatcagcgacatccgcgacgagagcgaccgccagggcatgcgcatcgtcatcgagctcaagcgcgatgcgatttcgcaggtggtgctcaacaacctgtatgcgatgacgtcgctggagacgactttcggcgcggtgatgctggccatcgacggcggtcagccgcgcacgctcaacctgaaggagatgctggaccggttcatcgcgcaccgccgtgacgtggtgacgcgccgcacgcgctacgagctgcgcaaggcgctggcgcgcatgcacatcgtcgaaggtctgctcgtcgcgcaggacctcatcgacctggtggtcagcctcatccgcgcgtccaaggacccggacgaggcgcgctggggcctgatgaacatcctgtcgccctcgctgtacgagcacgagcgcttcgcgaccctccagcgcatcgactacgacaaggcgaaggcgcagatggagctgctcgtctcgcgcgctcgcaacgaggagcccagctacgcgggcctggcgcacaagtacgagggcgcgggcttcagcgagggccaggcgcagaacatcctggagatgcgcctgcagcggctcaccggcctgcagcgcgaggagctgttccgcgaactcatcggcctggtgcgcgacatcgcgcggctgcaggacatcctggccaacgagcgcagcctgctcaacgtcatcaagacggagctcgtggagattcgcgagcgctacggcgacaagcgccgcacggaaatcactggcgccgtggatgagatgaccagcgaggacctcatcgcctaagagacgatggtggttactctgtcgcacacgggctacatcaagcgctcgccgatgaccgagtaccgggcgcaaaagcgcggtgggcgcgggaagacgggcgctgcgacgaaggaagacgatttcgtcagcaagctgttcgtggccagcacgcacgcgtacctgatgcccatcaccacgaagggcaagctgtactcgctgaaggtgcaccaggttccgcaggccagccgcacgtcgcgcggcaaggccatggtgaacctggtgcagttcggcgagggcgagcggttggcgcaggtgctggtgacgcgtgacttcccggagaaccgctacgtcttcttcgtgacgaagcggggcgtggtgaagcgcacggacctgagcgcgttcgagaacgtccgctccagcggcatcatcgcgctgggcatcgacgacggtgacgagctggtggcggtgatgattaccgacggcagcaaggacatcctgctgtcgacggcgtcgggcatgagcatccgcttcccggagacggaggtccgctccatgggccgccaggcctacggcgtgaagggaatcacgctggaggacggcgacgaggtggtgggcgccgacgtggtggagacggacgcggccatcctcacggtgacggagaacggctacggcaagcggacgcaggaggccgagtaccggcagcagggccgtggcggcaagggcatcatcgacatcaagaccaccgagcggaacggcaaggtggtgggtctgctccaggtgaaggaagcggacgaggtgatgctcgttaccaacggcggcatgctcatccgcatgcgggtgaaggagatctccgtcatcggccgcaacacgcagggcgtgcggctgattgccctggagaacgagcaggagaaggtcatggccatctccaagctgcccgagagcgacgagtccgaggagaacggcgaggcggtggcgccggccgagggcgcggtgcccacggcggaggccaacgctccggaagcgactgacgccgctgtgcctgcggacgccacggcggaggccgcggcgcctgcggaagccgctgtcgagtcagccccggcgtccgaggagggtggcaccccgggtggcgaggagcccacgcagggctga

SEQ ID NO: 2543 - DNA, 780 bp, Myxococcus xanthus
atggccaagagcacttcccagaagcgtccgtcgaaggcgaagaagcccgccgcgtcgaaggcgaaggcgaagaaggccgctgccccgaagaaggccgccttgaggacgagcgccgcgccccgtcgcgccagcgcgccggtgtttgagcccgccgtcaaagttcctcggccccccgtgctggaagctgagcccatcctcgccgacgagcccacccctggacgcccgggccccaaggcactcccgtccggtgagaccgcgggccgcgtgttgcccttcgaaatcgaccccaagcgcatggaagaagggctgcgcaagctccagggggagatggtccactgggccaacaagggccgctacacgcgggtgcgcttcaagttccggggcaagcaactgcttccggacctgccgctggccgccgtggtggccgcggaggggctcacgttctactggggcggcatcctgcgcgtgcttgtcgccaacgtggtgggcggcagcgtgttccaggtggagctcgtgaatgacgcggagaagcgcgtccaggccggcaaggaggccttgctgtcgggcgacgtggaccaggcgctggtgctcttccgggaagccgtggccatggaccgtgactttccctccgcgcacctcaacgtgggcgtggccttgaagctgaagggcgaccgggaaggggccctggccgcgttcgaaaaagcaaagaaacgggacccggaaggaccggtgggagccgaagcggagcgcctggctgctcccctgcgtccgcagggctga

SEQ ID NO: 2544 - DNA, 312 bp, Myxococcus xanthus
atggcccagtcccggcgaatcagaagcctggtgttctccgtgctcgcggtatgcgtgtcctcgtgtggtgtctccgaggacgaggcggtgcgccccaaggagggcgagagcttgtcggacgcgccctactgcggctcgttcggctgcgtgaacccgtaccagttctgcgcggaaatcttcctggagttcggccgctcgccgcccatctgcgtcttcgacgacatctgcgagcggctggagtgcgccaactccaaccgcacctgcgccctgttcgacggcttcccggcccaggtgaagtgcatcaaaccgtga

SEQ ID NO: 2545 - DNA, 477 bp, Myxococcus xanthus
cgcatcgtggagacggaggcctatatcggcgagcacgacctggcgtgccacgcggccaagggactcacccctcgcaccgaggtcatgttcggaccggccggcgtggcgtacgtctatctgatttatggcatgcaccactgcttcaacgtggtgacggatgccacgggggcgggcgcggcggtgctggtgcgggcggtggagccggtggagggcctgcccccggggacgcgcacggacgggccgggccgcctgtgcaaggcgctgggcctcacccgagcgcacaaccggcggggcctgtgcacgcccgtgctgcacttgcgacccgggacgcctgttcccgagtcagccgtgtcccgggggcctcggattggcgtggattacgctgggacctgggccgccgaacccttccggttgtgggtccgggacagtcaacacgtcagcaaggggccgccaccggggcgccgcaagcccgcttga

SEQ ID NO: 2546 - DNA, 615 bp, Myxococcus xanthus
atgtccgacgaggccgtcatgggcgaggaccgtcagctcctcgctcgcgcacaggatggggatgtttccgccttcgaggccctggtggatgcccaccgggacaaggtgtatggcctggcgctccggatgacccgttcggaagccgacgcggccgaaatcacccaggacaccttcctgtccgcctaccaacacctgaaggatttccggggggatgcggccttcggttcctgggtgcaccgcatcgccgccaaccatgcgctcatgcgcctgcgccaccgccgcgtggcccaggcagccgagcaggagctccagggcccggagttcaccgagcggggctccctggcggattatccccagacggattggagccgggacgccgaggagaaggccctggacgccgagctgggctccgccatccagcaagcctcggaccgcctgcccgaggggtaccgggaggtcttcctcttgaaagacgtggagggcctcagttacgaacagattgcagaggcgacgggggactccatccccgccatcaagagccggttgcaccgggcacggctcgcgctccgtgaagccatcgacgctttctacaaccgggatagccgcgagttgtga

SEQ ID NO: 2547 - DNA, 240 bp, Myxococcus xanthus
atgtacaactgcaaagattccatcaacctcctgctgcaattcctcgacggagagatgtctcccgaggacacacagcacttacgtgagcacctgcgcggttgcagtccctgtgtggacttcctgcgcacctaccgggccacacccgggctgtgcaagaaggcgctggtggcgaagatgccgaaggaagtctccgagaagctcaccgagttccttcgctccaaaatcaagtccgcctcgtga

SEQ ID NO: 2548 - DNA, 966 bp, Myxococcus xanthus
cagtccgtggaggacgtcgcttcggcccgtcaggtgccgcgccgcgtgggagaccacctgcgtgcccacgcggagatgccgaagctggcaatcgtcgagcgccgccgcgcggacgacggcttcgtgaagtacctcttcgactcgccgctgggcggacgtatcgaagcggtccgcatccccatcttcgatgagaagtacgtcatctgcgtctccagccaggtgggctgtgcgctggcgtgcgacttctgcatgacggggaagttgggcttcaaaaggaacctccagacctgggagatattggaccaggtgctccaggtccgggaggaagcggaccggccggtgcgcggcgtcgtcttcatggggatgggggagccgctgctcaactacaaggagacgctgcgggccgcggacatcctgcggcaccctgcggggttctccatcgcgggcgaggcgattaccttctccacggcgggccatgtgccggcgatccgccgctacgtgcgcgaagggcatccgtaccggctggccttctccgtgacgagcgccatcgcggagaagcgggcgaaggtgctgccgattgagaagacgcacccgctgccggagctcatcgccgccatccgcgagtacagcgaggtgcggcgcgagcgggcgatgatcgcctatgtcgccatcagcggcttcaacatggggcgcgaggacgccgaggcgctgaaggtcgccttcgagggcatccgcatcaaggtggacctcatcgacgtgacggaccccaccgggaagtacctgccgcccacgcccgaggagctgagcgccttccgcgaccacctccagattctcaagtcgccggtggcgcgtcggtactccggtggcaaggagattggcgcggcgtgtggcacgctggcggccacgcagtatggcggcacggtgatgccgcggcccgccgaggcgcctccgtccacgacgccatga

SEQ ID NO: 2549 - DNA, 1227 bp, Myxococcus xanthus
atgacctgggacaacgccgcgctgctgagcccggagaccgccaagaggctgagcctcgagcccggtgacctggcggagctgacctacggcggccgcaagctgaccgtgccggtctggattacccccggccacgcggacgacacggtgacgatgtcgctgggctacggccgtgacggcctgcacgaacaggtggccaaggcggtgggcttcaacgccaacgcggtgcgcaccgtgaaggccccctggttcgacggcggcgccacgctcaccaaggtgcgcggcagctacaagttcagcctgacccagacgcactggcggatggagaaccgcccgctggcgctggacatgccgctgtccgagctgaagaacccgtccatcgcgacgcagcacacgctccaccgcgtcaagagcgagctgaagttcggcgtccaggacaacctgccggccttcgactacaacaagggccccagcaacccccagggttacaagtggggcatggctatcgacctgtcccgctgcaccggttgcagcgcgtgcgtgattgcctgccaggcggagaacaacatccccgtcgtgggcaagcagcaggtctccgtgagccgtgagatgcagtggctgcgcatcgaccgctacttcgagggcagcgagagcgacccccggatggtcatgcagccggtgatgtgcgtgcactgcgagaaggccccgtgcgagtacgtctgcccggtgaacgccaccgtgcactcggacgagggcctcaacgacatggtgtacaaccgctgcgtcggcacccggtactgctcgaacaactgcccgtacaaggtgcgccggttcaactacctgcactacacggcggacaagacggccaccgagaagatgctgatgaacccggacgtcaccgtccgcaaccgcggcgtgatggagaagtgcacgtactgcgtccagcgcatcgagcgagtgcgcatcgacgcccgcgtcgagaagcgcctcatcaatgagaaggagctgcagacggcctgccagcagacctgccccacgcaggccatcaccttcggctccctcaacgacccgcagcagcgcgtcacgcagctccacgaggacgagcgcgcgtacaagctgctccacgagctgggcacccgcccgcgcaccgcgcacctcatccgcgtccgcaatcccaaccccgccctcgagcccgccgcgtccgccgctgcgaaccaagggagccactaa

SEQ ID NO: 2550 - DNA, 621 bp, Myxococcus xanthus
atggtggaatacatcgaccagctcatctcggccctggggcccctgggcctgctcgtgctggggctggcggcgatgctggagtacgtcgtgccgccctttcccggagacaccatcaccctgctggggggcgtgtacgcggtgcgtggttcgcagccgtgggtgctcgtcttcctggtggtgacggtgggcagtgtggtgggcgcggccatcaactacgcggtggggcactggctggcgaagcgcttcgacgcccaccccgaacgcagcttcttgggcatcacccatgcgcggctggagcaggttcaagcgcgcatgcgcgtgaatgggccgtggctgctgctggtgaatcggttcctgccgggcatccggggcctcatctttgtcgccgcgggcgcctctcgcatgccgcgcttcaacgcgctggcgctgggcgcggtgtccgccatggcacataccgggctggtgctggggctgggcgcggcggtgggcggcaatctggagcggctgacggcgctcgtcacccggtaccagtacgcggtggtgggactggtcgtcattggcgccattggcgtgggcatccggatgttggcccggcgccgtgcccccgcgccggggccttga

SEQ ID NO: 2551 - DNA, 1842 bp, Myxococcus xanthus
atgctgctgttgtcaggcgcggggctgacggagtccgttcgcctcacgggcctgggcatccggcccacgccgtgtccggagcgcccctgcttcgactcccgcttcgacgtggcatccgggacgtgcgtggaggcgccgctggaggaaggcgccgcgtgcacgccggagagccgctgtcaggtggatggccgctgccaggcgagcgtctgcgtgggccacccgaggacgtgtgatgacaacaatccgtgcacggtggatgcctgttcgcccacgcaggggtgtgtgacgtcgcgggtggcgtgccccgcgccgcagaacccctgcaaggtgggggtgtgcgaccgggacgagggctgcacggcggtggacgccgacgacttcagtccttgcggcccggcggactgtcagaaggcgcgtctgtgcttcagcggcgcatgccgggaggtgacgccacccgagggcttcgtctgcgcgcctgctaccgcctgccagggagaagggacgtgccagggcggcgtgtgtcagcggccggaccctgtcgagctcgcgccggagctcagcctggagctggaaggcgtgccggtggaggcggacggtgggacggtattgctcgtctcggaagacgctctctacacctccgtgtgtggcggggacgcgggctgccagttggtcgcgtacacgcgctctgggctgctgcggtacgcgtcttcgtacccggatgggggtgcgcggacgctgctgtccgcgtcggatgcgggcgtggtggtccatgcgccagaggggctcgaggcctatgcgccgcgcggctccggtgcgcgcctgtggcaggcctcgtgggcgtcgctaggggcgggcgagggcctgccgctgggaggcgccgccgcgagccacatcgcactcacgcacgaggaggacatcctcgcgtacgtcgcgtggcgagccgtgccggatgccggcggcgtggatgatggcggcaccgcgcctgaatccgcgaggctcgtctggctgtcgggtcgcgaggacgctggcacgttgctgggcgcgtcacaggtcgaagcctggcgaggagaggcgcggctggggctggacgtgctggggacggcctatctctacacggtggatgggcgactggcgcgggtggaggtgtcgccaggagtggcggatggcggtggggggacggagttgaagctgagcgcgctgctggatggcggtgttccggatggaggtgcgtcactggccatcgcgggtgggcggctgctggtgggagcgcgagcctttgtgccggaggatggcggcgtgcccgtcatgctctccgaagggggcggtggagccagcgtgcgggtgcccatcgcggagccggcgctcctgtcctcgggtggccagcctggccagctcttcgcgcgggcatgtgcgcgcacggacggcgttccctgcacggcgcgggaggagcgtgtcgtgcttcgcgccgtggacccggagtccggccacgtggtgtgggaggtggatgcgcttccggatgaggtggcaccgggcacggtgtacgaagccgcgttgctccaagggggcgcggtggcggtgctcgctgacgccgaactgccggagggccaccaggcctggatacagttctttgctcaaggtgcccgagtcggcagttgcccgcttcccagtcgcccgcgggtggcgggtgccgcgttcctggggcagcacctgtatgtcgtcttgaaccgcgatggcgtgtggcgactcgagtcctacggcctggggcgggacttcatgacggaagaccgggggtggccgcagcgccatggtggacccttgcggatgaaaaacgaatctccgtga

SEQ ID NO: 2552 - DNA, 4107 bp, Myxococcus xanthus
gcgaacctggacgccaccgcgagcctcgcccgtcccgtgcccgggcccgtgcggctggcgctgaaggcccgcggcgaagagggcgccttcgaaggcgatgtcgacctggaggccgcggggctggtgctggacgccagcggccgcgcgaagctccctccagagacgccgccgggcgcgccggagggccggctccaagcaggactggagctgcggcgcctgtccgcgccgcccgacctgctgcgggccttcgtgcccacctggccgctgcgggtgccggtgtccgcggagggctccgccggactggacggcgacgcggcgcgggtggacgtcaccgcgaaggccgccagcgcctccttgtccgtgaagggtggcatggatttggagcggatgcgcaccgacggcctgtccgtgaaggcgcgcgacgtggacctgtcggagctgatggcgcagggccccaagacgcgcatcgccgcggacctggacgcgaagggcggaggcacgagcctggagtcgatggaaggcgaggtgaagctcaccgtgtccccatcccaatacctgggccagccgctgggtccggtggagctggaggcccgcgcgaaggagggccggtattcgctgatgcggctgcggatgctcgcaccgggcgtggccctgcaggccaagggagacggcaccgcggagtcggtgaacctgcaaggcggcctcaccgccggcaacctcgccctgctctcgcagatgctgtccaagctgatgccgggcgtggtggcccccatggcgggcaacggcacgttggacttctccgtgaagggcccgctgcgcacgcccgccgtgaaggtcgacggcggcttcgcggcgctgcggtacggcgatgtggcggcgcaggacgtatccctgaagctggagatgccggacgtcagccaccccctcacgtccaacgccacgctggtggtgtcccggctgaaggcgggcgggcgagacttgcgcgacgtcgccgtcacgctggccacgcaggagcgtgcgctggaggccagcgtgcgcgtggcgggagacgcggagctggggctcacgctcagtggcctggtggacggcaatcgccaggggctggccatccggcagttggcgctgttctggccggaggccacctggacgctccaggcgcccacgcacgtgggcttcggcggaggcaacgtcgaggtggagcccccgctgcggctcgcgtcggaggggcagacgctgtcgctgcagggcacgatgcgcggccagcgcgtcaatgcgcgcgtggaattggacgcgttcgatttgtcgcggctgcccagggccttcgtcccggagtcgctgggcctgggcggcaggctgacgggccacgccgccgtcagtgggacgatggcgcgccccgacgcggagaccgacctgcggctggaagacggcagcgcgcagggctacgaggggcttcaggcgaagctgaaggcgcgctacgtgaaggaccgcgccaccgggacgctggcggccagcctgcccgtggcgcggctcgccgccgagttcgacgtgccggtgcagggcgtgctcaagcgccggcgcgatgtgatgtccgtgcgcctgaatctggaggacctggacatcgccggcgccatgaagctcgcgggccagccccagagcgccagcggccggctggctggcgcgctgaccgtggaaggccccgcgcgtgagcccctgctggacttcaccctccgcgggcaggacgtgcgctaccagtcgccgccgccgggcttctcgctgcccgagccgctggccttccacctgcgcgccgcgtccgaccgcgaggaccagacgctggatgcgcgcctggacgtggagggcctgggctcgcagacgtacctggccctgcggacgcccttcacggtgggcgggctgatggcgaagccgcccacgcccgatgagctcctggcgacgacgctgggcgttgaggcccgcgtgacgcagttgcccctcaccctgctcaagggcatgagcggcgtgcagcagccggacggcacggtgacggcgcacctggacttcgagggctcggtcctggtgccccacgcgacgctgcgcgtgcaggccaacgcggtgacgatgaacgggctgccgcccatgaacgggcagctcagcgtcgtgggcggcgacaaggacgtgaagctcacgctgaacgcgcagcgccaggacggaccgctggcgcaactgacggccacgctggcggccccgctgggcgcgctccaggaccgcgaggtctacggccacattcccttcgacatcaccggccgcgtgggcccggtgccgctgaaggagattcccggcgtggccaccccggcgtcgcccgtggcggagggcgcgccgccaccgcagggcggccggccccagggcatccagggcgtgctggccatggagctgggcgcgcggggcacgctcgacacgccgcagatggagctcaccgccggcgtgcaggacctgggcgtgggcaacaccgggctgggccaggtgcgcctgaactacacgtacaaggacacccgctcccgcttcgacctgctgctcaccgagccgggcggcggcaccatgctggtgaacggaggcctgggcctggacgtgtcactgcccgcgctcaaccggggcctccagacagacaacgctccggtggaggtcgcgctcaaggcgcgcaacttcaacccggccttcctgtccggcacggtggagatgctgcgcagcatcggcggcgtgctccaggcggacgccagcgtcgccggcacgttgagcgcgccccgcatcaacggcagcctggagtggaaggacggcaagctggggctgatgggcctgggcgagtaccgcgacatccagctcgccctgaaggccagccgcgaatccatcgccgtcacgacgctgtcggcgaaggccggcaacggctcactcaacctcaactcgccgctgaccgcggtgctcaacacccggaatgagtacgagctgtccagccccgggacgtccgacccgccgctggtgatgcgcaacttccccatcatcgtcgacgaccagctcatggcgctggtgagcctgcgcgcgaaggtggagggcacgctgtcccagcgactcgtcaacctgcgcaacgtcaccatccccgaggccaccatcgagctgccggaagccaagcgcaaggacctgcaggcgctggagcggcccggtgacgtggtgctggtgcgcaacggagagccgctgaaccgcaagaagcgcaaggaagcggcccaggcgcagcccccggcgaatcccgacgggacacccgtggaaggcgcggccccggcggagggcgtggcggcggaaggcgaggaggaaacggccacgccacccattgtgttctgggtgaatgtgaatgcgccccgcaatctctgggtgaagggctccgacatcaacgcggagctggggctgtcggatgactttcgcgtcgaatacacggacgtggcgcgcctgttcggtgaagtgcgcgtgctgcgcgggcgcgtggacgtgctcggccgccgcttcgacatccagcgcgacagccaggtgcgcttcaccggcccggccatggcgccgtacatcaacgtcaccgccgagcaccgcaacgacagcgccaaggtcaccgtgttcgtcaccatccggggccaggggcgggaaatcacgctcaagcccaccagtgacccgccgctgccggagtcggaaatctacacgctgctggcgacgggccggcgcacgctggagcgcagctccggtgcctccatgaatgccagcgcgcaggccgcgtccgtggtgggctcgctggtggccaacgaggcccgcaaggccctggccgcgaagctgcccctggacgtggtctccatcgaggcgggggcctccggcatcgcgggcaccaagctggaagtaggtacctacgtgacggacaaaatctacgtcggctacaccggccgcgtgggcgccaacctccagcagggagagaacgccaacgcggtgcgcttcgagtaccagttgggcacgcgctggagcctggaaggccagtacggcgacgcgcgctcgggcgggttggacctcatctggaccaaccagtactga

SEQ ID NO: 2553 - DNA, 1890 bp, Myxococcus xanthus
gacctgcgccgcatcgagcggtactaccaggcccagggcttctaccaggcgaaggtcacccacgccgaggtgaagccggccggtgacgacaaggtcgccatcgacatcagcgtgcaggagggcgaacccacccgcatcagcgaaatccaggtgacgggcctggacaccctgccggaggacgtgcgcgaggagcaccgcaagtacgtgctggacggactgcccctgcacgaaggcgacgtcttcaaggaagagtcctgggaggaagcgaaggcccgcgtccaggagcggctgcgcgagctggcctacgccgaggccgaagtcgacggcgaggtccgggtggacgtggacacaaggcaggcggtggtggaattgcgcacccggcccggcatccgctaccgcttcggcaacaccttcgtcgccacggacgccaatccccaggtgcctccgcgccgaatcatcgaacaggtgacgggcgcgctgaagaagggggactggtacagcgagacggcgctggccaacgcgcaggcgcgcgtgttccgcatgggcgtgttcggcgcggtgaaggtgaaccgcggcgcgccggaccgcgaatccggcacggtgccggtggtggtggacgtgcgcgaggcgcccttccgctccgtgcggctgggcggcggtctgggcgtggacgcggcccggcaggaggtccgcgcggtgggcgaatggacccaccgcaacttcggcggcggcctgcgccgcttcaccgtccgcggccggctgggctacgccttcatccccaacgtcctcaacttcaacaaggacggtcctgtcttcgacgtcaccgccgagtacgagcagccccgcttcctcttcagggacttgcgggcgcagaactcgctcagcgtggagaagggcctggagcaggcctatgacttctggggcggcaggctccagacgggtgtcatctggcagccgcaccccgacttctccatcttcccgtcgtacaacctccaggtgtaccggctcagcggccgcgtcagcgccgactcccgcgtgccgcccatcgtcctgggctgcggcgagggccaggcgcagtgcaacgtggcgctcagcttcctggagctggccttcacctgggaccggcgcgatgacgtcatcgagccacgcgacggctactacatctccttctccgtccagaagggcggaggcacgcccctcatgggagacttcaactacgtccgcctgctgcccgacctgcgcgtctaccgttcgttcggcgaggacaagcggttcatcctggcggcgaaggtgcgcgcgggcacgctgaaccccgcgggcggcagccagagctccatcgtcacccgcttcttctcgggcggtggcacgttcatgcgcggcttcaacggccagcgcctgtctcccctggccgccctgcagcgcacggcggacgtggacggcgacggcaacccggatgtcgtccaggacgaggaatgggacaccgtgcccgtgggtggcaacagcctcttcgagacctcggtggagatgcgctaccagttcacggagagcctgatggtggcggccttctatgacacgggcctggtgggcatcgaggacttctcccacgcgaaccggcccaagctcttcggcccccagcactaccacgccgtgggcatgggcctgcggtatctgacggtcgtcgggcccatccggctggacatcgcccggcggttgaacattggcgagggattgcccgtttccaccccgggatacatctatcccgaagccggaggctgctttggcatcggaagccggtggaggcccacgggtccgacgacgcccagcggcgcgttcgcgggcgctccggacgggctgtgcgcgctgcacctgtcgattggagaggcgttttga

SEQ ID NO: 2554 - DNA, 1485 bp, Myxococcus xanthus
tttggcatcggtgacttcggtgccctggagggactgttcacctggatgaagtccgcccgccagcggatgctgatggtgctgccgctgctgcccaccgcgccgggcgactcgagcccctacgcgacgcgttcggccttcggcctcaatcccctcttcatcgacctgcagcggctgccggagttcaccgcggccggcggcgaggcggccctgtccgacgcgcagcgcgcccagttggccgaggcgcgctctgcgccgcgcgtgcgctatgacctggtcttccccctcaaggacaccgccttcgcgcgcgccttcgacgtcttcgaagcgcagcactgggcgccccagtccgagcgggcgaagaccttccgccagtggcgcgacgcccagggcgaatggctggagagctacgcgctcttcaccgccatcagcgagcaggaagagcgccgcccgtggtgggagtggccggagccgctgcgcacccgtcaacccgaggccctggcccagaagtcccgggagctggagcgccgcgtgcgctaccacgcctggctccagtgggtggccgagcagcagtggaacgaggtgcggacgcaggcccgcgccaaggacgtcctcctgtgcggcgacgagccgttcatcatcggtcaggacagcgcggacgtgtgggcgcacccggacatcctgcggcgcgacgcccgcctgggcgtgcctccggatgacttctccgccacgggccaggactggggcctgccctacttcgacctggcggccatggagaaggacgacttcgcgtggctgaagacgcgcgcgaagaaggcggccagctactacgacttgcgccgcgtggaccacgcggtggggtacttccggcagtggattcgcgacgcgcagacgcccaccgggcgcttcatcccgccggacgaggagagccaccgccgcctgggcgagaagaccttccgcctgctgtccgagggcgccggcatcgtcgccgaggacctgggcgtgattccacacttcgtgcgccacatcctcgcggagctcaagctgcccggctaccgggtgatgcgctgggagcgcgacgacaaccactaccgcgacccgcgccagttcccggcggtgtccctggtcaccaccggcacgcatgacacggacacgatggccgagtggtgggagggcgcgggcgaccacgagcggcaggcggcggcgcgctcatggccggagctcaacggcgtggccatcacccgcgagttcaccccggacgtgcaccgggccatgctggcctcggcgctcaacgccaacagcgacctgtgcgtgttgccctggcaggacgtgctcggcacccgggaccgcatcaacctgcccggctccatgagcgattcgaactgggcctaccgcatcgaacagaacgtgagtgacctgctcaccgattcgcgcacgcgcgaggccgccgagcggctggcctggctcaccgcgtccgcgcggcgctga

SEQ ID NO: 2555 - DNA, 393 bp, Myxococcus xanthus
ctcagatggcgcgcgaggaatacacggcccaggggaccgagggccgtctccccgccttccgcaaccgctggctggccgactactccggacccggacaccttcctgtacttcctcctggcgtccaacgcccagacggtggtgcccatgggctaccggaacccggagctggaccgcctcaccgccgaggcccgcgtctccatcgacccggagctgcgccgtcagctctatctgcgcgcggagcagctcttccaggaggactgccccctcatcccgctgtaccacgaccgcgcccacgcggccgcgacccccgcggtccaaagcctgcgggtgcaccagacgccgccccaggtgcgcttcgaagacctctgggtcgacccgatctccgccacctga

SEQ ID NO: 2556 - DNA, 330 bp, Myxococcus xanthus
atggcctgcctggggtccacggaggccctgcgccagttcgtgagcggcttcgccgtgcccttcgagccctccctgctccccggccgcgtggagcgcttcctcgcgctcctccgggacggcgacctgctgcgcgcctggggcctgatgagcgcgaagctggccgccctcaacctgctgcccctgcccgcgctcgcaggaggcaccttcctcctcctgccgtggcgcaagggataccccgtctgggccggcctgctcggaatcctcggactcctggccgccgtgccgtgggtcctctacgtgctctacgtggtcatcaaggcgctcgtctga

SEQ ID NO: 2557 - DNA, 288 bp, Myxococcus xanthus
atgctgaacctgctggacgggctgttcaccctcttcttcctccaactgggcgtggccgaagagctcaaccccatcatgcgggaggcctatgagcagtccccgctcttcttcatgttctccaagctggtcatcgtgaacgcgggcctgtggctgctgtgcatccaccggcacctcaaggccagccgcatcgccatccggctgggcgccgccgtgtatgccgtcatcgtggtctaccacctcgcgttcctgacccacctggtcatgcactggccgcaaatgctgacctag

SEQ ID NO: 2558 - DNA, 300 bp, Myxococcus xanthus
atgaacatcaccgacgtccgggtgtttccggtcgaagaggacaagctcaaggcgtacgtcaccatcaccttggaccactgcttcgtcattcgcgatttgaaggtcattcacggctcgaccgggctcttcatcgcgatgccagccaagaagcggaaggatgggacgtacaaggacattgcccacccgctcaacgcggatacgcggagtcaaatggaacgcgtcatcctgatggagtacgagcgacacctccatcaggcgcaagccgggatgctcgtcgcagcgccagcggacctcgactaa

SEQ ID NO: 2559 - DNA, 939 bp, Myxococcus xanthus
gacttcaaggtgttcgccgggaactcgaatcccggcctggcgcatcgcatctgcgagtacctcaagcgccctctgggcaaggcggaggtcggtcggttctcggacggggagattcacgtcgagatcggcgagaacgtccgcggccacgacgtcttcatcctccagtcgacctgcccgcctgcgaacgatcacctgatggagttgctcatcatgtgtgacgcgctcaagcgggcgagcgccggctccatcaccgccgtcattccgtactacgggtacgcccgtcaggaccggaaggtggcgccgcgtacgcccatcaccgcgaagctcatcgcggacctgctggagtccgcgggcgccgggcgcgtggtgtccatggacatgcacgcggggcagatccagggcttcttcaacatcccctcggaccacctctacggctcgccggtgttcctggaagacctgcgcaagcgcttcccggagtcgcaggagctggtcatcgtctcgccggacgccggcggtgtggagcgcgcccgcgcgtactccaagcggctgaacacgggcctggccatcatcgacaagcgccgtccccgccccaacgcgtcggaggtgatgaacctcatcggcgacgtgagcggcaaggacgcggtgctggtggacgacatggtggacaccgccggcacgctcgcccaggcggccgcggcgctgaaggccaagggcgcacggcgcgtggtggcatacgcggtccaccccatcctctccggcccggccatccagcgcatccaggactcggtgctggaagaggtcgtcttcacggacaccgtgccgctgtccccggcggcgcaggcctgctcgaagatccgcctgctcaccaccgagcgcctcttcggcgaggccattgcccgcatccaccgcgcagactcgctcagctcgctgttcgtctga

SEQ ID NO: 2560 - DNA, 1359 bp, Myxococcus xanthus
atgcagcgcgcggcggacagcgccgagcaacccgcgctgtgcctcatcccccgcggcttcgaggaaggccagaaggtcgacctgggcgagcgacccttctcgctcaccctgggccggccggtgcagttccagctctactccaccaccagcgaccgcatcgacaagcccggcgatttggtgccgctggcggaggacctcaagccgctgccgcccatccacacgctgctcaagggcgcctccaacaaggtggcggaggtgcccgtgcacctccaggcggcgctgacggagattggcaccctggagctgtactgcgtgtccaacgtcgcggacgagcggtggcgcctggagttcgagctgcgcggcaccggcggctcgcacgagctgacggtcaccgagtccatgcccgcgcgcttcgtcgaggcgaaggacaacatcgagcgcgtctacggcaacaagccgctgcccattggccccaaggacgtgaagcagctcgggcgcacgctggagaaggccctgggctcgcgtgagacgtggcgcgtcccggtgctgcgggagatgtggagcaccctcttcgcgggcgcgagcaagcgccggcgctcggaggaccacgagcgtgtcttctacagcctcaccggcttcagcctacggccgggcttcggctacccgctggacggctggcgcgcggagcagaccttcggcctgttcgacgcgctggtgcagcaccacacggacaaggcggtatggacggagttctgggtgatgtggcgccgcatcgcgggcggactggacgaggcgcggcagcagaagctgtacgcgtacctccagccccacctggcgcggaaggtgccaccggacgcgccgccgccggggaagctcaagggcatccagcccgagggcctggaggagatggtccgcacggcggcctcgctggagcacctgcaaccgggtgacaaggcggagctgggccggtggattgccgcgaggctgaaggccgaggcgaagtccggcggaccgtgggcctggtccctggggcggctgggcgcgcgcgtgcccctatacggcagcagccacaaggtggtggacgtggacacggccgaggcctggctcacgctgctgctggagttggacctgcggaagattgacggcgcgtccttcgcggcggcgcagctcgcgcggctcacgggagaccgcactcgcgatctggacccggacctgcgcgagcgcacggcccaggccctgctggcggcgaaggcctccgagacctgggtgcgaatggtgcgcgaagtcgtggcgctggaagccgcagacgaggctcgcgcgctcggggatacgctccccgccggtctgcggctgtcgtag

SEQ ID NO: 2561 - DNA, 1245 bp, Myxococcus xanthus
ctggcccgcggtatcggcgtgtggggtaacaaccagcctgtcggctgggcgttcgacatcatcaacttcgtctggtgggtcggtatcggccacgccggtacgctcatctccgccatccttctgctcttccagcagaagtggcgcacgagcatcatccggttcgcggaagccatgacgctgttcgccgtcatgtgcgccggtctgttcccactgctgcacaccggccgtccctggttcgccttctggctgttcccctaccccagcaccctgggcgcgtggccgcagttccgctcgccgctggtgtgggacgtgttcgccatctcgacgtacctcacggtgtccgcgctcttctggttcgtgggcctcatcccggacctggcggcgctgcgtgattcgtccaagacgaagctccagcggaccatctacggcctgttcgcgctcggttggcgcggctccggtcggcactggcacaactacaagattgcgtacctgctgctggccggtctctccacgccgctcgtggtgtccgtgcacaccatcgtttcgttcgacttcgccgtctccctgctgcccggctggcacgccaccatcttcccgccctacttcgtggccggcgccgtgttcagcggcttcgcgatggtgatcacgctcatcatcccggcgcgcaagtacctgggtctgcgggacgtcatcacggaccgccacctggagaacatgaacaaggtcatcctggcgacgggtctgctcgtctcctatgggtacctgatggagcacttcgtcgcctggtactcgcagaaccagtacgagctctggaccttctacgtgaaccgcgccacgggcccctacgccggcgtgtactggctgatgatcgcctgcaacgtcatcaccccgaacatcttctggttcaagaagtgccgcaccaacatcgccatcatgtgggtggcgtccatcgcggtgaacatcggcatgtggtgcgagcggttcatcatcatcgtcacctcgctgagccaggacttcctgccgtcctcctggggcatctacaccccgacgtgggtggactggtccatctacatcggcacgctgggcctgttcggcaccctgttcctcctgttcctcaagttcgtgcccgcggtcgccatcagcgaagtgaaggagctccagctcgagctcaagcacgccgctcaccagcacggctctgatgatgcgcttgccggcgccggcaccctcacccacggagctcactaa

SEQ ID NO: 2562 - DNA, 663 bp, Myxococcus xanthus
atgtccgtcaatacgagcaccctcgaggccaagccgcgtgagggttccggcaagggcgttgcccgccgcctgcgcgcccagggtctgattcccgccgtcgtctacggaaagcacctggagaagccggtgcacatctccgtgaaccccaaggcggtccgccaggccatcaacaccccgcacaagttcaacaccctgatccagatcaaggtggagggcggtgaccgccaggtgctcctgaaggactaccagatggaccccgtcacccgcgccatcctgcacgccgacttcctggacgtgcgccccaccgacaaggtgaaggtcaacgtgccgctggtgctctccggccgcgcgcagggtgtggcggacggcggtctgctgacccaggcccgccgtgagatcgaggtctggtcgcttccgggcgccatccccgagaagatcgaagtggacgtgacgccgatgaagatcgctgaggtgctccacatcaacgatctgaagctgcccgagggcgtgtcggtgaagacgaacgtcaactacaccctggccgtcatcagcgcgccggaggccgtggaggcgggtccgggcgcggcggctgccgcggcggctccggccaaggacgcgaaggcggctccggccaaggacgcgaaggccccggcgaagaagtag

SEQ ID NO: 2563 - DNA, 576 bp, Myxococcus xanthus
atgaagctcatcgtcggactgggcaatccggggcgcgagtacgagcggcaccggcacaacatcgggttcatggtggtggaggcgctgctgtcgcgcgcgcgggcgcagctcaaccaggagaagttcgcggccaaggtcggccagggcaccctggcgggcgagcgcgtcctcttcgtggagccccagacgttcatgaacctgtcgggccgctccgtcgcggaggcggcgcgcttcttcaaggtgccggtcgcggacgtgctcgtcattcatgacgagttggacctgcccctgggccgactgcagctcaaggccggcggcggcagcggcggccacaacggcctcaagagcatcgtctccagcctgggcgacgagagcttcatccgcctgcgcttcggcatcggcaagccggagggccccaatgcccgcgagcgcgtgtccgactacgtcctgtccaacttcgacgacggcgagcgccgggagatggatgcgctcatcgaccgggccatggacatgacggagctgtggatccgcgaagggctgtcagtggccatgaaccggttcaaccggaaggcctga

SEQ ID NO: 2564 - DNA, 477 bp, Myxococcus xanthus
atggctgagacgcaggccgcgacgcggcttcgtgagtacgagaccatcttcctggtcaagccggacctgacggacgacaacgtggacaagctcaaggagcgcgtccgcggcatcgtttcccgtgagggtggcaaggtcatccgcttcacggtgtggggcaagaagaagaccctgttccccgtggcgaagcagccccgcgccatctacgtgcacacccacttcctgggcggcgcgaagctggtggcggaaatcgagcgcaacctccgcaacctggacgaggtcacccgctacatctccgtgaagctcgcggacgaggtggaccccgagacgcgtccggtgctcgaggacgtgaagctggccggcgacgtggaggagacccgtccgggcgctcccgcggagcgcgagggtggcttccgctccgagggttccgaggagcagggcggcgactccgaggaggagtcgtccgaggaggcctga

SEQ ID NO: 2565 - DNA, 396 bp, Myxococcus xanthus
atgagcaacggaacggatagcaagacggcctctgccccccccgcccgcagcggtggtggcttcggcggtggtggttcgcgcggtggagaccggggtgaccggggtgaccgcggtggtgatcgcggcgaccgcggcggcgggctgggcggcgacgacgacaagcgcggtggtggccgcggcttcggccgcaagaaggtctgccgcttctgcgcggagaagaacgcgtcggtggacttcaaggaccaggcgacgctgaagtacttcgtgaccgagcgcggcaagatcatcccccgccgcatctccggcaactgcgccaagcaccagcgcgaggtggcggtggccatcaagcgcgcccgtggcatcgcgctcctcccctacaacgcggtggtcggctag

SEQ ID NO: 2566 - DNA, 444 bp, Myxococcus xanthus
atgaaggtcattctgcgtgaggacatcgagaacctgggcaagtccggggaactcgtcaccgtgaaggacggcttcggccgcaacttcctcctgccccgcaagaaggcggttctggccagcgagcagaacctccgccagttggagcacgagaaggcggtcatcgccgctcggaacgccaagctgaagggcgcggccgaggagcaggcgaagaagattggcgccatcaaggtcagcatcaagcgccgcgtgggcgatcaggacaagctgttcggctccgtcacggcgctggacatcgcggaggcggttgccgccgagggtcagagcatcgaccgccgccacatccacctgcccgagcccatcaaggccctgggcaactacgaggtggagctgcgcctgcaccgcgacgtcatcgcgaagatcaagctcgaggtcctgccggagtaa

SEQ ID NO: 2567 - DNA, 1167 bp, Myxococcus xanthus
atgagcaccaccgcccccccgcacctcaccgatgagcaccgcccggacctggactggctccgcgtggtggccatcctcctgctgcacctgttccacaccgggatgatgttcaacacctgggactggcacgtgaagagcgcccaagccctgccgtggctggagccccccatggaggtgctgcatcacctccgcatgccgctgctgatgtgcatctccggcctgggcacagcgttcgcgctgcggcggcgctcgctgggcaccttcgccggggaccgcgcgaagcggctcctgggcccgttggtcttcggaatgttcgtcgtggtgccgccacaaatctacctggagcggctccagcgagggacgttccagggcagctacgcggacttctacccgtccgtgttcggcttcgtgccctaccccgccggcagcttcagctggcaccacctgtggttcgtcgcgtacctcttcatctactgccttctcgcgctgcccctcttcgcggcgctgcgcacggcgagcggccaggtctggctccagcgcgccgaggcgtggctgagccggggctggaacgtggtgtggctgttcctgccgctcgcgctcaacgaggtgttgctgcgccgcttcccccagacgcacgcgctgctcgacgacccgcgagccttcatccacttcggcctcttcttcatcggcggacacctgctgggccggtgtcctcgcgtcatggagcacctggtggcccggcgcaaggcgctgctgggcgcctgcggcctgctcttcgccgtcatggtgccgccgaacgagtacgccttcccactggagacactgggccgcacggcgctgcagtggctcttcatcctcacggccctggcgtgggcgcgggcctgcatccacgtccgccgcccctggctccggcacgcgcgcgagcgggcctacccgttctacatcctccaccagacggtcatcgtcgtcgtcggcttcgcggtcgtggactggcccgtgggcccctggggcctcttcctggcggtgctcacgctgacgttcggtctcacctggggcctgtgtgaaggagtggcccgggtgccctggctgcgagcgtgcttcgggatgccggctcgctcgaaacgggccgcgcccatccacgccgccgccccagtgcatactgcctga

SEQ ID NO: 2568 - DNA, 1116 bp, Myxococcus xanthus
atgacgccctctccgccccaggccggcttcgactggaagtggccccgcatccgcgcgaagccggcgctggcgctgttcggcttctgcctgctcatcggcctgtggatggggctcacgctgtggctcaccatcctcggggacggcggcaccctcccgggctcccgtcccttcctctgggaaatcaccggggcgctcggcatctgggccgtcttacccatcctctacacggcggtggtcaacgcaccgagccctcgcgtgggatgggggcgcttcctgggcattcatgccgtggccttcgtgctcttcaccggcctgcacaccgcgctgatggtggggacgcggcagttgctgtacgcgctgctcggctggggcacctacgactatggcgcgctcgccttccgcatccccatggaggcgcagaaggacctcatctcgtacacggtcaccgccacgctctggagcttcctccaaacctggaaggagcgtcaggcgcgggcgctgcgggaggccgcgctggaggccgagttacgagcggcccaactccagtccctcaccggccagctccatccgcacttcctcttcaacgccctgaacaccgtcagcgcggtgatgtacgaggacctcgcgcgcacggaccggctgctcagcgacctgggcggactgctgcgcgccagcatggagcggcgcgaggccacgtggacgctggccgaggagcgaacccaggccgcgcgcttcgtggccctgctggccgcgcgcttcggcgagcgggtgacggtgtgctgggacgtggcccccggcctggacggcgcccaggtgccctgcttcgcgctgcaagcgctcgtggagaacgcggtgaagcacaaccaggaccggacagagccgctggaggtgcgcatccaggcccgggaggacggcaatgggtggcggctggaagtggaggacacggggcgcggcttcggcgtggcctcgcccgcgtccggccccggcgtgggcctgtcgcacctggagcgcatcctgacgctgctccacgggggccgagcgcggctggagcggagccacggccccgagggcggcgcgcgcgtgtcgctgtggctgccccgggagaccgcggcatga

SEQ ID NO: 2569 - DNA, 771 bp, Myxococcus xanthus
atgacgcgcttccaggtgctcgtggccgatgacgaagcgcccgcgcgggcgaaggtgaagcgcctgctggcggaggacgcccgcttcgcgctggcgggcgaagcgacggacggcccgcagacgctgcggcaggtgggcaccctgcgcccggacctgctggtgctcgacgtgcagatgccgggcctcaccggcttcgaggtgctggaggccctgggcccggagcattgtccggccgtcatcttctccaccgcgtacgacgccttcgcgctggcggcctttgaagcgcaggcggtggactacctgctgaagccctacgacgcggagcgcttcggccgggcgctcgacaaggcgcacgcggtgctccgcagcgggatgccggacaccgcgcggatccagtccctgctagcggagctggggcgggcccccgcaggccgtccgttggagcggctggtggtgaaggtgggcgaggcctgggtgcccctgccgctggcggacgtctggcacctgtcagccgaagacaagtacgtgcggctctacacgggccaaggcgagcacctggtacgacagacgctccgcgccctggaggagcggctggacccctcacgcttcgtccgggtgcaccggggcgacatcgtcaatctggacgcggtggcccgcctggagccgtggagccacggggatggaatcctcgtcctcaaggacgggagctccgtcgtactcagccgcacctggcgtgaagcgttcctccagaagtggggactggaggggtaa

SEQ ID NO: 2570 - DNA, 1043 bp, Myxococcus xanthus
gaggacctcgccgcggagcgcgccgtgctgggcgccgtgctggcggacaatacgctcatcgccgcggtaggcgaggtcgtccacccagaggatttctccagccccgcgcacgcccagattttcgaggcgatgctgaagctcgacggccagtcgagacaggtggaccacctgacgctggccgaggagctgaaggtgttgggccacctggtgtcggtgggcggcccggcctacctgatgcgtctggaccaggtggtgcccatcgcgtccaacgcggtccagtacgcgcagatcgtcaaggaccaggccatccgccgccgcctggcccaggcgggcagggagatccaggacctcgccagccaggagacgggcgagctggaggtgctgctcgacgaggccgagcgcaaggtattcctcctcgcggagaagaagcgcgagggcgacctgcgcccggtcagcgagctgatggagcatacgctcgacctgctcgacaagatgaaggcggcggccacgggcatcacgggcctgtccaccggctacatcgacctggacaaccagctcaccggcctgcacgccggcgagctcatcatcctcgcggcgcgtcccggcatcggcaagacgtccttcgcgatgaacatcgcggtgcacgcggcgctgaaggagaacaaggccgtcggcatcttcagcctcgaaatgcccgccgaccagttgctgatgcgtctgctggcctccaccgcgcgcgtggacatgaagaagctgcgcggcggccggctgacgccgcacgacgaggagaagttccaggagatggcgggcgcgctctacaacgcccccatctacatcgacgactccggcggtctgtccccgttcgacctgcgcgccaaggcccgccgcgtgaagcagcgcgacccgcgcctgtcgctcatcgtcatcgactacctccagctcatgcatcagaagggcaaggtggagaaccgccagttggaggtcgccgaaatctcccgcgcactgaagcagctcgccaaggagctggaggtgcccatcatcgc

SEQ ID NO: 2571 - DNA, 657 bp, Myxococcus xanthus
cgtgcccccactggagccgccatgttcttcgacccgacgcgcctcacggcctacttcctggcggtgctcgcgctcatcctgacgcccgggccggacacgatgttcgtgctggcccggagcatggggcaggggcgtaaggcgggcatcgtctccgcgctgggcatcttcgtcggatgcctgttccacatcgccgcggcggcgttcgggctgtcgacgttgctggcgacatcggcgttggccttctccgtggtgaagtggggtggggcggcctacctcgtgtggatgggcgtgcagatgctgcgcagcaaggacaccgtggccgaggcggtgcaggcgctgccacccgctggcctgtggcgcatcttccgcgacggcgtcgtcaccaacgtgctgaacccgaaggtggccgtgttcttcctggccttcctgccgcagttcgtggacgcgtccgcgggctcgacagggctccagttcctggggctcgggttgatgttctccgtcacgggcacgtcgtggctggtgctgctggctgcgttcgcgggtgcctttgggggctggatgcggcgcaatccgcgcgtggcggcgtggcagaagcgcgtcacgggtggcgtgttcgtcgcactgggggcgcggttggcgttgcagcgccaggagtag

SEQ ID NO: 2572 - DNA, 546 bp, Myxococcus xanthus
atggaagccaccgttctcgattcctgggtcctggcggagttctcgacgccggacgccctcgtgaccgccacccgccagatgcgggagaagggcttcgagggaatggacacctactctccgtacccgctgcacggcgggtcggaggccctgggtctgccgccctcgcgcgtgcccttcatcgccctgtgcggcggcctgacgggcgtggccacggcgctggccatgcagacgtggatgaacaccatcgactacccgctcaacatcggcggtcgcccgctgctgtcgctgccggcgtgggtgcccatcacgttcgagctgggggtgctgatcgccgccttcggcatcttcttcggtctgctggggctcagccgcctgccccagccgtaccaccccgtcttcgagtccgaggagttccgcaccgcctccacgcacggctactggctgagcgtgccccaggcgacgggcacggacgcggcgccggtcatggatcagctcaaggccctgggcgcgacccaggtgaccctcgtcacgggagagaaggaatga

SEQ ID NO: 2573 - DNA, 771 bp, Myxococcus xanthus
cggaagtacgttgcggagttcatcgggacgttcgtcctggtgttgggtggcgtcggggcggccgtgctggcgggcgaccacatcggcttccaaggtgtcgcgctcgcctttggcctgtcactgctggccatggtgtacgtgattgggcccatctcgggctgccatgtgaatccggcggtgacgctgggcctcttgctgtcggggaagatggagggcaaggacgcggtcggctacgtggtggcgcagtgcgcgggggccatcctcggcgcgggcgtggtgctgctgattgccaagggcatgcccggtgggtactcggcggtgaccgagggactcgcgaccaacgggtacggcgccgcttcacctgacggcttcaacatgggagcggccttcctcacggaggtggcgctcaccttcttgctcgtgctcacggtgctgggcgcgacggatgcgcgcgccccggtgggcttcgcggggctggccattggcctggtgctggcgctcatccacttggtggggattccggtgacgaacacgtctgtgaatccggcgcgcagcctggggccggcggtgttcgcggggagcgtgcccatggggcagctctggctgttcatcgtggcgccgctcctgggaggcgccaccgcggcggcggtgtatcgcacggtgttccggcctgccgtgcccatcagcgcggaggaggccgagcgggcgctgcggcgcgagcgtgaggcgcgaatcgcggaggatcgggcgggcacgcgcgcgcccgtctga

SEQ ID NO: 2574 - DNA, 507 bp, Myxococcus xanthus
gtcctgatttccgaggacaagttgcaggcgcgcgtgcgcgagctcgcggcggagattacgcgcgactacgcgggcaaggacctgacgctcatctgcgtgttgaagggctcggcgtttttcgccatcgacctggcgaagtacatcgacctgccggtgaagttggagttcctgggcgtctccagctaccagggcggcacggagtccacgggcgaggtgcgcatcaccaccgacgtcagcaagccgatggctggcaagcacctgctcatcatcgaggacatcatcgacaccgggctcaccatgcagttcctgctggagaacctgcgcgctcggcaccccgcgtcgctgaaggtgtgcacgctgctggagaagccctcgcgcgcccggacgaaggtggacatcgactacaagggcttcgtcatcgatgacctcttcgtcgtgggctacgggctcgactttggcgaggtgtaccggaacatccccttcatcggggtgatgaagaacaagtag

SEQ ID NO: 2575 - DNA, 816 bp, Myxococcus xanthus
atgcgcgacaccctgtactccaacgttcccttcaagctgaacgagatgccccaccactatgggcctcacgtccacctggtgggaaatccctttctcctgacccagctggccacgctgtgttcgaagggcgtcatccagccgcagatcaaccgcctggtggagacgctgtacgtcgacctggtgaagacggtgctcaacgcggagttcccgcggaagaacgtcagcctgcccacgcggatgatcgactccacccctcaggggctctaccagggcgaggtcatcgacccgcaggtgcgggtggtgacggtgaacatcgcccgggcaggcacgctgccgtcgcaggtgacgtacgacctgatgaacgccacgctggacccgacggtggttcgccaggaccacatcatcatgagccgcatgattgatgccgcggaggcggtggtgggctcggagattggcggcgcgaagattggcggcgacgtggacgacgccttcgtcctgttccccgaccccatgggggccacggggggcagcctgtccacggcgatttcgctctacaagaacaaggtgcccgggacgccccggcgcatcatcaccctgaacctcatcgtcacgccggagtacctgcggaagatgaccacggaccatccggacgtcatcatctacgcgctccggttggaccggggcctgtccccgccggaggtgttcggcaccgagccgggcgcgctctgggagaaggagcggggcctggatgaccggcagtacatcgtccccggaggcggcggcttcggggagatcatgaacaacgcgtacgtgtag

SEQ ID NO: 2576 - DNA, 576 bp, Myxococcus xanthus
gggtggatagaggtcatctgcggttcgatgttctccggcaagacggaggagctgatccgccgcgtccaacgcgccgtctacggcaagcagaaggtgcaggtcttcaagccgcgcatcgacaaccgctacgacgaatccgcggtggtgagccactcgcagcacaaggtgctgtccaccgccatcgagcgggctgaagagattttttacaggctcgcgcccgacacccaggtggtgggcatcgacgaggtgcagttcttcggttcagaagtggtcgccgtggtggaggcgctggccaacaagggcctgcgcgtcatctgcgcgggcctggaccaggactaccaggggcgccccttcgaaccgatgccccagttgatggcggtgtcggagtacgtgacgaaggagctggccatctgcgtggtgtgcgggaatccggccaaccgctcccagcgcatcgtgtccagtggtgagcgggtggtggtgggcgcggcgggcgcgtacgaaccgcgctgccgcaagtgtcacgtggcggaaccggcggagggcacgccgccgcagacgttggaactgttcgactga

SEQ ID NO: 2577 - DNA, 888 bp, Myxococcus xanthus
atgaacgccaagcaccccattgccattgagcgaatttccagtcccacgcccgccttcttccgtgagcattatctggagaagcgccgcccggtggtgctcaccggagtggtcagccactggccggctgtgacgcgttggagcgcggactctttcaagcaacggtttggagaccaccgcgtcgtcgtcgagcgaagcagggcctcggtgccgtcgaacgatcccctcgagttcctgcgcaaccgctactacgaagaggcccggcttggagacaccattgctcggatgatgtctggcgaacatccgccaggggcgtactacgtgacgtatgccaacatcttcgatgcggcccccgaactgctcggggacttcgaatcaccgccgcaaacctggggcatcccgccgcattaccctcgagcgcttcaagaccggctgaccttgcgtcccggcttctggctcgggcccgcggggaccgtgtccgcggtgcatttcgatcggcaggagaacttcaatgcccagatctccgggcgcaagaagtggacgctgtactcgccccaggattcgcgccacctgtattacccggcgctcgacatgcccaccgtcatcttcagccccgtggacatcgaggcgccggatgcacgaaggtttccgcgcttcgcggaggcgcagccctacgagacaattctcgagcctggcgagctgctgttcatccccgcgggctggtggcaccatgtccggacgctggagctgtccatttcgttgaacttctggtggtggacgctcgcctcggtgggcaccacggcccgggtgaactaccacttcgcgcgcaagcagttgctgcgcatcctgggccgccagggggcgacggcggcctccatgccggtgggttga

SEQ ID NO: 2578 - DNA, 867 bp, Myxococcus xanthus
atgcagaatgcctccaacggtattgagcgcatcgacaatccgactcctgaggagttctatcgggaattcgtttcgaaaggccggcccgtcatcctcacgggaatcgcatccacatggcccgcctgtggccggtggacgccacgcttcttcgcggacaggtttggagacacgcccgtgcaggtggaggtccagcgcagtcaggacccgatgctgcactggggggagaaggaggtgctccagacgacgctggcccggtatgtggaactgctgtcgtcggaaagcccgaagtactatttgaacttcgcttcggtgatggcgcagttgcccgagctgcatcgggatgtcggctcgttggatgcctaccaggtccatcaccggccctaccccgagcgggtgcgccgcaagctccggctgtcacccatcttctggttcggcccggcgggcgccttcacgtcgctgcatcgcgacccttccgacaacctgctggtgcaggtgctggggcgcaagcggttgacgctcttcgcgccggaggacacgcccaacctctacgcgccgtggcatgagaactgttcgagcgggcgctgcctggggggatacagcccggtcaacgtcgcgcagccggacctggagcgcttcccgcgcctgagccgtgcgcgcggggtggacgtcctcctaggccctggggagatcctcttcatccccatccactggtggcactacgtgtcgtccgtggacgtgtcgatttcggtctcgtactggtggttccgccggctgtcccagtggcactggtcgaccgcggcctgggtgcccctgcgctccacgctggagtgccaggtgcgccagtggtggcgcgcgcgggccgcctga

SEQ ID NO: 2579 - DNA, 1059 bp, Myxococcus xanthus
atgctcacgcacggcaacctggtgcacaactcgcacctgattggcctgggcatggagctccgcgaggggtccgtagcggtgaactggctgccgccctatcacgacatggggctcatcggcggcatcctccagccgctctacaacggctttcacggcgtgctgctgtcccccatcaccttcctgcaacgaccgctgagttggctccaagccatcgagcggcaccgcggcacctgcgcgggcggtcccaacttcgccttcgacctctgcgtgcggaagacccgcccggaggagcgcgagcagttggacctgcgcacgtggcaggtggcgttctgtggcgccgaacccatccggcccgagacgctggcccgcttcgcccgcgccttcgaacccgcgggcttccggcccgagttcttctatccgtgttacgggctggccgaggccacgttgatcgccgcgggcggcgtcaaggcggaaccggtgcggacgggccacttcgacgcgcgggcgctccagcacggccagggcgccccccgggacgagggcaccgggcaggacacggtgacgctcgtcagcagcggcacccagcttcccacccagtcgctcgtggtggtggatccccaggcgcgcacgctccaggccgacggagaggtgggggagatttggatgtccgggcccagcgtggcccagggctattggggacgccccgaggagacggagcgggtgttccaggcccgcctggcgcgaggcgaagggcccttcctgcgcaccggggacctgggcttcctccgtgacggccagctcttcgtcacgggccgggccaaggacctcatcatcatccgtggccggaaccactatccccaggacctcgaacagaccaccgagcagagccaccccgcgatccgccccggatgcagtgccgcgttctccgtggatgtggacggagaagagcacctggccgtggcgttcgaggtctccgcccgccaggaggtttcgcccgacgacgtggccacgagcgtccagcaggccatcgccgaacaccaccagctcggtgtctttaga

SEQ ID NO: 2580 - DNA, 1245 bp, Myxococcus xanthus
atggcgccctcccacgtccaggccggcgtgcccatggagatgcgggaatgtccttacgcgggcagccgccgcaagcacgcccatcccatgaatgtctcctcgctgcgccagttcaatcagcactggcccgcggtggtgggcgggctggccgtccttcgcaacgcgtacctgaaacaggcgcagcgcccgctcgacggccccatcaccatggtcgacctgtggaagttcagccggctgggggtcgccctctccgcgtacctgctgcggcgcgggcaacttccgctccaggacggccacctgcccgcggtgacggccatcctctaccgcatgctcctgggcatcaaccgcgtggcccacctgcaggtgttgatcatcatctccgcgggcctgtacgaccagatggaggcgctcgacccggcggtgctctacgagttcaccgacgcgaacgagctcttcatcgggatgaactcggtgtgcgcggggccgcgcgggctcatcgaggactccttccgggtcctcatctccggccagctcccgccccaggccgacccgggccctgtcagtgcgctggtgagccgccccttcctcgagtacggcaacctgctgatggggttggacgcgcagaagtacctgttcggcgtccgggccacctcgctcgcccacgagctgtccaggcagctgtcccaaccgcgcgcgggagagccggggccgggcgagctcgccgcggcgctggaggcctatcagcgcaggacggaggagcaggtcagctcgctggcccgggaagtcgccgccgcggagcaggaggtccgcgagcgcaccgtccgggacctggagcgcttccgggcggagttggaccaggagcagcacgccatctccggccagggcctgggcgcgcagacccgcgagctcgaggccctgaccttccccgaggacacccccgcgcgggtgatggccctgctggagaaggcccgccccgccggccccgcgctgcgtcccttcgccgaggccctgacggagtatctgcgcctcgaacgcgccaacctggccatcttcgagcgcctgcaggggcgaatcgaacatgcgctcggccgcgacggagcgacgcttcagttgggtaacacggacgtaatgaaggcctttggtccgaagttgcgcgacttcgcctccgagttcttcagactcgacatccagagcggcgcccagagaaccgtgctccgccacggcgccgacacgctggtgctctga

SEQ ID NO: 2581 - DNA, 879 bp, Myxococcus xanthus
atggcgtaccgctccgccatcctgccccacgtccgggacaaggtggtcgcggacctcggctgtggcaccggcatcctctcgatgttcgccgcgcagggcggcgcgcgccatgtctatgcattggaagagagcgaggtggccgcgctcgcacggatgatgttccgggccaatggcatggaggaccgcgtcacgcttttgactggcaacagcaaggacatccagctccccgaacccgtggatgtcatcgtccacgaaatcctgggcatcgaccccttcttcgaaaacgtcatcccatacatcgatgacgcaaggagacgcttcctccgcccgggccagggcaccttgattcctcacaaaatagaagtctgttgcgttggggtggagccggagttcgttccctccatcgcccaccgcgccaggttggaagcgcgtgagttctccgggatgtatggcctcgacttctcgccctacctgcacgtgctggaacaggcggatgaaatcaatgacgacgccacgttcccccgccgggccaatgacttccgcgtgggcttcttcgagcaagccattctttcggaggagtgcgtggtgcgcaccattgacctggcgggtgacctggaggcgcagacggcgggcgagacgctgtcatccctgaagatacgggccggcgggcggctgggctcactcctgatgttcttcagggcccacctggacgaccggttggtgctgtccacctctcccttctcgccccggacgcactggggctgggcggtgagggacctgccgcgggccctctcggtgaacgcgggtgacgaaatcacgctcacctccagcctgctcaccgtggcgggccgccagaaactgaaggtcctaccgaagtaa

SEQ ID NO: 2582 - DNA, 864 bp, Myxococcus xanthus
atgccgggaggcgcccgcctccaggaagaggtgcggcgcttcatcgcggacgtccaacgggaccacacctactccggggtcaacacctatctgggaaacacggtgatgaagacgctgcttcccctgctacagcgcgcggcgaccgagcaggtcgcgcctccggacgatcagaccgtgcgcatgatggagatgttccatgcgcacctgcgccgcagggtccagggcagactcgtggactacttcgaacgcccccccctgctcggccgggacgtccccgacaccgtcttcgcgctgagccagggcgtctccgattgcatgcgatggcgaggcatccccttgttcaagacggtgtacgacctggcgctctatccacgcctgctgtcggacctgcggccgcgcacgatcttcgaaagcgaaagcgcgaatggcggcggcgccctctggctggcagaccagctcacggcgctggaactcgactgccatatccacacatatgacctggtgaagccagacgtctctcatccgcgggtcagcttcatgcagggggacagccacaagattcagaaggtcttcacgccggaactgctgagagcagcacctcacccctggcttttcatcgaagacgcccatgtcaacgtcgacggaatcctgacgtacctccacgaatacctccggccgggcgactacgtcatcgtggaggaccccgaaagcggacgcgtgtcaggcgaagagtcgctcgtcgaagaccaactcggcaggtttctctggcaccaccgcgaggcctaccgggtcgataccttctacaccgatttcttcggctacaacgcaagctgcgccatggatgccattttcaagcgagtctga

SEQ ID NO: 2583 - DNA, 594 bp, Myxococcus xanthus
atgaggtggctcatccccgccgccggactcgccacgctcacgggctgcaacgtcagctcggagttcctccagcgcatggagcaccaggcgaagtacgagtactacgaggcgtccgacttctgggcggacggtcgcgccatgcgcacgcctcccgtgggcacggttccgcgtgagcgcttcgagaagctccccgagctcaaggacccgacccagcgccaggtggccctcaccggccgcagcgccggccagccggtggcccacctgcccatcacggtggaccagaacctgctgaccctgggtcagaagaagtacaacatcgtctgctcgcagtgtcacggcgtgctcggcgatggaaacagcatcgtcgcggagaacatggccctgcgcctgcctccctcgctgctggacctggagagcaagtcggacggccacttctacgtggccatcaacgagggctacggcgtgatgccgtccttctccggtgagctcgacctgcgcgagcgctgggccgtggtcgcctacgtccgcgcactccagacggcccgcaatacccgcacggacggccagcagcccgttccgcaggagaaccgatga

SEQ ID NO: 2584 - DNA, 1104 bp, Myxococcus xanthus
atggagctgctcccactggactggctgaacgagcacctggggtcgaacaacgccgtctccctgaaagggggcgaaggcaaggtggacctggacctccgcatcaaagacggagggctggccgatgacagccgcattgacgtccagggccaggagttgaacgtgcgggccggtcccatccgagcgcgtgcgccctgggcactcaaggcctcgctggcttcggagagccaggacgcgcggaaagggacggcaacgctttccttcgcgcccgtgcgggtgtccggtcccgaaggaacgggagcagaggtccctgaaatcaccctcaccgtcctcgcgcgtcgcagcgcggagcagtcggattgggagctcgagccggacctccgcgtggccaggagccggccgttggacttgaggatgctcaacccctggctggcgcggacgatggaaatcgactccgggttcatgacggtgcagagccgggagcagtcgaagttcgcgaaggtccaggactcgctgcggctgagcgtggactccgacctcgtctccggacgcatgggaaacatcaaggtcctgctgcgcgccgaggcggacgtggatgcacggaacctgtcgtgggacacgaagtccctggccctgacggggacgacgctccggctgacgaatgtgtccacgaatggccccgtgcccatccgcgcttggagcggcgtcttcaccctgccccaggcccgactgtccctgtctccgacggtgctgtcggcacacttcgccagcaagctcacggacacacaacctgtcgccgcgctgctcacgtccgcgaagaatctgccgcgcttcctgacgtccctgctcaacatccgggacgtcaccgtgacgggccgggtgcagattgacgaaggcggactccaactgcgcgagctgaaggcggacggtgacggcttctccctgcaaggacacctggacctcgcaggcggagagctgcagggcgcgctcctggcgaccctgggcgccctcaccggtggaatcgaattcaaacccggcggacaggacctgcacctgctgaacgcgaagcagtggttcgcgaaacagcctgagccaccgttccggtag

SEQ ID NO: 2585 - DNA, 1746 bp, Myxococcus xanthus
atgccgagtcccagccgttccgtacagaccctgaccgacctgctgcgctggcgcgcctcgaaccagaccgaggcccgcgcatatacgttcctccaggatggcgaaggccaggagaccacctggacctatggcgatttggatcgccaggcccgcgccattgccgcggcgctccaggagcacaagggcgctggcgagcgagcgctgctgctgtatccaccggggctcgagtacatcgcggcgttcttcggcagcctgtacgcgggcgtggccgcggtgccagcctatcctcccgcgcagctacaggccgtcacgcgcatcctctccatcctccaggatgcgaagccacgcttcgcgctcaccacgcacgaaatcctggagagcgtgaacgcactggcggaggcctaccccgtcctgaaggacatccgctggattgcgacggacgcgctggaggatgggctggaggatggctggaagcgccccgccatcaccggcgacacgctggccttcctccagtacacgtcaggctccacgtcgacgcccaagggcgtgatggtgctgcaccggaacctgatgtccaacgaggagatgatccggcagggcttcagccacgacgacccgccgacgatatgcggctggctgccgctgtaccacgacatgggactcatcggcacggtgctccagccgatgtacctgggatcgcactccatcgtgatgtccccgtggtccttcctgcagcgccccatccgctggctgaacaccatcacgaagtaccgtgcgacgacgagcggcgggcccaacttcgcctacgcgctctgcacgcgaaaggtgaagccggagaagctcgcttcgctagacctgagttcgtggcgcgtcgccttcaatggcgcggagcccgtgcgggcggagacgctggtggagttcgcggacaccttcgcgcccgccggcttccgccgggaggccttctatccctgctatggcctcgcggaggcgacgctcttcgtgtcgggaggcatcacctccgagttgccacgccacctcaccgtggattcggcggcgctcgagcagaaccgcgccgtggccgcccagccgggcccgtccgcgcgaacgctcgtcagctccgggcggagctggggtgacagcctcatccgcatcgtgaatccagagacgctggtggcgtgcgcaccgggcgaggtgggcgaaatctggacggccggtccccacgtcactcacggctactggggacgcgaggagacgaacgcagagaccttccaggcgcgcatccagggcagcgaggaaggtcccttcctgcgtaccggcgatttgggcttcatgattgacggcgatctgtatgtcaccggccgcatcaaggacctcatcatcgtcgacggtcggaaccactacccgcaggacctcgagctgacggccgagagccagcacccggcgctgcgccctggctgctcggtggcgttctccgtcgaccacccggagggcgagcggctggtggtgctggtggaggtcagcgcccgcttcgctccatccgaacagggtgatggcgcccagtccctgaacgggagcgcgctccagaagaccatccggcaggccgtggccgccgcgcactccgtggacgtccatgaggtcgtcctgctccagcagggcgaggtcctcaagacgtccagcggcaaggtccagcggcgcgcctgccgggcgaagtacgtggagggcagcctccagcgctgggccgcgtag

SEQ ID NO: 2586 - DNA, 261 bp, Myxococcus xanthus
atgttgccgctggcgtacacgatcgccgggcctctggcggaccacgccttcgaacccgccatggcctcgggaggaaagctcgtccccctgctgggtgcgttcgtcggcgagggcccgggccgaggcatcgccttgatgttcctcatcgcgggcgtgctggcggtcctcatgacgctgctggccacgctctaccgcccgctgcgtgagctggacgtgccccctcaggacgcgccttccgccgaacccgcggcgagcccctga

SEQ ID NO: 2587 - DNA, 567 bp, Myxococcus xanthus
cagcagttccggaagcagggcaagtcgattgctttcgtgggcatcctcaacaccaccgtcccggtgaacgaggccccgccgagcgaggctcctccgttcgctgacgcggactggatggcctctgtcgcgagcacggccggccgtctctacggcgtggacctgggcatctccgccgaggcgctccgtccgctgtctgccgaagcgcgccgagagtacctgacccacaggctggtccaggcggggctcctccccgacggcgcggacagccagcaggtccaagggttcatcgacgtctacaaggccgcgtacgagattgattacgtcccccgggacacgttccccgttcccgtcgccctcttccgggcccaggagcggcacgaggaagacggcatcgtccccgagtccttcgcggacgacccgagctggggctggggccgccacgcctccacggccgtcacgcccgtgacggtgccgggagaccacatgacgatgctggccgcgccgcacgtccaggtgctggcggagttcgtgcgccagggcctcgtccgagccggagccattcgatga

SEQ ID NO: 2588 - DNA, 900 bp, Myxococcus xanthus
ctaaagaccggcgtgcgcgacttcggcgtgttcgtggacctgggcggcgtggagggaatgattcccgtctccgagctctcgtacacccgcgtcggccacccgagcgacgtggtgaaggtcggcgatgacgttgaggtcgagatcctccgcatggaggccggccagcccaactcgccggacaagtccaagcagaaggagcgcatcacgctgtccatgcgctcgcgccaggaggatccgttccagaaggcgctgtccgaaatcaaggaaggcgaccgcctccagggcaaggtcgtccgcctgcagcagttcggcgccttcgtggagctgcgtccgggcgtggacggtctggtccacatctccgcgctcagcgaccgccgcatcgcacacccgcgcgacgtggtgaaggaaggggagaccatctgggtgtcggtggagaagatcgacacgcaggagaagcgcatcggcctgcgtcgcatctccgaggaagaggcgcagcgtcctcccgaggagcgcacggcgcccgccgctgaagccgccgctccggcgcagcccgccacgccccgtcccaaggtgggccaggtcgtcgtgggcaaggtggaccgcatcgagccctacggcgtgttcctcgcgttcccgggcggcaagggcttgctgcccgcgagcgagacgggcaccgagcgtggcaccgacctgcgcaagcactactcgctgggccaggaggtgaaggtggccatcctggacatcgacgcgtccgggaagatccgcctgtccgtcaccgccgccatccgcgcggaggagcgcgccgaggtggaggcctggcagaagacgcagcagccgcagggcgcgggcaagaagggcttcggcaccttcgcggatctgctcagcaaggcgcgcaagtaa

SEQ ID NO: 2589 - DNA, 945 bp, Myxococcus xanthus
atggacgccgacatcacgcatgtcctgctggtcggaggtacggggcgttttggcggcaggttggcgtcggcgctgctggcgcgtcccggcatccacttgcatgtgttggtacgtccgggcacgcgcagcgacgcgctggtgcgtctggcggagcatggggtgacgttggtgagcgggacgctggatgacatgcgctcgctcgattcggccttggagggcgtggatgcggtggtctccgccgtgagcggaccacccgaggtgcaagtggcagggcaactccggttgctggactccgcgcggcggcatggcgtcatccgcttcatcccttcggactactcgctggactacaccgacgcggacgcgggtgacgccttcatggatgcgcaccgccgtgtcgcggacgccgtggtgaagagcggcgtgccgcactccttcgtcctctgcggcgcgttcatggagacggcgctgtcgccgcaggcgcaggtgttcgactttgagcgcggcgttgtctcgtactggggcacgggggacgagcccttcgacgtcaccgcgatggcggatgcggcgcgttgggtggcggaggtggtggtggatcctcacgccgcgggccggcggctggagttcgtgggggacgtggcgacggtgaatgacgtggccgccctgtacgaagcgctgaccggtcagcgcctgcgccgcctgtgcagggggagtgtggaggaccttcgccggcagctcgtgcgcgcacggcccgaaggcgtgtccgttcaggtgtcttcagcggagctgagtctgctctcgcagcttgcggggaaggggagactgcgcgaaccggcaaatgccgagtacccgcggctccggcccatgacgctgcgcgacttccttgaagcacggtggatggtgtcgacatccgcgcgggcgacgttgccactcgcttcacagccgtag

SEQ ID NO: 2590 - DNA, 4287 bp, Myxococcus xanthus
tggctgccggacggcgcgacggagacgcagggtaacaacgtcgacgcgtacgcggacctcgccgatccggactactacagccccggcgacctccgtgcttccgtcacggccccgggcgtgttcgaccggatcatcgacttcggcatccagccgaacgccaacaacgagcagatcgccgcggcgacgacgagcctgttcttcctgaacaactggctccacgactggtactacgacgccgggttcgacgaggcctccggcaacgcccagcatgacaacttcgggcgtggcggcgtgggcggtgaccgtctgcatgcgcaggcgcaggactacagcggcaccgacaacgccaacatgcgcacgccggcggacggtgcgtcgccgcgcatgcagatgtacctgttcgccggggcgcgcaactcgcgtctgacggcgaacgctccggcggaggtcgcgggtgactacgagggtggcgtctcctccaccttcggtccgcagaccttcaacgtcaccggcgacgtggtcgcggcgctggatgccgtcaacaccgccggcccgacggaccgtgacggctgcaccgcgctgaccaacgcggccgaggtcgttggcaagatcgccatcatcgaccgcggcacctgcggcttcgtcgacaaggtgaccaacgcgcagaacgcgggcgccatcggcgtcatcatccacgacaacgtcgcgggtcccacgatcgacctgggcggcgactccaccaccatcaccatccccacgcttcgcgtgaacctggatgatggcaacgtgctgcgcagcggcctgccggcgctcaacgtcaccctgtggcgtggcccgaccgcgtggatcgacggcaccatcgacaacgccatcgtggcgcacgagtggggccactacatcagcaaccgccttgtcgcgaactcgtccggtctggtgaacaaccagggccgctcgatgggcgagggctggggtgacttcaccgccctgctgatgatggttcgcgccgaggacatcaacgtcccgtccaacgcgaactggaacggcgcctacgccgccgcgggctacgccacgcgcgcggacgcgaactccgagttcttcggtatccgccgtggcacgtactcgtcggaccagaccaagaacgcgctgtcgttccgtcacatcatggacggcgtggcgctgcccacgggtgtgccgttcaacggcaacacgggtcagccgaactcgcaggttcacaactccggcgagatctgggcgacgatgctgtgggagtgctacacgtcgctgctccgcgcgcatccgttccaggaggcgcaggaccggatgaagagctacctggtgaacgggtacaagctcacgccggcggcccccacgtacctggaggcgcgtgacgccgtcatcgcggcggcctacgccaacgacccggcggacgccgagcggttctggacggccttcgccaagcgcggcgcgggcgtcggcgccgtggctccggaccgctactccacgaaccacgccggtgtcgtggagagcttcgtggtcggttcggccatccagattgtgtcggccgagttcatcgacgacgtcgaggctggctcgtgcgacctcgacggcatcctggacaacggtgagacgggccgcatcgaggtcaccgtgcgcaacgcgggcgcactgcctgcgtccgcctccagcgtcaacctgtcctccgccttctcgggtctcgagttcggcaacggtggtcaggcaagcttcccggccatccccgtgttcggtacggccacggtctccatcccggtctcgctcacgggcgcgacgggccagcaggacgtgaccatcgacatcgcggcgcgtgatgcgggccaggcgatccccggcgacatcacggacagcatcatcctcacgacgcacttcgacgagcgtgagaactcctccaacatcgaggacgttcagatctccccgtccaagctgccttgggaaaccgagtacgacgaggccctgaccccggccgcgttcagcgtggtcacgttcccggacggcaaccgcacgttctacgcggagaacaccgcttcctacgccgacgttcgcctcatctcgcctgagctgcacgtcagcgcgaccgagcccttcgtgatcaacttcatgcacgcttgggacttcgaggatgactacgacggcgccacggtcgaaatctccgaggacggtggccagacctgggtggacatcggcgatccgatccacaactcggttcttgagacctacccgggcaacctgaacccgctggctggcaagcccgcgctgtccagctacaaccctcagttcccgggcatgctccctgcgaccatcgacctgggcacggcctacgccggcaagacggtgcaggtccgcttccgggtcggtacggacgagagcggcggctacacgggctggctgctggacgacctcgagttcaacggcatcacgaacactccgttcgccaccatcgcgcccgaggatggcgtttgtgtgaacccctggcccatcgccaacgccggtccggaccggtccatcgcgccgggtgaactggtgagcctctacggttcggctgccgatccggaaggccagccggtgaccttcacctgggcacagacgtctggccctgcggtcaccctggcgggtgccaacaccctgaacccgtcgttcacggcgccgcaggttaccgagtccaccgcactggtgttcacgctgaccgtctccgacggcgtcaagacgtccacggactcggtgaccgtgacggtggcgctccccaacaatccgcccaccgtgaacgcgggcctcgacggcatcgtcgaggagcgcgctgagtacacgctgagcggctccgccagcgatgcggatggcaatgccctcacgtacctgtggacccaggtctccggtacgccggtggcggtgaaggactacaccacgccgacggcgacgttcatcgcgcccgaggtcacgctggatgagtcgctggtcttccgtctgacggtcagcgacggcatcgccacggtgaacgacacggtcaccgtgacggtcaccaacgcgaaccgcgcgcccatcgtctccgacacgtccgtggccttcgccgcgggcactgtcaccgtgacggcctccgcggtcgacccggatggtgacgcgctcagctacagctgggagcagacgggtggttcgacggtcgccatcaatggcgccgacacgtccgccatctccttcgccaccccggtcccgggttcgtacgagttcaccgtgacggcgacggacggctcggcctctgcctccaaggcggtgccggtgaccatcatcgatggttctctgccggcgaactctgcgccgaccgtgaacgcgggcatcgatgccacggcgaacgctggtgacgtcgtgacgctcagcggctccgcgagcgacgccgagggtgacacgctgacgtaccactgggagcagatcggtggcacggatgtgaccctgacgggcgccgacaccctgacgccgtcgttcaccgcgccgagcacggccagcggtaccacgctcggcttcatcctgacggtcagcgatggcacctcgaccaccagcgatgccgtgcgcgtcatcgtggcggcggacccgggtgccaacccgagcaacactgctccggaagcggacgcgggcgagtcggccatcgtggcggagggcgccactgtgacgctcaacggcacggcgaccgacgctgacggtgacacgctcgtcatcgtctggacgcagatcggcggcacgcccgtgacgctgtctgacgcgtcctcgctgacgccgacgttcaccgccccggcctcctccgatccgctgaccttcctcctgatggtcagcgacggtacggcgactgtcgtcgacgtgacgtccatcagcgtgaccgaggagaacgtcgcgccggtggcgtccgctcgcgcggtgctctctggcaaccagacgtcggccacgctcgacggctcggcttccagcgacgcgaacggcgatgtgctgacgtaccgctggacgcaggtctccggcccgaacgcgaccatctccggcgcggaccaggcggttgcggtcgtcaacctgcctgacctcgacgacaagacggcgtcgttctcgttccgcctgacggtgaaggactccgcgggcaccgagagcagcaccaccgtgcagttctccgcccgcaacggcggtgacagcggtggctgctccgcgacgggcgcgggcgctccggtcggcatgatcggcctggcgctgctcggcctgctgcgccgccgtcgtctgaactga

SEQ ID NO: 2591 - DNA, 1533 bp, Myxococcus xanthus
gaggccaccgtggtggacctccaggccgcgatgaaggcaggcgagctcaccgcgcaaggcctcgcggagcgctacctcgcgcgcatcgccgactgggactcgcgcgggcgcctgccgctgcgctccgtcatcgagctgaacccggacgcgctcgccacggccgccgcgctcgaccaggagcgccgcgagaagggaccccggggcccgctgcacggcatcccggtgctcctcaaggacaacatcgccaccgcggaccagatgcagacgacggcgggttccctggcgttggtgggcgcgcggccgtctcgggacgcgttcatcgtggagcgcctgcgagccgcgggcgcggtcatcctgggcaagacgaacctgagcgagtgggccaacttccgctccacgcgctcggccagtggctggagcgcgcggggtggccagacgcgcaacccgtatgcgctcgacaggacgccttcgggctccagttcgggggcgggtgcggccacggcggccaacttctgcgccgtgtccgtgggcacggagacggatggctccatcgtgtcgcccgcggcggccagcgcgttggtggggctcaagccgacggtgggactggtgagccgctccggcatcattcccatctcccacagccaggacacggccggccccatgacgcgcaccgtggcggatgccgcggcgctgttgagcgtgctcgcgggcgtggacccttcggacggggcgacgggggcgagccggggcaaggcccatgcggactacacccggttcctcgatgtggacgggctgaagggcgctcgcatcggcgtgccccgggagcgcttcttcggctaccacccggccaccgacgcgctcgtggaggaggccttggccttgatgaagtcccgcggcgccatcctcgtggacccggcgccgattcccgcggtggcgcaggtggacgcccccgaactggaggtcctcctctacgagttcaaggcggggctggaggcctaccttgcgacgttggaggaggggacggccccgcgcacgctcgcggagctcatccgctacaacgaagcgcacgcgccgtcggagctgccgtacttcggccaggagctcttccacatggctcaggccaaggggcccctgacggacaaggcctatctcaaggccctccaggcttgccgccgcctgtcgcgcgcgcaggggctggacgcggtgatgaagaagcaccagctggatgcgctggtcgcgccgacgcaggcacccgtggggctcatcgaccccatcaacggtgaccactggctgggcagcagctccacgcccgcggccgtatcaggctatgcctccatcaccgtgcccgcggggttcgtgtacggcttgcccgtggggctgtccttcatcggcggggcctggagcgagcccgtcctcttgaagctggctcatgcctatgaacatgcgtcgaagcaccgccgcccgcccaccttcgcggagacggcggacctgcgggtgcacgctggcgcgggaagcccacccgcgaagccctga

SEQ ID NO: 2592 - DNA, 1041 bp, Myxococcus xanthus
atgagccagcaacctcgagcctctcacgcgcctccgcccgccgctctgcagatgacgcaaatggtctatggcttctgggtttcccgaagccttcaaatcatggcggaactcgagctcgcggataccatcggtgatacgcccaagacggtcgaggagctcgccgaggcgagtgggactcatgcacccacgctgcgccggctgttgcgactgctcagcggcctgggtgtgctcgtgaaggatgagtccacgcagcgctgggccctcaccgagctgggcggaatgcttcgcaaggacaaccccggctccgtgtatggctcgctccgggcgcatggacacatcctgtcgtggcaggcgtggggagacctggtcaccgcattgaagacgggcaagcccacggtcgagaagttcatgggcgacacgttcttcaactacatgacgacgcatcccgacgtcgccgccatcttcaatggcagcatggccgcgtaccagacgctgaacgcgcccgccgtggtgaacggatatgacttctcctccgcgcgcagcatcgtcgacgtgggcggcggtacgggcatgctgctgacgcacatcctcaaggccaatcccggcgtccgtggcaccgtcttcgaaatgccacacgtggcggtggaggcccgcgagcgaatcgccgagcaggggctgtcgccgcggtgtgacgtcgtcgctggtgacttcttcgagtgcatcgttcccgaaggcaaggacgtctacatcctgtcgcagatcctccatgactgggatgacgagcagagcctgcgcatcctcaagtgcatccgcgcggcgatgcgtcccgactcgcggttgctcatcgtggagacggtgctgcccggcgacaacgtgccccacttcggcaacctctacgatctggccatgctcgtgctcgtgggcggccgggagcgcacggggccggagtacacggcgctcttggagaaggcggggctgagactgttcaacgtcttcccgacgacgatgccgcccagcgtcgtcgaagccgtggtggcctga

SEQ ID NO: 2593 - DNA, 321 bp, Myxococcus xanthus
atgagcgccttcctcgacaccattctggccttcccgaccgccatcttcaccatcgtcctcggcgtggtgatgacgtactggctgttcgtcatcgcgggcgcggtcggcatcgacctgttcgatggggacatcacgctggagtcgggcggcaaggcgctgagcggggccatcgagggcggcggcaaggcgctgggcggggccatcgagggcggtggcaaggcattgggcggggccatcgagggcggtggcaaggcattgagcggggccatcgagggtggtggcaaggcattgggcggccgcgaaggcgctgggcgcccatga

SEQ ID NO: 2594 - DNA, 1248 bp, Myxococcus xanthus
atgagtccccccgtcaccaactcgcacaccaacttcgggccgtacaccggcacgccgaagctcatggtgcccgcgttcgccgtgggcattctctgcctcctggccacgctgggtggcttcttcgccaccgacgccaagggtgagacggcgcacgcctatctgattggcttcacctactgggtgggcatcagcgtcgccttcctcatcatgcaggccatcttccacacggcgaaggccaagtggctcatcgtgctgcgccggacgatggagacggcctccgcggtgattccggtgttcttcgtgctggccctgacactgctggccatggccacctacctctacccatggtgggaaggctccgagctgaccaagggatactccagcctggaactggagcacctgagccacaagcagcacgggtacctgaacaaccacctgtccttcccccccggcgtgggcattcgccacatcatctacttcggcgtgtggacgttcgcggcctggcggccttcggtccgtggagacctgaagcagcacaccgagggtggactcgacttcacggtgaagcagcgcaagttctctccgggtgtgctgccgttccttgccctcaccatcacgttcgcttctttcgactggctgatgagcctcacgccgctctggcagtcgaccatcttcggcgtctattacttcgccggaagcttcctggcggccttctgcatcctgaccatcgtcacggtgagcgcccagggcaaggacctctacggcagcgtcgtgaagctggaccacttccacaacctcggcaagctgatgctcgccttcaccgcgttctgggcctacatcgccttctcccagttcatgctggtgtggatcgcgaacatcccggaagaggcgccctggtacggcctgcgcatgttcggcccgtggcggtcgatgtccatcgccctgttcttcctccacttcctgctgcccttcggcatcctgctgtcgcgcaagctgaagctgcagcctcggaagctggccgtggtggccgtgtacctgctcatcatccacgcggtggacctgtactggctggtgtggccggcgctgaccggtgacgcgggcccgacgttccactggtcgctgctcacggccttcttcggagtgggcggtatcgcggtgggcttcgccctctacctggcgcgtggccactacacgctcacggtgaaggacccctacatcgccgagtccttgaggtacgtgcagccatga

SEQ ID NO: 2595 - DNA, 543 bp, Myxococcus xanthus
gtcgacggtggcggagtcctggcggccatgggcttcgcgggcatccccatcaccgtgtccgtgagcttcgtggcgttcatcgcctggctcctgtcggtggtgagcgcgcagccgctgcacgaggcgctgggcgggatgatgccgtcgtggctgttgagcagcgggctggggctggcgtgcttcgcggcggggacggtgacggcgggcttcgcggtccgacccctgcggccggtgttcgtgaccaggcgcgccccggggcgcgacgcgctgatgggccgcgtgtgcaccatctccagcggcagcgtgacggccaagacgggccacgccaccttcgaggacggcggcgcgggcgtcatcctcaacgtcgtctgcgcgaagcccaatgaactcaagcgagggcagccggcgctgatcctcgcctacgacgccgagcggcgcgtctacgaagtggagccggtcgactggctgctgccggaggagatggagcagctccaggatccggcccgcgccgcggcattggctcgcgtgaaggcacgaggctga

SEQ ID NO: 2596 - DNA, 1304 bp, Myxococcus xanthus
atggccatggaccccattaccgcggtcgctgccggcatcggtggcatcatccttctcggaggcatcctcctcaccatcgtccggctctaccggcaggtggaccagggcaaggtgctcatcgtcaacacgctgaagaacgagccggtcgtcaccttcaccggcgcggtggtgttccccatcatcaaccgggccgaggtgatggacatctccttgaagacggtggaaatcgaccgccgtggcaaggaaggcctcatctgccgggacaacatccggggtgacatcaaggtcaccttcttcgtccgcgtgaacaagacgcgcgaggacgtgctgaaggtggcgcagaccattggctgcgcgcgtgcctccgaccaggagacgctggagaacctcttcgaggccaagttctcggaggccctcaagacggtgggcaagagcttcgacttcgaggagctctacaccaagcgcgaggagatcaaggaccaggtcgtcaacgtcatcggccgtgacctcagcgggtacatgctggaggactgcgccatcgacttcctggagcagaccccggtcgagatgctggacaaggacaacatcctcgacgcgcagggcatccggaagatcaccgagctgacgacgaagcagaatgtcttcaccaacgagctgcgccaggacgagcgcatggccgtcaccaagcgcaacgtcgaggcggatgaggccatcttcgccctcgagcgtcagcgtgaagaggccgccgcgaagcagaagcgcgagatcgacagcatccaggcccgcgagacggccgaggccgagcgcgtgaagcaggaggagtacgccaaggcccagctggcgcgcatcaaggccgaggaagaaatcaacatcaacgagcagaacaaggcccggcagatcgaggtcgcgcagaagaaccgcgagcgcgtggtgggcgtggagaccgagcgcgtggagaaggaccgcgccctggaagccatcaaccgcgagcgtgagacggagctgcagcgcatcgccaaggagaaggcgctcgaaggcgagaagaagctcatcgccgacgtggtgcgggcccgcatcgccgtggagaagacggtggcggaggaggaggagcgcatcaaggacctgcgcgtgaaggccgaggccacccgccgcaaggacgcgctgctcatcaccgccgaggcgcaggcgcaggagaagctggtcaaggacatcaaggcggccgaggcctccaacgaggtggccaagttcaccgccaaggagaagctgacgctggccgaggccgagctggaggccgctgacaagac

SEQ ID NO: 2597 - DNA, 1047 bp, Myxococcus xanthus
ctcacgctcctggccgggccggacgcgctccggctcattcgcgaacgaggcttgcgcggggacgacgtggacgtcgtccccggcgcctccggcggtccgaagtggctggtgctggcgggactggaccgggcgctcttcgccggcctcttccagaaccgctcgcgccccctccacctcatcggcagttccattggaagctggcggctcgcctgcatggcccagaaggacccggtgctggccttgcgccgcttcgaggcggcgtacatcgaccaacgctatccgcccaagcccacgcccacccaggtgagcgagacctgcgagcgcatcctggatgcgctgctgggcgaggatggtgaagcggagattctggaccacccctgggcacggctgcatgtcgtcaccgcgctgtgccggggggcggtgggaatggaaggcccgggggcgcagctcttcgggctcgtgctctgcgccctgggcaacctggtcagccgacggacgctggggctccacatggagcgcgtcatcttccacacggccggggacaccagccccttcaccgggctcaacgacctgccctccacccacctgccactgacgcgggagaacctgcggctggcgctgctggcgtcaggctccatccccctgctcttcagtggcgtgcgtattcccggcgcgcccgcgggcgtgtttcgcgacggcggcgtggtcgactaccacctggacctggacttcggcccaggcacgggcctggtgctgtacccgcacttctacccgtacgtggtgccgggctggttcgacaagtcgctgcggtggcggcgggcacggccccagaacttccgcagggcgctgctcatcgccccgtctccggagctggtggcccgccttcctggcggccggatcccagaccgggtcgacttcgaacggatgaaggacgccgagcgcatgcgcgcctggaaccaggtggtctccgagagcgagcgcatgggcgacgcgttgcacgagctgatggccaccggacgcctcgcggagcacgtgcggcccctctga

SEQ ID NO: 2598 - DNA, 339 bp, Myxococcus xanthus
atgcgggaggatccgggaggccccgtggtcatcctgaacctggtgcgcttcaaggaaggcggccgcgcgtcctatgaggcctatgcgagcgcggtgatgcccttcatccagaaggtgggcgcccagcccctctacgccggagacggctccacggcgctggtggccgatcccggacagacatgggacgcggtgctcctggtccgctatcccagccgcgccgccttcctacagatggtggcggacccggagtaccagcacatcgcgcacctgcgcacggaggcgctccaagaagccgtgctccaggccaccacgccctgggccacgtcgccggagccctga

SEQ ID NO: 2599 - DNA, 624 bp, Myxococcus xanthus
atggggacgttccaggccagccgggggtttgccttcatcttcacgcacgagggccgcgccacgttggaggcccgcttccccttcctggtgccctacctggcccacgtgctggacccgctccatgcgacaggattgttgccttggcatgagcggctctggggttcgcggcgggagcggcccgcccccaatgcattctatctcaacctcttgttgctcgatgcggggcgcggcgtggggcgacacatcgacgcgacactgcaggagcccagcggcgtccccgacgcgacgccccggcacgtgagcgtgctgtatctccaggtccccgagcgcgcccagggtggtgagctgcgccttctccagaatgacacccccgtgggtgaaatccgcccacgcgagggcctgctggtgcacttccgcggcgacctccaacacgaggtgcggcccttcactggcagccaggaaggcgcgacccgcgccagcctcgtgtgtgagcaatacgtcttcccgcccgaggcgctcgcccgaatccccgccttccgcatccaatccaaggcaggcttcgccgcgtatctcgaccaccagcgcgagcagcccggtggcagctccgttggcacgttggaatag

SEQ ID NO: 2600 - DNA, 150 bp, Myxococcus xanthus
atgttcgagcgcggccaggtggtgaacacctggttcgactccgtggacgagctggcggagacgcggagcgggagcctccactgttcggagaaggccttgctgaacatgctcgacacgtcccggcagcgccggaggcgggcggaccactga

SEQ ID NO: 2601 - DNA, 324 bp, Myxococcus xanthus
atgaagcaaggcaagcgtgttccggggctgaagtgggtcatcgccgcgttcatcctggcgggctgtcgtggtgccgagggcgaggtgcccacggagaccgagtccaggctgtcgttgaaggagggccaggtgcttggcccggcgtgtaccggggagcagaagcaatgccccgagggcctctcctgcgcctcgttcaacctgggctcgggccccgaaatccgctgcgtccagtccccggaaatctgtgacttgttcaagtgcagcagcggcgagtgtgtggtgctggagagccatccaatccaggttcgttgcagcggctcctga

SEQ ID NO: 2602 - DNA, 189 bp, Myxococcus xanthus
atgctgaccgcctcgatggagacgtatggcgcggtcagccccgccgtcctcacgcgggcgcgggggttcgccgcctgccgcgcggtggccgacatcgccttcggtcagacgcagggacggccggagtacatcgccgccgggcaacgggcgctcaccggacttgggaagcacccgcccttcgacgcgtaa

SEQ ID NO: 2603 - DNA, 753 bp, Myxococcus xanthus
atgcagctcgcctcgacgtgggagttcgtgggctggcagggcggcgatgacacgggccccattggccacgtcccggagacgacctgggcggaccgcggtgtggacctcgacggcccggccatatcgcccgcggcgaccgaagtgcctctggcttcggcgtgggacttcatccagcagccctggcagcccacggcggcggagccttcggacgtcatcaccacgctcctggccgcggcggccagcggggccacggaagtgcccgtgggtggcccttccgtgacggcggagcacgtgttgtcggcgctcgatgtcgtgagtacccaggggacgctcggcagggtggtgctggcgtactgcgcgggccgcttccagcgcgccttcctcctgggcgaaagcctcggcctcgcgcgggtggggcatgcctggggcccgggcagcgacagcgcggcggttgcccaactcaaggtcgacctcgaagcaccgtccctgctgcacaccgcgatgacgtccgcgggtgccagcgtcttcgacgcaccggcctgtccccaggacgaggccatcttcgccgcgctgggcggggagggcgcttcgcgcctggctgtcatcgccatccggagccggggccaggcggtggcgttcatcgtcgcggaccacggcgcggagcccatcgccgcgctcgcgctcgatgaactcacgcgcatcgcgcagaaggcctccgaggccttctcccgtcttcccacccggagcgcctga

SEQ ID NO: 2604 - DNA, 342 bp, Myxococcus xanthus
atggctcctccctaccagcgccacgtcttcgtctgtaccaaccgccgcccggacggaaatcccaaggggtgttgcgcctccaagggagcggaggaggtccgcgccgccttcaaggcggagctcgacaagcggggcctcaaggggggcatgcgcgccaacgcggcgggatgcctggacacgtgcagcttcggtgtcgccgtcgtcgtctacccggaaggcacctggtatggcggcgtcaaggtggaggacgtgaaggacatcgtcgagcagcacctgatggaaggccgccccgtggagcggctgctgatgcccttctcccgcaagaccgtcacttcgggctaa

SEQ ID NO: 2605 - DNA, 468 bp, Myxococcus xanthus
atgaagaagacccaggttgagctcgagtcgcgcgtcatcgtcggcgcgcacggcgtggcggcggaagaagaccacctggtcatgggcaaggtggtgggcgtcggcgtgggtgcgctcgccatcttcgcggtgggcatcgtctgggcctacaccatccaggtccggacgatggctgacatccagccggagggtccgccgccgcgtcccgcggcgatggggcagtacgaggtgggcatcgtcaaccagcgcctgttcgagcaggactggcacgccgtggacaagatcagcggccaggaccaggcgctgcgcgccggctggggtaacgagccgggggtgaagcagcaccccggcatcgacgacgcgatgaagacggtcatcgagcagaagcgcaacccgccccctgctccgacccccacgcctaccccggagaccactcccgggcagacgcctccggcaccgcagcagtag

SEQ ID NO: 2606 - DNA, 1707 bp, Myxococcus xanthus
atgacggcgttccaggatgcggccctggccgcggagtgggcagcgggcgtcgcgtactccgtgggaacgcgcgtcacctatcaagggcgcctctatgagtgccgccagccgcacacgtcccaggcggactggacaccggtggcggtggcctcgctgtggttggacctggggcccgcgggcggtggtgagccggacgcgggcagcggcggaacggacgcgggcacgggcggggacgtcaccgcgcccaccgtgggcttgagtgccagtgcctcgcgcatcatcgccgtggggccgctgagcctgacggccacggcgacggacgacgtgggcgtgacgcgggtggagattctggagaacggtgccgtcgtcgccaccggctcgcagttcagccgggccttcagcggttgggagcagaacggcacgtatgtctacgcggtgcgcgcctatgacgccgcgggcaacgtggggaccaccacgctcaccgtcgtcgtggagattccaggtgggccgccgccgggaggaaagcgcatcgtcggctacttcaccgcgtggggcatctacgcgcgcaactaccacgtgtccaacgtgcagccgtccaagctcacgcacatcaactacgcgttctccaacatctccggggatggacgctgcatcctcggcgacccgttcgcggacatcgacaagagcggcggctggcagggtgagtgggaccccggtcagttgcgcggcaacttccgcgcgttcaaggagatgaagcggcagaacccgcacctgaagctgctcatctccgtgggcggctggtcctggtccacgcacttctccaccgtggcgtcctcgcctgcttcgcgcgcggccttcgtgaagtcctgcgtggacctctacatccgtggccagtaccccggtgtggaccccgtcaacggcgagggcgtgttcgacggcatcgacatcgactgggagtacccggtcggcggcggcctgccaggcaacagcaacagcccggctgacaagcagaactacacgctgctgatgcaggagttccgcagtcagctcaacgccgtcaccacgcagacgggcaagccgtacctgctcaccatcgccacgggcgcgtcgccggacctgctggagaacaagcaggagacgaagaagctgtccgacgtgctcgattggatcaacgtgatgtcctacgactaccacggggccttcgagagcacggtgaacttccactcggcgctccatcgcgtcacgggtgacccgggcgcggccacgggcttctacacggatggctcggtgtcgaagatgctggcgctgggcgtgccgcccgcgaagattgtcgtcggcgtgcccttctacggccggggttggggcagcgtgcccaacgtgaacaacggcctgttccagagtggtgtgcccacgcgcggcacctgggatgacggctcgtcgggtctgacgggtgtgttcgacttcaaggacatcaaggccaactacgagcgccccggttccggttacacgaagttcttccacccggaggcgaaggaggcctacgtctacaaccctgccacgggcatctggattgggtatgacgacgtgcagagcatcaacgccaaggcggactacatcctgaacaagaacctgggcggcgcgatgttctgggagttgagcggtgatgacggctcgctgctcgatgcgctggcacggaagctgcgctga

SEQ ID NO: 2607 - DNA, 1194 bp, Myxococcus xanthus
atgtccttcgcggcagccgtcctgctggtggtgctctccagctcttccgtggccgccgagccgtggaccgccgtcgtccgggtggcctccgacgaggacaccgccttgctcgtgcgagtgcgggggcagagcagcgatctgcccgtgcgtctcgaggtctcgtccggagcgccgctcggagaatttcgcgagggcccatggctcgcggcggaacggctggccgggcgccaccaggcccgcgctgtcctctggttcgtgcgagagggcagcgacgttcgcgtccaggtggccgagttcgacagccggcgtctgttctcccgggccgcgcggatggggcagtcgccaggctccctggaatggtccacgggggcggaggcgctggcgctggctgctcgctccgcacttcgcgcggtggaggccggcgcgccgctgggtgacgtggtggagttggcgctgccgcgacacacgtcgaacggcgaggggactgacaccggggtggggcatcgcatcgatgatgcggcctccagtgatggggccgcgctggggacgccctcgtccgagggcgccgacgttgcgctcgcggaggcagtgggctcggcttccgcgcgggaaggcgtgacgtcacctcgcgagggcccgaggctggcttcggccgaggagtacccagcgcgccagatgtggctcacgttggggggccatgccgcgctggatgggtacacgcgcacgggccaccagggggtgatggtgggcgtgggattgcagccgggccggtggcggctgcgagcgcaagtcctggccagtgtgccgacccggcttcgtgatgcccggacggagttgacgctggggcagcatgcggcgtcggtgtgggcggggctgccctgggcggcgtcggagcgattggatgtggaggccgggctcggcgcgggcgcggtggtcttcactcgccggacgcaagcgctgacggaggaggtggaggctgcacctccgggcacgatgttggccctgctcatgggccccgagctccgcgcccgctggcggatgggggcgcgtgtcggcctggaggcgagcatggccgcggaggtcctcctgggacggcccgagcttcgctacgccatcgacggaaacttcgtgtcacgcggtgcgggttgggccgtccgcccccggctggggttggcgatggtggtttttctttga

SEQ ID NO: 2608 - DNA, 495 bp, Myxococcus xanthus
ttgctgatggagctgctcccccgggttcgcaatctcgtgcgctacctggtgcgcggggatgtggacgtggaggacatcgcccaggaggcactcatcgccctggtgcgggggctgccgtcgtatcgcgctgaaggccgcttccaatcctgggcggatcgggtggtggcgcggacgacgttcgcatggctgaagcgctcccgaggccgggatgcccagcacgcggatgcgccggtggagctggtcgcggttccctctgaggatgccctgccggacgagtatgttcatcgccgtcacatggtgacactcctggatcggctttcgaatgagcagcggcatgcactggtgttgcatcacgtgctggagttgagcgtgccggagatttcaacggagctgggcattcccttcgagacggtgcgcagccggctccgcttggggcggacggcgctgcgctcgctggcgaccgcggagggagacggaggggaggagcggggatga

SEQ ID NO: 2609 - DNA, 696 bp, Myxococcus xanthus
atgaagtgggaagtgaaggccggcattgccgggctgttgttcgggtccatgctggtcggctgcggggtggcgccggaacaaggagaactgggtggcttggaggacgtgacggcggagtcgtcagcgagcgccgagaccgggctcgatgcacatcgtggctactccacgccagtcgcagtggctcgatatgggcacgcggtcgcgtacggcgacggcaagtacttcgcggtctgggccgacgtgcggaccggcggcatctacggcacgcgggtgaagccagacggcaccgtgctcgacccgcggggcatccgcatcaacttcggcgaagagattgggcgtcgaccggccatcgccttcaacgggacgcacttcttcgtggtttgggacaccatcaacggagtggatggtgtgcgcgtgaagccggacggtaccgtggtggggccgatgtttttagcagtccagtcggacgaagtcttcgatccagcgcgagtcgcctgttccccgaaaatctgcctggtgacgtacaccgtcgccggtgacgactcctcgaccatctacttcacccgggtgtccaaggacggcgtcatcctctcgacggacgaccacacgctcaacgcctccaacaccttcgcggatgacgcgtcgtcgacttggaacaacagcaagaaggagttcctggtcgtctggtccgtctag

SEQ ID NO: 2610 - DNA, 2766 bp, Myxococcus xanthus
acggcgaacgggaaggagcggcgcggcgggcgcaaggcgcgcgtggcggcgacgggcttgacggtggagcgcttcttcacgacaccgggcgtggatcccgcggatgagttggcgtgggaataccgcagcgccagcatcaccggcgaggatggcaaggccgtcttcgagcagaaggacatcgaggtgccgaagtcctggtcgatgctggcgacgaacgtcgttgcgtcgaagtacttccgcggcacgccgggcacgccggagcgtgaaacgagcgtgcgcaagctggtggcgcgtgtggtggacactctcacccagtggggtgtggaaggtggctacttcacgcgggacgcggaccgcgaggccttccacgcggagctgacgcacctgctgctgcgccagaaggcgtccttcaactcgcccgtatggttcaacgttggcgtggaggcgcagccccagtgctccgcgtgtttcatcaacagcgtggaggacaacatggactccatcctcacgctggcgcgcacggaggggatgctcttcaagtacggcagcggcacgggcagcaacctgtccaccatccgcggcagcaaggagctgctggcgggcggtggcaccgcttccggcccggtgtcgttcatgcgcggcttcgacgccttcgccggtgtcatcaagagcggcggcaagacgcgtcgcgcggcgaagatggtcatcctcaacgccgagcacccggacatcctcgagttcatccgctgcaagtcgagcgaggagaagaaggcctgggcgctcatcgaggccggctacgacccgtccttcaacggcgaggcgtactcgtcggtgttcttccagaactcgaacaactcggtgcgcgtcaccgacgcgttcatgaaggcggtggtggatgacgccacctggacgacgcggtcggtgcgcgatggccagccgctggacacctaccaggcgcgcgagctgttccgggagatctccgaggccgcgcacctgtgcggcgacccgggcatgcagttcgacaccacggtgaacagctggcacacgtgttcgacgacggcgcgcatcaacgcgtccaatccgtgctcggagtacatgttcctggacgactcggcctgcaacctggcgtccctgaacctgatgcacttccgcaccatcgatggcgacttcgacgtgacggcgttccgccacgcggtcgacatcctgctgatggcgcaggaaatcatcgtcggcaactcgcgctaccccaccgagcgcatcgagaagaacagccacgactaccggccgctgggcctgggctacgccaacctgggcgcgctgctgatggcgtccggcctgccgtatgactcacccgcgggccgcaactacgctggcgcgattacctcgctgatgtgcggcgaggcctacgcgatgagcgcccgcctggcggagaagcagggccccttcgctggctacgcgaagaacgcggagccgatgctgggcgtcatccgcaagcaccgcaaggccgcgtaccacatcgccccggagggtgtgagccagggcctgttcgccgcgcagaaggacgcgtgggaccgcgcgctcgcgctgggtgaggagcacggcttccgcaacagccaggtgacggtgctggcccccacggggaccattggcttcatgatggactgcgacaccaccggcatcgagccggacatcgcgctcatcaagtacaagaagctggtgggcggcggcatgctgaagatcgtcaaccagacggtgccgctggcgctggagaagctgggctacccgcagacgcagtcccaggacatcatcagctacctggacaagcaggacaccatcgagggcgcgccgcacctgaagcccgagcacctcccggtgttcgactgcgccttcaagccggcccagggcgagcgcagcatccactggatgggccacatccagatgatggaggcctgccagccgttcctctccggcgccatctccaagacggtgaacatgccgtcggacgcgacggtggaggacatcgagaaggcgtacatggaggcgtggaagcgcggcctcaaggccatcgccgtgtaccgcgacgggtgcaagcggacgcagccgctgaacacgtcgaaggagacggtgaaggacacgcgcgccgccaaggccaccgtggcccccgagcccgcccccgccgtccagccggagccccgcgcggtccgccggcgactgccggacgagcgccgctccatcacgcacaagttctccatcggcggccacgagggctacctgacggtgggcatgtacgaggacggcctgccgggcgagctgttcatcgtcatggcgaaggaaggctcggtggtgagcgggctgatggacagcttcgccaccagcgtgtcgctggcgctccagtacggcgtgccgttgaaggtgctggtcgacaagctcagccacacccgcttcgagcccagcggcttcaccggcaacccggacatccccatcgccaagtccatcaccgactacatcttccgctggctggagttgaagttcctgccgagcgaggaagaggacgcggtgctggaccgggtggacgtgcagccgaagcgggaagccctgcccgcgcggacggcttcggtgcagcggtccgacgccaacacctcgaagcggtccacctggctgaatcaggcggacgcgccgccgtgccacacctgcggcgccatcatggtgcgcagcggtgcttgctacaaatgcagcaactgcggcgcgaccagcggctgcagttga

SEQ ID NO: 2611 - DNA, 357 bp, Myxococcus xanthus
atgtgggccattggcggggcctctgtccggtgggagctgcgctcgcgttacgggaaccgccagacctgctacgaggccggcctgcagcgcgtgggcatcaacttccgagacatccacaccggcgaactggtgtacggcgacgtcggtgactgtcacgactgcgtcgatggcccgaatgaaagctcggtggtggtgtaccagttcctgcggcccggccgttacgtggtggagatgtacgccagcgctcgcgacggtcgcgagtacttctcgccgaacaactcgcccgtcatcgacgtggtcgcccaccagttcccgggcccgaactcctcgctgccggtgtacctcatcgaggactga

SEQ ID NO: 2612 - DNA, 816 bp, Myxococcus xanthus
atgcggcaaggcagccacagtcccattggtgtcttcgattcaggcgtcggcgggctcaccgtcctcaaggccctcatggcccggctcccccacgagagcacggtgtatctgggggacaccgcgcgggtgccctacggcaccaagtccggcgaggtggtgacgcgctactcgctgaagaacgcggagtttctcctggagcgcggcatcaagctgctggtggtggcgtgcaacaccgcttcggccgtggcgctgcccgcgctggaggcggcgctgccagtgccggtggtgggcgtcatcctccccggcgcgcgggcggcgttggcgcgcacgcaggggggcggggtgggtatcatcggcacacccggcaccatccgctcgggggcctaccagcgtgcccttgagtccgcggacccgcgggtgcgggcgaaggcccgcgcctgtccgctcttcgtgccgctggcggaagaggggtggaccacaggcgacgtgcccctgctggtggcgcgcgactacctggccgagttcacccgcgacggcgtggacaccctggtgctgggctgcacgcactacccgctgctcaagggcgtcatcgcggaggtggtggggccccaggtggcgctggtggactcggcggaggccaccgcggacgccgtggccgcgctgctgtcggagcgggatggactggcgccggcgtcgcgaggcacgccggagcacgcgtactacgtcaccgacgtgccggagcgcttcatggaggtgggggcccgtttcctgggccggcccatcaccgcggcggagcaggtggacctgaccttctga

SEQ ID NO: 2613 - DNA, 567 bp, Myxococcus xanthus
atgacgaaaaccttcgaaaaagccgtcaccggcttcaatcacaacatcaagcacaaggggaaggtctaccacgtccagactgaggactcgggcgtcaacaacccccacatcatcacccacctgttcgtgggcgggaacatcctcgcgtcgaagaagacgtcctacgcggacatcctcaacgcggagaacctcgcggaggtcgtgcgtgagttgatggaggagcagcacaaggagatgctgcgcaacctcatcaacggggtgtacgacagctacgagtccaccgcgcgcagctaccagcccggtcagctcgcggcggacacagacccggcgcaggtgaagctgcagcccggccagtccatggtgcagcggccgcctccgcctcctcctcccgtggcagtccccgcgcctgtggtggttcctccggaggtcgccgcggcgcgcgccctcaaggagaagccgaagatcaacgagattggcgtggagacgctcttcggcgaggacctcatctccgagaagagcctcgacgaggtcatcctcagttacctggcgggtgagggcgagcagtag

SEQ ID NO: 2614 - DNA, 1616 bp, Myxococcus xanthus
gttggcggccttccgctcgccgccatgattcagttcttccacgtatacaaggcgtatcccggcgacccaccggtgttgtcggacatcaacctcaacgtggagaagggcgagttcgtgttcctcacgggcccttcgggcgcggggaagacgacgctgctgaagctcatcttctgcgcggagaaggccaccaaggggcagattctcgtgggcggccgcaacatcgcccgcatccgtgagtccgcggtgccgtacctgcggcgcaatatcggggtggtgttccaggacttcaagctgctgccgcaccggacggtggaggacaacgtgtccttcacgctggacgtgctgggtgtgccccgcgcggaggcgcgcgagaaggtgcggcgcatgctcaagctggtggggctggagcacaaggcgggctcgttcccgctgcgcttgtcgggtggagagcagcagcgcgtcgtcatcgcgcgggcgctcgtcaatgaccccaccatcctcctggcggacgagcccaccggcaacctggacccggcgctcaccgtcgaaatcatggacctgctcacgcaggtcaacgtgcgcggcaccacggtaatggtggccacgcacgacgcgacgctgctgtcgcgttaccagaagcgcaccgtgcgcctggagcgcgggcagattgtgtccgacgaggacggcgtcaaggcggcgcgccggatggtggtatgagcgcgctgtcgaaggtgacgtacttctgccgctcggcggcggtggggctgaagcattcgcccttcgtgcacttcatcgcggtgacgaccatcgccatcgccttgttctccgcgggcatggcccggggcgcggcgcgggtgctggacaacctcctggcgtcgctcggcggcgaggtggaggtgacggtgtatctgtcgccggagctggacgcggacgaggtccacggggtgcgtgccctcgtgctggcgctcagcggcggtgaggtgacgctggtgtcgccggacgccgcgctctcacggctgcgcacggagctgggcgacctgggcgaggcgctggcggaactgccagagaacccgctgccggtgtcgctggagctgcgcgtgccgccggagcggcgcaacccggacgcgctcctggcgttggcgaaggcgctgcgagcggcgcctggcgtggccggcgtggactatggcgaggcggcggtgcagcggctgtccgccatcgcccgggcgctgcgcttcggttcgctggtggccttcgcggtggtgctgggcgccaccgtggtcatcgtggcggcgacgctgcagttggccatctattcgcggcgcggcgagattgaaatccagaagctggtgggcgccacggaccgcttcgtcaaggcgcccttcctgctggagggactgctccagggcgtgttgggcgcggcggtggcgctcttcgggctctgggccttcggccgggtgctcgggcccacgttgggcgcgctcttcgcctttctgttggggcccggcgtcgcggcgccgtgggtggagccccggctggcgctggagctgctgtgcgctggctgcggcctgggactgggcggcagcttcgtcgccgtggggcgcttcctccgcgtatga

SEQ ID NO: 2615 - DNA, 882 bp, Myxococcus xanthus
atgatgtccacccgctcctacatccttccgcgcgcctgccgcgcgggcttcctcgccgcggcggcgctggtgctggccgtcgcggtgccagccttcgccatgccaggtgccgggaagacgccccgggccatcctggaggcacagcaggacctgccgccccccatccagggtgtggacgtgcaggagcatctgggggagctggtgcccatggacacccgcttcctcgacgcctccgggcgcgaggtgcgcctgggcgacgtggtgccgaaggcgcggcccaccctgctgacgctcgtctattacaactgtcccatgctctgtaacctggtgctcaacgcccaggtgcagtccatgaaggagctcgggctcgagctgggcaaggactacgaagccgttaccgtcagcatcgaccctgacgacacgcccgcccagagcatggagcggcggcgacggcacctgcagtccatgggcaagccggagacggccccctggcacttcctgaccggcacggacgcggaaatccgccggctcgccgacgccctgggcttcaagtacacctacgacgagagcacgaagcagtacgcccacgcagccgtggtgcacgtgctcacgccggaaggcagcatctcccggtatctctacgggacgacgtttcccccctcggacatgaagctggcgttgctggaggcggccaatggccgcgtgggtaccagcttcgatcagatcatcctgtcctgcttcaagtatgacaccgccagtcggcggtatggcttctacatcttcgggttcatccgcctgggcggcatagccgtgttctgcgccctggcgacgatgctgatctacttctggaggcgcgagctgaagaaaggcgcggcggcatga

SEQ ID NO: 2616 - DNA, 1131 bp, Myxococcus xanthus
atgagccggcgcctcctcctcctggcactggggctgtgggcctcgacggcgacggcggctcaggcgacggcggccgaggaggccgaacaggccgcggtgcgtgagcggctgagcgcgcagcgcgcgacgctggcgctggtggaggcgaagaagctctccgtgctggagggcgtggagctgatgcaggagatggccgccttctcccgccggcgcgtgcgctcgctggaaggggacctggcggtgttccgccggcgcgtgctgctggcggagcgcgagcaggccgtgctggccgaggcgctgaagctgcaactgcgccggctgtctccgcgcctgcgcacgttgtaccgcctgatgcgccgccgcccgctggaggtgctgctgtcggccgaggacttcgccgcgctggtgtggcgcgcccgggcgctggaggccagcatgtccggcgacctggagctgctgcgcaccgtgcagcgtgttgcgcggctgcagcgtcaggcgacgcgcgagctggagcggctccaggcgtccctcgccgcgcgcatggccttcctccaggagcaggagcggctcgcccgcatgcagcaggaagggctggaggaggtggtaggcacgctcgcgggcgaggcggagctggcccggcgcgcggtgcgcgagctggagcaggccgacgcggagctgacgcgcatggtgcaggacctgaaggagctgcccgcgacgagtggcttcggcgcgcttcgaggcaggctcccccggcccgtgtcaggcatcgtcgaggtgggcttcggcaaggtcgtcaacccgcgcttcaacactgtcaccgtccagaagggcctggacatccgcgccgccgcgggcacgccggtgcgggccgtggccgagggcaccgtcgcctacgccggcgccctccgcggctacggcaacctgctcatcctggaccacggcgacggctaccacaccctcatggctcacctgtcctccattacccccgagctgggcggcgtggtgctccccggagatgtggtgggcgaggtgggggacactggctccctcaagggggcctacctgtacttcgaggtgcgcaaaggcgggcaggcggtcgaccccgccctgtggctggttcccgggtcctga

SEQ ID NO: 2617 - DNA, 861 bp, Myxococcus xanthus
atggacctgatgggcggaatgcaaaaggcgctgcggcacatgctggtggcgcgtggtgtcgagtccacgacagtgcaggtcggtgcccagacggtgcaccactacgcgttgacggggcagggcaaggggccacccgtggtgctggtgcacgggctgggcggctcagcgaacggctttggacgcacgctcttcgggatggcgaagcgcttctcgcgcgtgtacgccccggacctgccgggacacggattctccgtggagtactgcggcggcgaggtctgcgtgcgcaaccagttcgacgtgctgcgcgcctatgtggaagaggtggtgaaggcgccggccttcgtggtgggcaactcgctggggggcgccatggcggtgaacctggcagcggagtaccccgaatgggtccgcgcgctggcgctggtggctcccgcgggtgcgcagttgccggaggcggagaacaccgcgctgctcaactcgttcgtcgtgaagtcccccgcggaggcgcgtgccttcacgcggcggttgttccaccgtccgcccctgcccgcgctgctgttcgcctacgagctgcggcacttctacgacacacccaccgtgcgggcgctgaccgcggaggcgctggccacgcgcgcctgcctggagccggagcaggtgcgcaacctggccatgccgctgctgttcctgtggggcggcagtgagcggctgctaccgtcggagacgctgaagtggtaccgcgcccacctgcctgcccatgcgcaggtgcgcgtggtggatggcttcgggcacgtgccgcaattggagcgtccggacgagctggtgtcgcacctggtgcgtttcgccgactcggcggagctgtga

SEQ ID NO: 2618 - DNA, 1236 bp, Myxococcus xanthus
acgtaccggcagctggaggtgttcgcgcgggtgctctcctacgtggagaacaactacgtggagtcgccggaccgccagcggctcatgtacggggccatccagggcatgttggagacgttggatccgcacacggtgttcctcccgcccgacgtgtaccgggagatgaaaatcgacacctcgggcgagtggggcggcctgggcatcgaaatcgcgcgcaagggcgagcgcattgtcgtggtggcgcccatcgacgacacgcccgcggcgcgcgcgggcatcaaggccggcgatgagctggtcggcatcgacggtgagcggaccgagggcatggatgtggggcgtgcgctgcagaagatgcgcggcccggccggcgggcgcgtgctgctgaccatcatgcgcgagggcttcagcgcgccgcgcgaaatcgccatcatccgggaccacatccgcatcgtgtccgtggagggcgcgctgcatggtggcatcggccatgtgaaggtgaagaacttccaggaccgcaccgacctgtacctccgcaaggagctggaccggctgcgcgcgctcaacggtggcaaggagctgcgcgggctggtgctggacttgcgcaacaacccgggcgggctgctggaccaggcggtggcggtgagcgaccggttcctgccgggcaacctgcccatcgtctccacgcgggggcgggatggccgaagcgccaccgtggagcgcagcaaggaccgcgacacggagaaggactaccccgtcgtagtgctggtcaacgcgggcagcgcctccgcgtccgaaatcgtggcgggcgcgctccaggaccatggccgcgcgaccatcctgggcgcgcccaccttcggcaagggcagtgtccagacggtcatcgagttggaggatggctccgggctgaagctgaccatcgcgcgctactacacgcccaagggccgcagcatccaggagcgcggcatcaccccggacttcctcgtccccgacgagccaggaggcaaggtgccgcgcgacgtggtgcgggagaaggacttgcggcgccacttccgcgccgagccgacggcggcgaccgagccggccgcgccggagcctcgagggctgccggagaatctcaagccctgggacgtcaccgcgaaactggaagactatgccttgagggtcgccctggactatctccacggaatggcatccgctcccgcgcgcactccatcccgggcagcgggtcgttga

SEQ ID NO: 2619 - DNA, 1485 bp, Myxococcus xanthus
atgaaggcgggccaacgcgcctacgacgagctcgacaccgagaaggcgctcgagcacttcgacaaggcggtgcgcggttacgagggcgccgacctctcccagcgcttcaccgagctgagccgcgcgcgggtgatgaaggccgcatcgcaggtggccaacggtgagaacaccgccgcgcagttggagattcgcaccgcgctggcgctgaacccggaggcgcgcttctcgcccaacttcttcccaccggaggagatgaccttcgtggagaaggagcgcaaggcggtgctcaccggcaccaagtccagcctgcgcgtgagtaccgagccggtaccggcccaggtgttcgtggacggccagttccggggcatctcgccggtggacgtcgccgacctcacggccgcggaccactacgtgacggtggtggcgccgggctacgcgctgacgcagcgccgggagcgcgacggcgaggtcagcctgacgttggcccccgtggcggcgcagaagggcctgcagacgttcaccgagcaggcggcgcgcaagccggagagcccggagcgcgacgcggccctgcgtgagctgggaacgctcgcgggcctgtcccaggtgctggcgctcctggtgctccgggtggcagggaccgcgccgctggaggtgacagccctgcgcctggacgtgtcggatggccacaaccaggccttcgcgctgggaacggtgccgcgcggggaggggctggtggatggttcgcaggcgctgctggcgcagttggtgtcggcggatgcgccgcgccagggcggaaagccggtgacgcacttcgcgggtggcgtcagcaacacgcgccgcaccgtgggctacgtgctgatggccaccggcgtggcgctgctggccggcggcgtctacttcggcatggaggcctccgcgaagtcggatgacttcaagcgcgcggcgcagaacagcagccgcgcccaggacctcaagagcacgggcaagtcgtacgcgctggtggccgacgtcggcatcctcctgggcctcgcgtcggcgggcgcgggcggctacctggccttcgccaacggcggcggcggtggttcgaagtcgacctcccgcgcgagccgccccgcgccgtcgcccgtccccgcggccgcgccgcaggacacgcctcccgcaccgaaggaggcccccgccgcggagaaggagccgttgcccatgcctccgccccccgcgcagacggcgcttgcctcgaagcagaaggagcccagcacgtccaacaagcgcgcgcaggaggacgaggcgcgccagcgcgaggaagagctccgcaagcgccgtgaagaggtggagcgccagcgcaaggagctggaggagcggcgcaagcaggaggaggccgcggcgcagcgcgagcaggaagagcggcgtcggcaggaggagcggcggcgagaggaagagaagaagaagcggcccgcactcgacgatgacgatctccggaactactag

SEQ ID NO: 2620 - DNA, 321 bp, Myxococcus xanthus
atggccctgagcaccgggctgtccgcgtgcagcctcctcgtcgacttcgacgaggaagggcagccctgcgatgagctcaaccagtgtctggagggctacacctgcgtcgacaacgcgtgtgcccccgacgacggcgcgccgtccgatggcggctccgatgcgggcaccgatggtggcctgaacaccgacggtggcctgaccacggattcgggaacccttgacccggacgcgggctcggaagagctggacgccgggctcccggacgacgcgggcaccaccgaaccggggcccgtcctggagccggagttcccggccagctga

SEQ ID NO: 2621 - DNA, 170 bp, Myxococcus xanthus
atgggcaagcgcgtgggagtgctgatgggcgggtggggcgaggagcgggagatttcgctcaagacgggagaggccgtggtggcggcgctcgagtcccggggccatcaggtgacccgcatcttcgcggggccgggcctggaccgggcacttcgcgccggccgaactggacg

SEQ ID NO: 2622 - DNA, 201 bp, Myxococcus xanthus
atgtcgatgaaatcctgctgcgctgtcctcgttgccgccctcttcctgggcgcatgtgtcgcgacgaagccctccgtgacgtactcgtcgttcggcgaggcacggctcgccaaggatgcggcggtggtccagcgctatgaggcggactatgatcggcgccaccccagcttcccgtcgatgacgggaaaccagtttcaaatt

SEQ ID NO: 2623 - DNA, 1230 bp, Myxococcus xanthus
atcgaaatctccggcgccaacttccgcccactgcccgtggcggtgcccgcgcccctgacgcagaacgacggcgcgaaggcgttggtggcgcccttcgattcggccttcagcttcgacctgaccgcctccggcatcctccaggtgctggaccgcaagggcttcacggcggacgcgaaggaaggcatggccgcggccagcatcaacttcagccgctgggcggacgtgggcgccgaagcgctcgtgaaggtgtcgctggcgcaggacggcggcgtgctgcgcggggagctgcgcctgttcaacgtgggcaccggccgcgaggacctgaaggtgtccaaggacgcgcccgccgacaacgcctcgctgctggcgcaccgcctggcggacgcgctctaccggcacttcactcgcgagcccagccccttcctgtcccgcatcacctacgtgcgcaaggcgggcaccaaccgcgacgtgtacgtggcggactgggacggcggcaacgcccgggcgctcaccaagggcggcatcaacatcctgcccgcgctgagccaggatggctcgcaggtcgccttcaccacgtaccgcaagaatcgcccggacatctacgtgcagtcccccggcggtgaggcgaaggccgtcatctccggtgggcagatggccaccggcgcggccttctccccggacggcaagcgcatcgcgtactcgctggcggagggcgagagcgcccaggtgtacgtggccaacgcggacggtagcggcgcgcgcgcgctcaccgacacgccctacggcctcaacaccagccccacctggtcgccggatggcaagcgcatcgccttcgtgtccaaccggggcggcagcccgcaggtctacatcatgaacgcggatggcacgggcgtgcgccggctcaccttccagggcaactacaaccagacgccggactggtcgccgcgcggagacctcatcgtcttcaccgctcgcgacgagcgcaacgccttcgacctcttcaccgtcagcgtggagacgggcaaggtgacgcgcctcacgcaggaccagggcagcaacgaggagcccgccttctctcccaacgggcggctcatcgtcttcacgtccacgcgcaatggcggctcgcagctctacgtcatgacggcggacggcaacaaccagctcccgctgcgcaccgagaagggcacgtaccagacgccggactggtcgccgctgccgcaggcgcagtag

SEQ ID NO: 2624 - DNA, 738 bp, Myxococcus xanthus
atgtcgcgcttcgtggtggtgtccgtcgtggggcacatcctggtgctggtggcggcgattgcgtacgcgcgcttctccgccacgcccaaggtggacctggacaccaagcccattcgcgccacgctggtgcgcctgggcaagccgcgcgactccaagctgctgccgcgcaaggagcagttgccaccgccgcccaagaaggtggacgcgcccaagcccgctccggaggccccgcccccggagccctcccccgccaaggtggcggtgcccatcccgggtgtgcagccggagccctccacatccaagcccacgccgcagaagggcgagacgacgggcgaggatcggcgcaagcggctcttcggtgccttcgacaagacggccaaggcggcggagcccgaggaggcggagggcgccgaggacggcgacccagacggagactcggccaccgcggaaggcgagcgctacttcggcctgctccagtcgcaggtccgccgccactacagcgtggcggacaccatacccgaatccgagcggctgcacctcaaggccatggtggcggtgcgcctgagccgcacgggtgaagtgctggacgtgagtctcaccaaggccagtgggaacgacctcttcgactcggccgtcgtcacggacgtgcgcaaggccgcgcccttttctcctccaccggaccatctccggaacgccctgcagaagagcggcgtcaacctggtgttcaacgccctatga

SEQ ID NO: 2625 - DNA, 468 bp, Myxococcus xanthus
atgggaatgggcggaggcaaccgcggcggtggccgcaccaccatgagcgaaatcaacgtcacgcccatggtggacgtgatgttggtgctgctcatcatcttcatggtgacggcgcccctcatccagcagggcgtgaaggtgaacctgccggagaccaaggccgcgccggtggaggccacggagaagaaactggtcctctccatcgacgcggggcgcaaggtctacatcggtgacgcggaagtggcgctggaggagctggagcagaagctcgccgccaacgccaaggcgcaggccgacaaggaagtctatctccacgcggaccgggacgtgccgtacggggtggtggtggaggtcatggccgcggcccagcgcgcgggcattggcaacgtgggcatgatcacggacccgtcgaccgcgggtcggacgtccaacaccggcaaaggcaagtcgaaggaagcgaagcgctag

SEQ ID NO: 2626 - DNA, 1047 bp, Myxococcus xanthus
atgagcgagcttctcaacaatatcctgttcctcccggaggccgcgtccacgttcgcggaacgcatcgactcgctgcatcacttcgtcgtgggtacgacgatggtgatgtcgacggcggtcggtctggcggccctgttcttcttcttccgttaccgccgccgcctcccggcgcaggcgacggagtacatcgtccccaccctgaagacggagttcctcttcgtctccgttcccctcgtgttcttcctggcctggttcggtatcgggttccgggacttcacgtgggtcaccacgccgcccaaggactcgatggatgtctacgtcatgggcaagcagtggatgtggaagttctcctacccggagggccccaacggggtgaacgtgctgcacgtaccggtaaaccgtccggtgcgtctgctcatcacctcgcgtgacgtgctgcactccttctacgtgccggccttccgcatcaagatggatgcgctcccgggccgctacacgcagatctggttcgaggcgaccaagccgggcacgtaccaggtgctgtgcaccgagtactgcggcctgtcgcactcgaagatgctggccgaggtcgtcgtgctcccgcaggaggagtacgagaactggatccaggagcagcgccgcggccgtctgcaggaccgtcaggacgcgctggcggacaactccctggtgccgccggtggcgcgcatggtggagcagggccaggtgctcgcgggcacccagggctgcctcaagtgccactcggtggacggctcgcagcacatcggcccgaccttcctgggcatgtacgaccgcgtggagaagctcgatgacgggcagaccatccgcgtggacgaggcctatatcacccagtcgatgatggacccgggcgcccacctggtggcgggctaccagaacgtgatgccgacctaccagggcaagctgcagggcccggagacggccgccatcgtcgagtacatcaagtcgcttcgcactccgaacgtccgtgagggcgcctccgagggacccgcctatgacgccatccagtag

SEQ ID NO: 2627 - DNA, 711 bp, Myxococcus xanthus
atgacgccccacctgcccctggcgcttggcgccatgaactacgtggagatcatccgcgacgcctccctcatcgagctggcagtcctactgctcctgatgggcgtatccgtggcctcctgggccctcatcgccatgaaggcgtcccagctcgccaaggctcgcgcacagtctctcaccttcctcgacaccttctggaaggcctcgcgcctggaggccatctaccagacggcccagaagctcgacggctcgccgctgtcgaaggtcttctgcgccggctatgaagagctgaccaagctggcgcaagccaaggagggcggcaccgaaggcgcgctggccgagcggctgggcggcatcgagaacgtggagcgcgcgctccaccgggcctccacggcgcaaatcaccgagctggagaaccgggtgtccttcctgggcaccgtgggcgcggcgtcgcccttcgtgggcctgttcggcaccgtcatcggcatcctgagcgcgttcaatcagattgccgagcagggcaacgcgacgctggccacggtggccgcgccggtgggcaacgcgctcttcgccaccgccgcgggcctgttcgcggcgattccggcggtggtcgcctacaactcgttcgtcagccgcatcaaggtgttcgacacggagatgtcgaacttctccgcggacttcctcaacatcatcaagcgtcacttcttccggtag

SEQ ID NO: 2628 - DNA, 804 bp, Myxococcus xanthus
gcccaggtgctggcccaggggtactcgcccgccatccgcgcgatggagattgccgccatcgtctccttcgtctcactggaggtggcgctggtgtaccggctgtggggcaccccctatgctggcacgtggctgctgctcagcgcggtgctgctgggctacctcgccgcggacttcgtctccggcttcgtccactggatgggcgacacgtggggctccacggagatgccggtgctgggcaaggcgctcatccgccccttccgcgagcaccacgtggacgagaaggccatcacccgccacgacttcgtggagaccaacggcaacaactgcctcatctccctgccggtggccatcatcgccctgtgcctgcccatgagcggcccgggctgggtgttctgcgcgtcctttctaggcgcgatgattttctgggtgatggcgaccaaccagttccacaagtggtcgcacatggactcgccgcccgcgctcgtcggcttcctccagcgcgtgcacctcatcctgccccccgaccaccaccgcattcaccacaccaagccgtacaacaagtactactgcatcaccgtgggctggatgaacaagccgctgacgatggtccacttcttccccaccgccgagcggctcatcacctgggccacgggcctgctgccgcgccaggacgacatcggcgcggaggcggcgcgcgcgctggtggtcgccgcgggtggcagcgaggccccggtggtccaggcggccaaggagctgctcacccaggccaccgtgcaggagaagcccgcctccacgcgcccgtag

SEQ ID NO: 2629 - DNA, 648 bp, Myxococcus xanthus
ttcatcgtgaaaggtgactccgcaggcggctccgccaagcagggccgggacaggcgcacccaggccatcctcccgctgcgcggcaaggtgctcaacgcggagcaggcgtccaccgacaaggtgacgacgaacaaggagctccaggacatcgtgtccgcgctgggctgcggcatcggctccgacttcgacatcagcaagctgcgctacggccgcgtcttcctgctgatggacgccgacagcgacggccaccacatcgccacgctgctgctcaccttcttctaccggcacctgcgcccgctgattgagagcggcgccatccacatcgcccagccgccgctgtaccgcgtggacatcggcaaggagacgtactgggcgctggatgagccggaccgcgaccgcatcatcaaggagaagacgaagggcaacgccaagcccaacatcatgcgcttcaagggactgggcgagatgacgcccgacgagctgaaggagacgacgctcgacccgaagcaccgcatgagcctgcgcgtcaccatcgacaagcccctggagacggaccggctcatcaacgacttgatgggcaaggacgtcagcgcccgcttcaggttcatcatggagcgcgccagcgaggtccaggacctggacgtctag

SEQ ID NO: 2630 - DNA, 1428 bp, Myxococcus xanthus
atgctggccacctctcccgcctatgggcagtccacgcggaagaagaagtccagcaagaagccccccgccaccactcagccggtgaagacgaccaaggcgcccgcggcggacgacgcggatggcgatgaatccgtcgagccccaggctttcggttctccgaacggggacgaggagacggccgtcacgccgctggtgtcgccggacgctccgaccgtggccaaacccgcggcggcgccaggtgcctcgggtgagccggcggtggccagcgcggcggtgacggcctccgggccggtggcgctcttcgcggtggctcggacgtccgcggaggaggatgccgcggtgaagctggaggacgagctgctgagccggctcaaggcgagcggcgtggcgctggtggacctgggcgcggccttcccgccgtccccgccggtctcgctgacgcgcgcggacacgctcttcgagcagggtcgcaccgactacgacaacctggaccccgagtccgccgaggcgaagttcctggcggcggcggaggcctacacgaagcacccggcggagctgagcccggagcggctggccaaggcctacctgttcctgggcgcctcgcggatgctcaacggcgactccaccggagccctggacgcgttcaagcgcgcggtggtggcggagccgtccacgtcccccgacgccgccctcttcgggcaggacgtgctgaagaccttcgaccaggcccgcgccgacgtgaaggcgcgcccggccggcacgctggtggtggagtcgaagccggcgggcgccagcgtcctcgtgcgaggccaggagctgggcgtcacgcccctcaagggcgtggagatgccggcgggccagcacccggtggtggtgtccctgcccggctactcggccttctcccagtacacagaggtggcgtccgccaagagcaccgaggtgaaggcgacgctggagcccaccccgggcctgtccgccgtgcgtgacgcggcggtccacgccagcacggaacaggccttcgagcgggacacgccgccgcccgaggcacgcgccattggggagcggctcaacgcccgttacgtggtgctggcggcggtggctcgcggggacaagggccacctccaggccgagctccaggcgtgggacctgcgctccaacgcgcggctgcgcggcgtggagattgccctggcgccgggcgcgaagaagaacggcccggacgcggcggcggaccaggtgcgcgccttcgtcaacggcgtcgcggcgccccgcgtggcggagagcaattcgttctccaccctcatcaagcgcccgtggttctgggcggtggtcggcggcgcggcggcggtgacggccggggccgtctacgtggcgacgtctcaggacaagggccgcccgttcaaccccgtttctggtggagtcgggttctga

SEQ ID NO: 2631 - DNA, 1113 bp, Myxococcus xanthus
atggacccggcctccgaggcgtccagcgtgcagatggagggttacatgaacgacgccctctccaacttcgccggcatgacggtccgcaagtcggaggagctgttcggcatgccggaggacccggaggccaaggcctccctggagcgcgggcgcaaggggtactcggagagcctctccgccttcgacaagaaggaatacgaggaggcggagcgcaaggtgcgcgccaccctgaaggagcttcagggggccgcgggcgccatgcgcgggtgctcgccgctgtgtgacgcgctggcgctgtacgccgccgtgctgcacctgcgcggcgaggtggaggaggcgaagctggcgctcatcgacctcatcgcgctgtcccctacccatgagctgtcccccaagcgcttctcgcgcgagttcctcgccctgcgcgtgcaggtggccaccagccgcacgtcccagctacgcggctccgccacggtgaactcgcggccctcgggcgcgcgcgtgtacgtggacggcgaagtcgtgggctacacgccagtgacgctgcccgcgctgcccattggcaagcacctgctgcgcgtggagcgcccgggcttccggcagtacggacagttcatggaggtggccaccgacgacgccgaggtcaccgccaagctggtgcctacctctgcgtacaaggccttcgacgtgcagttggaccgggtggcgggcgaggtgaaccgcgccggtgagaaggcgtctggcgtggcggccatggcgcagtcgctggggctggaccgggtcatggtgggcacccttcgcgccaatggcgagggcaccgacctgacgctgggctactacgacgcgcgcaccggtcagcggctggcggggcggcgcatggccgtccagggcgatgagttcggccagttgaagcaggagatggagcgggtggtgaaccacctggtgaacaacatcggcgagaaggtgaccaagagccgggacccgctggacaaccgcgggggcatggaagactggtcgtccgaggaccggggcggccgtggcaaggcgcaggacaagaagagcaagcccggcgacgacccgctcgacggtgtgtccggaaccgaggactggtaa

SEQ ID NO: 2632 - DNA, 2358 bp, Myxococcus xanthus
atgaagccaccgccctgtcgctgcaaccccgcgggcctgggcttcgtcaacggcagtcagctcttctacctgcacgagcgcaacctcgtgcatgacggactgggagacggcgtcttcctggccacgcgcctgctcggcctgggcctgggcggcgccatggagtggattcgcggacgggcggagccggactaccgccgcacgtccctgggtctctccctgggcacgcgcacgctgcagctcggcggttcgtggcacgcctacggttcatcccaccgggacatcgacgcgctggacaccttcgacgtgggcctcacggcgcgccccatgcgggcgctgtcgctgggcgcggtggtgcgcgacatcaacgcccccaccgagggcacgctggcactgaagcggcagtacaacctgggcgtgggcgtgcgcccgctggatgagcgctacacgctgggcgtggactggctcttctccgagggcgccttccgccagggccaggcgacgtacaccgtcaacgcggaggtgattccgggcctccgcctgggcgcgggcgtgtcgcacggcttcacctccggggtgcccatcgcgctccaggtggcggccacggtggacacctcgcacctgggcctcacctacgcggcgggcgggacgaatgcggggctggaccacctggtggcggtgcgcctgtcgtcggagacctaccgctccatcgcgccgcgcggcggcgtggtgacgctgctggacttgaatgacgcattgagcggcggcaccagccccgtcctctcatggttgggcgtcaccgaggcggacccgtacctgcggctgacgcggtggctggacctggccacccaggacgaccggctggccggcgtggtggtgaagatggagagcctgcccggggtgagctggggcaaggcggaggagctgcgtcaggcgctgctgcggctgcgcgcgtccggcaagcgggtgatggcggtggtgctgtccacggacgacctgggctacttcgttgcctcggcggcggaccgcatctacgcgctgcaggagtcgattctctacatcaacggcctggccgtgcacctccagacgtacggcgggacgatggagaagctgggcgtgcactgggacgtggcgcgcgtgggccgcttcaagacggccccggagcagctttcccgcaccgagcccagcgacgcgtccttggagtccacgaacgcctacctggacacggaggtggccgtctacgagaaagccgtgcaggagggccgcaaggtgcccgtggagcggctgcacgcgctgtgggcactgggcctgccccatccgaagcgcgcggtggagctggggttgatggacggcatcatctcctcgacggagctggacaagaaggtggcggagctggtgccgggtggacgcttcagcaccacgtacgcgccgcgcgacgagcgcgacggccgctgggcccgccggcgccgcatcgccgtggtgccggtgctgggcgacatcatcggcggccgcagccgcgaggacccgctgggcttcagccgcctcgcgggcgcggagacagtcattcgcgcgctggagcaggcgcagtcggacccgagcgtggcggccatcgtcgtgcgcgtggactcgggcggcggcgaggtgctggcgtcccacctgatgtacgaagccgtgatggaggcggccaaacacaagcccgtcgtcgcctccatgggagacatggccgcgtccggtggctactacgccgccattggcgcgcacgaggtgttcgccctgcccaccacgctgacgggcagcatcggcgtcttctacatcaagcccgccgtcgagggcctgctgagcgggctgttgggcgtgcaccaggagagcctgacccgcgcgccgctggcggacatcctggacgtgtggcgcccctggacgccggaggagcaggaggcggcccaggcgtgggcggacgcctcctacgacagcttcatcaccgaggtggcgctgcggcggaggatggacaaggcgaaggtggacgaggtcgcccggggccgggtgtggagcggccaggacgcgctcgcccgcggactggtggacaagctgggtggcctgctggaagcggtggactccgcgcggatgcgggccggaatccctccggacgaggagctggacctggtggtgatgggcgaggcgcggggcttcttctccgcgctgggcggtgagcccggggtgcgcgccgcgctgtccctgctgcccgcacaagagcccgccctgcctgagtccctgcgggcgctggcccgctcggccggcctgaatctgatgttgctccagccgggcgtgaaggcgatgttgcccttccagataaccgtccgctga

SEQ ID NO: 2633 - DNA, 1294 bp, Myxococcus xanthus
atgcagcctggagcggacggccagcaggtccaggtgttcctcacgccgcaggagctggagcagtaccgccagcgacaggcgcagcaacaacagcaacagcagcaaccaccgcagccggcgcacggcggcgggggccagcagcacgcccgccacgcgcagcacgggggcggcggccagcaggcctcgcagcaggcgaacctgtcgccggtggagggcgtgctggacacggaggccaagggccccaacgccttcctgcgccagctcaagcgcaacctgctggcggcgccggatgacccggagctgccgaagaatctggtccagaagctgcgcctgcggcagggccagtacatcaccgctttcgcgcagatgcggggccacaagggcgtcatccagaaggtggacacggtggacggccggccgctcgagggcgcgccgcggctgccgcacttcgcggacctgacgtcggtggaccccaccgagcggctcaagctggagaacggtcacaaggagatggtgacccgggtgctggacctcatctcgcccattggcaagggccagcgcgcgctcatcgtcgccccgcccaagacgggcaagacgatcatgctccagcgcatcgcccaggccatcctctccaaccacccagagtgccacgtcatggtggtgctcatcgacgagcgtccagaagaagtgacggacatgcggcggggcatcaaggcggaggtcctggcctccagctccgacccgccccaccgcggaccacctcaaggtggcggagctggccctggagcgcgcgcgccggctggtggagtccggcaaggacgtggtcgtcctcctggactcgattaagcgtctggcccgcgccttcaacaaggaggtcgacaactccggccgcaccatgaccggcggcgtggacagccgcgccctggagcgccccaagcgcctcttcggcgccgcccgcgcgacggaggaggccggcacgctgaccatcatcggcacggcgctcatcgacaccggcagccgcatggacgaggtcatcttcgaggagttcaagggaacgggtaactccgaggtcaccctggaccggctcctggcggagaagcgcgtcttcccggccgtcaacatcgcccagtccggcacgcgcaaggaggagaagctcttcaccctgcgcgagtacgagaaggtgaagaagctgcggcagatgctcttctccgtgaagccggtggaggccatggaggcgctcgtgaagcggctgtcccgctacacgtacaacgacgagttcctcgacgagctgtag

SEQ ID NO: 2634 - DNA, 270 bp, Myxococcus xanthus
atgattcaaggctcgggccgctgccactaccacccggagcgcgccggcctcggcgtctgcgtggagtgccggcgtgtcatctgccgggaatgcaccacgcagttcgagggcatcaaccgctgcgccagttgcctggaccagcgcctcaaggcgctggagggcccgggtgagcgccgcgagtggtcggcgggcaacgtggtgctggcgctgatgagcctggcgctcgtctttggcggcatcctcctgctggcccaagtggcggcgagctag

SEQ ID NO: 2635 - DNA, 1860 bp, Myxococcus xanthus
atggacgccgcgctgcgcctgtgtacccgcaacgcgggcgtctgggccctcaccctgcccggcggcgcggccgtggtagccgccatgttgtacctggcggagtcggtgcgcatgggctggccgctcgtggtgccttcgctgctgctgacgctggcgtggttcctccggggcctgggccagggcgcgacgtgccattacgtgcaggagctgctgctgggcacccagggcgagccttccgcgtgggcttcgctcaaggccgcgctggcccggatgcccgcgctcttcatcgccgtggcgtacctgctgggcctcaacaccctggtggtgatggtgacgggaggcttcggctacatcctgctgcagtcccacggggtgggctacgcggcggtgatgcaggggcgaggcagcccgctgaagctctacggcacgtgctcacggctgctgggacccgcgcgcggcaccgcgctgtgggtccgcgccctcatgtccgtgcaggtgctggccttcttcaaccttcacatcgccttcaacttcctgctgttcctgggccgcaagctggtgggcgtggacctgacgttcgcggagcgcttcgcctcgctggacaacggccagtggctgatcttcctcgcggtgacgacgttcgccctcttcgagccggtgcgcgccgcgacggccacgctgctgctggtggacgggcgcgtgcgtcaggaagggctcgacctgctggccagcgtccagcagcttccgtcccgggatttggggcgccccctgcctccgccgggagcggcgcgtggcgcggcgatgctggcggtggtgttgggcctgggcctgctgacggcggcgccggcccatgcccaggacaccgaggacgcgaagcccctggccccctccgaggcgctgcggcggctgggcgaggtcgcggaggcgtgtgaggcctcggcggatgaggacgccgcggacctgtacgcgcccctggagtccctggggcccggcgaagccgtgaagctggaccgcttcgtccgccgcgtggagcggcaggccttcgacgaggaggactgcgacaaggcccgcgccacgctgacgcaggggctcaccacgatgggcgccaccgtggacgcccaggcccgggcggatgcacgtgccgccaccgcgcgggcgaaggacatcctggcccggcccgagttcgcggaagccgcgcccaaggcggagaaggacgcccccgagcccgcggccccacccgagacgccaggctggtggcagcgcttcatcgactggctgggggagcagctgaagaaactgttcgagcgggagccggcggagtccagacagcagactgcgcagcccatcctaagcggcatgaatgtggccaacgtgctggtggtggtgctggtgacactcaccctcgcggtgctgggcatggtgctgctgcgggcgctgaaccgcgacaagcgccgcacggatgccgcgggagtgcaggtgtccacggtggacgcgtccacgctggcgggggatgcccaccacgcgctgtcacgccctcccgagggctgggcccacctggcggacgaactggcggcgcggggggcctaccgcgaagcggtgcgcagcctctacctggcgctgctgtcccggctccaccgcgacggcgccatcctctatgacgagacgctgagcaactgggactacctatctcaattccggggccgcgcggaatggaaggcccccttccgagagctgacgcggcgcttcgacttcgcctggtacggcaacctgccggtgggcgtggacggctaccgcgagttccgcgcactcaccgagcccctgctggccgcgccgtcacgcccggaggtggccggtgcgtga

SEQ ID NO: 2636 - DNA, 1530 bp, Myxococcus xanthus
atgttcctgttctgggtcctgctgttcttcctcgtgggcggcatcttcgcgctgctcatccgggtggagctgctgacgccgggcccgaccatcatggacgcgatgacgtacaaccgtacgttcacgctccatggcctggtcatgatcttcctgttcatgattccggccatccccgccgtcttcggcaacttcatgttgccgctgatgctgggtgccaaggacgtggccttcccccggctgaacctgctgtcgctctacatctacctggccggcgcggtgctcgcgctgtggggcatgctcaacggcggcctggacacgggctggacgttctacaccccgtacagcgcgcacacgacgaccacggtggcgccggtgctgttcggtgcgttcatcatcgggttcagctccatcgtcacgggcatcaacttcatcgtgacgtgccacacgatgcgcgcaccgggcatcacctggttcaagatgccgctgttcgtgtgggccatctacgccaccagctgcatccaggtgctggccacgccggtcatcggcctgctgctggtcctggtgacggtggagaacctgttcgggttcggcatgttcgacccggcgcgcggcggtgacccggtgctcttccagcacctgttctggttctacagccacccggccgtgtacatcatggtgctgccgtccttcggcgtgatgagcgaggtcgtcgcgacctacagccgcaagaacatcttcggctaccgcgcggtggcgtactccagcctgggcatcgccttcgtgggtttcttcgcgtggggccaccacatgttcgtgtctggccagtccaccttcgcgggcggcctgttcggcgtgctgaccatgattgtgggcgtgttcaccgccatcaaggtcttcaactgggtgggcaccgtctacaagggcgcggtcgagttcaagacgcccttcgcctacttttgcggcttcctgttcttcaccgtgttcggtggcatgacaggcatcgcgctgggcacggtgtcgctggacgtcgcctggcacgacacctacttcgtggtggcgcacttccacttcatcatggtgggcgcgaccatcatggccttcctggccgccctccactactggttcccgaagatgttcgggcgcacgtaccacgagggttggggtctggtggccgcggcgctcatcatcctgggcttcaacgccacgttcattccccagttcctgctgggcaacaacggcatgccgcggcgctactacgagtacccggagcgcttccaggcgctgaacgtggcctccacggccggcgcgacgctgctggcgttcgggttcatcatcatcgccatgtacctgacgtacgccctgatctacggcaaggcgtccggcaagaacccgtggcgcagcaagggctacgagtggctgtccgagtctccgccgccgacccacaacttcgtggggccgcagccggagttcccggaagagccccacttctacgtggaccccaagaaggccgaggtgcccgatgcagtctag

SEQ ID NO: 2637 - DNA, 777 bp, Myxococcus xanthus
atgcgcacgctggtgccgccccagcccacgccgtacacgctgggcgtggagcgcgtggaggcgaaggtccaggcctacctggagctgccccagatggccgtccccgtcctggaggatgagcggctgggcatgttcgtggcggcggtggtgccgtacgggcagggccgcgtgctggtggtgggcgccccggagctggcgatgaaccaggccctggcgcgcgcggacaacgcgcagttctggctcagcgccctggcgtcaatcggccccggccccatcgaattcgatgagttccaccacggcttcaccaacgagcgctcggtggtggacttcgcgcgccgctacggcctgcacttcgcggtgttgcagttcctgctcggcgtggccctgtggtcggtatcgctcaagcgcttcggccgtccgcggcccccgcccgagtcctcgcgcgtgggcgccaccgacgcgctcttcgccatgggccggctctatcgcgagggccggcaccacggattctccgcccagctcatcctccggggcctcacccaggacctggccctgcatgcgggcctgcccgcgcatgcgtccgcggacgcggtgacccacggcctgcgcgagcgtggccgcgcggacctggcccaggggctcgaggagctcaccacggacagccgcgcggtgacgcgcgacacggacctccagcagctcgcagagcgcgcggcgcggctgcgacaacgccttcattccgccggcgccgcccggcccagccctcccgaaacgacatga

SEQ ID NO: 2638 - DNA, 999 bp, Myxococcus xanthus
atgaacgacaccctgtccgccccctcccccgccccggctggcaacgccgtgcaggccgctcacgccatccgcgaggccgtgctgtccgaggtgcgcaaggccgtggtcggccaggacgaggccctggagctgatgctctgtggcctcatcgccggcggccacatcctgctggaaggcgtgcccggcgtggccaagacgttgatggccaaggccctgtcgcgcagcatcggcgcggagttcaagcgcatccagttcaccccggacctgatgcccgcggacatcctgggcaccagcgtgttcgacctgaagacgcagggcttcacgctggtacgcggccccatcttcacggacctgctgctggcggacgaaatcaaccgcgccccggcgaagacgcagtccgcgctgctggaggccatgcaagagcgctcggtgtccatggagggccgcgtgctgccgctctccccgctcttcaccgtgttcgccacgcagaaccccgtggagtccgaaggcacctatccgctgcccgaggcgcagctcgaccgcttcctgctgaaaatcgaggtgggctaccccgcgccggaggaggaggacgcgattctggcctccgtgcaccggggcttcgactcgggggacctgcaacgcgcgggcgtcaatgccgcggtgacgaaggacgggctgctggccgcgcgcggcgcgctgaatgaagtgacggtggagccgccggtgctggcatacgtccgcaagctggtggcggccacgcgcgcctccagccgcattcgactgggagccgggcctcgcgcgggcgtgcacctgctgctggcggccaaggccctggcggcgctgcgcgggcgcggcttcgtcaccccggacgacgtgcgcttcctggcggcgcccgtgctgaagcaccgcctgctgctgtcgccggacgcggagctggacggggccacgccgacggacgtgctgcgcgaagtggtgcgcggcgtcgaggtcccccggtga

SEQ ID NO: 2639 - DNA, 1161 bp, Myxococcus xanthus
cggagggcccggctggaggtccaccgggtgctgccggcgcggctcaacgtgggtgtggccaacaaggtggtggtgcggctgattcaccggagcggcggcgccgtccaggtgcgcgtccgggacgacgtgccggatggcttcgccgccacgccggacgaggccccgctgcacctgcccgcgcggagcgagtcacgctgggtgtaccgggtgacgcccgtgaagcgcggccgcttccagtttggagacgtgcacgtccgcgtgcgcgggccgctggggctggtgtcccacgagcgcgtgttccccgcggcgcaggacatcgccgtgtacccggaccttcgcggcgccaaccggctgctgctgtcgggcgcggcgctggacctggtcaacctgggcctgcggcagctccggcgcgacgggcgtggcagcgaattcgcccgcctgcgcgactacgcccagggcgacagcgtgcgggacgtggactggaaggccaccgcgcggcgtgggcggccggtgacgcgcgtgctggagtcggagcgctcgcagtccatcctcatctgcgtggacgcgggccgctccatggccgcgcaggtggacggcctcaccaagttggaccacgcggtgaacgcggccctcttcctggccttcgtggccgtgcgcaacggcgaccgcgtggggctggccgtcttcgcggatggcgtgaaggcctacctgccgcccgcggccggacgcacgcagtaccggaagattgtcgacacgctctacggcaccacgcccagcctcacgtacgtggactacctggcgctcttcaaggagctgaacctccgcctcacgcgccgcagcctgctgtgtgtcttcaccgacttcctggacgaggagcaggcctccaccatggtggccccgctgcaccgcctggctcggcgccacgtccctctgtgcctgtcggtgaaggacaccgcgctccagaagctgctgcgcacaccgccccccagcccggaagaggccttccagcacgcggtggcctccgagctgctcaccgaccgcgaagtgctcaaggcgcgggtgagccagggcggcgtgcagatgctcgacgtgcagccggatgagctgagcctggccgccgtcaaccgctatctggacatcaaggcgcgcggcgtgctgtag

SEQ ID NO: 2640 - DNA, 1524 bp, Myxococcus xanthus
atggcgttcctgggatggctgctcgccctgctgtcgggatgcacgagcatgcgcgccctgtgtcccctggagggaggccgcccctgggtggaggtgcgcagtccccacttcaccgtccgcaccaacctggacacggagacggccgaggaagcggcccaggagctggagctgctccgcgaagggctgctgcaagcgtggggcggcagcttcgacccgccgggcacggtggacatcatcgtcctccacaaccgcagcgcgctggaggagttcaccaacatccgcatcgaagacttgtcccccatccccgaggatggcccgctactggtcctggccgggcacgcgtacgaggtcagcgaagccacctcggacatcaccacccaggcccacgagctgacgcactacctctccgagctcgcgctcgtccgccaaccacgctggctatccgaaggactggccagctacctggagaccatcgcgctcaggccggaacggcgcgaggtcatcctcgggcgcatccacggggccttctacaaccaggtgcagcggcatggctggcgcacgctcgacgagctctgggaatgggacagcaaggggctgctcggcaccgccgagtcgcggcagtactacgcgtcctcctggctgtgggtgcacttcttcatcagccggcacggcgtgcgcttcgaggacttccagaagcgcctcatgcagggcgaggaaccccggcaagccttcgaggccgccttccgcggcgaggaggacctggctggcgagctgaatggctacgtgcgccgccctgggcacatgaactaccgcaccatcaccgcgccgttggcgcccgtgacgagcccgctgcaaacgcgccccatgcgcgcggccgaggtccacgccatccgcgcccagttgttcctgatgacaccgggcgcgtcccccatggaggaacggctgccccacatcgaacgggagatggcggaggccacgcgcgaggagcccggcaacgtggacgccatgctgctgcgcatccgctccacggaggatccgttccgcaggctcgccgtggcgcgagagctggtggagcaccaccccgccagcggccacgcgtggaacgccatggcccaggcgctggacgccgcgggaaatacgtccgaggagcaagaggccgcgaggctccgcgcggtggcgctgctgcccggcagcgtgagcgcgcagaacggactggccggctactacgcgcgcacggcccagccggagaagggcctgacggcggcgcagcgggccctgtcgctggcgccggggaacgcgtcagtgctggacacgtggtccaccctcctgttccagctcggtcgatgcccggaggcgctggatgcccagcagctcgcggtggacatgctccacgaaggcacgccgcagcggctgcggcggaccgtgcacgacacgctggcccgctatgaggccgtgtgcgggcccgatgcccctcccgccgcggtgaccccgcccacggcggcgcctgccgtggaaacgccgtga

SEQ ID NO: 2641 - DNA, 288 bp, Myxococcus xanthus
atggggccccggctggcgctggggcagcggctgcgtgtgccggtggtgggcgtcatcggcttcgtcgacgcggggcggggggacccgaaggtggtgtgcgccgccgcgcccctgacggccgccgagcgcgcgggcctggagcgcttcttccgcgtctacgccctcttcaagcaggtgttgcaccgcgtgcgaggcaacgtcccggatacccgcttcatggggtggctgccgctgcccgtcccggcgccggacgcggccccggaggctacagcacgccgcgcgccttga

SEQ ID NO: 2642 - DNA, 1017 bp, Myxococcus xanthus
atggagatggcggagttcatcgagtcccgcaagccgcgctgggagcaactggagtcgctgctggaccggtccgaatcccacggcctgcgcgagctgagcctggaggacgccaggacgctgggccggctgtatcgtgccgtctccagtgatttgctgtgggttcgcgcgcgcagtggctcggcggacgtgaatgcctacctcaacgatttggtggggcgggcgtacgcgctgacgtacccgggccggcgcccgcgcctggcggacgtgtggggcttcgtggcgcggggcttccccgcgctgatgcggcgcgagtggcggatgtacgtggcgtcgctgctgctgctgctggcgggcatgggcttcggctacgtggggatgatggtggaccccgacgcggcgcactatctggtccccgccgagcacctgaacctggaccccgtcgaacgcgcggcagacgaggccgcgggtgacgggatgtcggtaggagaccaggcccagttcaccacctacctcttcacccacaacatccaggtggccttcctggcgttcgcgctgggaatcaccgtgggcctgggcacggccatcatgctgttcgtcaacggcctgttcctgggcgcgctcgcacaagtctatgcagccaagggaatggcgggctggttctgggcgtggattcttccgcacggcattccggaaatcaccgccatctgcatcgcgggcgccgcgggattggtgattgcgcgaggcatggtggccccgcgaggactgccccgtggacaggcggtgcgacaggaggcggtgacggcggtgcggctgctgttcggcacgctcgtcctgttcgtgctcgcgggcttcatcgagggcacggtgtcccagattcatccgcccaagctgtcggtggcgttcaaggtgtccttcgcgttgacggtgggcgcgggcgtgtacgcgtacctgctgtcggactggctgcgtggggggcgcgcggcgccagacggcggcgctgggtccgcccatggatga

SEQ ID NO: 2643 - DNA, 369 bp, Myxococcus xanthus
ctgcccgccggtccggtgactcgcggcagcatctactcggtgatgccgttcgagaactcgctcctcgtcgtgaagctgaagggcgaggacctggcccggcagttggccaacccgaacgcgctcgtttccggcttcacggccgcgggcaagggcaagttcaaggacgccaagggcaaggccctggacccgaacaaggagtacacggtcgccacggtggagtacctctacttcggcggtgacggcttcgagttcgagaagctggcccccgagcccaccgagacgggcatggcgtggcagacgccggtggtggactggaccaaggaccaggcgagcagcgacaagaagccgctggagaagctgctgaagtag

SEQ ID NO: 2644 - DNA, 1032 bp, Myxococcus xanthus
attcctcccatcccgcccatccctccgattcccgacctcccgaacgcgttctccgaggagacgcggaacgagatgaagcgcgcccgggacgagatgaagcgggcccgcgacgaggtgcggcgcaacatgcgtcgcaacggcagccgcaacgtggtggcgcgcggacagaacctggaggtgaaagacggccagacggtggagagcgccgtggtgtacggcggcaacctggtggtccacggccacgtgaaggatgacgcggtcgccttcggcggcaacctagaggtccacggccgcgtggacggggacgcgcatgccttcggcggcaacgtcatcctggggccggacgcacacgtggagggcgacgtgtctgcctttggcggctcggtggagcgcgacgacgacgcccaggtggaaggcagcatcgagtccttcggcggcgcgggcattggccgcatggtggccagtgaaatcaagaagggcgtgaaggaagccaaggacccctccgagagccggagggaccgcgacgatgacggcgtgggcctggcgggcttcatcctcaccttcgcgatgctcttcgggctcggcttcctgggacagatgttcttccccgcgcgcatgaagcagttgggcgaggaagtgcgccgcaagccggtgcaggcggggctcaccggcttcgtgggactgctggcgatgattcccctcacggtggtgctgtgcatcaccatcatcggcatcccggtggcgctggtgctgtggatggcggcccccgtcgcggcggcgctcggctacgcggcggtggcgagcgagctgggcacgcggttgcccatcttccgcggccggaagacgcaggcggtggtgctggccctggggctgctggtgctgatggtggtgggctcgctccccatcgtcggccccctcatcaccacgctggtcggtttgatggccctgggtgcggtggtccgcacccgcttcgggcagcggccacagggcatgcccgagcccgtcattccctcgagcgagcagcctgtctga

SEQ ID NO: 2645 - DNA, 1321 bp, Myxococcus xanthus
cgcggccgggccatcaccgtggacctcgagggcgagagcctccccgccatcgaaggtgagccggtggcgtgctcgctgattgccgcgggtgagcccatgctcgcccgctccatcaagtaccaccggccgcgaggcccctactgcttcgccggggccctgctcgcattgcctgatgcgggtggacggcgtgcccaatgtctacgcgtgccgcacgcccgcgcgggacggcatgaagctggagcggcagaacgcctatccctccgcgaaggtggacatcttcgacagcatcgactggttcttccccaagggcatggaccaccacgagatgttagccggcgtcccggtggctgagcaggtcatggccaaggtggcgcgtcagctcgcggggctgggcctgctgcccaagacgcccgcacccgcgacggcgcccgcgcgcacggtgcgcacccgcgtggccgtggtggacggcggcgcggcaggactggcgacggcgcgcgtgttgaccgagcggaacgtgggcttcctcctcatcgagcgggacgacgcgctcggcggccggctcgcgaacggcgcgccggaagccggcggccccagcctggacgacatccaccgcatctcccccagcagcgtgctcacgcgggccaccgcgctgggcctgtatgacgacgaggcggggcgcttcctcgcggtgggcacctgggaggcggacgcgccacgtctggtgaaggtgtactcggagcgcttcctgctcacgcccggcggccatccgcccacgctccccttcgagaacaatgacttgcccggcgtctacgcgggacgcgcggccagcctgctgctgcgccgctacgacgtggcgccggagacagcggcgctggtgggctggggcgcggagttgcacgcgctggcgaacctgctccaggagcgcggcacgaaggtggtggcggtggtggacctgcgggacacgccgccggcgggcacccatgccacggcggtgcgaggcagcgagcccaaggcccatggcctgcgcggcgtgagcgccttcagctacacgcgcgagggcggcggacgcgaaaaggtgtcgtgtgacgcggtgctggtgtccgtccccgtcagccccagcttcgagctggcgcggcagggcggcgcgaaggtgccgttcgacgagaagcgcgggctcttcgtggtggagacggacgcggacgggcgcacccaggcgccggacgtgtacgccgcgggtgacgtcacgggcggaggcaccgcgaaggacgcggcggcggccggacggcgcgcggcccaggcgctggtgggagggctgtcatga

SEQ ID NO: 2646 - DNA, 1518 bp, Myxococcus xanthus
atgagcaaggcgatgatctgctcctgtgaggacgtcaccgtcgacgacatccgtcacgcggtgtcccggggcttctgcgacgtggagtcggtgaagcgctacaccggcttcggcaccggcatctgccagggcaagagctgcacggcggcggtggccgcgctgctggagaaggagaaggcgctcaagcccgcggccgtggtgcccttcacgccgcgcccgccgctctaccccaccgagctgcggatgatggcctccgcgcccgtggacgagtcccagccgcctgtgggcgggctgccgcaggaagtggacgccttccccgccgcgctgcgcccggagggcccggtgcccgcgaaggcgaaggtggtcatcatcggcggcggcatcatgggcctggcgctggcgtacaacctggcgcgcgccggtgagacggacgtggtggtgctggagcgcggctacctgtgcgcgggcgcgtccggccgcaacggcggcggcgtgcgcatgcagtggggcacgccctcgctggtggagctggccaagcgctccatcgagctgatgaagggcttcgcgcgcgagctgggcatcaacgtctggctgcgccagggaggctacatcttcctggcgaagacagcgccggtggcccagcggctggagcgcaacgtctcgctgcacaaccgcttcggcgtccctacccggctcatcacccccgacgaggcacgcggcatcgtccccgggctcacgatgaaggactgcctcatcgcgtcctacaatcccgaggacggcgtcatcttcccctggcccttcctgtggggctacgcgcagggctgccagaagcgcggcgtccgcgtggagacgtacacggacgtcaccggcttcgagaccagcggcggccaggtgcgcaaggtgaagacgacgcgcggggacatcgcctgcgacaccgtggtgctggccgccggcgcctggagtccgcaggtggcgaagctggcggacgtgaagctgcccaacgagccgcaccgccacgaaatcctcagcaccgagccgctgaagcccttcctggggccgctggtgtccgtgctcgacagcgggctgtacttcagccagtccatgcgcggcgaaatcgtgggcggcatgggcgacgccaaggagcccgcgggcctcaacatgggcagcaccctgcgcttcgtgtcgcgcttcgcgcaggcgctgatggagcagttgcccgaggtgggccatgtgaaggtgctgcgtcagtgggccggctgctacgacgtgacgccggacaacaacccgattctgggacgcaccccgggactggacaacctgctccagatgtccggcttcgtgggccacggcttcatgatggcccccgccgtcgcggagcggatggcgaaatggatggccaccggcgagtccgacgagctcttcacccgcttcaacctccgacgctactctgacgcggcgggccattcgcgtgacttcggcaccggaacgctggagcgcgaggacatggtcatcggctga

SEQ ID NO: 2647 - DNA, 564 bp, Myxococcus xanthus
atgtggctgttcctggcgacggaaatcctgctcttcgccggcctcttcatctgctacggcgtctaccgcttcctcttcccggaggcgtgggccgccgccagccgcagcctggacctgacgctgggcaccgttaatacggtggtgctcatcacctcctcgctcaccgcggcgctcgcggtgcactacgcgaaggaggggaagaacaagatggtcgcggtgcagattggcctcacgctggtgatggccgtcggcttcctcgtcatcaagtacttcgagtatcaccacaagttcgagattggcacgctgccgggccgcttctactcgtacgagggcatccagcttccgggcgtgcccctgtactttacggtctacttctgcgcgacggccctgcacggcatccacgtcgtcatcggcatgatcgtgctggccttctccatggtccgcgcgctgaagaaggctgacttcgggccgaacaactacacgatggtcgagctgggcagcatgtactggcacctcgtcgacctggtgtggatcttcctcttcccgatgctgtacctcgtttga

SEQ ID NO: 2648 - DNA, 795 bp, Myxococcus xanthus
atgttcccgaagagcgttcgtgcgctgttcctggtgggagccctgtctgcctgcggcaccgaagcacctcccgacgttcccaacgcggacggccaggagccgctgcagtcgcaggagtccaacgtcatcgtgggctcggtgaactgggtgagcgccacgacgctgtccggcacgcagcgcacgcgctcgcgcgcggtgggatacctgtccattccggcggtgggctcgcgctgcacggcgtggctggtgtcgcgggatgtgatcatcaccaacaaccactgcgtcggcagcagctccgaggcctccggtgcgcgtgtgtccttcaactatgaggacggcgtcagctccaccgctcgcgtctggtacaactgcggcacgctgatccgcacctgggccggcgacgacatgacggcgctgcgctgcacggccaccaacggccagctcccgggtgacgtgtacggctggctgacggtggccagcgccaacgccgccaccaacgccagcatctacgtgctccaccagaactgcgactactacacgacgagcggctgcacgccgacgaagaagtcctcgccgggcgtggtgcgcaatgccaactacagcaccacggacctgtcctacgacgcggacacgctgggcggctcgtccggctcgcccgtgctgtcctcgtcctcgcaccaggtggtgggcctgcaccacatcggtctgggcggcaactcgcagggccgcggcacggccaacaccggcgtgaaggccacgcgcgtgaaggcgcgcctggccgagattggcctctag

SEQ ID NO: 2649 - DNA, 462 bp, Myxococcus xanthus
atggcgactgtttcccgaatcctcgttcccgtggacctgtcggacggctcccgggaggtcatcgactacgcggtgaagctcgctcggcctttcaaggcatcggtcgaggtggtccacgcctgggagccaccccagtacgtggcgcccgacctgctggtggccgcgccggggtggaactcccaatccctggagcacgtcgccgtggaggccgcgacgaaggagctgacggcccagatgaaccagggggagcccccgggcgtcccggtgagccagaaaatcgtcgtgggtgaggcggcgtccaccatcctcgacctcgccgagcaggacaaatgcgacctcatcgtcatgggcacccacggccggcgcggccttccccgcctgctcctgggaagcgtggcgcagaaggtcgtcgcccgcgcgtcctgcccggtgctcaccatccacctgtccgagcggaagtag

SEQ ID NO: 2650 - DNA, 525 bp, Myxococcus xanthus
atgcgctcgtcccccattgccactttggccctcgggctcgccctcgccacccctgccttcgccgaggacgacgcgaagccgccccagaagtggaaggtggtgtgcgccacgcagtcgaaggacggaagccgcgccgtccagggcacggacctcatcatcgaggccggtgagaaggtgaaggacggcgtcgccgtggagggcaacgtcatcattcgcaagggcgcggtggtggaggacgtcgtcgccatccggggccgcgtcatcgtcgaatccggtgcccgggtgacgggcagcgcggtgtccctgggcggagaggtccgcgtccacaagggcgccgctgtcgacggggacgccatcgccctgggaggaaagctgaaggtggatcaggacgaagcggtgaagggcgacaaggtcagcctgtccttcgagattggcggccgggacatcgtgcgcggcttcattgaagacgcgctcgacgaggagactggctgccacatcgtcgacgagagcgacaaggacgtctga

SEQ ID NO: 2651 - DNA, 783 bp, Myxococcus xanthus
atgctttgcgtcgacgtggaacggttcgatatccgccctgccctggcccactacgccgagcacggctacgcgaagctgggccgtgtgctgggtgacgagggcctggacgcgctccgcgagcgggccgacgacctgatgctgggccgggtcgtccacccgggcctcttcttccaaccggacgccaccaccggtcgctacgaggacgcccccctgggactgggctggcagggcccctccctggactaccgcaagctggagaagctggagaaggacccgcgcttcctggcgtggatggagaacccgctgttcgaacgcatcgcccgggcgctcatccccggcgacatcgtcctctaccgcgccatcctcttccacaaggggaaggccggcggcagcaacctgccctggcaccaggatggcggccggctgtggggactcacccacgaaccggagctgcagatctggaccgcgctggatgacgcccccgaggacggcggctgtctggaagtcgtcccgggcagccaccgcggcggcctggtgacgcctctgggcggggtgattcctccggacgcggtggcggcggccgacgctgaatcccgcgtcctgtccctgccggcgcgcgccggcgaggccatcctggtccacaaccacctctggcaccgctccggacgcgggcgccccggcttgcgccgccgcgccttctccgcctgctacatggacgcggtcgtgcgctgcctgcgcaagaagaaggccccccgcgtcttcccgcccatgttccgccggtga

SEQ ID NO: 2652 - DNA, 756 bp, Myxococcus xanthus
cagccgcactacctgccgtgggtggatttccacgagcagttggcccgcgcggggaccttcgtcgtgctggacaacgtgcagtggctgcggcgcggctggcagcggcgcacccgggtggccctgccccacaacgtcccccagcccccgcccacggagcccgggttccagtggatgtccatccccctggagaacccgcaccgggacaccctcatcaaggacctggcggtggatgcccgtcagccctgggcccgcgagcacctgcgtatgctggtgtcgctgtacgcaaagcggccctacttcgcttcgcaggtactgccccggctggagcccttctatgacgcggcggcgcgcgagtcgggccccgggtcgctgctgcgggtgctgctggcgagcatggcgctcttcaacgagccgctgggcctgacgccgaacctggtcctggcctccaccttggacaagcagggcgaggacaagtcggcccggttggtggcgtactgccggcagttgggcgcgcacacgtactactcggggttgggctcgtccctgtacctccaggtgggcctgttccgagacgtggacgtgcgcgtgctgtggcagcgcttccgccaccccgaatacgcacagggccgcccgggccgcttcgtccacggcatgtcgttggtggacgtgctggccaacgtgcagttggacgaggtgcgccaatggctggagccttcgccctggggaccgttcgcgccccggcccccgggcgaatga

SEQ ID NO: 2653 - DNA, 243 bp, Myxococcus xanthus
atgcgcggcgcgcgaagcccacccccatcattcgcattggagctcttcgtgaagcgacttctgtccgtcctcgccctgcccctgctgctgctcggaacctccgcggcggcgcagacgacgcccaccctcacgttccacggcaactggaccatccaccagtcggaggtactgaccgaaggaggccaggtacaggtcgtctacagcaccgcgcgcctgccgcagtgccgcgtcaacaacccttag

SEQ ID NO: 2654 - DNA, 861 bp, Myxococcus xanthus
atgcgtcctctccccatcgaccaaggaaccgtgctgatcatcggcgcggcccgggggattggccgggagcttgcccggctgcttgcacgtcgcgttcggaccctggtgctcgtggaccatcaggcccaggtcctggagcccctgcgcgaggaactcctgctgaactacccgacgctgggcgtgctcgtcgaatcctgcgacgtgtgcgatccccagcaggtggacgcgctgctcgcttcgctggagtcgcagttcgtccgcgtggacgtgttggtgaacaacgccgcggaaggcgaccaggcgctgtatgcccaggagggctgggggcgtgtggaagccatgttgcgcgccaacgtctgggtgcccgcgctgctgacgcaccggctgctcaagcccatgttggagcgtggacggggcggcatcctcaacatcggctccggcgcggcgcagctcatcctgccgggctcggccaccttctccgccacccagcgcttcctggacggcttcacggaggcgctgcgcctggaggtggaggggcagggcgtcacggtgacgcgcgtagctccggggccgctgtgggaagcgggtgtggagggcgcggagtcactggcgcctttcttccatctgtcactggagcgctgtgcccgcgaggcgctcgccggcttcgagcgcggcgcggccctggtgtacccgggcttggggcaccggtgggtgatgcggctgctgccactgctgccacgcgggctcaagcggagcctggggcggatggcgctgcggggcctgcggcgggaggagttgctgctcccaccacggcaggccccccaggcgctgccactttcgggcgagccatcacccgcgtga

SEQ ID NO: 2655 - DNA, 942 bp, Myxococcus xanthus
atgcgggagggtatctccggcttcacgctcctgccggtgagcacctcggcctcgctggtgggaatgttcgtcttcctcacgtggatgcgctggtggcgttacgcggggcaccgccaggtgtggggcttccaggtgccagcgccagggcggtggacgctgctgtcggggctctgctcggcggccatcatcggcaccacgacgctggcgtacaccctgccgggggcgtccatcgtcttcatgatgctgttgatgcgcggcggcgtgctcgtcctggcgccgctggtggacgtcctcagtggacggcgggtgcgctggccctcatgggtggccttgggcttgagcttctcggcggtggcggtggccgcgggctcgtcggtcagccccacgctgacgctcctggccacggtggacgtgggcgtgtacctggcggcctatttcttccggctgcgcgcaatgagccaactggccaagtccggcgagcgtgaggtctccatccgctacttcgtggaggagcagatggtggccacgcccgtgctggtgggcaccctggcggtgctggcccttatcggcggcgatggcgtgctcggtgacatccgcgacggcttcaccggggccttgtcgcgaggccacctggcctccgagctcgccgtgggactgctgtcgcaggccaccggcatcttcggcggcctcatcctcctggacgggcgggagaatgccttctgcgtgccggtgaatcgcgcgtccagcgtgctcgccggagtggtcgcgaccgtggtgatgtccgtcacgctgggccagccgggcgcgggggccttggagttggtgggcgccgcgctcgtcgtcgccgccatggcggtgctggccgtgcccacggtgctggccgcgcggcggaaggcgggggagccggccgcacccccggtggctccctccccggggccgtga

SEQ ID NO: 2656 - DNA, 777 bp, Myxococcus xanthus
atgaacgcactgctctccatctggacgtggatcgagattggcctggtggcgctggtcggcttctgtgtgcagctgtcgctggccatcctgacctgggccttcgaccacaagcgccacgtgacgggacgctgcttccggctcatcggcgtcaccgcggcgaagctgacgccgttctggcgcttcggcgtgcacggccaggtgccggacaaggtcgcgccgaacacggtggtcgtaagcaaccacgagtccaacgcggacccgttcctcatctcgcacctgccgtgggagatgaagtggctgggcaaggccagcctcttcaagattcccgtggtgggctggagcatgtggatggcgggggacgtccccgtgcaccgcggcgaccgcgactcggcgacgggcgccatggcgaagtgccgccagtggctggccaagggcatgccggtgatgatcttcccggaagggacgcgctcgaagacggatgacctgctgcccttcaaggacggcgcgttccggctggccatcgaggcgcaggcggacgtgctgcccctggcggtgagcgggacgcggcgggcgctgccgaagcactcctggcgcttcgccacctcgcgcggtttggtgacggtgggcacgcccatctccaccaaggggatgacgctggcggacgtggagacgctgaagaacctggcccgcgagcagatcctgtcactgcgggcttcgctgatgccgctgacgcgcaccgagccggccgtgccgccggggccggccagcgccgcgtga

SEQ ID NO: 2657 - DNA, 783 bp, Myxococcus xanthus
gtgcgagtcgtttcgtggaacgtgaacggacttcgctcggtgcaccgcaagggcttcctgccctggctcgcggggtgccgggcgcaagtcgttggtctgcaggaggtccgcgcgcgcgccgaccagcttcccgacgatgtgcgctcaccgtcccggtggaagacgcacttcgtggcggcggagcggccgggctacagcggcgtcggactgtacagccgcctggagcccgatgaagtcgtgacggtgctcggcgtgggggagctggacgtcgaagggcgcctgcagattgcccgcttcggcaagctcaccgtggtgaacggctactttcccaacggcaacgggaaggaccgggacctgagccgcatcccctacaagctgaccttctaccggcgcctcttcgagcggctggagaagcccctgcgcgatggtggccgggtgctggtgatgggggacttcaacacagcgcatcaagaaatcgacctggcgcggcccaaggagaaccgggagacgagcggcttccggcccgaggagcgcgaggagttcgaccggtggattcgtgccggctgggtggacaccttccgccacttcaacaagggtggggggaactattcgtggtggagtcagcgggccggcgttcgggagaagaatatcggctggagaatcgactatgtcctggcctcgccagcggccatggcctacgtgcgcaaggctggcatccacccggacgtgctcggctcggaccactgtccggtgagcgtggacctggaccccgcggttcgctga

SEQ ID NO: 2658 - DNA, 456 bp, Myxococcus xanthus
atgggcattgccaacgaatcccggcaagaagaacagaacatgcgcgaggagcaccacggagcgggccgttactggctcatctggggtctgctgctggtgctgacggttgtcacggtcgtcaccggccgtatccacatccccacctggggcctggtgctggcgctcgtcatcgcctccaccaagggcacgctggtgctgctctacttcatgcacctggctgaccaccgcggcgccaaccggctggtgttcgccgtctccatcatcttcgtggtgttgttgctcgccattccgctggtggacctgggcacccgcttccgcggcgccacgcctccgggttcgacgtacagcgacctgcaggcgatcgacatcggcgcggatgccgaggaaggccgctacggcggcgccatccgcaagcaagggaagacgggcgaggagtccggcgctcccaagcagtag

SEQ ID NO: 2659 - DNA, 1707 bp, Myxococcus xanthus
atgccctggtccttccggcagatgctggcgccgctgtccgcactgctccttttcatgtccgcatgtggcgacgaccctgaagtcaggcccgtttgcggaaatggcatcgtcgaggctggcgagacgtgcgacgacggcaaccgaaacaacaacgacagctgtgacaacagctgccgtcgtcccacgccggacgcgggcaccgaggaggatgccggcaccgaggacgacgccggcaccggtgaagtggacgctggcaccggtgaagaggatgcgggcaccggtgaggacgacgccggcaccaccgaggacgctggcaccggtgaggacgacgctggcaccaccgaggacgcgggcaccggtgaggacgacgctggcaccaccgaggatggtggttcaggcgagcaggacgcgggttcggatgaagacggtggttcgggtgagccggattccggcaccgacgcgggcacgggcgaggacgacgccggcaccgacgcgggcacggtccaggtctcgctggacagcttcggtccgacgggcaccttcgcgcgcactggcaccacgggggcgacgttccccgaggcgctgacggtgcgtctgcgtgaggaagctccggcggaggtctgggtggaggttacttcgtccagcgccgtgctgaacgtgcagggtggtctggtgcgcatcgccccgggtgagcgctccgccacggtgcaggtgacggcgaacctggccgcggatccggagacggacaaggcgacgctgacggccacgctgggcaacgacacgcgtgcggccacggtccgggtgctggcggcgaatcaggccgctgagctggccacgctgtcgcccgaggtcatctcggtgagcgctggccagacgcagggctacacggtggagctggacgttcccccggcgcaggacacggtcatccagctcgcgctggagcccgcgtcgctcggcacggtgccggtgacggtgacggtgccggccaacagcctgtccgccaagttcgacttcaccgcgggcagcacgggcggtgagggtcagctggtggccgcgctgaacggtcagtccatcgcggcggcggtgcaggtgaccgcgggcagcagcacgggccacgtcgtcatcagcgagttcgcggtcgcgggccccggtggcgccagcgacgagttcatcgagctctacaacccgacctcgagcgcggtggacatctccggctggaaggtccagtacaaggcctacagcagcacgaactacaacaactcgttcacgctgcccgcgaactcggtcatccagccccgtggctacttcctggtggtcgccagtggttatgcctcgacgagcggcaacaccgtgtcgggtgacgcgaactggggaacggccctgaacctgggcgccaacagcaatggtggccatgtgcgcgtcggctatccggagctggcgctgaccgacggcatctcctcgccgctggtggtggatacggtgggctacctcaacgcgaacgccgctgagggcagccccttgccggcgtacccgcccaccgccggcagcttcgagcgcaaggcctcggccgtgtcgaccgcggcgtccatggtcgacggcgcgcacgcgctgctgggcaacggccacgactcgaacgacaactcggcggacttcatcctccgtccgacgcgccagccgcagaaccgcgcgagcgccacggagccgtag

SEQ ID NO: 2660 - DNA, 852 bp, Myxococcus xanthus
cccacggtgctgctgacgaacgggattggctcctcggagaacttctggcgctacctggtgggaaacctggagcaggaccaccgggtggtgcactggaactaccggggccacggcagcagcgatgaatccctgggggatgggtaccagattcgcgtgcacgtggatgacctggagcgcatcaccgcggcggtgatggcccggggggatgggcggccgccgcaccatgtggcgttctccatgggcgtgcgcgtcctgctggacctgtaccggcggcggccggacctggttccgtccatgacgctcatcgccggggcgccgggggcgttcggctcgggggtggactcggcgggggcccgcgcgttcctgtccgccacccggggcatgctcaagctggccacgcccacgctgccgctggcggcgcccgtggcgcacgcggtgatggccagccgcttcgcctatcccctggcgcggatggtgggggcgctccgggcccgggcgcctcgggcggacatcgacgagttcatgctcgccctgcgccggatgagccccagggcctactggtacaccctccggggcatggtggagggccatgcctgggacgtggccaggacggtgcaggtgcccacgctcatcgtcgccgccagcaacgatctgctcgttccgctgggggagatggagcgaatgcgtgacgcaatgccgcacgcacattggatgcgggtggatgacgcggggcacgccggcctgctggaggccgggtcggagatcgccgaggccgtgcgtgtcttcctcgtggaccacggcttggagccgccccatgaggtcggggagcacgctccagtgcctccgtcctga

SEQ ID NO: 2661 - DNA, 2073 bp, Myxococcus xanthus
atgaagttcctgtgtctcacctctgatgaccggcatcccgtggcggaggagctgcggcgccagggccaggccgtgttcatcaccgccgacgtggtggaagccggcgcggcgctggggcacgggcccgtggacgtgctggtggtggacgcggcggacctggtggaggacgcgcgctggctggacgcgctgcggacgcgggcccgtcccgaggagccgctggtgctggggttggcgcgggaaggcaccgacgcggcgctcgagccgctgctggccgcgggcgtggacgagttcctggtggagcccttcaccccggtgcaggtgcgctcacggcggttgttgctggagcggcgggtggcggcgcggcgccagcggcggacgtccgaggcggaggcgcggggcgaggtggcgcggctgtcctccatcatccagatgcagtcggacgtggcgatggcgggctacgggctcgacgagctgatgcggttgctgtgcgagcgctcgcgggtgttgtgcggcgcggacggcgcggcggtggcgctgctgggggcggacaccgacgaggaggtgacctacctggtggccagcggcagcctgatgcccttcatcggcttccggctgaaggtggagggcagtctcacgggcgccagcctgctgcagggcgaggtgatgcgcacggatgactcggagacggacgtccgggtcaacgtgacggcgctgcgccaggtgggcgcgcggtcgatgatttgcgtgccgctgtggcgcgagggccgcccggtgggcgtgctcaacgtcaccagccggcggccgaacacgttcgaggaccgggacgtgcgcacgctggagctgatggcgggtctgctcggcgcggccatgggcaacgcggccgaggcccaggcgcgtcaggagttgatggtgcagaacacgctggcgatgggcgcgctggaggagtcgcaggagctgttcgcgtccttcatggacaacatccccgcggtggccttcatgaaggacgagcggggccgccgcatctgggtgaacgcgcgctacagccggttcttcggcttcccggtgggcgcggacatgtccaacgtgtccgacgtggatttgatgcccgcggcctccgccgagcagtcgcgccgggatgacgacgcggtgctgacctccggcaagcagagcatcaccgagatgatggttcccgcgcgcgacggcaccgagcgccactggctcacctaccgcttcatcgtgcgggagcgctcggggcggcggctgctggcgggcgtggcggtggacatcaccgaccgcaaggccatgcaggcgcagctcgtggtgtcggaccggctggcggcggtggggacgctggcggcgggcgtggcacacgaaatcaacaacccgctggccttcgtcctctccaacctgtcgttcctcgcgggcgaactgcacgccctggcgccggagttgccgtcgggccgcatggcggagctggaggaggtgctgcgcgaggccaccgacggcgcgcaccgcgtgcggcagatcgtccgggacttgaggaccttctcccggggcgacgacgaggtggccaccgccgtcaacgtgcaggcggtgctcgagtcggccatcaccctggcgcgcagcgagctgaagctgcgcgcgcagttggtccgcgactactgcgaggtgccgctggtggagggcaacgagggccgcttcggacaggtgttcctcaacctgctcatcaacgccgcgcaggccattccgatgggccagacggagcagcacgaggtccggctgagcctgcgaagcgcaggggaccgcgtcatcatcgaggtgcgcgacacgggcgtgggcatgcctccggaggtgcgcgcccgcatcttcgaccccttcttcaccaccaagccggtgggcgagggcacggggctgggcctgtccatctgccacggcatcgtcaccggcttcggtggagacatctccgtggagagcgaggaaggacggggcagcaccttccgcgtctccctgccggtggcacggcgcgcgaaggagccggtggatccgccgctgcgcatgcccctggtgggctga

SEQ ID NO: 2662 - DNA, 1608 bp, Myxococcus xanthus
atgaccgccgcgctcccgccgcgccccccgggcgccgtcactggctcacgtcccgcgctgcccccggagccggacgagcccgactttcccaccgagcgtcgcggctcgtcctcgccgccggaccgccgtgctccgccgccggcaccggccacgctgccgtccgtcatcgtcgccccgcctgaccgtcgtgggcccgggccgtcccagtactcgggcccggaccgacgaggcggcgccgccagtccgcagtacagcggcccggagcgccggacgccccggcggtcgggagaggagggcggcgccggcccgggcgaccgtttctggccctcccagccgcgcaccctgggcgagacgggcctcaacaccaccttcgtggaagagctggttctcaaggcgctcttcttcgccggtgagatgcgcggcatggacatcgccgcgcgccttcaactgcccaccgcgctggtggacgacgtcatcgaaggactgcgccgccagaagtacatcgacatccgcggcggtggcggatcgggcgtgggcaagtcgacgatgatctaccagctcaccacgttcgtgacggacgtgctgcggcaggtgctcgaccgcaaccgctacaacggccccgcgcccgtgcccttcctggagtgggcggccgccgtgaagaagcagaccgtgcgcggcaaccgcatcactcgcgcgcgcatgcaggacaagttcggcgacctcatcatcaaggactacatcttcgacggcatcggtccggcgatgaactccggccgcgccatcttcttctacgggcccccgggcaacggcaagacggccatctgccagggcatggtgaactgcttcgacggggacatcttcatcccccacgccatcctcattgacgacttcgtggtgcgcatcttcgacgccaacctccacaaggtggtggaggacgagcccggcacttcgccgtatgaccggcgctgggtgcgctgccggcgcccgctcgtcgtcgtgggcggtgagctgacgctggagatgctggacctcgtgtactcgccggaggtgaagtactacgaggcgccgttccagatgaaggcgagcaacggcatgctcctcatcgacgacttcggccggcagaaggtgtcccccaaggacctgctcaaccggtggatcgtcccgctggagagcgacatcgacatgctcaccctgcacaccggcaagaagctgcaggtgcccttcgacgtgttcgccgccttctccaccaacctggaccccagcgacctcgtggatgacgccttcctgcgccgcgtccgctacaagctggaggtgcagcgcccggacgaggagcagttccacgacatcttccaggtcatgtgccgcaagcgcggcgtgccctacaacgcggcggcggtggactacctcatcgacgcgcactaccgccccgtgggccgtccgttcgccgcctgtcagccgcgtgacttgttggatcaggtcatcgacatggcccactaccagggccaggagccgcgcctgacgaccgaactcctggactccgccgtgcgcggctacttcgtgcgcttcgacaaggacaagccggcggggacgtcggcctccgcgcgctga

SEQ ID NO: 2663 - DNA, 576 bp, Myxococcus xanthus
atgggccagagcatggggcccctggcctatcccaccctggatttctccgccgagcgcgtgctggcgtgctacgcccagaagttggtcaagcccgaacctcgctttctgctcatcgcctatgagtccgatgcgatgatgccgctgcacctcttctacgacttcaatgcgccctcgcgaaacgatgccatggtcacttcccgcgaagcgcgcggcaaggaattgaccgacgccttcgagacgttgagggagatgctggcgtggggagcgctctccctcttccgcattgacagggcgccgcacacctgcagcggcagtctcaagggcgacaccaccgacttcctggtggacctcgacccagtgatgagcagtcttggattcatccagcccatccccactggcccgctctgcagattgtatgagcgaccggatgcagtcatggtgtgcacgggcacgccaagagcgggaaccgggaatcggagggcttttgacctcggcggcaatagtgtcggaaggctgcggagaattctgggagagatctcatccgcgcgcgtcgcggaactccaggtgaagaagtag

SEQ ID NO: 2664 - DNA, 894 bp, Myxococcus xanthus
atggacgccgcactggggacgtcgttcggggagcagcctcggagcgacatcgtcgtcgcggacgtcttccagttcaggccggcgctgacgctcatcgacgtgcaggtgctcggtgcgccgcgcgtcgaaggcgaggcggaggcggcggagcaggacggcttcctgacgcgcgtggccagcctggcgaaggaagcgggcttcaagagcacgcgggtgtggatgggcgaggtgggcaccatggcgtgggaactggagtcccaggacgaagagggcgtgcccgttggtgcgaagcgggaggacgaggcgctgcgcacgctgggggcagacgggtggaccgtggacccgctggcgcccgtggtggcgcgcgaggtcatccggagcatcgtcaagctgccgctggaggaggtccaccactacatcgactgggcggtgagctgccgcagctcgatggcggcggggacgccggtggagggcttcaacctgacgcgagcctcgcggctgatggccacgcactacctggtgtggaaggggacggtgctgcccaagccgacgccggtgagcgagatggcgccgaagctcgggagggcccggaggatgcgcagggcggcgactttggtccctgctgcgcgcgtctggggactggtgctgctggtggccttcgtggtgcccgcggtgctttaccacttcatcttcgccccgccggtggagagcccggtaaagggcttcgtgctcagtggcgtgatgacgctggtctgggccctgttcgccctggtgcgctttgacgacttccaggggcggccggtgcgcctaccatggaggctggcgctgttcgtcggtggccagctcgtggtgggggcgttgatgtggtggcttcatgggatgccaagcagatga

SEQ ID NO: 2665 - DNA, 1967 bp, Myxococcus xanthus
atgcgggagcgtgccttcggcgcggacgaggtcgtcacccggctccagaccgaggcggcttccgagcgcgaggcgcgtgctcgggccgaggaggcgctcgcagcggagcgtgaggcgctcgcccaggttcgtgtggacctggacgtcgaacgccaggggcgcggcgatggcgaggccgagctggctcgcgtgcagggggtgctcgggggggagcagcaggctcgctcgggggcggaggccgcgctggctcagctccgtgcgacgctcggggcggaacagcagtcgctggccgatgccgaagcttccctggccgaggcacgtgctgcgctgactgcggaacagcagacgcgcgccgagaccgaggccgtactggcgcagtcgcgcgatgcgttcgcggcggagcaagaggctcgcgccgagaccgaggccgtgctggcgcagtctcgcgaggcgttcgcgtcggagcaacaggctcgcgccgagaccgaggccgtgctggcgcagtctcgcgaggcgttcgctgcggaacagcaggctcgctcagagaccgagtccgttctcgcacaggctcgcgcggcactcgaggcggagcagcaggctcgtgccgagcttgagacagccctgtcgcagtcgcgtgagtcgctgacggcggaacagcagacgcttatcgagcttgagaccgcactgtcgcggtctcgagagacgctcacggcggagcagcaggctcgcgcggccatcgaggctgccctgtcccaggcccgtgaggcacttgccgcggagcagcaggctcgcgcacaggctgagtctgcactggcgcagtcgcgtgcgacgctcgaagcggagcagcagactcgcgccgataccggtgccgcgcttggacagactcgctcggcactggagtccgagcagcagggccgcgccgaggccgaagccgcgttggcgcaggtccgcgcggtgctcgaagcggagcaacgcacgcgaaccgatgcggagtccgcgctgcaaacgctgcgcacggagacgtccgagcgcgaccaggcccggcaggagcggctggctgccgccgaacgtgtcatggctgagcaggagcgcgcgctcgaagcgcagcgcctggcggccgaggctcgcgagcaggagctgcgcgataccgtgacgcgcctggagtcggagcgggcgtgggcggaggacacggcgaaggaacagcgctcggcgttggagtcgcggctctcggaggcgcgcgcggcgcaggagtcggacgcggcgcgtgcggtcgcgttggctcagtccctggcggaccttgagtcggcccgaagcgcggcggatgcccagctcgccgagcgtgcgggaaccatcgaggcgctggagacgcaggtcgcccaactgcgtgagcaggtcgcggagcgtgaggcggaggcgggccgtgtcggtgaggccgccaccgaggctcgcgaggcgctgacccggcaggaagccgccgcgcaggagcgactctccgcggtcgagcgtgcgctggacgatgcgcttgctcgggcggagcggcagcagggcgaaatcgaagcgctggcggcggagcgagaccgcgaacggacggccttggccgcggcgcagcaggaactggcgcatttgggcgccgcgcggcaggagagcatgcgtctgggggcacagctccagcacgccatggcgaccctgcacgagcggggcatgcacatcgctcggctcgatgcagagttggtggatgcgcaggaccggctcgcggcgcagcgggagaacgccgagttgctcatggtgcagctcgagacggcgcggcgcttcgcgggcaaggccaccgcgatggagaactcgctcgaagccgagcgcgccgcgctggagacgctgcgggccgagctggcccgcgcgaccgaggccaccgccacggagcaggcgcgggcgaacgcgctggaggcccagctcatggactccgccggggg

SEQ ID NO: 2666 - DNA, 1053 bp, Myxococcus xanthus
acgttggagacaccgcgccgcagcgcgaggagcacggaagcaatgctgttgaaccctggcctgaatctcacgctgcgcccgatggcgtatccgcagttcttcgagatgtaccggaacgccatcaagaacacctggaccgtggaggaggtggacttctccacggacctggtggacctgcgctcgaagatgacggacgcggagcgccacctcatccaccggctggtggcgttcttcgcgacgggtgacagcatcgtcggcaacaacctggtgctgaacctctacaagcacctgaacgcccctgaggcgcggatgtacctgtcgcgccagctctacgaggaggcgctgcacgtccagttctacctgacgctgctggacacctacgtgccggacccggcggagcgggcgatggccttcgcggccgtcgacaacatcccctccatccagcgcaaggcgcagttctgcatgaagtggatggacagcatccaggggctggacacgctgcagacgaaggcgcaccggcggcagttcctgctgaacctcatctgcttcgcgggctgcattgagggcctcttcttcttcgcagccttcgcctacgtgtacttcctgcgcagcaagggcctgttgaacggcctggcggcgggtaccaactgggtgttccgggacgagagcgcccacatggcgttcgcgttcgaatccatccaggtggcacgcaaggaagagccggacctcttcgacgcacagatggagcgcgacgtggtggccatgctccgcgaggccgtggagtgcgagacgcagttcgcccaggacctgctgagcggcggtgtcatgggcctgtccgtacaggacatgcgcggctacctggagtacgtggcggaccagcggctccagatgctgggcatgacgccggtgttcggcacgaagaacccgctgcacttcatggacctgcaggacgtgcaggagctcacgaacttcttcgagcgccgcgtgtcgtcgtaccaggtggccgtgggtgttggcgcggccacggacgtcgtgctcgacgcggcgttctga

SEQ ID NO: 2667 - DNA, 2358 bp, Myxococcus xanthus
atgcgggtgcgtaagcgcaacggcggcacggagacggtggacctcaacaagattgtgcgcgccgtgggccgctcctgcgtgggcctgccccgcgtggacgcgatgcgcgtggccaccaagacgatctccggcctgtatgacggcgcgacgacgcgcgagctggacagcctctccatccagacggccgccgccctcatcgtcgaagagcccgagtacggccgcctctccgcgcgcctgctggccaccttcatccagaaggaagtcagcaaccaggacatccactccttcagccagtcggtggccgcgggccacaagcacgggctcatcgcggaccggctgctccagttcgtccaggccaacgcgcgcaagctcaacgcggccatcgacccgtcgcgcaacgacctcttcgagtacttcggcctgcgcaccgtctacgaccggtacctgctgaagaacccgcagacgcgtgaggtgctggagacgccgcaggagttcttcctccgcgtggccagcgcgctcagcggcgacaatgtgaatgaggccatcgagctgtaccggctgttcagctcgctggagtacctgcccagctcccccaccctgttcaactcgggcacgcgccacgagcagctttcgagctgcttcctgctggactcgcccgcggacgagctggacgccatctacaagaagtattcggacatcgcgatgctgtcgaagttctccggcggcatcggcgtggcgtaccaccgggtgcgcgcacgcggctcgctcatcaagtccaccaacgggcactccaacggcatcgtcccctggctgaagacgctggacgcctccgtggcggcggtgaaccagggcggcaagcgcaagggcgcgtgctgcgtgtacctggagacgtggcacgcggacatcgaggacttcctcgagctgcgtgagaacaccggcgacgacgcgcgccgcacgcacaacctgaacctggccaactgggtgccggacctcttcatgaagcgcgtggaggcggacggcgactggagcctgttcgacccgaagtccgtcccccacttcacggacctgtacggcgacgccttcgagcaggcctacgcgaaggccgaggccgacggcctggccatgcgcaaggtgaaggcgcgtgacctctacgcccggatgatgaagagcctggcgcagacgggtaacggctggatgaccttcaaggacatcagcaaccgcaagagcaaccagacgggcaaggcgggcaacgtcatccacctgtccaacctgtgcaccgaaatcctggaggtgacgagccagggtgagacggcggtgtgcaatctgggctcgctgaacctgagccggatgctggtggacgggaagttcgacttcgagcggctgcgcgccaacgcccagctcgcgatgcggcagctcgaccgcgtcatcgacctgaactactaccccatccccacggcggcttcgtccaacaagcgctggcgcccggtgggcctgggcctgatggggctccaggacgtcttcttccagctcaagctggccttcgactcggcggaggcgcgtgcgctctccaagaagatttcggaggagatctacttcgcggcgctgaccacgtcctgcgagctggccgagcagtacggcgcccacgagtccttcgcggagacgcgggcggccaagggcgagctccagttcgaccactggggcgtggtgcccgaggacacggcgcgctgggacgcgctgcgccagcgcatcatgaagcacggcctgcgcaactcgctgatgattgccattgcccccacggcgacgattgcgtccatcgtgggctgctacgagtgcatcgagccgcaggtgtccaacctgttcaagcgcgagacgctgtcgggtgacttcctccaggtgaaccgctacctggtgcgcgacctccaggcgctcgggctgtggaacgagaacatccgcaaccgcatcaagatggcggaaggcagcgttcaggacattacggagctgccggagaacctgcgcgcggtgtaccgcacggcgtgggagctgccgatgcgctcgctgctggacatgggcgcggaccgcggggcgttcatcgaccagagccagtcgctcaacctcttcgtcgagacgccgaacatcgggaagctgtcctcgatgtacttctacgcgtggcagaagggcctgaagaccacgtactacctgcgctcgcgtccggcgacgcggattgccaaggccacggtgggcgcgggtggtggcgccagcgtggcgcaggcggcccctgctccggtggcgaaggcgaccgaggccgaggcggtggcctgctcgctggagaacccggaggcgtgcgaggcctgccagtag

SEQ ID NO: 2668 - DNA, 837 bp, Myxococcus xanthus
atgaacggaacggcacaacagggattcggctatcgggcgcggcgtaccttcacgcggctcctcgtcttcactctcatcctgggcctgggcggcgtggtcgtcttcctcctctcccagctcaacgcgcgcaccttcaccctggccctccaggacggacagttggtggtgatgaagggtcgcaacgcccccatgggcgcggtcccctaccggaccggggacccgcggctggcggacgcctatgcgcccgtcgccatcgaaggccaggacgtctcggccctcctgacgcgcaagttcaccgaccgggacgagctggaccaggccctgttccccgtcctggagggcctggcccggccgcgcatcgcgtcggacgagccggcccgggtcgaccagggcctctactacctccggcgcgcggagaagctctccggcatcaccgaggagcagcgcctgtcgctccagaagcacatggtggacgtggcctactaccaggcccggcagaagctggaggacgcccgccggctggtcagcgaggccctcacccagctcaagctggccgcggagagtcagagccgccacgcgcgcagcgccaaccagatgctctccgccgtggccccgccggcccgcgatttggaggagtcgctgcggcgcgccgtgcacaccctcagcggcccccaggcggccccccaggcgccgtcccagcccgcgccgcagcccgcccccaccgcgccgtccccggcccccacgccgcagccggagaccaccggggaggccctggacggagccccccaggcccccaccgggacggatgcgggcggtgtggttccaacccctccgtag

SEQ ID NO: 2669 - DNA, 1701 bp, Myxococcus xanthus
atgcgaatcgttggcatcgacctgggcaccacccattgcgccgtggcatccgtggacccctcgcggggcgcgggtgcccccgtggaggacttcgcccttccgcagctcgtccgtcagggcgaggtggccccgcgggccctgttgccctccaccgtgtacgtgcccgccggccacgagctggcggagggttcgctcacgctgccctggggggatgacggcggcccgtgggtggtgggtgagctggcccgctggcagggcgcgcgcgtgccggggcggctggtagccagcgccaagagctggctgtgccacccgggcgtggaccgctccgcacccatcctcccctggggtgcgcccgcggacgtccagaagctgtccccggtggacgccagcgccctgctgctgacgcacatggctcgcgcatgggattacgcgcacccggacgcgcccctgtcgaagcaggaggtggtgattaccgtccccgcctccttcgacgaagcggcccgcgccctcacggtgagcgcggcgcgcaaggccggcctggagaagttcaccctcctggaggagccccaagcggccttctacgactacaccgcgcgccaccgggcggacctggagcagacgctctccaacgtccggctggtgctggtggtggacgtgggcggcggcaccacggacttcacgctggtgcatgcgggcctgtcgcccgaaggccccatgctgcggcgactggccgtgggcgaccacctgatgctgggcggcgacaacatggacgccgcgctcgcgcgccgggtggaggagaagctcttcacggacggccgccgcctgtccgccacgcagtggacgcaggccatccaggccgcgcgcaccgcgaaggaggcgctgctcggtctcgccccgccggagaagcacggcgtgtcgctggtgagtggcggcagcaagctgctgggcggcacgttgtccacggagctgacgcgcgacgaggcgcaggcgctggtgctggacggcttcttccccctcaccacccccgctgacaggccacgccgcgccgcgcgaatggcgcttcaggagctgggcctgccctacgtgcaggacgcggcggtgacgcggcacatggcggccttcctcgcgcagcacgcggtggcgggcttagcggcgctgggcgagacggcgccagcggagggcgccctgccccggtcggacgccatcctgctcaacgggggcgtgttcaactcgccccagatttccgagcggctggtggaggtcctctccgcatggtggccgaacgcgccgtgcattcccctgctgcgggacgagtccctggagctcgcggtggcccggggcgcccagtactacgggctggtgcggcccggtcacgggctgcgcattggggcggcgccgcgcgtgcctactacgtgggcatgcagcgcgcggcggacagcgccgagcaacccgcgctgtgcctcatcccccgcggcttcgaggaaggccagaaggtcgacctgggcgagcgacccttctcgctcaccctgggccggccggtgcagttccagctctactccaccaccagcgaccgcatcgacaagcccggcgatttggtgccgctggcggaggacctcaagccgctgccgcccatccacacgctgctcaagggcgcctccaacaaggtggcggaggtgcccgtgcacctccaggcggcgctga

SEQ ID NO: 2670 - DNA, 678 bp, Myxococcus xanthus
atgcccctgcccctgcgccccgctccgctcctgctgctctgcgccctgctcgtccccgccgcggcctccgcccagcgcgtcaccgtcccggtggacgtgggggtggggcccgcggccttcgccttcttcggccccgtgttcgacgaccagcccatccacaccgggctgaagctctccgtggaggcggtgctggacaaggagtggatgaagaagaaccagcgtcgcgtgcccccgcgctaccgcaagtacgccaagagcctggatgaggtccgcatctccccgtccatcctcatcccggacgcgctcatcatctcccccaagctgcgcaataccggcatgtacggcgccacctggaagccgctgtcgctgggggtgccgctgacgtccagcccggcacggctgtcgctcggcgcggggctgctgctgacgtacgtctacatgcactcggacacgctgcccaacacgcacttcctgcggcccggcgcggaggtgggcatcgacctggagctccagctctccaagagcttcctgctaggcgtgggctgggagtccgcgttctacgtcccgcaggagttgggaggcctgggcctgcccgagcgcctgcgcgatggcatcttccacgtgggacaggcctaccttcagctccacttccggttcccctacaccgtgcgcttgtga

SEQ ID NO: 2671 - DNA, 1323 bp, Myxococcus xanthus
atgcgcgaatacaacttcgacgggctcgttgggcccacccacaattacggcggcctctcgcccggcaacctggcatcgcagagccatgtcggtgagcccagccacccccgggacgcggccctccaggggctggaaaagatgcgctttgtgtccgccctgggggtgggacaggcggtcctgccgccccagccgcgcccgtccctgcacgcgctgagggcgctgggcttcacgggctcggacgaggaggtcatcacccgggccgcgcgcgaggccgaacacctgttgcgcctgacgtccagcgcgtcctccatgtggacggccaacgcggccacggtggcgcccagcgcggacacggcggatggccgggtgcacctgacaccggccaacctgtcgcagatgtaccaccgggccatcgaggcggagacgacgcactcggtgctgcgcgccatcttctccaatgagaagtacttcgcggtgcacgcgccgctgccgggcagcgggcacttcgcggacgagggcgcggccaaccacacgcggctcgccacgcccgggcacgcgggcgtccatctgctcgcctggggccgcagcgcgtggcaggacgtgcaggggcccagccgcttccccgcgcggcagacgctggaggccagccaggcgctggcgcggctccaccagttggacgcgaagtcggtgctcttcccgcagcaacaccccgagggcatcgacgcgggggccttccacacggacgtgctggcggtgggcaacgagcggttcctgatgctgcatgagctggccttcgtggaccacgcggggctcctggcggtgctgcgcgagaagctgggccaggacttccgcgcggtggtggccacgaaggcggagctgccggcgaaggacgcggtgaaggcgtacccgttcaactcgcaggtgctgacgctgccggacggcaccatggcgattgtggcgccgatagagagccgggagacgcccgcggcgcggcagttcctggagcgcgtggtggccgaggacacgccggtgaaggccgtgcactacctggacgtgcgccagtcgatgaacaacggcggcggaccggcctgcctgcgccagcgggtgtggctcacggacgaggagcgcggggccatcaaggcagacgtcttctacacgcccgcgctgcatgactcgctggccggctgggtgcggcggcactaccgcgaggtgctgcggcccaaggacctgcaggacccgcagctggcgcgggagacgatgacggcgctggatgagctgacccggattctcaacctgggcagcgtctacgacttccaacgctga

SEQ ID NO: 2672 - DNA, 537 bp, Myxococcus xanthus
atgattcccgaagcgatacagcactatctgcgccgcaacggggtgcgtttcgagcggtactggcacccgcgtgccgtcagcgctcaagaagtggccgagtcgctgcacgtctccggctggcgcgtggccaagtccgtcatcgtgatggcggaccggcagccatggattgtcgtcgtccccgcggcgggcaccgtcgatttggaccaggtccgagacatgctgggtgcccggcacgtccggctcgcgaccgagccggaattctccggccactttcccgactgcgaggtgggcgcggaacctccctttggtgagctctacggcctgcctgtcgccgtggatgaatccctcagcctggcggaacggctgctcttccgcgcgggctcccacgaggagtcgctcgagctgcgcttccaggacttcgccatcttggagtggcccctggtggcctccttcatcgaggaggagcagcaactccaagccatccacaacaccggcgcgcccagccgcccccgtgaggaggcacacgcccacgtctga

SEQ ID NO: 2673 - DNA, 276 bp, Myxococcus xanthus
atgcgccgcttcatcgtcaccgccgccctcctctgttccgccctgtccggcctcaccggctgcaagggcgcctgccgcgagctgtccgagaagctgtgcgactgctccatcaactcggtggagaaggagctgtgccttcgccgcgcctctcaggaggaaaaccgcgtggagcccaccgccgaggatgaggccgtgtgcgaggagcgactggccggctgcgactgccgcgccatcgagaccgacgaaggcaagcgcgcctgcggcctctcccgctga

SEQ ID NO: 2674 - DNA, 2571 bp, Myxococcus xanthus
tgggcgtggacggccagtcccctcatgcccacgcataccaacgcgcaggccacgcccgtggtggtggacgtcaacgcggatggcgtccccgacgtggtgttcaacagcttcgagggctggaacttcaagacgaacggcgtgctgcgcgccatcagcggcgcggacggctcggacctgtgggcggtgacggacccggcgtaccgcacccggggctccgccagcgtcgccgcgggcgacatcgacggcgacggcaaggtggagctgtgcaccgtgccggagagcgcccagggcatcatctgtttcgagcacaccggcgccttcaagttccgcgcggacggccccccgctcgactggggcggcgtgtccctggccgacctggacggggacgggtcggtggaaatcatcgccggcaaccacgtctacgacagcagcgggacgctccggtgggtggggagcgacggcgtgggcagcccggccaacgacaccggaccgctggcgttcgccgtggacctggacggggacgggctccaggaggtggtgaatggccgcgccatctaccggcatgacggcacgctcaagtgcaaggcggcggagctgggccacgggctcgcgggcgtgggcaacttcgacgcgggccccgagggcgaaatcgtcgtggtgtggggcggccacgtgtccttgatggacgcgaactgcaaggtgaagtggaccgtgcagcacctgggcggcggcgtgggtggacctccgaacatcgcggacttcgacggggacgggcagccggagattggcgtggcgggtgcgtcccactacgccgtgttcgagtcgaacggcacggtgaagtggctgagccccacgcaggaccacagctccaaccgcaccggttcctccaccttcgacttcgagggcgatggccgcgccgaggtcgtctacgcggacgagacggcgctgcgcatctacgacggcgtgacaggtcaggtccgcttcgaggcgccgcacagctcgtgcaccgcgtatgagaatccggtggtcgcggacgtggacggtgatggcaacgccgaaatcatcgtcgcgcagaacacggcctgcggctacggcgacttccagggcatccgcgtgtaccgggaccgcaaggacggctgggtgaacacgcggcgcatctggaaccagcacgcctactccgtcaccaacgtgaatgacgacggcaccctgcccgcgcgccccgtgagcaactggctggcgccggggctcaacaccttccgcaccaacagccagggcacgggcaccgtgcggcccttcgcggcgccggacctcgccatcgggcaggtgacggccacgtgcacgggcgagggcgcggtgatgctcggcgcgcgggtgcgcaaccagggggactcggcggcctcggcgggggtccaggtggccttctaccaggacgcggtgggcgaaggcggcacgctcctgggcgtggccaccgtgccccacaagctgaaagcgggcgaagagacgtccgtggagctggcgctcgacaccccggagagtggctgggtgctggtctacgcggtggtggatgacgacggcaccggcaccggacgcgagctggagtgccgcgaggacaacaacgccgcgtcggcgcaactgaagctggcgtgcgcaccaaacgagcctccagtggcgttgtgccgggacgtcgtcgtggaggcggacgcgcagtgccgggcctcggccaacgtggaccacggcagccatgacccggacggacagccgggccccttcacgctgacacagacggcgcccgggcccttcggcctggggcgacatgccgtgacgctgacagcccacgacggcgaagacagcgcggtgtgccaggccacggtgaaggtggtggacacgacgctgccgtccatcctctgtccggcgccgcaggtgctggagtgcgtggcgggcggcgcggaggcgacctacaccgctcgggcggaggacaactgcgggccggtgtcggtgacgtgcacgccgccggatggctcccggttcccgctggggcgctcggtggtggactgcaacgcggtggatggctccggcaacgcgtgcggctgcgccttctccgtgacggtgcgggacacgcgggcgcccgtgcccggcgcgtccctgggcaagcggctgtggccggcggaccaccagtaccgcacggtgacgctggccgagtgcgcggcgcccgcgaaggacgcatgcatgggagacctgtcgttggagcggtacggccgcatcgtccgggtgacgtcggatgagtccgaggacgtcgcgggcatctgcgacggcaccacttgcgacgacatcgacgtgcgggtgaatgccacctccgtccaactgcgcgcagagcgcgacgacaccggggatggccgcgtctacacggtgcactacgtggtggaggacccgtccggaaaccgggccgacgggcgctgcaccgtggaggtgccgcgggattcggccggccagcaggtgcacgacagcggtccgaagtactgcgtgggccagggctgcgcgccgggcctgggcggcagcccgctgtgtccgtga

SEQ ID NO: 2675 - DNA, 669 bp, Myxococcus xanthus
atgagcgcgaggctgatcgccgagggcctggagaagagtttccgcggccgcaagaaggtggtggccggcgtgtccttcagcgtggccgccggggaagtggtgggcctgctggggcccaacggcgcggggaagacgaccagcttcaacatggtggtgggattggtgtctccggatgcgggacgcgtgcgcattggcgacgaggacctcacgcacctgcccatgcatcgccgcgctcgccggggcgtgggctacctgccccaggaagcctccgtcttccgcaagctcacggtgcgcgacaacttcctggccgtgctggagctccagaaggacctggacgccaaggcccgcgagcagcgcgccgacaccctcctggacgagttcggcctcacgcacgttggggagtccctggggggagacctttcgggcggcgagcgccggcgtgccgagattgcccgcagcctcatcccgcagccccgattcatcctcttcgacgagcccttcgccggcgtggaccccatcaacgtgggcgacctccagcggcagatcttcctcctccgcgaacgcgggttgggcgtcctcatcaccgaccacaacgtacaggacaccctgtgtatctgtgatcgtgcgtacatcatcgcacaggggcgaatcctggaagagggcaccccg

SEQ ID NO: 2676 - DNA, 609 bp, Myxococcus xanthus
atggccttcttcgtcgcgcagcccgcgcccgcggtcgccgccacccccgcgcagggcacgcctcccgccgccgtggggggctctgccccctccgctgggacggggacccgcgccccgggccccctgggcggcaaggagctgacggagcccgttcaaatcaacggcgacaacgtcaccttccagaagtcccaggccaccctcaccggcaacgtgaaggtgaagcaccgcacgctcgacctgaagtgtgaccggatgacggccaactacacccctcaacgcgaggtgacgcgtgtggtgtgcacgggcggggtgcatgccgtggacggcgaccgcatggccaagggcgagcgcgctgaatacgacgtgcccagcggcgtgctggtggtgacgggctcgcccgaggcccgccagggcaccacgcacatgcgcgggacgaaggtccggctgacgctgggcaacgagcggctggaggtggagaacgccgtcatcgtcttcgaatcgctgccctccaaccccaccccggccaggcgcaaggggcggcagtccgcgccccgtccggccccgtcctccgggacggccccctccgcgcagggaggcacggctcgatga

SEQ ID NO: 2677 - DNA, 252 bp, Myxococcus xanthus
atggaggggagcctcgcgtccaagcaggtggtggcctcgggcggtgtcatcatccgcaccgggaagggcatggaggcccgcactccccggttgacgtacgacgccaccacggagcgggcgcatggaaacgagggcgtgacggtgaagggacctgactatcggctgagggcggaccgcttcgagctgttcttcccggacgagacgttcaacttcgcgggctcggtggagtccgtgctgggagcgccagagtga

SEQ ID NO: 2678 - DNA, 819 bp, Myxococcus xanthus
tacaccctggccggaggggaacgccgcaaggccctcaagtccctttccgtggccttcccggaaaagtcggatgcggaccggcaggcgctggcccgcgacgccttccgccacctggccgccgccgcgctggaggtggcctgcacgggcgccctcgacgaggccctggagcgcctggtcgcctggccggacgccgaccggcaggtgctggagacggccctggcccgggggcgcggcgtcgtcttcgtgtccgggcacgtggggaactgggagctgctcgcccgccgcgtggctcgcgccggctaccccagccagagcatcgcgaaggagaccaccgacccccggctgacggagctggtgggtcagttccgggcccggggcggggtgcggagcatctggcgcggccaggaaggcgctgcccgggccatgctgcgcgccctgcgcaacggcgaaatcctcggcatcctcatcgaccaggacacgaaggtgcagtccctcttcgtgcccttcttcgggcaactggccgccacaccacgcgccgccgctgacctggccatccgcacgggcgcggcggtggtgacgggcttctgtcaccgcgaaggggcggggtaccgcctgtccatggaagaggtcccggtgccccaggacacggaccgcgaggcggccgccctggccctcacggccgccctgtccagccgaatcgaagccgccatccggacgacgccggaacagtgggtgtggatgcaccagcgctggaagacgcgtccgccggtgagcgaggacgtcccacttccggaggcggcgcccgcatccgccgggtga

SEQ ID NO: 2679 - DNA, 1740 bp, Myxococcus xanthus
atggtgggtgcgtacacggcggcggacggcctgtgggcggaggcgcgcaccgcggacagcgtggagaagctgcgccagtccaaggtggcactatggccgatgctggcggacgccgcgcgggcgtttcccgtgctgggcatggggcgcggcgccttcgaggcggcgtttccgcgctaccagtcggagcccaatcccaacaccttcacgcacccggagaacgcggtgttgcaggtcgcggcggagctgggcgcgctggggctggtgttgctggcggtggccgtctggggcttcttgcggctgctgcgccgagaggggttggagacagtggacctggcggcgctcgcgggcgtggcggcgctggcgctgcacgacctcttcgatttcagcttggaattgcccgcgtgcccggtggcggcgttggtggcgctgggcgcggtggcgcgtccccgggagcgggccgtcgaggagaaggcgtggtgcgcgcggccctcgggcgcggtgctggggacggggttggcgctcacggcggtggcgctggtggcgctggtgcccggccgtcatcgcctgggcgacgcggaggcggagctggcgcggctcgtcacgtcgggggcatccgcgcgggaggtccacgcgcggggactggcgctggtggaccggcacccctcggactacctgttgtaccggctggtggcgtcggcgcacgcggcgcgagggcgtgagggggcaggggaggcgctggccctggtcaaccgggcgctgtacctggcaccgctggatgccagctcccaccgggtggcggcgcgggcgttgctggcgttgggccggagcgcccagggcttcctggagtaccggctggcgcacgaggctggggatgccaccgtgctgctgggcgaggccctgccgcaggcggagaccctggcctcgctcacggtgctgacgccgcggtcgccggcgaccgcggtgcggttgctggacgcgctggccaacacgccggggcggttggcgctggcgctggactactcgggctgggcgcgggagcacttcgcgggtcagccggaagccgcggcgctgtgggcgcgcgaggcccggttgcgaatcctgcgaggggacctggagacggcggaggccgcgcgggcgcaggtggagcgcctggcgccggacgcgctggacacgcacctgttgcgcgcggaagtgttgcgggcgcaggggaagcgggaggaggccctgcgtgtgttggagcaaatgttggcgcgcttcccgggcaacgtggcgctgtccttccagttggcggcgcagcaactggatgcggggttgactcggcgggcgaaggacacgctccaggcgctggcgcccttcatcacggactacgcccagcgcgcgcggttgctggccatggaagcggcgtgcctggagcgcgaggggctgctctcccacgcgctggagcggcggcagacggcggcccggctcgtgcctggcgcggatgcgttcttcgcggtggcgcggacccaggaggcgctgcgtcgctatgacgcggcggcgcgttcggtccacgagggcatgcggcatctccccgcgggcgcgcgggccgaggcgcgggcctgggtggcgcggctggaaggcgcggagcgcgagcgcgtggattcgcggcgcaagacgttgtcggaggacccgcgcgaggcggagctggagtacctgctgcgtggcccggatgtggatggcgaggctcgggacgcgcattag

SEQ ID NO: 2680 - DNA, 348 bp, Myxococcus xanthus
atggcgtactcgggctacgtgctgtccccgttgctgctattgggcattcccctcatcatcgtcggcatgagctcgtcgaatgacgacgacgccggcaccttgctggccctgggggtgggcacgacgctgggcggagtcgcgggggtggggctgctcatcgcgggcatcgtcacgggttccaagcaagcgggtatcaaccgggcccaccgggaaagcctggttcgcgagcgcatccgcctggaggatgagttgcgcgacgtgaaggcccgccgggacgcgcgaggggccatgcagacgcggcagtggacgccgcgcgctggcatcccgctggtcgccttcgccttctga

SEQ ID NO: 2681 - DNA, 435 bp, Myxococcus xanthus
atgcatctggtcgtcgccaacgaagcacagaaggccgagagagaccgccacacctataccgcctgggggtcgccgctcaccgtcgagcagttcctcgagcgggaacagcggctgcgcgcccatccctggagccgggacaccatgcgcacctggctgctgtgcgatgacgccggccgcgtgctcacctcgtgcgagacgttccgcacgcccagctacctgcgcggccccgactgtcagacgacgcgcggcgacagcttcgtcatcgccagcgtctacaccgagccggccctgcgcggacacggccatgccacgcggctgatggaccaggtggccgcggagcttgagcgcacggagccggacgcccaggccgccgtgctctactccgacgtgggcgcccgcatctaccggggctccgggtacctgggagtccccgcc

SEQ ID NO: 2682 - DNA, 558 bp, Myxococcus xanthus
atggcgctcaagttcaacccgctggcgcggctgccggagttcctcttcggcgtcctgctgggctggtgcttcgtgcgcgagcgcgcggcgggaggggcgaagggctccggcgcggtgctggcggcgctggggacggcactgctggtggcggcgggcgcggcgggctcgagggtgccgtacccgctgatgcacaacgccctgctggcgcccgcgtcggggctgctggtgtacgggctggcgcggggcggaggcgccctgggctggctgctgtcacggcccacgctggtgaagctgggaggcgccagctacgcgctctacctgctccagtacccggtgtcggaggcggccaagggcctgggggcttgggtgtcgccctgggtggagctgcgcacgcccgaaggactgctggccaccgtgttgttgctgggcgtgcccgcgtcgctgtgggtgcaccgcgccgtggagacaccgctgcgctcacgcatccgcgccgcgctgacgccctggggggagggggcgtcgcgcgagcccgtgaagccggtggtgtcggggacctga

SEQ ID NO: 2683 - DNA, 1299 bp, Myxococcus xanthus
atgcgtattgccatcatcggaaccggctacgtcggactggtcgcgggcacctgtttcgcggactcgggtaacgacgtcacgtgcgtggacatcgacgagcggaagatccgcatgctccaggcgggcgaggtgcccatctacgagcccggcctggaggagctcatcaagaagaacgtgcgcgagaagcgcctgttcttcacccgggacctgacggaggccgtcaccaacgcccaggtcgtcttcatcgccgtgggcacgccggaaggtgagagcggcgacaccgacctccagtacgtgctggccgccgccgagcagattggcaaggcgatgaagcagtacacggtggtggtggacaagagcaccgtgccggtgggcaccgcggacaaggtgcgcgaggccatccgcaaggtgacggacatcgagttcgacgtcgtctccaacccggagttcctcaaggaaggcgccgcgctggacgacttcctcaagcccgaccgcgtcgtcattggcgtggactccgagcgcgcccgcaaggtgatggcggacctgtactcgccctttgtgcgcaccgagaacccggtgttgttcatggacacgcgctcggcggagctgacgaagtacgcggccaacgcgatgctggccacgcgcatctccttcatgaacgacatcgccgcgctctgcgagaaggtgggtgcggacgtggacttcgtgcgcaagggcctggggtcggacaagcgcatcggctatccgttcctcttcccgggcgtgggctacggcggctcctgcttccccaaggacgtgaaggcgctggtggccaccgcgcgtgactacggcctggagctggacctgctgcgcgcggtggagcgcaccaacgagcgccagaagaagctgctggtgaccaaggcggccaagcactacggctcgctggagggccgcaagttcggcgtgtggggtctggccttcaagccgaagacggacgacatgcgcgaggcgccgtccatcgaggtcatcgagggcctcatcggcaagggcgcccaggtgattgcgcacgacccggtgtctccgcacacggccaagcgcgtcttcggtgatcgcatccgctacgcctccgtgccctacgaggcgctggagggcgtggacggcctcttcgtggtgacggagtggaacgagttccgccacccggacttcgagcgcatgaagacgctgatgaagtcgcccgtcgtgttcgacggccgcaacgtgtacgacccggcgcgcatgcgtgagctgggcttcacgtactacggcatcggccggcggtag

SEQ ID NO: 2684 - DNA, 867 bp, Myxococcus xanthus
atgcagggcctggcgcccctggcggcctacaacctggagtaccggctgggcgcgggcaacgcgccggagtgggctcgggacaaactgctcagcatctatcagggctccgtcaacgacaacgtgatgaagctcgtgaacttcaagcgcatcgtgggcgcgctggaggcacgcaagctggtgctgatgggggccgcgtccttcgcggactcgctctatccgcacgtgggcttccggcccgtgccggagctgcaaatcctgatgaagcgcctgcacgtggacggcttctcgggcttcctgtcccaccacgagttcgccccagagcccgacacggagaacagcggcgccacgaaggtggtgtccgacgggcgcacggtcatcctgctctattcggacgtgctgggcccccagcgccgcgaacagacggcgggcatcctcgagcgggcgaagcccatgcgcgtgtatggcccctccctctaccgcccggagctggaggacgcggtgctgctggtggcgctggagcatgcgcgccatggatacgcggtgccgtggttgtccttcatcgacctgcgcgagctcgtcaccggcgcgaagtggatgggcggcgtgtactcgcgtccgttggatgtgccggtgctgctggcccgggccgcggagtggcgcctggagcgggccctctacacgtccctgtcgattgtcgcgcgcttgttcccggacgccgccgcggacgccaccgccgcgctgccgccgctgcgccgggcgacgcgggagctgttggagcggacggtggtgggtcctgtatgcacccccggccggacctcggccctcaaggggatggagcgggttcgccgcctgctcacgggccagtaa

SEQ ID NO: 2685 - DNA, 312 bp, Myxococcus xanthus
atggtggtggagcgggcacgcggcacggccttcccacatgcggcctggtatgcgtgggccgtggcgcggcggctcctggcggcgccggtgccggacgaggcgctggcgccgctggctccgcctcgctggcagcaagtgctcgcacggcgttttttctccgacgcgcggctgctgggggcgtcgctgctggatggccggaccgggtggatggcggcgaagctgctgctggcgccacggatgggctccgtggcgcgatatggcgtccggcgagcacggaacgccgtgcgggcgaggctgcgccgtccaggctga

SEQ ID NO: 2686 - DNA, 420 bp, Myxococcus xanthus
ggcgtcctcgccatgggactgtggcccacgcgcggcctgcagatggtggccctggaggacctcgcggcattctccgtccgcatcatggaggagccggagcgcttcgaggaacaacgcatcgaggtggcctccgacgaggtgacgggccagcaggccgccgggctgctgtccatggtgagcggccaccgcatccactacgagcaacttcccctggactacatccgcgagcgcagcgaggacctggccgccatgtacgagtggctggaccgcaagggctaccaggcggacgtcctcacgctgcggcaccgcttcccggaggtccgctggcacaccttcgaggactgggcgcgtggacaggactggagcgccctgacttctcccgcgtggccccatgccgccgcggagcccgtatccccatga

SEQ ID NO: 2687 - DNA, 243 bp, Myxococcus xanthus
atgttcagtcgttcggaaatccacaaggggatgaaggtgcgcggcaacgacgggcacgttctcggacgcatcatcaagatgacgggggatgaactcatcgtggagaagggcctcatccgccggcatgacttcgcggtgtccctggcggacgtgcgtgaagtcgtgggcggagaagtcctgctcaaccacggacgggacagcctcttctccgcgccccgggaagtcccgcccacgaagcactga

SEQ ID NO: 2688 - DNA, 1872 bp, Myxococcus xanthus
atgccccagttgctcgacatgctcgcggacctcatcgaccacggcccggacgaaatcctcaccacggtgccggacgagcacgcgatgtcccggctggacgccggcttcgacctgggccaggtggcgtccgagtacgcgctcctgcgcaagtgcatcctccgcaggatggacgccgaagcggcctaccccgcgccgggcgagttggagcggatggaggacgcgctggaccggattgtcacccggacggtgacgtccttctcccagggacggcagcgcatcctccaggccctggaccggatgacgcaggccacgctggacagcccttccatggccagcctcccctcgcggctgctcaccgtcctggcggagtccgcgctctcggtcgactcggcggcgttcgtgctggtggaaggcgacgcgctggtggtgcgcgccgcggtgggcctgggcgcggacgaggcgctcggcgtgtcgctggagcgtgggcaaggcttcgtgggcgaggtgctccgccagcgtcagcccctgacgctgcgctcagcgtccacggaccctcgcgtggcgctgcccacgctgaagcaggaaggactgcgcgccgtgtacggcgtgcccctgctggatggcgaccaactcctgggcgtggcgtacatgtgctcgcgcaccgccttcgtcttctccgagccggacgccctcttgttccggaccatggcgcagcgagccaccgcgcacctggtgcaggcccggctccgggcccgcgagcgccaggcccacgcggacgcccagcgctcgctggcgcaactggacgcgctgctggcctccacacctctgggcatcgcccaactggaccgggagttgcgcttcgtgcgcatcaaccaggccttggcggacatcgatggccactcgccggaagcccacctgggccgccgcttccgggagatggcccccgtgacggccgtgggcacgttcgagcccatgttccgccgcacgattgagacaggtgaacccgtggacgccgtcgagttcaccatccctggagatgcccggaccttccaggccagcttccacccgatccgcacgcccgaccaaggggtgctgggcttgagctgcacggtggtggatgtctcccaccacaagcaggccgaggccgtgctccagcgggcggtggacttccgggaacaactcatggcggtgttgggacacgacctgcgcaacccgctcaacgccatcaacgcctcggccttccaactgacgcggtccgaggacctgacaccccccgagcgtcgcgccgtggaccgcatccgcaaggccaccgcgcgcatggggcgcatgattacggacatcctcgacttcgcccgcacccgcctgggcggggggcttcccgtggcccgccagcccatggacttcgtggaggtatgccaggcgacgctggaggagctccgggtcagcgccccggagcgctcgctggtgttcgaggcgagcggagacacccgagggaactgggacccggaccgcgtgtcacaggtgctgggcaacctggtggccaacgccatccagcatggccaggaagacagaccggtgtgtgtcacggtgcgcggagaggcggatgaggtggtgctgaaggtccacaacaccggcgagccgattgcggccgagctgatgccgcgcctgttcgacccgttcaagaacatgcccgcagccgcgccaccgcaggacgtcgcgaggaagaaacgcagcctgggcctgggcctctacatcgtcagccagattgtcggcgcacacggggggcacgtggaggtccgctccaaccgggaccagggcaccaccttcaccgtccactggccccgcaccctcacgacgctcggggacgcatga

SEQ ID NO: 2689 - DNA, 657 bp, Myxococcus xanthus
atgttcttcaatccgaccaagaagctgaggattccgaccccggaggaagcactgccgggccgctcggatgtgatgcccgtcccggagaagcacgaggtgctgggcacgcccatcaagggccccgtgccggaaggcctggaggaggtctacttcggcctgggatgcttctggggcgcggagcggaagttctaccagacgcctggcgtgtacagcacggcggtgggatacgccggaggcccgacgcccaaccccacctaccgcgaggtgtgcagcggtctcaccgggcacaacgaggtcgtccgcgtcgtcttcgacccgaagaaggtgtccttcgagcagctcctgcgcgtcttctgggagagccatgacccgacgcagggcatgcgccagggcaacgacgtgggcacgcagtaccgctccggcatctacttcaccagcgaggcccagcagcgcgccgccgtggcgagccgtgacgcgtaccagaaggcgctggcggcccggggcttcgacgccatcaccaccgagctgctccctgctccgcccttctatttcgccgaggactaccaccagcagtacctggagaagaacccgggtggttactgcggactgggcggcaccggcgtgagctgcccggtgggtgtgggcgtcaacgcctga

SEQ ID NO: 2690 - DNA, 804 bp, Myxococcus xanthus
atggctgcgtatctcgttcagaatcagtggggtggttcgcaagcgacctggaacccgggtgggctctggctcatcggtgcccgggacaagcagaacgtggtggccctcgacatcaagtccgacgacggcggtaagaccctgaagggcaccatgacgtacaacggcgaaggccccattggcttccgcggcacgctgtccagtgccaacaactacacggtggagaaccagtggggtggcacctccgcgccctggcagcccggcggcgtgtgggtgctcggcgcccgggacaagcagaacatcgtggccgtcagcatcaagtccaacgacggaggcaagacactcaccggcaccacgacctacaacggagagggccccatcggattcaagagcgaggtgactgatggcgacacctactcggtggagaaccagtggggcggcagcgccgcgccctggcattctggcggggtctgggtgctgggcactcgcggcaaacagaacgtcatcaacgtcgacgcaaagtccaacgacggaggcaagacgctctcgggcaccatgacgtacaacggcgagggccccattggcttccggggcacgttgacctcgccggacacctacaccgtggagaaccagtggggcggcagcaccgcgccctggaacccgggtggcttctggatgattggcgcccgcaacggccagaacgtcgtcgccctcaacgtcgcgtccagcgacggcggcaagacgctggctggcaccatgatctacaacggcgagggccccatcggcttccgcgccagactcggctga

SEQ ID NO: 2691 - DNA, 1140 bp, Myxococcus xanthus
atgacggagtggatgcccaagccgaaccccgcggtcgacctgcggacgctggccctcagcccagaggagggcttcgtgctctcccgcctggacggcgccacctcggcccggaacctgcccgcgctgacgggcctgccccccgagcggctgcggaccatcctctcccggctcatcacccagggcgcgctgctgcccacgcccaccgcgagcccggcggcacctgtcgccgctccgccagtggccttcgagccccagcgacggacgtcccccgcggcccccgagcccgaagcagacctccccgtgctcgacctgacgccgctggacgccgcgcccgaagcagacctccccgtgctcgacctgacaccgctggaggccgcgcccgcccccgacaccgcgcaggacgccgagccgtcctccgaagacgagcccgaagccgccctgggcaactaccgccagctcttcgaactgcggctgcacccgctccccgaggaccagcgcatcgcccatgcccacgcggcggaggaccccatcctctccgcgctatgcttcgacccggtgcccgccgtcatcaaggccgtgctggagaacgcgcgcacgggtctgccccatgcgcggctcgtggcgcgctaccaccgcaaccccgtcggcctggaggcactgtgcgcccgggcggccttcgcggtggacacaggggtgcggcgctggctcgtgcgcaacccgcagctccccgccagcctcttccggcggctgtggagcgcacgccggctcatggagctgcacaaggtgggcaatgaccgcgacgtgccggaatccacgcggcgcgcggcgcgcgaggtgctccgccagcgcttcgccagcggccccgcggaggagaaggtggagctcatcctcaacacggaaggccgtgccctggcggcgctcatcggcctgccggtggatgggaagacagcgtcgctgctgtgcggacgcacctaccgttcgcccatgctcatccagaacatcgcccgctggagcgcggccccgccggccctcatcgcgcacttgctgaagcaggaagcggtgcggcgtcagccccaactgcgcatgctgctggcccgccaccccaacgccccagcggacgcgaagcgcggcggcgcctga

SEQ ID NO: 2692 - DNA, 993 bp, Myxococcus xanthus
atgctttccgctgccttcttgattgctacgtccctgcaggcccagacgcctgcgcccacttcttccacgccgccggctcccgccgcggagaccgcgcccgccgcgcccctcagcgtggaggagcgcgccgccatcgccgccgagcgcgccgccatcgcggctgagcgcgccgccgaggccagcgcccgtgccgccgaggccgccgagcgcgccgccgccgccaccgttccgcccccggccgccgcggccgcggccgctcccgccaccgacaagaagcagggggagtgggacgtcaccgtcggcctgggcctcatctcgctgacgggtaacgcctccaccctgacggtgagtggcctggccagcgcccagcgcacgacggaccactggatttacgccatcaagtcctacggctcctatggccgcagccgtccgcccgaggtgacgggcgaggaggctgtgtcccaggtggtggcgttcaacgcgggcctggagctgcgcggcgaccggcgcttcaccgacgtcatcagcggctacctgctggggggcgcggagacggaccacgtgaagagcgtggagtcgcgcaccttcggcgaaggcggtctgggcgtgctgtggtgggacgagaagaaggagaagggccgcgagtcctacctccgcacggacgccgccttccgctacgccaacgagacgcgcttccagtactaccccacgcggatgaacctgccggacgtcgacctgggtggccctcgcttcggcgccgtgttccgctacggcctggcgcagaacgtcaccttcaaggaggacgtggaggtgctggtgagcgtcatcggcgactcgcgcatgctcttcaacagccagacgcagctgtccgtggggctcaccaagcagctgtcgctgggcaccagcttcctggtgaagcacgacagcgcgccgcctccgggcaaggtgtccacggacaccgcgctggcgctgaacttcgaagtgttgctgtag

SEQ ID NO: 2693 - DNA, 603 bp, Myxococcus xanthus
atggcaacgcagcaggcaggcctcgacgccaacgccctcaaccagctctttctcgacgcccgcacccacaacgcgtggctcgacaagccggtggcggacgacgtcctccagcagctctacgcgctcacccggatggcgcccacggcggccaactcgcagccggtgcgcatcgtcttcgtgaagagccgcgaggcgaaggagcggctcaagcccaccctgtcccctggcaacgtggacaagacgatgaacgcgccggtgacggccatcatcgcgtacgacaccgcgttctacgaaaagtttccccagctcttccccttgcgcgacatgaaggcgggcttcctcgccatgcccgcggaggcccgcgagaagacggcctacatgaacagctcgctgcaggggggctacttcatcctcgccgcgcgggcgctgggcctggactgcggccccatggcgggcttcgacaacgcgaaggtggacgcggcgttcttcccggaggggaagtggaagtccaacttcctcatcaacctcggctacggcgacgcggagaagctcttcccgcgcaacccgcgcctggacttcagcgaggcgtgccgcatcgagtag

SEQ ID NO: 2694 - DNA, 1836 bp, Myxococcus xanthus
atggccgctgagcgtgagccgctggagccgctgaagccgccacgagaggacacccccgccgaggacctgcgtccctacgctttgtccccgcgcgagggcctgccggtgtcggaccagagcatggcggcgcatccccggaagcaggcggacatggtgcgctggcttcatcccgcgcagttgctgcgcacgggcctggacgcggtggttgcggccgtcttcggcgcgcgcgcggaccaacggctcatcgaagcggtggtgcggccgcaggtgccctacttcgactactcgcaggagccgatgccggagggcggcttctggctggactatgtgtcggacaccggcgacggctggaactccacctacgcggtggcgcggctgctggcgctgccggagctgacgctgtccgtgcagggccagccccacgcggactcccacgccacacagcgaggacggctgctcgtccatggcggtgacggcgtgtaccccggcgccagccgcgaggtgtacgacgagcggctcgtccagccctatgaggcggccatgcggcgctcgcatgcgcccagcccggacctgttcgtcattccgggcaaccatgactggtacgacgggctcggcgccttcctgcggctgttctgcgcgaaccggtggattgctggccggcgcacgcggcagagccgcagctacttcgcgctgaagctgccccagcgctggtggctcatcggcacggacgtgcagctcaacagcgacatcgacgtgccgcaggtggagtacttccgcgaagtggccagccacatgggccccgacgaccgcatcatcctctgcaacgcggagcccgcgtggattctggccgccaccgagcggcgcaagggcagctacctggagaacaacctggagtacctccaggagaaggtgttcggccggcgcatcaacgtcttcctcgccggggacctgcaccactaccggcggcacgaggacgccggcgggcggcagaaaatcaccgcgggcggtggcggggccttcctccaccccacgcacgcgccctccgcccacgtcctgcgggacggctacacattgcagaagagcttcccggacgaacggacgtcccggaagctggcccggcagaacctgctcctcattcgccacagtcctctgttcggattgatgaccggcatgctgtacctgctgctggcactggcggcctacgcggaggtgggctcgttcggaatatcgcagctttcagacgtcatcctggcggtggccaacagcatggtggcccggccgtggacgctggtgctgggcatggccaccatcggcgggctcatcgggctggcggactcggccttcggcaagtggcgcacgctcgcgggcacgctccatgggctcggacacatcgccgcggccttcttcgtggcctggggcgccacctacttcacggtgagcggcctgggtgtgtgccccgagctcgccgcggacggcatccactgcgaggcgggctggtggcacctggcgggcaagttcctgctgtcctcgggcttcaccttcctgggcggcttcctggtggggcccttcgtcatgggcctgtacctgtggctgagcgtaaatcgcttcggcgcgcactccaacgaggccttcatctcgctggcgcttccggactggaagaacttcctccgcatgcgcattggtgaagacggacggctcaccgtcttcccggtgggcatcgagcgagtgccccgcaagtggaaggagacccacgccggtccctacgcgcccgcgttcgacccgaatgacccgaaggccaccgcgcccgtactcatcgaaccccccatccgcgtgtga

SEQ ID NO: 2695 - DNA, 607 bp, Myxococcus xanthus
atgagcgcccctgtcttcatctacctgaccccgcccgacggactcgtccccctgctgacgccggcgcggctcgcggccttccgcgactggctctggcgggagaacacagagcacctgaacgcggaggacctggccgacattgagtcggacgaggagctgatggccctcctcggcctcgtggaccacctgctccagcagggcgccgagtccctgagcaagccccccacccgccacgcggacgcgatgctggacctgctcgatgagctgtccgactacttcacccgcgaggaactgggcattccagagggcatggagctggcgacggacctcaagcctaccgacaagcaagtccgcgcctcggacgtcgtcatcggagagaactgtcccaagcggacgttcgagctgtggcgtcacctcgtctggggccgggcgccggaccggaccgtggcggagggcattggcctgcgacgcaacttcccctccatgggctactggacggccgcggaggtccggcacgtgcgcgacgacctgcgccagcacctgagcggggcccctgactacatgcccatgaacaactgggcccgcttcatgacgtcgctccgcctaa

SEQ ID NO: 2696 - DNA, 231 bp, Myxococcus xanthus
atggtggtgggcggactggcgtcggggacgtcgcgaggcgcggcggtggcgctcgtgggcctggggcccctggtggctgcggccctggactgggtgcccatggcggcgctcttcggtctgcccatggacggcccgacgctgcggcgcgagttgggtgtgtccgacgaggcgtcgttgttggagggcttccctcgcgcgtccatgcgggacgtctcgccgacgcttcactga

SEQ ID NO: 2697 - DNA, 1389 bp, Myxococcus xanthus
atgaggcacagggtgcgggggctcctgtcgcgcatcggcctgacgcggcccgcgctgcgcgcgtgggcgatgtacgactgggcgaactcggccttcatcaccaccgtcgtcacggtggtgttcccgctctactacgcctccgtggcggcggaggggcttccgcgcgaggtggccaccagccgcttcgccaccgccactgcggtggcgctgagcgtggtagcggtgttgtcaccggtcctgggcgcgctgagcgaccgggccggacgcatcaagcacatgctgggtatcttcgcgggcctgggcatggtgtccacgctggcgctggccacggtggggccgggtgattgggcatggggcctgctgctcttcggtctgggcaacgtgggcgtgacgggcagcatcgtgttctcggacgcgctcttgcggcacatcgccagggacgacgaattggatcgtgtgtccactgcgggctacgcgctgggctacctgggcggcggtctgctgctggccgcgcagttggtgctgctgatgaagccccagtggttcggactggcggacgcgggggccgcctcgcgcgtggccttcgcctccgtggcggtgtggtgggccctcttctcggtgcccctcttccggcgcatccccgagccgaaaccggacgtgtccatccaacgtcccccgctgtccctgcgcggcatcttcacgcagttggcgggcacgctgggcgggctgcgccagcaccgtcaggccttcctgttgctggtggcctatctgctctacagcgacggcatcggcaccatcatccgcttgtccacgctgtacgggacggagctgggcattggccggggcgcgctgattggtgcgttgctgctgacgcaggtggtgggcgtgccgtgcgcggtgttgttcggccgggccgcggggcgggtgggggtgaagcgcgcgctgatgttcgccctgtcggtgtacgtgggggtgacgttcctgggctacttcatgcgcacgccggtgcacttcttcgcgctcgcgttgctggtgggcatggtgcagggcggcagtcaggccttgagccgttcactcttcgcgcagatggtgccccgggacagggcggcggagttctttggcctcttcagcgtcttcgaaaaggtcaccgcggtggcgggcccgctggtgttcgcggccacggtggagctgacgggctccagccggcaggcggtgctgtccctgctcttctttttcgtgtcgggcgcggcggtgctgtcccgggtggacgtggccgcggggcgacgcgcggcccgtgaggcggaggcgcgtgccggatggcgcggcgacggtgcaccggaggccaccgctgccccggagggcgcgccggacgcgagccgcggcgtctga

SEQ ID NO: 2698 - DNA, 981 bp, Myxococcus xanthus
ggttagggtgtctgcaagatgcgcacgctcctgctgacccgctccgacgtctcccgcaacctgcaggctcctctcttgctggaggacatgcgagaggccttccgcaccgacgccctggcacgcaccgtggcaccgcagcgcgcccgggcccccctccatgccgagggcaccgccctggtgctgttccctggcagcctgccctccatccccgcctactccgtgaaggtgcacgcgaagttccctggccagtcgccggcgattcgaggcgtggtgcacctgcacgacgtcgctaccggcgaggtgatggcggtgatggacgccggccacctgacggcggtgcgcacgggcgtggtgggcgcgctgtcggcggacgtgctggcgcggccggacgcgagccgggtggcgctcatcggcgcgggccggcaggcggtgctgcagctcaagtcgttgcggctggtgcgctcgctgacgcacgtgcgggtgttcgacacggcgccggagcgctcgctcgccttcgccacgcgcatgtaccaggagttgaacctgccggtgcggatggcggagtccctggaggaggccgtctccgacgcggacatcatcgtgacggcgacgtggagccgtcaccccttcctgcaccccggcatggtgcggccgggcacgcacatcatcgcgctgggcgcggacgagccgggcaaggccgagctgtccgcggagctgctccgtcagtcccggttcgtcgtcgaccaccggggcctggcggtgtccaccggcgccgcgggcgcggtgggtctgggtgaggagtccatccacgcggagctgggcgaggtgctggccggactgaagtccgggcgcacgtccgaggaggacgtcaccgtcttcgcggcggtggggctgcccttccaggacctggcggcggcctggcacgtctaccagtcggcccagggcgacgatgccgtgagtggggtggacttcgacgcatga

SEQ ID NO: 2699 - DNA, 723 bp, Myxococcus xanthus
atgggacgcattttcgagacacgcaaggccacgatgatggcccgctggaacaagatggcgaaggtgttcacgcggatcagcaaggacatcgccatcgcggtgaaggcgggtgggcccaatcccgattcgaactccacgctgcgccgggtgctccagaacgcccgcgccgcgaacatgccgaaggacaaggtcgacgcggccatcaagcgcgcgagcggccagtctgcgaccgactacgaaatcgtactctacgaaggctacgcgccccatggcatcgcgctgctggtggagacggcgacggacaacgtcgtgcgcaccgtggccaacgtgcgcatgcacttcaacaagcacagcgggaacctgggcaccgcgggcagcgtggccttcatgttccagcggatgggcgtgttccggttgaacccggagggcttggacctggactcgctggagctggagctcatcgaccacggcctccaggagatgggtgagggcgtgggagagaagggcgagaagcagatcatcatccgctccgccttcgccgacttcggccagctgcaggccgccatcgaggccaagggcctggtgcccgtctcggcggactccgaatacgtggcgctgaaccccatcgagctgcccgaggacaaggccaccgaggtgctggagctcgtggacgcgctggagcaggacgacgacgtccagcgcgtgttccacaacctggcgtaa

SEQ ID NO: 2700 - DNA, 66 bp, Myxococcus xanthus
atggacctgcacccgacctgctacacgcacttcgggctggtgctggagaagcccgcgaaggtgtga

SEQ ID NO: 2701 - DNA, 384 bp, Myxococcus xanthus
atgtccgaccgcatcgagacctatgccgagttctggccgttctacctgcgggagcacgcgctgccgtccacgcgctggcttcacttcacgggcacctccctgggactggggctgggcgtgacggccgtcgccacgggccgcggcgcgctggtgccggccgcgctcgtcgccgcctacggcttcgcgtggttcagccacttcgtcatcgagcggaacaagccggcgtcgttcaagtacccgttctggtcgttcatctccgatttccgcatggcggggctgatggccattgggcggctggctccgcacctggagcgtgcccgggcgggcggcgtgggctcgggtgaagtggcccgcgcggtgcccgcgacgcagcaggtccgctag

SEQ ID NO: 2702 - DNA, 336 bp, Myxococcus xanthus
acacggtgtgcgcggttcgagaaggccagtgagctgatggggaagcgctggacgggcctcatcctgcgcatccttctcgcggggccccggcgcttcggcgagctgacggacgcgattggcagcatcagcgagcgcgtcctgtcggagcggctcaaggaactggaggcggagggcgtggtgtcgcgtcacgtggacgcggggcctcccatccgcgtggcgtaccagctcacggagaagggacaggcgctgtggaaggtcgtggatgagctggcgcggtgggcggagcgctgggtggacatgaagccctccgccgctcgcaagcgcaagtccgcgtga

SEQ ID NO: 2703 - DNA, 357 bp, Myxococcus xanthus
atgggcagcgaactggacaccgtggccgagcggctggcggagcgtctcccttccgcctgccacttctacccccgcgatgcactcgcggccttcgtcatcgccctgcgtggcggagacacgccgccggaggacccgcgctacaccgtgctcgacatgccgctctacttcggtgagatccggctggtggactcggacttcctccagcagtgcgcggcccggggcaagtgggtcaacgtctggacggtggatgacccggcggagatgcaccagctcctggcggaaggcgtcggcggcatcatgaccgaccggccggacgtcctgaggcagatcatggacgccccctcgaagccgggataa

SEQ ID NO: 2704 - DNA, 771 bp, Myxococcus xanthus
atgagcgacctggcgctggggttctacgagggcatggcggaggaataccacctgctcttcgccaattggccgcaggtggtggagcggcagggcgccatgctggacgcgctgctgcgccgctgcgaggcgccgccgccccggcgtgtgctggactgcgcgtgtggcatcggcacccaggcgctgggactggcgggtcgtggctacaccgtccatgccaccgatttgagcccggccgccgtggcacgtgccgagcgcgaggctcgcgcgatgaacgtgcacctcaccacgggcgtggcggacatgcgcacgctggacgcgcaggtggagggcaccttcccggtggtgctggcgctggacaacgcggtgacgcatctgctgacggacgaggacctggacgcggcggcgcgcgccatggcgtcgaagctggcttccggtgggctggtggcgctgagcgtgcgcgacgccgacgcgctggtgcagagccagccccgcttcacctcggagcggctcttggatgcgcccgagggccgccgcatcctctttcaaatctgggactgggccgcggacggacggacgtacacggtgcaccagttcatcctccgccccgagggcaagggctggcacaccaccgagcacacgggcgtgtaccgcgcgcttcagcgcgtggacctggagcgggcgctcacgcgcgcggggctgatggatacgcgctggcacacgccggaggagacgggcttccatcagcccatcctcacggcgcggcgggcctga

SEQ ID NO: 2705 - DNA, 465 bp, Myxococcus xanthus
atgccggactcgccgctcaaggatttcccggtggtcgtctccttccccctccactggggggagatggacgccttcggccacgccaacaacacgcgcacgttcacctggttcgagaccgcccgcatccactacttcgcgcgcatcggtctgacagggccgtccggcgcgggggacgagcggacgaaccgcgacggcgtggggcccatcctgaaggccaccaacgcggagtacctgcgtcccatcctcttccccacgcgcctggtggcgggttgccgcgccacccgcatcggaacgtcgtccttcaccctggagcacgcggtggccggagaggacgacggcgtcctctacacccggggtagctgcgtcatcgtcaccctgcgctacgccacccacgagaaggtccccgtgccggcggagctccgcgcggcgattgaggcgctcgaggggcgctccttcagctcgtga

SEQ ID NO: 2706 - DNA, 351 bp, Myxococcus xanthus
atggcgaccccaacccgcttcgcatttacccagccgagctcgccgggcaccgagttcatcatcgagctgacggacgaaaacacgattgcccatgcgcgaaggattctctcaggcgaagagaagaacgagattcacgtgcatggacgaatcatcaagaggacccagccatacaacccgaggttctcattccatttggacccggccaccatccggttcttcgagattgccatcgaggtctgcgacgcgaacatggtgtacgtagaggaccatctggatgaggcgggcggcgcgttcctgccggggggccactggtgcccgtgggactccaagctgacgcgtgaggtgacttga

SEQ ID NO: 2707 - DNA, 528 bp, Myxococcus xanthus
atgtcgatctacgaaatgaccgttccctgcttcgcgcaaatgctgcgcgcgttacaaggtttcctgaagaagggggaggcgcatgctcgcgagctcggctgcgactcgaagaacctgcttcagtcgcgactggcacctgacatgcacaatctggccagccaggtgcagttcacctgtacccaggcgcaggaagcagtgctgcggcttggccagcagccgctgtcggcgctagacgcgccggacgacatggaacaggcgaacgccttgattgagcgaacgctacaactgctgtcgagcgctgacagggcgcggatagaggaaggcgcacaacgccaactgtccatcgagctgcccaatggcatggccttcgacatgaccggcagcgaatacgcgcggaactgggtgacaccgcagttctactttcacctcgtcacggcctacagcattctgcggaacaacggtgtgcagcttggcaaggccgactacgtcccgcacatgttcgcctacctgcgccagccagcggcctga

SEQ ID NO: 2708 - DNA, 1554 bp, Myxococcus xanthus
gatgctgcggcgtccagcccaacaccacgcatccatcaggtagcgctcatgaagctcgacaagcccgagaacctgttcgctgccatcgagcagtgcgatgtcttcgcggtggaggacctgctggccaaaggggccgaccccgatgaagtcgacctcgacggctaccaggccacgccgttggcgtatgcctgcagtcacggtgacgaggctgccgtgcgcgcgctgctggacgcgaaggccgccccggatgcagcggccttccagccgccgctggtcgcggccactgcgcatggctttgccgctcttgtgagcttgctggtgaaggccggcgcggatgtgaacgcgggggacgaaaccggcgccagcgcgctgtggacggccgccgcgaatggctttgccgacatcgcacgatgcctggtggaagccggcgcggatcgcgaacaggcggacaacgacggcaagttgccctccatcgtggcgttggagaatggccatgtcgcgctgtcgaactacctgagcgatccggcgagctacccggccacgcattccttctggcgcggcagcaagaaggctgcgcggcaggcggcggaggcacggcgcgcacaggttgtcgacagggccacgggcaaggacgtccgtggcgctgccgctgccgaacccgaatggacgttctccggcggcattgcccgcagcccgtgggcaacccaggacttcccttcggtggccgctgccggcaacctcgaactggtggggcggatgctggacgccggcctcgaccccgactggacccagttcaagggcaacccgacggcgctgatgctggccgcgcgcagtggcgaactgggtgcggtggacctcctgctcgcacgcagagccaaggtgaaccaccgaacggacaagggactcaccgcgctgcacatggcgctgttcaaaccgtcggcacgcgtgcacggccccatcattcgcagcctcttggccgcgggtgccgatcccaacgtgcccgacgatgaaggacaacgaccgctacagcgcgcgctggcgcatgcgatgccaacgctcgtgcaggcattgatcgaagccggtgccgacccgttcattcgcggccgcgtcgtccgcataacggtggtcatggtgccaggagatggcaagccttcagatgcctccagcgagtttctgtatcgtgcgcacaaggggcggtggtacgacagagggacggcacccatcccctatccacggtggagccaggggataggggatgggccgtctgaagcatgcagcgaaggttgctcaccgcgacagcctggcggaactcacgctgcttcgacgcgcgcgccaacgggacgcgcgtcgccctggccaacgtcattcaaccagcaccatgggcgacgtctgtcgtcgcccatggtgtgcggggctagcgagccgggatgcgcaggagcaggtcgtgcggcggcaggtagagctgctcggcaggcgttgcccgtccttcgttgtcctgcccccacgtcaccacggtgccaccggcgaggaaggcctggctggcgttgctcgtga

SEQ ID NO: 2709 - DNA, 999 bp, Myxococcus xanthus
atggcgctctccgcgctgacggcgctgctcctgtcgacccggcgcgaattgacggagctgcgcgcgcaggtggagggcctcacccgccgaatcgaagccgcgacgttcgaagggctcatcggcgaatccccttcgatgcgcgccctataccggcaggtggagcgactggggcccacgccgctcaacgtcctcgtcacaggcgagacaggcacgggcaaggagctggtggcgcgggcactccaccggcgcagtggccggcgcggccggctggtggccatcaactgcgcggcgctgccggagagcctcatcgagcgcgaactgttcggccatgcgcgtggcgcgttcaccggcgcgggcacggagcgggcgggactggtggaagcggccgacggtggcaccctcttcctggatgagattggggacatgccgctgtcgctccagacgcgtttgctgcgtgtggtgcaggagcgcgaggtcacccgcctgggcgaacaccagccgcgcaaggtggacgtgcgcgtggtgtccgcgacccatgtggccctggaggaggcggtgcggcggggcaccttccgcgcggacctgcgcttccggctggaagaggtgcgtgtcgacgtgccgccgctgagagcgcgtggtgaggacgtgctgctcatcgcccaccatgtgctggcgcaagaggcgcgcaaggcgcgaggcttcacgcagaaggcctcggaggcgctgcgggggcaccccttccctggcaacgtgcgagagctggcgtcgcgcgtgcgccgcgcggcggtgttggcgacggacgagttgttgcgccccgaggacctggagctgggcggcgacgcagcgcccatgattcccctggaggaggcgcgggaggcgttcgtccagcgctacgtgcgggaggccatcgcccgctgcggcggcagtaagaaggacgcggcggcggcgctgggcatcggtcttcgctcgctgtttcgctacctcggcgaaggggactga

SEQ ID NO: 2710 - DNA, 1875 bp, Myxococcus xanthus
atgaacctgacggagacgacgatgaagcatgtggtgatgggattgttcctggcgctgacggtcatgggctgcggcagcacgaaggacgatgacggtgaggggcccgacggcaaccccaacgagcagagcgcggggctgtgcagcgcgagcaaggcatgtccctccgggcagttctgcttcaacggcctgtgtgccatcggctgtcagtcgaacggggactgcgcggcggaccagtactgcgacctcgaggacacgggcatggccgtctccttttgcaagaacaagaaggtgccgacctgcagctccaacagccagtgcctgagcaaccaggtctgcatcgagggcctgtgcagcctggcgcctccggccaacccgccctcgtgcaacccgaacaccagcgacttcaaggacggctgcgacacctatgcggtgtgcctggacgcagcggaccagggctcgcagcagccgtactgcgccagcttcgcgccctgccccgaggatggcgtgtgccccacgggcctgggcggcgcggtgtgcaacgacggctacctgcccaacaagggccgcttctgcatgcaggggctctgcagtgacaactcgaactgcccctcggcgtggagctgcgtgaagcccttctccggcgcggtcctcgggttctgcagcccgggtgccttcggcttcccgtgcgcggagaacagccactgcaagagcggccagtgcttcagcgcgccgggcgtcatgggcacctgcatgtagctggcgaagacggccccgtgttcccccgtcggggagcacggggcctctggcgttgttggggggtgctctccgagcctccctccgcctagagtcgcccgggccttggtgatgcgccgactcctcctgctctcgttgttgcccgcgctggtgctgctcgtcgcgccgggctgtccgctcgacatccgaatccgctgtgacgagcccaacggctgtccccaggggcaggtctgcgtgcgaggtgactgcgagcccgtggacacggtgcggattggggatgcctgcggcgagcatgcggactgcgggccggggcgcacctgtggcacgggctttccgggcgggtattgcctgctggcgtgctccgacgcggcgccctgcccggcaggaagcgtgtgcgcaccggggctggggcagtgcctgcgaacctgtggcgaggcctgtgctcggccaggctacggatgtgggcacgtgcccgacgcgtccggccccctgagtgcatgtgtgccggtgacgacgtcgacggatgggggctgcacaggctcgggatgcgaggtgccggatgccggctgtacgggctcgggatgcgggtcgccggacgccggatgcgcgagcgctgtggaggtgggaggagcgtgcacgcggccgtgcgagtgcgcggatgcagcggcggcctgtgtcggcgggacgtgcacgctgacgtgctcgacggacttcacgtgtcgcgacgggcgacggtgctcctccagtgcaacctgtgtcgtgggggctcggattggagagccgtgcagggacacattcgagtgctccgacttcgccggttgccccagggagcgaatgcggtgcgaggagaagtgcaacccggagagcaaccactgcgaggcgggctaccaatgtgctccggacgggctgtgcgtgcaggagtgctcgggtaccccggtctcggtgggagaggactgcgagaactcgctggactgcgcgccctgtagcgtgtgcctgtcatcgggggcggcgctgcggtgccggcagccgtgccggctggaccgggactgcccaggaggggcgacgggcgcctgcgaacaggtggggaacacgaaggcctgtcggctgtcgctgtaatctacc

SEQ ID NO: 2711 - DNA, 1905 bp, Myxococcus xanthus
atggccacggtcttcctggccacggacgtgcggctgtcgcgcccggtagcgctgaagcggatgcacccaggaggcggcacgggccgcgcggagcgtttccggcgggaggccgagctggccgcctcgctccatcatcccaacgtcctggaggtccacgactacggcgaggatgaggcccatggcccgttcctcgtctgcgagtgggtgcggggcgaagacctccgcgcactggcgggaaggctctcgccggcgccgcccgaggcggtgatggtgttgggctgggagctcgcccgggcgctggcggcggcgcacgcacgcggcatcgtccaccgcgatgtgaagcccgacaacgtgctggtggcggaaggcgggccgctgaagctggcggactttggactcgccgcgctagaggaccaggagcgcctcacgagtaccggggcggtgacgggctcgttgccatacatggcgcccgagcgcatcgacacaggcgcgtactcccctgcctcggatgtgtacgcggtgggtgtcatcctgttcgagctgtgctcgggcaccacgccgcacgcgggcaagggcgcggcgcatctggccgcgtcagtgatgacgaaggatgcgccaccgctgacggaggtggtgccgggcacgcccgcgcccttgtcagcgctggtcgcgcggtgtctggcgaaggatgcacgggatagaccgcgcgacggggccgcgctggcgttggcgctggaggagctgctccaacgagaggtcggcccgcctgccgacgtggcgcgggagttcttgggagacccggtggcccgcgccaatcgatggcgccgggcgcgcttcgagcggttgctggaggaggggcgcggactgctggcgcgcggcgagggggcgcgggccgcgaaggtcctcaacgccgcgctgtcgctggagccgacgtccgccgaggtggtggcgctgttgcgtcagcggccgaggcgttccgcgtggagggctggcgccgtgggcgccgggctcgtgctctgcgcgactgcgggctggtggatgaggccggaccagcgcgtcgaagacgtgacgacaccgcgtggcgcggagccctcgtcagggcaggcctcccccagaacggcatccgttgacggcgcctccacgggtgaacgccttcatgcgcccacgcccccgggccaggagaggcctgcctcggggacggcccccggcatgttggatgcttcgcgggaaccggcgccttcggctgaaagtgacaccacgaatctggccggggcattggtaccgacagaacgcgcggcggacggtgccaaggcgaagccggctcggccatccgtttcgacagggcgttcggggggaatggattcggcgaagcgggccgtatcgcccctgccgacagggcactcggcgggagccgagcccacaggggccgcgcggcccttggtgccggcgccagggccggacgtggaaaccaccctccccgcgcgtcccgccctgttgaaggtgacggcgcgcccatgggcggaggtgttcgtgaacggcgagagccacggctacacacctcgagtgcgtgaactctcgctgtcagcggggacctaccggctgcgcttcgtcaacccgctgtgcgacgaggtcgagcaggaagtgacgctcgcgccgggggagaccgtgacgcgcgacgtggtgttgtcacctcgcaaggcagaggtgctcatccacgctcccgccggcgcgcggctcttcgtggacggccgggaggtgggcatcgcgcccctgcccgctccagtggtggtcgaacatggacgacacacggtgacggcacgccgcgcgggtgaaccgcccttggtgcgagaggtggacgtcgtcgccggccgtcgtctcgaagtggcgctggacgtgacgccatga

SEQ ID NO: 2712 - DNA, 240 bp, Myxococcus xanthus
atgggcacggtgctggcggtgacgcaggggttgggactcgcggcggcgggaatctccctggggacctcgctctcgctgcgcggaccagacggccggtatagcgcgagcgacgcggggacggcgcggacgctcaacgtgacgtacctggtgggagcctatgccttcgcggtggcctatgcatatggtgtcctggatgggttggtgttgacgcccgctccacccgttcgcccggttccgtag

SEQ ID NO: 2713 - DNA, 252 bp, Myxococcus xanthus
atgaagcggcggcgggtggtgctctctgaggccacgtctggtaaacccgtcaatacgttgctgaccgtcgcccgggcgcgcggttgctacttctccgaggcgttcaccctctacatgggcgcggaagtcgcggcgacgctggcctatgcgcaccagcgcacggacgacgcgggaatctctctgggtatcgtcacccgcgacgtgaactgcgtgtaccggaccatggtgagcaccgattccggcccgaggtga

SEQ ID NO: 2714 - DNA, 642 bp, Myxococcus xanthus
atgcgtgtcaaggtgcccaaggcgcggcgcttcgtggcgctggcgggcaacatcggcgcgggcaagacgacggcggcgaagatgatcagccaggccttcggctacgagctgttcgacgagcccgttatcgacaaccgcttcctgcgtgactactacgcggacatgacgcggtggtccttcacgctccagctcgagttcctcatccggcgcgtcgaacaccacgagctcatccattcgtaccgccgcagctgcgtgcaggaccgcaccctgtacgaggacccggaaatcttcgccaagtacctccatggcctggggcacctgacgaacgcggagctggacctgtactacgagtacttccagcggctgtcgcgccacatcatccggcccgacaaggtcatctgcttcgaggtcggcagcgtggaggtgctcctccagcgcatccgcacccggggacgcgaggaggagaagggcatccgccaccagttccttcggggcctcaacggctactacgccagcttccccctggtgatacaggagaagtacggcgtggactgcctcaccatggacgtgtcgaagcaggacatccggcgaggccggggacgtgaggagttcctcgaccgcgtctccaccttcctgtcctga

SEQ ID NO: 2715 - DNA, 180 bp, Myxococcus xanthus
ttgaggaagcgcaggtttcccgaggagcaaatggtccgcaatctgcgggaggcggaggcgcctggggccagcgtggcggaggtggtccggaagcacggcattaccgagcaggcgctctaccggtggcgccagaagttcgggggcacggaagccagtgaagcggcgcgacccggcaagtga

SEQ ID NO: 2716 - DNA, 2088 bp, Myxococcus xanthus
atgacgggcacgtacaccctgcgagtgcggcgggagaactatgtggacgcgcagcagaccgtggaggtccgcgcgaaccagccgagccaggtcaacctgacgttgttgctggtacgcggggacgtggcgggcaccgtccaactgtcggacggagccaccccctcgggcgtcaccatcaccgtgacgcagacgggcgccaacacgacgacgaacgcacaaggccagttcaccttcaccgggcttccgctgggcacctacaacctgaccgcccagaaggagggctacgcggtggtgcagcaatccgtcacggtgcgcacgggcgctgcggccacggtcgccttcacgctggtacgggcccagggccgcgtggagggcacggccctgctcgagggcgcgagcagccacggtggcatcaccgtcaccctggcggagacgggggccaccacgaccacgaacggccagggccgtttcgccttcagcagcgtggccgcgggcacgtacacggtggaagcgcggttgagcggctacgccgtggcgcgcgagtccgtccaggtgcaggagaaccagcaggccaccgtctcgctctcgctggcgcgcgagcggggcaacgtggccggtgtcatccagctcgagggcgggagctcgccggtggacatcaacgtcaccctggcggggacggccttcagcgcgcgcacgaacaccgcgggccagttctccctcacaggcgtccccacgggctcctacaccttggaggcccagaaggacggcttcgccacgggccaacgtaccgtggaggttcgtgccggcgagcaggcccaggtcagcctgacgctgtcccgcgctcgcgggagcatctcgggcgtggtcctgctggaggacgccaacacgacctcgggcatttcggtggcgctggtggagagcaacgcctccgtgttgacggacgcccagggccgcttctccttcagtggcctcatcgtggggacgtacacgctgtccgcctattggacgggctatgagattcaagagcggagcgtggtggtgcggaatcaggagaccacggtggtcaacatcacgctgcggcgcaggcccggcgtggtgacgggcaccatccaacttgaaggcgaaagccaccacgagggtgtcaccgtgtcgctctccggccatggcgccaccgcgatgacggatgctcaggggcactttgtcctcgaagacgtgccccaggggcgccacaccctggcggccagcaaggcgaactacgcgaaggcggaggccgcgctggacgtgcgcgaaggcgagcccctgccggtcagcctggccctgtcgcggctgggcgcgctcgaggtctccgcgcccaagctggcggtccaggggggacacctgaccttgacgggctccggtttcggcgccgagcgcggccccttcaccgtcacggtgggaggagaagccgtcaccgacttcatctcctggtccgacacggaggtggtggcgcgggtggcgcaccacgtcgctccgggcgagcgcgacgtcgtcgtgacgccgggtgtgccctggcggcggaacaccaccacctccgtgtgggtggtgccccagaagaccgtcgcctacggggagcattggggcgtgggtgtccttgcttccaatcacgtctccgtctggggtgggccctccctggccgacatccacccgattccggcggggctcaccgacgtggtgagcgtggccacgtcgcgaaggaccgccttcgccctccaggcggatggcaccgtggtggcgtggggcggtgaccttccctcggacctgagtgtccccgccgacctcacggaggtcgtggccatcgcgggaggcgattccttcgtcctggcgttgaaggcggatggcaccgtcgtggcctggggcgaaagcgccatcgccccgtcctccgacgtgagggacgtggtaggcattgccgtcacgagcaacgccagccaggccttcctcgccggtggcaccgtggtgacgtgggggcaggacaacgaaggacgggcaacgcctgccgagcagctctacctgccgccgcacgacctgctcctgcgcatcccggctcgctag

SEQ ID NO: 2717 - DNA, 207 bp, Myxococcus xanthus
atgcaggtgcccatgacgcccggcgcgctgaagcactggccgctcttgcagtggctgttctccgcgcacgggaagccgaaggcacccgggctgcagaacccgaggaccgcgccggagaagggcttcacgcagctccacgccgaggggcagttcgagttgtcactgcagagcccctgcatgcagaagcggcccttgttgggcaggtag

SEQ ID NO: 2718 - DNA, 366 bp, Myxococcus xanthus
atgggctgtctcgggtttcttcgctcgcaacaggcgcagcgccggattggcgagtggatcgggctggacgccggcgtactcgccgagggccgccgcgcggacctggccatcatcaaccccgagggcctggacgggaagctggatgaaatcgccgaggcgcccatggagaacttcgggggcttcgtccggctggtgcgccgcaatgatgccgcggtgaaggccgtgctcaactccgggcgcgaggcggtacgggagggcgccgtggccccctcgctggggcgcgagcgcggcttcggaaaggtgctccgggctcaatacctctcgggtatgaagttcttccccgcgagcgaagcctcgtcgtcatag

SEQ ID NO: 2719 - DNA, 675 bp, Myxococcus xanthus
atggtccggtacacgcagaagctgcgcctgtccgggctgctgcagtccctcgagctgcgctgccgcgaggcggccgacgccaacttgccgctgacggaattcctctaccgactgctggccgacgaggtggagcggcgcgacggcaagcagttggacgtgcgcctgcgccgtgccgccttcgaacggcccagcaccctggaggacttcgacttctccttcaacgtctccgtcccgcgcacccaggtgctggagttgggcacctgcacctttgtcgagcggcacgagaacgtgctggtggtgggccctgcgggcgtcggcaagagtcacctcgcccaggcgctgggccagcgagcctgtcgcgccggccacgccgtcctctacgtgagcgcccacgacatgctcacgcagttgcgcgcctcacgcgccgacaacagctacgagcgacgcctcctgcgcttcaccactccagccctgctcatcatcgacgacctcggactgcggccactcacgggtgaggagggcatcgacatgtacgagattgtccgccgtcgctacgagcgcgtggccgacttcaacgcggacgggcggctggatgtcgccgcgacgattgcagcggcgaacaccgtcagtctgtttccgggtctgggggatggctcgctctcggagagggcatga

SEQ ID NO: 2720 - DNA, 417 bp, Myxococcus xanthus
aacctcactcaggagtgttccatggtccgtctggaagacgcgcgtcccctcatcgccgcagccgagaagaaggctcaggaactggggcagcccatgaacatcgctgtcgcggacgaaggcggcaatctcgtcgcgcacgtgcgcatggatggggcgtggctgggcagcatcgacatctccatcaagaaggcattcacttcgcgtgccttcgatatcaccacgcaggaactggcaaagaacgcccaacccggtgggcagttctacggcatccacgcgtccaacgacggaagggtgatgatcttcgcgggcggcatcccgctgaagaagaatggcaaggtcgtgggggctgtcggcgtcagcgaaggctctggcgaccagaaccatgcggacgccaccgcgggcgcgtccgctttctag

SEQ ID NO: 2721 - DNA, 944 bp, Myxococcus xanthus
atgacggtccccggcgctcaggcgcgggcggaggacacgcccgacggcgtggccctcgtcttcaccacctccgaggaggaccaggtggcgaacctccggcagcgtggccgcaacatgatgcagcggcaggcggagcacggcgtatcggggcgccgcggcctcgagcagcctcccggcatcgactacgaggccatgggcggtagcgggctcccgggttctgcgggggctccgagcgtgccgacctacgcccgcgtggaggacactccccagggcgtcaccatcgcctacaaagccgtggacccctcggatggagagcgactgcgcgcggagatccacgagaccgccgggaagctgacgccgggccagtgcccgggcatggcccccccgtggagtgaagcccccctcttctcctaccggggcacgaggtcatggcaccagacacccatacggaacccatgaagcgcaaggcctatgaaaaggagcttcgcaggctccaggcccagctctgcatgcttcaggattgggtcaagcaggagggggtgcgcgtcgtcgtggtcttcgaagggagggacgcggcgggcaagggcggtacgattcgcgccatcacggagcgggtgagcccccgggtattccgagtggtggccctgccggtcccctcggaccgggagaagacccagatgtacccgtggactcgctggtacgattactctcaggcgcgtgacatgatgttggccgcgacggatacgccgtatgcgccctggttcatcttgcgctccgacaacaagaagaaggcgcggctcaactgcatccgcttcctgctggagaagattcctcacaagagggtgaagcgtcccgaggcgaagctgccccgccgctccaagcggggcgcctatgacgacgaggcttcgctcgcggggaagaacttcatacccgagaggtattga

SEQ ID NO: 2722 - DNA, 141 bp, Myxococcus xanthus
atgaacgccctcatcgagtgctcgtacctgcacggcgtcaacgtcttcccggcggagtccttcctcctcgtggagagcagcggcggcgcatgttccgtgacggacgtgggcatcaccgaggagattgaccgctcaccgtga

SEQ ID NO: 2723 - DNA, 1174 bp, Myxococcus xanthus
ctggctcgcctcgtcgcgccaacgttcgccgactggtgcatcgtcgatgtggccgaagcggacggcaggattcgccggctggccgggtttcactccgaccccgcgaagcagagggtcctgcgcgagctggaggagcgctatccgccccactggggctcgctccagccggccatccgcgtcatggtccggcaagcccttcctgcgctccgagctctcggagcccgatatgcacgactacagcctcgacgccgagaatgcccggctcatccgcgagctggggacccggagcggcatggccgtgccgctcatggcgcgcggacggacgctgggggccatctccatgggccgcacggacccgaagcgccccttcgggccatcggacctggcgctcatggaggaactggcccaccgggcggccatggccatcgacaatgcccacctctaccaggaggcccaggagggcatccgcgtccgtgaggagttcctcggtgtcgcggcgcacgagctgaagacgcccatcatctccatgaacatcgtgcttcagtcggtgctgcggagacgaaacgagcgcccctccgcagagcggctcatgcaggccctcgagtcggccgagaagcaggtgcagcgcctcatgcgcctggtggacgacgtgctggatgtctcgcggctgcacgccgggcggctcaagctccacctggagcgcgtggacttcctggccgtcgtgggcgaggtcgtggagcggttcatcgagaccgccgcccgaaccgggtcgcgggtgaacgtgcgcgccgaagggcccgtcgaggggatgtgggaccggagcaggctggaccaggtggtggcgaacctcctcggcaatgccctcaagttcggcgagggcaggcccatcgagatttcgctctcacgcggggagggggcggccgagctcgtggtggaggaccacggcatcggaatcccgcccgagcgcctgctccacatcttcgagcggttcgagcgcgcggtgcccacccggcactacggcggattcgggctcggcctctacatcgttcggagcctcacggaggccatgggcggcacggtgcgcgtggacagcacgccgggcctgggctcgaggttcacggtggtgcttccgtgccagcccctgaaggaggccgcgggagagtcgcaggcgtga

SEQ ID NO: 2724 - DNA, 519 bp, Myxococcus xanthus
atgaccgacctgagcgcgaagaatccgaaggacacggaggtggtgatgacccagctcatcctgcctccggacgccaacaacctggatgctgccttcggcggcaaggtgatgcagtggattgacatctgcggggccgtggccgcgcagcgccactgccggcaggtcgtggtcacggcctccatggatgatttgcacttccacgcccccatcaaggtcggctgggtcgcgctgctgcacggccgggtgctggccgccttccgcacctccatggaggtgggcgtcacggtgcacgcggagaacccgctcaccggcgagcgtcacctcaccaccagcgcgctgctgaccttcgtggccatcgacaaggacggccagcgcgtgccggtgccgccccttctgatggagacggacgcggaccgcatggccttccaggaggcacagacacgtcggacgctgcgtctggcccggcagaaggagaaccagtcctggttgaaggtgatgacgcccatcgcgggtgcctga

SEQ ID NO: 2725 - DNA, 2343 bp, Myxococcus xanthus
atggtccagcagctgcgcgcggcgaagcgctaccaggccgcggactcgctctccaacctcgacccggccatcaagacccagtccaagccgagcaagctggaccaggagctccagtcagaggtggccctgaactccgtgtccgctgagcgcgacgggctcaacgcacgtcagaagttgctggaccaggaaacacggaccaccgcccgccagacgctcgacgacatcgcgaagaaccccaagtcgaaggcgcccttcaacgtcgagcccggcgcgacgaaggaccatgcggtcctcgtgcgcaaggacaaggatggcaaggtgaccgagcggctcgagctgtcgttccagggcgacaaggtcaaggttgactcgacgaaggtggacaagtccggcgaggcgcgccgctccatcttcgagagcgaggagccgggggggccgagcaccgccatcgacgcgcgctggaagcaggatgccgccgcgccgccgccgtcgcgcgaggagctggcagaggggaaggtcaagggcgcctcgtacgccgagacgaagttccaggtgggtccatccgccagtcagaccaccacccaacgcgcgccggatgggtcgctgacggagacgaagaagaccttctcccaaatcaacaagggagaccacgttaccggcaggtttggcgagttcatggagaccgtgccctctgacaagatggacgtcaccaccaccgtcattccgccccccggtgcgaaggacgagcagggtaagcccgcgaaggcgacggtgaccgagtcgtcgtcgtactcgcagggagatcggctgcggctgacgcgcacgtcgaccaaggccgtggactgccctgccaaggccgaccgccccgctggcgcgaaggagttggaaaaggttcggaaagaatccattcaggctgacgacgccgcgcctcgcagttacgtgcttgagaaggccggcgatggcgagctgaacacccagaccttcttcgagggacagcccaacgtcacgctcgtcactcgcaagaagctggagggcaacactgtcacggagacgaccgagggacggctccccaagcctgcccagaagggcgaagacgtggagttggtggacgtcaagagcaccaccacccggacgtacaacaaccagggcctcatcaccgcgagccactcggaccagacagacgtcacgggcattcgccgggtgaaggacttccagcgcaccgaaacgcgcaatgccaagggcgaggtggaggtcaccgagcgcaccacgggctcggaagaaggaggcggcaagcccaagcgcacctacgagcagtcgctgacgacggcgcagacgcccaaggagccgcaggtcgtccacgcccagtcgaagctcacggggcccgagggaaccgccgaggcgtccattcctcctgagcgcgtgatggtgaacggcaagtccttcgatggccccaaccagctcaagcaggacttgccacccgcgcaggcggccctgggggcctacgcggtcaacgggttgcagaacgagctcaatcacttcacccaactgtcggcgctgcatacccaggccctgaaggacacgccggaggcaccggagagcgagggcatgggcgtcgcgggcgatgcgtcggagtatgggctggctcgactggcgaaggaggccaactcccgggcggcgaatgcgcagggcaagccggacccggcggacaacccgaagttcttcagcttgaaacccgaggacgcgttcaagcaggagctcacgctgaacctgaaccggaacgagcgcctctcggtgggaatggtgggtggcttccaggtggccgccggcatcaacgacatcgtgagcggcgtgggagacttcaagaaggcgctcgacgagcagaacctgctaagcttcaagggcgcgcgtgagctcgcgacagccggcgcggacgtcctgggaggggcggtgggcgtggtcgagggagtcgggctcatgcgcttcgccgccaaggggtcgggcaccaccatctccccatcgggcctgccaggcccgctgaatggccgtgtcaatcccatcaagttcgcggagtggtcgggacgactcaacgcggctgtgggagtcatcagcggtggcctctcggtggcggagggcatctccaaagacgacacgtaccaggtcgccctcggcgcagtgcaagcgggtggcgccctggctggctacttcgggacggccgccgccgcgggcgccctgggcggccccgcgggcgtcgccgtcgccctgtcggtggggatggtgaccatcggtgtcggcagtgtgattgagcgcgagcgtgcgcacgcgctcgccgaacagcgcatctga

SEQ ID NO: 2726 - DNA, 606 bp, Myxococcus xanthus
atggagcaagcccatccgacacgtcgcttcggaatcaagaaggacatcaccttcacttccgggcagacgctcgacggcgtggagatcgttttggatcacgcggaggaccagccgcagcgcgtcaacgtgaaaaacctcaaagcctacggcgcgaaggcctacgtcacgatggatttctacttcggctccgggttcctcttcaggaacgaggcgatcgacactccgccgctccagattcccgcgatgccgctcaccccgcccttcgacctcatccagcttcacacgatggtgctcgtgggctccgagggagagttcggactcacctccgcgagcgcaacggtccacacggagggcggctcgactcccgaggtgacaatgccgccccctcttcaactcacctcggttccactcggcacgatggaggttcctgccgtcgctccgctcgagggcttctccttgtcgtggaacgtggatcccgccgcccaggtcgtgcgtgggcatctccgccataaaggacgagatcccagcctccactggagcgtgacggcaccaagctccatcacatcgttcacgccgttcgagctgcccgtggatttgagtagctga

SEQ ID NO: 2727 - DNA, 2709 bp, Myxococcus xanthus
ctacaactccctttgccctgcggagctagggggtgccaatggacctcgctcttcttcgccgggagcgaatccggtaccgggacggagctgtggaagtccgacggaacggaggcgggcacggtgcgcgtgaaggacctcttgccgggaatcggcagctccaacccctccgagctacgcgacgtggggggaatgctctacttcgccgcgaccgatgggctcacgggcaaggagctgtggaagagcgacggcacggaggaggggactgttcgcgtgaaggacatcgcggccggcactcggtcgtccgatccgcggcccagctccctgattggaatggatgggtcgttctttctcacggccgacgatggcgtgacgggccgtgagctgtggaagagtgacgggacggaggggtgcacggtccgggtgaaggacatcacgcccggaacgcagagctcctcgattcatcccgccgtgatcttgaatgggtggggtttcttcgcggccgatgacgggagttatggcctcgagctgtgtaagagtgacgggacggaggaggggacggtccgggtgaaggacatcaggccgggcctctcctcaggcctcttgcccgaagggatggtcaagatgggcggcgccctctatttcccgggcaccgattcggccgctggctctgagctgtggaagagcgacgggacgactgacggcacggtgttgctcaagaacatccggccgtggagtgcgagcgccaccgtgcagtccctcactccgatggagggggtggtgttcttcacggcggatgacgggacctctggacgtgagctgtggaagagcgatgggacggaggcgggcaccgttcgggtcaaggacatccgtcagggcccgctcggctccgcgccccagtggctcgtcgccttgaacggcgtcctctacttcgtggctgatgatggcgtctccggtgctgagatttggaagagcgatgggacagaagccggcacggtgcgggtgacggacctcctcccgggcgccgcctctgtttcgcccacgtcgctcaccgtctcgggcgggcgcgtctacttcctcggagacgacgtcattcacggcagggaactctgggtgctgacgcctccagccccggcagataccgtccctccgtccgtgacgtgccccgcacccgtgtccgccgaggccacgagcaccgcgggtgtgcaggtcagctacccggcggcggaggcgacggacgacatcacgctctccccggccctgagttatgacatcccaagcggaagcgtcttcgcgttgggggagacgaccgtgacggtgacggccgcggatgaagctggcaacacgtcgacatgccagttcacggtaacggtccaagactcccaggcacctctgctgacatgccccgacgatgtcgtttgggaggccacgagcgccacgggggcgaccgtgagctatccggcggcgagcgcctcggatgatgtctcctcggtcgaggtgacgtacagccagggctccgggacgcccttcgcggtggggacgacgcctgtcaccgtcaccgtcacggatggcgcaggcaacgcgtccacatgccagttcacggtgaccgtgcgggataccacggcgcccaccatcgtctgcccggccgaagtcgtggtggaggccatggggcccgccggggccgtggcgggattcgtgctgccccaggcaacggatgcggtgacggcctcgcctcaggtcacggcgagcccggtctccggcagcaccttcatgttgggttccacgccggtgacgctgactgcgaccgacgacgcgggaaatgtgggctcgtgccaattcctggtgactgtgcgagacacggcagcgccagtcctgacgtgccctgaggaagtcatcgtggaggcgacgggtgctggcggcgcgacggtgagctatccggcgggccaggccgtggatgtggtgtcccaggttcaaccggtgtacagccacgcctctggagcggacttcccgctaggggggacactcgtctcggtgaccgccacggatgccgctggaaacgccgccgcgtgccagttcacagtgactgtgcgcgacaccacacctccagagttggggtgtccccaggacgtggtccttgaggcagaggacacgcaaggcgcggtggtcaccttcgcaggagtccagcctcgggacctcgtgacccacgacccgtccatcgcgttcagtcagacctccgggagccgtttcccgctgggcaccacggcggtcgccgtgacggcgtcggatgccgcgggtaatgaggcctcgtgccgtttcgcggtgacggtgcaggacaccactgcgccccaggtgatgtgcccgtcagacgtctcagtggagacccaggaccccgagggcacggtcctgagctatgcgcctgcctctgctgttgatggagtctcctccgtgacggtggcctatagcctggcgtctggtggccacttcgcctcgggcacgacgccggtggtggtgacggccaccgatacagcggggaacgccgcccagtgctccttcctggtctctgtgcgagtcaggaagcccacgctgataccggccccccaaacgggatgcagcagtagcgcggatgcgggcgggcccatgagcctcacctggagtgtcctcgtcctggccggctggcaggtggcgcgtcgacgcctgcgccatcgcatgtaa

SEQ ID NO: 2728 - DNA, 924 bp, Myxococcus xanthus
gggcgccatggtgatgcgcatccccggcatctacggggcccgggcgcgggcattcacacgcgcttgctgtcgggggcgctccggctgcccgaaggcggcggcggacgcatctcccgcatctacgtcgatgacctggtggagtccattcgcgtggtgctgacgcgcggcgagcccggcgccctgtactgcgtcgcggatgaccgctccgcgccctccgaggagccggtggcctggctcagccagcgcctgggcgtgccgatgccgccccgcattcccctggcgcagctcaatgagacactgagaggcgaccgcgacatctccaacgcgcgcctgaagtcgctgggctgggcaccgcgctacccggacttcatctcggggtacacggcgctcctgaaggcggagggccacggcgccggaccgacgcagcttgtcatccgcaggttggtggcggaggacgcggaggcgttcaaggcgctgcggctgcgggggctgcgggacaaccccgagtccttcgcggcctcggtggaggaggattcggcgctgtccctggaggccgtgcgtggctggctggtgggggcgtcccagtgtgtcctgggtgcctttgacggtgggcagctcgtgggcgcgttggggctgaatcgcgagtcccgggcccggctggcgcacaaggcgatggtgtggggcatgtacgtggcgccggaggtccgctcgcggggcgtgggccgacggctgctgacggcgctcatcgacgaggcgcggaagatgggcggcctcaagtgcctgctgctcgcggtctcggtggggaacgcgcccgcgcacgcgctgtaccgctcgctggggttccggacctatggcgtggagcccaacgcgctgaaggtgggggagacgttcctcgacgaggagttgatggtcctcaccctgtga

SEQ ID NO: 2729 - DNA, 246 bp, Myxococcus xanthus
atgctgtcgggaagcacggagctgggccccggcgaggcggtgccgctggcccatgcctacgaactcgatgacgcgccggacttcgagcgcttcctcttcgtgacgtccgatgcacccctggaggtggcgtcggtcctggaggcggcgcgcgcgcttgcccggcggcccaccgacgcgcgcaccctgccgctgccacttccggataccctgggccagacgtccttcacgttggaaaaggtgcggtga

SEQ ID NO: 2730 - DNA, 2256 bp, Myxococcus xanthus
atgacgcggtccctcctgttttcgctcctgctcgtgcccgccctggccgccgcggctccctcggcctcggcgccgcaggcgtcggtgcgccgcttcgcgctgctggtgggcgtcaacgacggtggcgagggacgggcccggctccggtacgccgtcacggatgcgcgctcgttcggcgacgtgctggaggaactcggaggggtgcagccgcaggacaagctgctgctgatggagggcgaccgcgcggcgctggagtccgccctggtccgcttcaaggcgatgctggcggcggcgaccacgccgggcacgcgcatcgaggcgctcgtctactattcgggccactccgacgagcaggggctgctcctccagaaggatcgcttcggctaccgcgagctgcgcaaggcgctggagtcgcttcccgccgacgtgcgcatcgccatcctggactcgtgcgcgtccggcacgctggcccgccagaagggcggcgtgcggcgtccggccttcatggtggatgcgtcctccgcggtgcgaggccatgccatcctcacgtcgtcttccgaggatgaggtgtcccaggagtccgaccgcatcggcggctcgttcttcacccacaacctggtgtccggcctgcgcggcgcggcggacgtctcaggggatggccgggtgacgctgcacgaggcctaccagttcgccttccacgagacgctggcccgcacggaagagacgcgggccggggcgcagcaccccgcgtatgacatcgagctggcgggcacgggcgacctggtgatgacggacctgcgctccaccgccgcggtgctcgtcctgggggacctggtggacgggcggctctacgtccgtgactcccagggacgcctggtggtggagctgaagaagtacgcgggccgcaccaccgagctggggctgcagaagggccgttactcggtgatgcgcaaggtgctggaccagacctcgcaggcggagttcgagctgggggagggcggccggacggtgctggcggcctccgccttccgcgcggtgcagggggagctgacggccatgcgcggcggtgggcccctgccggcgagtctctcgtcgggcgccggtgccggcgtggcggaagtcgccgcggcgggcagcgggcaccgctcgcgcttcttcaacgtgggcctgttccccggcctccagacgaatgacctgatgaacgccggcgagcccgtggacaaccatctctccatgtccatgggcgtgtcccgcatggcgcggctggacggcgtggcaatggccctgggcgcgaacgtggccacggacagggtggacgggttgcagctggccctgggcgccaacgtggtgcggggcgacatgtcgggcacgcagctggccgtgggcggcaactgggcgcacggaaaggcggagggcatccaggccgcggtcgggctcaatgtggcgcggtccagcggctcgctcgggcagctggcggtgggtgccaatgtgtccggcacgtcgctggtgggagcgcaattggccgtgggcggcaactggacggcggggaacgtcgacggtgtgcagggtgcggtggcgttcaaccacacgcgggaccggatggcgggcctccaggtggccgtgggcctgaactgggcggcggaggcccggggcgcgcagctgtccctcgtcaatgtgggcggtgacgtgaagggcgcgcaggtggggattgtcaacgtggcggggcggatgagcggcctccagctcgggctcgtgaacgtgtcgcgggagctggattccggtgtgccggtgggcctggtgagcatcgcgcgcaacggccagttccacgtcgaggccttcggcaatgacttcaactacgccaacaccgccatcaaggtgggcagccgctacctctacacgacgctcgtgttgggcatgggcaccatggagggcgcgcgtggccccagccactggtcgctgggcctggggctcggcgcgcacatcccaatctccgagcgcttcttcctggacgtggacgcggtgacgaacaccctctatggctggaatctgtcctttgaaggcgaccgccgcctgcaccagctccggctggtggcggggttccaggtggcgcggaacctggccatcatcggcgggcccacgctcaacgtgttgcatgactcgaacggcgagcccgtgtcgaacctgagccgtctgtcgaacctggacgcagggggcgtgctcctgtggcccggtgtacaggtgggcctgcgcatctga

SEQ ID NO: 2731 - DNA, 567 bp, Myxococcus xanthus
atgtccaagttgctgttcgcggccttcaatgacggcgtgagcttgtccatggcgggcaaccatgaggcggccatcctcgctttcgacaaggtgctcgccgtggaccccaagcacgtcccggcgctcaccgcgaagggggcgtcactggccacgctggagcgcttcgaggaggcgctgcgctgcttcgagcgcgccatcgaagtggaccccaccgaggccgaggcccaccgcgacgcggccctctgccagttggagctgggggagccggaggccgccgcgcagctgctccagcgcgccacgcagctcaaccccacgccgggctaccgcgagtccgccgccgttcaaatctacaccctgggcaacgcgctgctgacgcggggctcccgtcgcccggacaaggcccgctaccgccaggcccgccatgtcttcgaactggcgctgacgctgtctcctggttccgccgagtgcgcccgggccctggcagacgtgtgggagcacctgggcgaccccgttcagagagaccactacgcccagctcgccacccggctccgccccgtgccggcctag

SEQ ID NO: 2732 - DNA, 1119 bp, Myxococcus xanthus
atgatcgtcatgctcgagccggactcgcctgagtccgtggtgtccgccgtcctccaggttgcttcccagtacaagggagtgacgccgcggacgcacgtcatcggtggctccgagtacacgattacggaggtctacctgctgggttccaccgcgcaggtgcccgtggagcccttcgagcagattcccggcgtgcggcaggtggtgcgcgtgtcgcagaagtaccgcgtcatcgggcggcacaagggccagcggacgtccgccggcttcgagtacaacggcgtcaccttcgacgagcgctccgtgaatgtgttcgctggcctgtgtgccgtggacaacccggagaacgtggacacgatgatggcggcgcttgctcgcttgggcatccgcaccacgcgcatgggcgcctacaagccccgcaccaacccctacgagttccagggcctgggcgccgcctgcctgccctgggtgttcgaatccgcgggcaagcacggcatcaaggtcatcgcgatggaggtgacgcacccgcgtcacatcgacgagattcgcgacgcgctcgagcgctccggcaacgccacgggcgtcatgctccaggtgggcacgcgcaacgcgcagaacttcgagctgctcaagagcattggccagcagcgtgtcttcccggtgctcttcaagcgcggcatgggcatcaccctggaggagtcgctcaacgcgtgtgagtacgtggcgagcgagggcaatccgaaaatcatcttctgcctccgcggcgtgaagacgcacctgggtgacccgcaccgcaacatggtggacttcgcccacgtgcccgtggtgcgccggctgacgcgcctgccggtgtgcgtggacccgtcgcacgccattggccaggccgcgccgccgccggacggactgccggacatcttccacgccattggccaggggctcatcgcgggcgcgtccatggtgctggtggacttccacccgcacccggaggccgccctgtgtgacggcccccaggccctgcgcatggagcagctccccgcactgcagcgctacgtccaactggtgcgctccgcgtacgagacggccgtgcagagcggcgacgggctccaggccaccggcgcctga

SEQ ID NO: 2733 - DNA, 573 bp, Myxococcus xanthus
atgggcaagacgagcgcggggttctggacggtgttgggcgtgatgctcctggggggctgcgcgcaccagtcgcaggtgaaggtggacaactcggagcagccctaccggattggccgcgaggacgtgctggacatcgcggtgtggcgtgacgcggagttgtcccggacgctgccggtccgtccggatggctacatctccatgcccatggtgggcgaggtccacgccgcgggcaagacgcccacggagctggccgactcgctgaaggaagccttccagccgtacgtgcaggagccgcgcgtgacggtgattgtccgcgaggtgaacagcagccgcgtgttcgtcaccggcgaggtggccaacccgggcgcctatccgctgcgcggccgcgtgtcgctgctgcaggccatcgcgctggcgggcggcttcacggacttcgccaactcggacggcatcgtggtcatccgcaccgacagcaagggcggacagattccggtgcgctacagcgacctcatctctccggatggcggacacgaggtcatgctccggccgggtgacaccgtcgtcgttccgtga

SEQ ID NO: 2734 - DNA, 843 bp, Myxococcus xanthus
atgacgcgtcgcctgcggctggacacggcgctccgggtgttccgggtcacggaccccagctcgctgccgcgtgccggcctggcgcgctccacgctgcccacgttcttcacgcaggcgacgctgggcgtgacgaaccgcgtggcggagcggctggacgtgcgcgcgggctaccgcttcgaggcggtgcgcatcatcgacgtggggcagcgcgcggggtacgcgcatacgccctccatcgaaggctggtaccgcgccacgcgccggctcggcctgggcttggagtaccggtaccagggcttcctctatgagggggcgctgagccagtcacacggcgcggcgctggggttgcggtatcggctgacgcggccaaccaccttcaccgtgcgggcgggccccgtgcggtacctggcgccggtggcccagcagggtggctgggttccgcgagtgaacgtggagctgcagcgcgaaggggagatgttcgacctgggcgtgtcgatgggacacgacctggtgggcgcgaacggcttcaccaacgcgctgtgggcggactacgcgtcggtgatgttggcgcgccgtttcacccagaagttctcgctttttggcgcggccagcttcttccgcaacgggcaggcgccgtcgctggactgggccgtgttcagaggagcgccgcgggtgtcgcagggctacgcggtgagtggtggtgtggagtaccgcattgaccggcgcctgtcggcgcagggggcggtggatcggatcgctcaggttgggctggcggattcggcgagcgcggtggacctgacgcgcaatgtgttcgccgtccgtttggtggtgacgccttggtag

SEQ ID NO: 2735 - DNA, 381 bp, Myxococcus xanthus
atgctcggcaagcccaacgtccacggctccatcttccgcttcgagggccaggtgacgtccttcgtccccggccagggcccctgctaccgctgcctctaccccgccccgcccccgcccgagctggcgccctcgtgtgcggaggcaggcgtcctgggcgtgctgcccggactcatcggtctgctccaggccaccgaggcgctcaagctcatcctcggccagggtgcccccctggtggggcggctcctcaccttcgacgcgctgggtacccgcttccaggagctcaagctgcgtcgggacacgcagtgccccgtgtgcgcgccgggcgcgacggtggagctcatcgactacgagcgcttctgcgccgcccccacgcccgcctga

SEQ ID NO: 2736 - DNA, 1287 bp, Myxococcus xanthus
atgtacgaggcttcggtggtggtccgcgtggagccgcagcggccgggtgaggagatggtgcagcgcacggtgagcgaaatcatcgagcagcggctgctcaccgttcgccaggagctgctggcgcgtccggtgcttcagaaggccatcgaggagatgaacctctatccggacatcgtttcggagaagggcatggagtccgcggtcgcgcagatgcgcaaggacctcacggtgcgcgtggaaggtgagacggccttcgagctcacctacgccaaccgcgacccgcaggtggcggcgcaggtggccaaccgcctgccgaccatcttctccgatgagacgctgaagattcgtcaggcgcaggcggcgcgcgccaccgacctcttcaacgaggagatggttcagctgggcaaggcggtcagcaactgggaggcgaagctctcccagttcaaggtggaccacctgggcgagctgcccgagcagatggagatgaacatgcgcggcctggagcgcgtgtcgcatcagctccagacgaagtcggaggagctgcgtgtcgccgagggccgccgctccgacctggcccgcgctcgcaacgcggtggacagcgaggctggccggctcgaggccgcggagaacgggctcacccgttccctggtcaacgctcgcaccacctggacggaggaccacccggaggtgaagcgccttcagacggagctggacggaatgtcggctcgccgcaaggaggccgaagggcggctgtgggccgagcgcgccgagcgcacccgcgtggccacgctgattggcaacatccagcaggagattcaggacctccagaagcaggccgaggcgtaccagggccggctgaacaacaccccgcgctgggcgcacgagctggcggtgatgaaccgcgactacgaaatcgcgcgcaccaagtaccagagcgtggtgagccgcaaggtggaggcggagatcgcgcaggagctggaggccaagagcgccaagagcctgttcaacgtcatctccccggcgggcgtgccggcgaccccggcccggccggaccgcatggcgggcatgctcatcgtcttcctcctggccctgggcctgggggcgctgacgggagcggtgctggagatgcgtgatgacagcctgcgcgatggcaccgaggttcgccagcgcctcacgctgccggtgctcgcggtggtcccggaaatgcagggcaagacggagcggcggattctgatgccggcttcgggggctcgaaacagcgtgtctaaccccacgtcgttgaactga

SEQ ID NO: 2737 - DNA, 726 bp, Myxococcus xanthus
atggagcgggcgggcaacttcctcccccgagtggatgacaacccgacgggcggcaacgcggtggaccgccgggtggtgacgctgacggcgccggcatcggccgcggcggagcaataccggagtctttactacaggctcgagcggatgcgggacctgcggccgatgaaggtcgtcgcgctcacctcggcgatgcccggggaaggcaagacggtgacgagcgtcaacctggcgctcgccgcggcccgggcgaacccggagcgccgcatcctgctggtggatgcggacctgcgccggggcggcgtggcggccatgctgggcatgcgcaacaagatgggcctggcggagctgctggcgggggactgtgaggtgcgggacgtggtgcggcggttcaactccacgcgcctggccctcatccccgcgggcgtcacgcccgaggacaccgcgcaggtgctggcgagcggtcggatgaagcagttcctcaaggcggtgcgtgagggcttcgacgaggtctacgtcgacctgccgcccgcgctgcccttcgcggacgcggccatcctgggccatcaagcggacggcatgctgatggtcatccgcgccaacgtgacgtcgggcaaggcggtgcacctggcggtggagagcctgggcggcgcgcccatcatcgggtgcgtgctgaatggcgcggaggtccactcggcgccgtatctgaagaactacgagaagaagtag

SEQ ID NO: 2738 - DNA, 1281 bp, Myxococcus xanthus
atgggcgcggcggcctgcgcggcactcttcgcgcccgaagggacgcacacgccgctgtcgcaactgtggcccacgctgctgtggatgggcgcggcgttcgtcatcaccttccagttcacgctgtacctgttggacttgtatgacctccgtgtggccgcggaggaccgggtgaggggataccggttcctcaaggccgcgggtgtcacggcgatggtggcgggcggcgtcatgctcgtcaccccgctggtggtgccgatgcagcttccaccgggcacgctgctgggcggggccatgggcgccctggccgggacgttgatggtgcgggtgtccatccgcgccctggtgggagcgccgcactcggtgctcatcgtcggagaagggcccaaggcgcgcgcggtggccagcgcgattgacgcgggcggggagggcacctaccgcatcgtgggcctgacggacccccgtacctcgggtgaggcgctggaggagacggcggcccggctgaacgcggcctatgtggtgcaggccgcggatgacatgcgcggggccaactgggtggacggcctgctgcgctgccggctccagggccggcgggtgtatgaggccacgggcttctgtgagcgggtgctgcgccggattccggtgcagttcctgcgggcgagcgacttcgccttcgcggacgagctcaccgtgtccccgctgcgccgcacgctgaagcggggcttcgacatcgcggtggcatccctcctgctaatgctgtccgcgcccttcctgttgctggtcgtggtggccatcaagctggattcgaagggccccatcttctaccggcaggaaaggaccgggctgttcgggagcacgtatcacctgtggaagttccgcagcatgcgcacggacgcggagaagcatggaccggtgtgggcgaaggcgaacgatgaccgtgtcacgcgggtgggccgcttcatccgccgtgcgcgcatcgacgagattccccaggtcttcaacatcctgacgggagacatgagtttcgtggggccccgccccgagaggccagtgttcgtcgagcagttgaaggagcagattccgttctacggcctgcgggaggccgtcaagccaggcctgacggggtgggctcagattcgctacccctacggcgcgtcggtggaggatgcgcggaacaagctggagttcgacctgtactacgtgaagaacggttcgctgttcctggatgtgggaatcatcttccacaccgtgaggcatgtgcttctcggtcgtggggcgcggtag

SEQ ID NO: 2739 - DNA, 503 bp, Myxococcus xanthus
atggtgggaatggacatggaagcgccgctgcccgcggagtgggcggaggcccgtcgcaggctggagctggagcgccagggcaacgaggtgcttcaggggcgggtggaccggccgacgcgcatcgtcgccatcggcggaggcacggggttgcccatggtgctgcgcggcctggcccggcgcgcgacaccgaaggcccgggagcccggcatcgacatcaccgcggtggtggccatgagcgacgacggcggcagctcgggccgcctgcggcgccaacacggcgcgctgcctccgggcgacatccgcaactgcctggtggcgctggcgggtggaaagaacgcgctcaaggacgtcttccagttccgcttcggcggggcgcgcggcctggcgggccacgcggtgggcaacctgctcatcgccgcgctcgcggagctgaagggtgacttcatggaagcggtgcgcatgtccggggagctgctgggcgccgggccactgctgcgtcacct

SEQ ID NO: 2740 - DNA, 1963 bp, Myxococcus xanthus
atgaccaccctccccgacctcgacctcatccggacctccatcgagcgcatcgacgaggagatcctcgatgccctccgccgccggatggcgctggcggacgacgtcgcccgggcgaagctggccgccgccgcgcccttccgggaccagcgccgcgaggacctgctcctgcgccgcatccgcacccgcgccgcggagcacggcctggacccgcacgaggtggagcgcatctggcggctcttcatcgacatgtccgtggctcggcaacacgagctcgtcacccgcctggacaccacgcccctgcgcgtggcctaccccggcgtggagggctcctacagccacctggccgcgcgccgccgctatgggcaccgcgcgggcggcgtgctgctgtccggcttcgaccatgcgcgagaggccgtggaggcgctccgccgcggcgagcaggacctggtgctgctgcccatcgagaacaccaccgcgggcagcatgaacgagacgtatgacctgctcgccgagggcggcgtggtcatcaccgcagagctggtcagccaggtggaccaccgcctgctgggcctgccgggcgcgaagctggaaggcctgcgggaggtgctgtctcatccgcaggcgctggcgcagtgcgagacgttcctccgggagaaggtgccctgggcccgcgcggtgccggacgtggacaccggcggcgcggcgcagaaggtccgcgagcgcaacgacgcgtcggtggcggccatcgccagcgagacggcggcgcagcgcttcggcctggaggtgctcgcgggcgatttgcagccggccttcgactacacgcgcttcgtggaggtgggccgtgaggcctcgcccctggcgcccggcgtgccgtgcaagacgtccctgctggtggtgctggagcacaagcccggcacgttgggagagatgctccagcggctcaccctgcgcggcgtgaacctgagcaagctggagtcgcgccccatcccggggcagccgtggcagtaccgcttctacctggacgtggagggccacgccgcctccgcagcggtgacggcggcgctcgacgacatccgtccgctcacctcgtcgctgcgcgtgctggggacgtatgcgcgcgcggagtcgcctcatgcctgagtcgccgcgtcgcatcgccttccagggcgagcctggcgcctacggagaagaggccctgcgcgcgctgcatggcgccgacgtggaggccgtcccctgcctcaccttccgcgccgtcttcgaagccgtggccgaaggccgcgtgcacggcggcgtggtgccggtggagagctcgctgggcgggcccgtggcggagacggtggacctgctgctggagcatgacgtgccggcgacgggcgagctgtccctgcgcatccgccactgcctgctggccccaccgggcctgtcactggacgacgtccagcaggccctctcccacccgcaggccctggcgcaatgcgcgggctacctgcgacggcggggcatctcaccgctgccggaggcgaacaccgccatcgccgcgcgaaaggtggcggaggagaagcctccgcacacggccgccatcgccagccgcatgtccgcggacctgtacgggctggccgtgctggaggaaggcgtggaggactcgccggacaacttcacgcgcttcatcgccctggggaccgcgcccgaacggacgtggacgcggcggaaaacggcgctggccttcaccgtggagaacgggccgggcgcgctgttccgcgtgatgagcgccttctcctcgcgcggcctcaacgtggcgcggctggagtcccggccgcagcgccgcgcctgggagtacgtgtggtgcctggacgtggacggcgcgctggaggacccgcgggtacgcgaggcggtggccgcggcccaggccgcctgcgtcaccctgcgggtgctcggaagctacggcgtggtgtgaggctcgctc

SEQ ID NO: 2741 - DNA, 444 bp, Myxococcus xanthus
gacatccgcaagattccggctcaggacacgcgcggcctccgccacgccatcctccgtcccaaccagcctccggagatggccgtctatcccggagatgacgacgcggacacgctccacctgggcgtctatacggagggtcgcctggtgggcgtggcctccctgtatcgggagccgccgccggacgcgctgcgcgccaccacggcctggcgcctgcgaggcatggcggtggacgccaccctgcgtgggcacggccatggcgccgccctcctgaaggcctgcatggagcatgcggcgcggcagggcggttctcaggtgtggtgcaacgcgcggatgacggcctccgggttctatcgtgcgcagggcttcgcccagcgaggcgagcccttcgacctgcccggcatcggcccgcaccacctcatgtggcgcaacctcggaacctcgtga

SEQ ID NO: 2742 - DNA, 429 bp, Myxococcus xanthus
atggccaagccacagtactggctcatcaagagcgagccctccgtctacgcctacgcccagttggagaaggacgggaagacggagtggaccggcgtgcgcaacttcgaggcgcgcaacaacatccgggcgatgaagcctggggacctctgcctctactaccactccaacgaggacaaggccgtggtgggcgtggcccaggtgctcacgccaccgggaccggactccaccgtgcctgatgaggactgggccgccaccttcatggggcctgtcgtccccttcacgcagccggtggacctggccaccatcaaggccaccgccgcactgaaggattttccgctcgtcacccgcggccggctgagcgtggcccccgtcaccgccacgcacttcaagcaggtgttgaagatggggaagacagtactaccgaagtag

SEQ ID NO: 2743 - DNA, 144 bp, Myxococcus xanthus
atgaccctgatgggtgtggccttcgcaacgcagatggaggccgcggtggtcgctgtggtgggcctggcgttgtacgcgagcagcgcgctgctcacgaacaaggcgccggcgacggcggccaccagcgtcgcgaagcaggcgtag

SEQ ID NO: 2744 - DNA, 573 bp, Myxococcus xanthus
gcggtgggcctcttcggcgtggatgagacgctggcgcagctggcgccgctgccagggccggacgcgctggggcaactgcggcccgtgcccacggtggcctctccggccttcggtgtcctggacggtcaggcgctggccatggggcgcattcgcggggccaacgcggcgtcggcggcggtgctgcgggtgagcgacgtgcctcggcgcgagcacacggagccccgcgtgacggtgaacgcggtgacggccttcgagccggagtcggagctgaccgaccccttctacaccgtgctggcggagctgcacgcacaggtgcgcgcctgggaggagaaggcgccgcaggggcagacgctggaccccgcgggcatggcccggctgtgggagggcgcgctggcggcgtgtgagaagcgcggcgacaaggtgacggatgcctttggccgccggttgaagctgtcgcggctgcccgtggacctgctggcgctcaccgacccgcgggcggtggtgtccagcggcacgcggctgccggaggacgtggagaactggaacgcttgggttgcccaggaggcgccatga

SEQ ID NO: 2745 - DNA, 333 bp, Myxococcus xanthus
atgcccattcccgagattgcccccgcccgcctcgccgagctgctcgccggccccgcggagtcccgccccgcgctgctcgacgtgcgttttcccacggagaatgcgtgggtcgccctgccggactcgctactgattcccctgcctgagttggaagagcgcgcggaggaactggaagccctgcgcggccggcccgtggtggtctactgccaccatggcgtgcgcagcctggacggcgcggcctacctgatgtcgctgggcatcgacgcggtgtcgctgcgaggcggcatcgacctgtactccctgcaggtggaccccagcctgccccgctactga

SEQ ID NO: 2746 - DNA, 168 bp, Myxococcus xanthus
atgttcgtggcgctcttcggtgacaacgtgcggcgcctgttcggcgcatccgctgacgcactggcgggggcgcccgcgccccaggcatcgaaaagcctccgcacctttggacagaacaactccgagtacgacgaggtgcaagcggtgctggcccccccgccggtcatg

SEQ ID NO: 2747 - DNA, 681 bp, Myxococcus xanthus
atgcggcagcgtcattccagtgtgactgacatcgagatcatcgaggatttctcgtctaccgcgagatgcgacgagggctttctcagggttcggcggctgcgctgccgcaaccggcgcgcggacggttcttcctctcccgtataccgcgtggacgtggtggaccggccccggttggacgcggtggcggtgctcgtctatcgccgcggcgcgtcaggtctggaggtcctgacgcggatgaacctccggcccgcggcgtatttccggaaggacagccgtgacgcgatgaccgttccagaccctgcgtctggctacttgcgcgtggaagaaattgtcgcgggactgctggagccggaggacaagggcgaggacggcctgcgtcgccgcgccgcggcagaggtgcatgaggaggccgggttcaacgtgaagccggaggacatccggctgttgggcggcgccttcttcctggcgccgggcatcctgtccgaaaaggtgtttcccgccgcggtggacgtcaccgacctgtcacccgaggagcccgaaggggatggttcgcctctggaggagggcacgcagttgcactggcgtcccatccaggacgtgttggacgcgtgccggcgcggtgacatcccggatgcgaagacggaagtcgcgttgacgcggctgctcgccctgcagccctga

SEQ ID NO: 2748 - DNA, 1464 bp, Myxococcus xanthus
atgtcgtcgctgcccccctggctggcccagttcctgcccatcctcatcctcctgggggccatcggcctcgtcctcacgcgcctgcccaaggtggagctgggacactcggaggcattcaagcgccgccggttcttcaactggttcccgttgggcatgacgtacgcgttcctctacatggggcgctacaacctcaacgtggccaccagcgccatgggggaccgcacctccaacgcggacttcggcaccatcttcgcgtggggcaccgccgtctacggcgtggccttcctcctcaacggcccgctgacggacaagctgggcggccggaagaccatcctgatggcggccgcgggttcggcggtggcgaacgtggccatgggcggcgtggtgtacgcggtgctgacgcacaactgggcgccgccgggcggcctggtggcgacgctgtcgttcctctacgccgtcaacatgtacttccagagcttcggcgcggtctccatcgtcaaggtgaacgcggcctggttccacgtgcgcgagcgcggcctgctgggcggcgtgttcggcatcctcatctcgctgggcatctacttcgcctacgactggagccggctcatcgtgaaggcggcgcccacgtactgggcgttcttcgtgcccgcggccatcctcgccgtgttcctggtggtggactacttcgtcatccgcgacacgcccagccacgcgggccatccggacttcgacaccgcggacgcgtcctccggagagacggggccgcagttgggggtggcgggcgtgctgaagcgcatgctgaccaaccgcgccatcatcatcatcctctgcatcgagttctgcagcggcttcatgcgcaacgccatcatgcagtggtaccccaagttcgcgaaggcgacgggccttggcgaaacgttcgtcgcggccaactggggcatgctgctgtgcgtggcgggcatcaccggcggcatgttcgccggcgtcatcagcgaccgcgtcttcgactcacgccgcggccccgtgtccgccgtgctctacgccggcatgtcggtgggcgccgtcatctccgtgttcgtcctggagagcgtggccctgggctggacggtcatcttcatgtccctgtgtgtcatcggcgtgcacggcatgctgtccggcacggccagcatggacttcggcgggaagaagaacgccggcctcgctgttggcatcatcgacggcgccgtgtacgcgggcaccgcgctgcagtccatcctgctgggttccatcctgccgatgggtgacgaggcgaagaccgccgccaactggggcaactggccctacgccatgctgccgctgtccttcctcgggctgctgctggccacccaggtgtggaacgcccggccccagccgaagtccacgcctgtgccggccaccctgccggtgccctcggaggcgccagcgaatcggaccggtactggcgggtga

SEQ ID NO: 2749 - DNA, 1272 bp, Myxococcus xanthus
atggggtccgagaaggacgtcgtgtaccaggccaagctcctctcctgcgtgctgcgcggtgcgctgcgccgcttcgccaccggggtggagtcgcggtgcgagggccccgcggcgctgaccacggacgcgtgcgcggtgctggagtccgagatcctggccatgcaggcgggtgtgacgcaggtgctggcgcgcttccgcgtgtggctgcgcgcggtgggggagctgcacctgcaggagcgctcgcgggcgtcgctgcggctggtggacgaatacgtcagcctgctggtggagggcggctttcggcgctcggtggcggacatgaagtcgctgccccgcggcgagccgtggcatgggctgcgcaaggggctgatggaggcggtgctgcgggaggaggcgtaccgcaaggagcaccggctgcgcagcgtgctcagtcccacgggggacaacgaggagtacatccttcggctgggcttcctgaagaagttctgcatgaacgtgctgttcctgtcgtcgaagcggcggcagaagcggcagggctgggaggagatgctcttcgcgctggccgcgggcatcgcgatgacggtcgccaccgcggtggccttctgggcgcaagagcgctacgcgcaggccagcctcaacttcttcctcatcctcgtggtggggtacatggtgaaggaccgcatcaaggagggcctgcgccggatgctcagccgggtagcggccatgcacctggcggaccggaccacggacctggtggaccccgtcaccgggcgcgtcattggcgcgtgtgaggagcgggtggactacgggccctcgctgaaggttccagacacggtggcggcgctgcgccagcgcgatgacttcctcaccgcgacgcagggcgagctgtcggagacggtcattcgctaccagaagcagattgtcctggatgcccggcacgtgccgcgcacgcagcgcggcctgacaggcgtgacggacatcctccgcctcaacgtcgagcgcttcctgcgcgacatggacgagccggagctggcgctggagtacgtggacctggcggacctgtccgtgggccacatccgcggcaccaagcgctacccggtggacatggtgttccgcttcacggtggtggaggaggagacggaccgcagccaggactccgtccagttcgtgcggctggtgctggaccgcaacggcatccagcgcatgcagcgcttcacggaccccggccccggaatgccgcccagccgttcggggtggaaggccgcggcctga

SEQ ID NO: 2750 - DNA, 747 bp, Myxococcus xanthus
atggcttacgacgacttcaagaagcgtattcgcgacgactggcgtgacaccctgcgttccatcctggagcgcgcccgctcccagggctcctccgccgtgctggcgttcgacctggactccaccctgttcgacaaccggccccggcaggcccgcatcctccgtgagtatggtgccgcccgctcgctggccgtgctggccgcctgcgagccgcaccactgggtgacgggctgggacatgaaggaggccatgcgcgcctgcggcctggaggacgccctggtggagtcccacttcgccgaagcccgccgcttctgggccgagcgcttcttcaccagcgactactgcgtggacgacgaggccatcgacggcgcggccagcttcacccacgaggtggtggccaccggcgcgaggctcgtctacgtcacgggccgccatgaggccatgcgggaaggctccgtctcctgcatgcgccgtcacggcctggtgctgccggatgacgaccgggtgctcctcgtgatgaagcccacgctggccgaggacgacgacgccttcaagcgggaggcgcacgcgcggctgggccgcctggggagcgtggtggctgcgtttgacaatgagcccacgcacgcgaacgactaccggcggaagtttccagaggccaccgtcattcacctggccacggaccattcgggccggccggtggagttgctggatggcgtcatttccgtcccgcacttcgcgctgggttcctga

SEQ ID NO: 2751 - DNA, 1161 bp, Myxococcus xanthus
cgggagttccgtgggcggccagcatggaggcattccgcagtggccagcccgtactcaaaagaactgctgttggacatgtaccggaagatgtacctcatccgtcgcttcgaggagcgcgcgggtcagcagtacacgctggggaagattgccggtttctgccacctctacatcggccaggaggccgtggcggtgggaccggtggaggccctgcgaccggatgactacatgctcagtgcgtatcgtgaccacggccagccgctggcccgtggcagcgacgcgggcatggtcatggccgagctgatgggccgggacaccggctacagcaagggcaagggcggctcgatgcacatcttcgacatcgagcatcacttctacggcggctacggcatcgtcggcggccagattcccctggcggcgggcatggccttcgcgagccgttatcgcaacgaggaccgcgtcaccgtctgctacttcggcgacgcggcggccagccagggcgccctccacgagacgttcaacatggcgtccaagtggaagctccctgtcatctacatctgcgagaacaaccgttacgggatgggcacggccatttcccgcatcgcggcggtgccggagatctacaagcgcgccagcgcctacgacatgcgcggcgagccggtggatggcatggacgtgctggccatgtacgaggccgtcaaggacgccgccgagtactgccgcgccggcaagggccccgtgctgctggaggccaacacgtaccgcttccgcggccactcgatggccgaccccgccacctatcgcaccaagcaggaggtggaggatgagcgcaagggcgacccgattccgaagctgcgcgcctacatcctgaagcaggggctggcccaggacgacgtcttcgagtccatcgaagcggaggtcaatgcgcaggtggaccaggcagtgaagttcgccgacgagtcgcccgagcccagcctggacgaactgtggcgcgacaccatcgtggaggagggcgaggaggacgtgcgcccccgcgagcgcgtgctggggcagaaggtgaactggccgacgtaccccagtggccaggagctgaaggtgacgtgggacctggagccgcgcgagcaggccgaggcggccgacaagaaggcgggcctcatccgctag

SEQ ID NO: 2752 - DNA, 729 bp, Myxococcus xanthus
atgcccgagttgatgtaccgcgaggcgctgaaccaagcgctcgccgaggaaatggaacgcgacgccaacgtctatctgattggcgaggaagtgggccgttacaacggcgccttcaaggtgtcgcagggactgctggacaagttcgggagcgcgcgcatcatcgacgcgcccatcgccgagctgggcttcaccggcctgagcgtgggcgcggccatggtgggcttgcgccccgtggtggagatgatgacctggaacttcgcgattctcgcgatggaccagatcgtcaacaacgcggccaagctgcggcacatgtccggtggccagctgcgctgccccatcgtgttccgcggtccgggcggcgctggcggccggttgtccagccagcacagccaggcgctggaggccaactacgcgcacttcccgggcttgaaggtgattgcgcccgccacgcccgcggatgccaagggcatgctcaaggctgccatccgggacgagaacccggtgctcatgttcgagggcgagcggctctacgccatcaagggtgaggtgccggagggcgagcacgtcgtgccgctcggcaaggcggacgtgaagcgcgagggctccgacgtcaccatcatcacctggagccgcatgtattacttctgcatgcaggcggctgaggagttggcgaaggaggggcatcagcgtggaggtcctggacctgcgcacgctgcggcccctggatga

SEQ ID NO: 2753 - DNA, 96 bp, Myxococcus xanthus
atgtcctatgcagcgaacctggagaacgcgacccagccggacgcaccgaagatcatcgccgcggtgaagaaggtgctgtaccgcgagggagcttga

SEQ ID NO: 2754 - DNA, 1545 bp, Myxococcus xanthus
atgacggaggggaagatcgtcaagtggctcaagaagcaaggggacaaggtgtcctccggcgatgccgtggccgaggtggagacggacaagtccaacctcgaaatcgaggcctacgacgacgggtacctgctgcaggtgctcgtcggcgagggcgagatggccaaggtgggcgcgcccatcgcctatatcggtgcgaagggtgagaaggtgggggccggcaagcaggtcgcgcccgccgccgcgcctcctgagcagaagccccagccggcacccgcggcccccgcgccgcaggccgccgcgaagcccgcatcgtcgggcggcggcgacaaccgcatcgccatccagatgccgagcctgtccccgacgatgacggaggggaagatcgtcaagtggctcaagaagcagggggacaaggtgtcctccggcgatgccgtggccgaggtggagacagacaagtccaacctcgaaatcgaggcctacgacaacggcaccctggcggagatcgtcgtcggagagaaccagatggcgaaggtaggggcacccatcgcgtacctcaccgcgaagggcgccaaggcggccccggccgctccggcggcgcagcccaagccgcctgctccggctcccgagaagccggcggcagcgaagcccgcggcggctccggcccaggcgggtggccggcgtctccgcgccagccccgtggcgaagagaatcgcgcgcgagaagggtctggacctcacccaggtgagtggctccggtccgtctggccgcgtggtgaagcgcgacatcgaggaggcgctcgcgcgtggaccggcggcggttcctgccgcgaagaaggccccggccgcgcagcccgctccgggcgtgcgtcccgagccgaccgtgctccccctctcgtccatgcgcaaggtcatcgcgcagcggatgacggaggtgaagcccggcgtgcctcacttctacctcaccatcgaggtggacatggaggcggcgtcgaaggtgcgcgaagaggcgaaggcgatggacctcaaggtctccgtcaacgacctcatcgtgaaggccgtggccatggcggtgcgccgttacccgaagatcaacgtctcgctgcagggcgacaaggtcgtccagttccacagtgtggatgtgggcatcgcggtggcgctggaggaaggcctcatcacgcccatcctccgggatgcggaccagaagggcctgcaggccatcgcgtcgggcgtgcgtgagctggcggagcgcgctcgcaagcgtgccctcaagccggaggagtacaccggcggctccatcaccgtcagcaacctgggcatgtacggcatcgaccagttcgtcgccgtcatcaacccgccgcaggcctccatcctcgcggtgggtgccgtctccgagaaggcggtggtgcgcgatggtcagctggcggtccggaagatgatgacggcgacgctgtcgtgcgatcaccgcgtcatcgacggtgccattggcgccgagttcctgcgcgagctgcgcgggctgcttgagcaccccacgcggctgctgttctag

SEQ ID NO: 2755 - DNA, 297 bp, Myxococcus xanthus
atgaacgacgacatgacacgcgaacggcttgcccagggtgtgtcggagttggagtcgcgcgtaggcccgccgctgccgctggcggaatcgctgcacaaggcgctcgacggcgccgtctttccgctgtccgcgcggcagttgacctgggtggcccgtgagaacgaggccccggccctggtgctctcgctcctgggttcgcttccccgggccagcttcggctccgtggatgcggtggcccgggcgctggaaggcgacctggaggccacggttccgcaacagtcggcttcttcgcgctga

SEQ ID NO: 2756 - DNA, 462 bp, Myxococcus xanthus
atgccaacagagggagagcccatctccgtgtcgttgcatgtaggcaacttcgagggtcccgaattcgacggccccctcaccgtcaccttccaccccaccgggtcgccttcccagcagacgaagacgctgacgcgggacggggtcaactggcacacccagttcactccggacgagcccggcccctgggacctggaggtgcggtaccgagggacccacctgaaggtgatcaccgcgcgcttctccgtggccagctcgcccctgccccgcggcatgggctgggggttgattctggtgggtgccggcacggcgctggccctgggcctgcgcaacgtcctgcggcgcgtgaagtcatccggagccacccctggggcaacggagactccgcccccaccggcggcgccctccacgccggaagcgggcagcgtccccatcccaccggccgatcctccgtccgggcagtaa

SEQ ID NO: 2757 - DNA, 1158 bp, Myxococcus xanthus
atgaacccgtctgaactccccgcggtcctctacgtcgacgatgacgcgctgaacctccgggtcttcgacgcgaacttcgggcagcgcttccgcatctttcgcagctcctcgcccagcgaggcgttggcgctcctggagcagcgcaggggcgagattggcgtcatcctctccgaccagcggatgccgggcatgacgggcgtggaactgctggagcgggcgcgcacgattgctccggacgccaagcgcatgctcgtcacggcctacgcggacatgcaggccgtcatcgacgccgtcaaccgcggccaggtgacgcgctacttcgtcaagccgtgggaccggacggagctccaggccgcgctcgatgacgcgctcaagattgcccgactggagctgcgcatccgcgaggtggaagggcgcatgctgaagtccgagcgcctggccaccctgggacaggtgacggcgggcatcgcccacgagctgatggggccggtgggctacctgtcgcagaacgtggcgtcgttgcagcgcgacctgggcagcgtcatccagtacgtgtcgcggcacctgcagacggaccccgagcccgccgtggcggagacggtggaggacctgcccgccctcatcaaggacctggcggacggcgccgagcacctgcggcaggtggcgctggggctgcgagcccaggcccgcggtgaggacctggaggccacggcggacgtcgcggaagtggtgtccttcgcggtgaagctggcgcgcgccgaggtgcgggagcgggcgcggctgacgagcaacggcgagcccgtgcgcgtcaccttcggcccggtgaagctgtgccaggtgctgctcaacctcatcgtcaacgcggcgcaggccatgggcaccacgggacgtcccgggcgcatcgaggtccggtggacaacgactcccgacgacgtggtgctcacggtggcggacaacggctgcggcattcccatggagcagcaggagcgcgtcttccagcccatgttcaccaccaagcccgtgggcgtgggaaccggactgggcctgtccatctgccgggagctcgtcacgcagttcggcggcagcctccggttgtcctccacgcaaggggagggcacggaaatcgaaatcaccctccggcgagccccgcccccctga

SEQ ID NO: 2758 - DNA, 156 bp, Myxococcus xanthus
atggacctggtgggcttcggcaccagccagggcgccgtcgcgctgccggagaaggtgcgcatgttgttgctgcgccggggcgtgcagcgggcgcaagatcggctcgccgcggcgctcgccgccttccggcagagcatcgccgcgccgttgccctga

SEQ ID NO: 2759 - DNA, 291 bp, Myxococcus xanthus
atgggggacattggccaggtggtgcacggcctggcgtccttcacgccgggcgaggaggtggtggtcttcctgcagaagcgcggcccccgtgccttccgcgtctccgacatggcgcaggggaagttccaggtgaagcgtgagggaaagacggcgctggccgtcccggagcccaccgagtcgcaactgttggaccccgtcacccgaaagccggccgcgtccgcgctccagtccatgacgctggtggagctgaaggccgccatccgtgaagcccttggggagcagacgccgtga

SEQ ID NO: 2760 - DNA, 867 bp, Myxococcus xanthus
atgctggccctgaccctgggccaggtggacccctacgtccgcagccgtgtcgatgcgggtgacacgcgcacgcagtgcctctactggacgtccaatcgcgtcgtctggaaccagagcacctacggcaacccggacacggcgggcgactccgagttcgacgcgattcgcgcctccttccagagctggcaggacattttcgccgagtgcggcaacctcacgttggtggaaggcccgcgcgtggacgaacgcgaggtgggctaccggcgccagggaaccaataccaacctggtgctgttccggacccgggactgcaactccgtagtgcccgcgaccgatgcgtgctgggccgacgacacgtgtgccaacacacatgactgctgggatgacgacgacaacaccatcgccatcaccctcaccacgtacgacgagcgctcgggcatcatctacgactcggacatctccttcaacgcggcgcgcttctccttcacgacggcgaacggcggcacatgcttcccgccggtgacgacccactgcgtggccaccgacgtgcagaacaccgccacgcacgaggtcggccacctcatcggtctggaccacacgcgcgccaccggctccaccatgaaccccagcgcgccgccgggagaggtgtccaagcgcgtggtggactcgggctcgcgcggctttgtctgtgacgcctacccccaggggcaggccagccagtcgtgcctccacccggtgacgtccatcgaactggggcccaaggctggaggctgctccgcggcggggccgggtggagcgctgtcgctggtggccgtctggtcgctgtggctggcgcgccgccgccgtcgcgaggaggcggtccggtga

SEQ ID NO: 2761 - DNA, 623 bp, Myxococcus xanthus
atggaggaggagccgtcctaccgccgcaccgtggtgcccaggcacccgctgtgcctggtgtggccggtgcgtgagtatgtctaccacctagatgcggcgggcagcgcgcgcacgcctggagactccgaggtggcggccatcgaggcgtccttcgactcgtggcggaacatctccgacgggtgcagcgactaccggttcacccggggcgaggactggcgagcgcccatcgccgtgggctacgacgagacgcgtccccgggacaactacaacatcatcacgttccgggagacgtcgtgccacgaggttgccccggcggatgatgcgtgctggaccgaagagacgtgcggcaacgtctaccagtgctgggagcatccgcctgggaccatcggcctcaccacgtccacgttctcctatcgggacgggcgggtgttggactcggacatcgagctgaacgcgtcccagccggcacggggctacggcttcctcttcaccacggtggactcaccggtgtgtgaaggcgagccctcggtggactgcgtggccacggacatccagaacaccatgacgcatgagattggccacgtggtgggcctggaccatgtcttcgtcccgggcgccacgat

SEQ ID NO: 2762 - DNA, 765 bp, Myxococcus xanthus
atgccggtgctggaaggccaggactacaacctcgaggggcaggaggtgcgtctgacgctccttcatacctcggacatccattcgcgcctcatcccctatgacttcacgccgttgaagacggacgtggacctggggaccatcccggaagcgggtcccttcggcggcgccacgcgcatgggggcgttgctcaagcgcgagcgctcccagggcgagcgtgtgctgcacgtggactcgggcgactgcttccagggcgcgcccatcttcaacctcaacaccggcgaggtggagttcaagttcctctccgaagcgcggctcgacgcggccgtcgtgggcaaccacgagttcgacgcgggcctcctcaacttcacccagatggcgcagcagcacgcgatgttcccgctgctggcggccaactacttctgggacgactggcgggcgaacggcaaccaccagacggccctggaagtggagccgtacaccatccgcaacgtgaagggcctccgggtggccatcatcggcatggccaacatctcctcgctcaactccatcgtcgaaggtggcaacagcctccaggtgacgccactggagcagaacgaggtggcgcgcgcctacgtggacctgctgcgccccgtcaccgacctcatcgtgctggtcagccacctggggctccatgaggaccaggacgtcatccagggctacgaggcctattacgagtactcccgcgccaaggcctacgtgcagccccagagaggccccctgcctgag

SEQ ID NO: 2763 - DNA, 249 bp, Myxococcus xanthus
atggtggacagcaagggtaaatccgaggagacgaagcacaacgcagttggagacaacggttatgcggagcgcatcgagcatgtggagggcacgcacccagagccctggcccggcatccgcggtcgctcggacgatgaggagaacgagctgccgaccggaacgtctcgcgagcgccaggcaagcgtgacgcagactcaacgcaagctggagcaggaggcgcacggccgcaaagagccgacgcgcaagtaa

SEQ ID NO: 2764 - DNA, 189 bp, Myxococcus xanthus
atggtggagcgccccggtccccgttacgcgctggtggtggagtacgcgccagagaatgcggaaggcccgctgcgccgcgcggtgctggtggaggacatccgcgcctccgagacgcagacgctgcaccgcgtgtggcgcatgctcagcaacgccttcggactcaggggggcggggctcgccggagggtga

SEQ ID NO: 2765 - DNA, 408 bp, Myxococcus xanthus
atgatgcgtgcccttgacagcctgaaacgtggtttctataaggcgcgcccgctcggagcggcgctggtggcgctctgggcggtttcagcgggcgccgaagtcatcaatggcgcgcagttgccggatgggtccaagcgggtcggtgagaatcgctaccggtcacccagggatttcgatggcacgctggagtactaccgcgcggtctactcgacgagcggttaccctcgccggcagatcgtgaaccagccgggcgtcaaggcggttcacatcagcaacccctcggggaagaacttcgcggggctgaacatttacgaggcgaacgacgaagttcgcatctacatcgtcccgacccagcaggcagccaagcccgccaagaagccggagacgacgaagagcaggaagaagtaa

SEQ ID NO: 2766 - DNA, 1428 bp, Myxococcus xanthus
cttcgcgtccgcttcgctccctcgcctaccggctaccttcacattggcggtgcccgtacggcgctgatgaactttctccaggcgcggcgccagggcggcaccttcgtccttcgcatggaggacacggaccagggccgctccaccccggagtcggtgcaggccatcctggacgggctgaactggctgggcatcgactgggatgagggccccggtaaggaaggcccctacgccccctacttccagatgcagcggctggacacctatcgcaagcacgccgaccagctcatcgccgagggcaaggcctaccggtgctactgcacgaaggaggacctcgacgcgcagcggcaggtggcggagaaggcgggcggcgcgttcaagtacccgggcacctgccgcgagcggaccgagccccccgccggccgcaacgccgcggacgccgtcatccgcttcaagatgcccgcgggtgacggttccgtgtccttcaccgacaaggcgctgggcaccatcaccaagacgcacagcgacctggatgactgggtcatgatgcgggcggacggcatccccgtgtacaacttcgggtgtgtcattgatgaccacctgatggacatcaccctggtcgcgcgcggccaggagcacgtcaactccaccttcccgcagctcatgctgtaccaggcgctggggtggacgcctcccgacttcgcccacctgccgctcatcctgggcccggaccgcgagaagctgtccaagcgcaagcacccggaagcggacgtgatggtgcacaagcgcaacggcgtcatgccggaggcgctgctcaacttcgtcatccgcctgggctggagccacggcaacgacgaggtcatcagccgcgaacagatgctcgagtggttcgacttcagcgacgtgggcaccacctccggcgtgtggaacccggagaagctgctgtggctcaaccagcagtggatgaagcagttgccggtggagaccgtggtggagcggctgctccccttcctggaggcgaagggcatccaggcgaagggcgacccgcggctggagacgctggtgcgcacgctgcgcgagcgctccaacaccctggaagacatcgccaccaccgcggccaacgtctacttccgctccggcatcaccctggacgagaaggccgccaccaagcacctctccggagagtccctcaacctgctgcgcaaggtgcgcgagacgctcaccgcgctgccggagtggtcggtggaggcgctggacggcgtggtgaagcaggtgagcgaggcctccagcgtcggcatgggcaaggtggcgcagcccatccgcgtggcactcactggcaacaccaccagcccgggcatcggcgagacgctggtgctggtaggccgcgacgaatccctgctgcgcatcgacgcggcgctgacgcgcggttga

SEQ ID NO: 2767 - DNA, 1215 bp, Myxococcus xanthus
atgggcatgccggcgtgggctgtcgccaagacacccggcccacggacggaggcagttgccgagcccgtggaggatgcccctctgtcaggtggcgtggtggatgacgttgagcctcccgagcccttgctgccggaggaggacgacgcctcgcaggcgcagctcgagggcgccatggcccagtccctgccgcctccgtcgcagcctgcgcccggcgcgcagccgccttccgtgagtcccctccccggagcggatgacggggcgacggcagagcaggacgcgaacaagcgcaagcaaaagcaacggcccggtcaggcgcaggacgactcgctgggcgagaatccggacgcgattgacgacaagcccaagggcgaggtgcagaccatccgcgtcatcggacgcgtgtccgcacgggcccgcgctgacgagcgcaaccagtaccagcgccgcctctccatcgcggacgcacgcgtgggtgtgagcacgtcactgcccaacctggaagccgaagtgacggcggacctggcggactcgcaaatgctcaaggacgccttcgtgcgtctggcggatgaccgcaagcgattccgcctctacggcggccagttcaagacgcccttcctccagcgctcgctggagtcgtcgtgggacctgcccatccagacccgcggactggtggaggagtacatcacggagacccatcaaatgggtggccgccgcatggggctgatgggcgaagtccggctgaagcagctctgggggctcaagatctccgcgggcttcttccagggggccatcgacaatgcgggcgcgcggttgaaggaggacgccgccgcgcgcgtgagcttgcggcccttcaacttcaagcacgctcaccgtgggagtcagcacctacgtctgcgaagcaatggacctggcgcgcaagcacgcggtggccgcggacgcggagctgaagctggcgggcttcgtcttcaccggcgaggccatttccgggcggctgcccctggggcccttcacggcgcagatgctgctggcccagtacctcatccacgtgggcaacgaatgggccatccagcccgtcgcgggcgtggaggccttgcagcttcgcggcgacacggtgcggggggacggacattcactggtgggcggcttcaacgtgctgctcggcactcgcttccgggccctattccagacggagcgcgcgctgcgccccggcgatga

SEQ ID NO: 2768 - DNA, 324 bp, Myxococcus xanthus
cccaccgggccccaggacgtgatggtccagtgcgcccagaaggccgaggccctgcaggcgcccctgaagcggggcgacgtggagctccggttccaggagggccagtggaaggcctacgacgcggcgaaggcccacctctccaaggggcgcaagagcgaggcgctcgcgcagctcaacgattgcatcgcggaggggcgcatcctcgagaaccggtaccccgacttcaaggagcagaagttcgacatcggcggcaccagcatgagcatgttggagctgctccaggcctgcgcgaaggagcgcaaggcgctgcagccttccccttga

SEQ ID NO: 2769 - DNA, 237 bp, Myxococcus xanthus
atgcgcctcgtcggctactggatgggtcgcgagcattggggcaagggcatcgccactcgggccctctccgagtttctcgtgctcgagcccacccggccacttcatgcgtgggtcgctctcaacaacctcgcgtcgatccgcgtcctcgagaagtgtggcttccacaccctgcgcaacgagaacccgcatcacccggatggcgttgccgaagtcctgatgaggctgggttcgacgtag

SEQ ID NO: 2770 - DNA, 1050 bp, Myxococcus xanthus
ctcgaacgcatgaaggcgtcaccgcgcttcaaggacgggatgttccacaacacatccctggtgactcaggggctgaagaagggcaccgctgtctcgacgatgaaggagttcatctgtggcggtcagcggcgggtgccgactggcgtgctgcccatcgtcaatccgctcgagcagtggctgctcccggtgcagggcgggctccgcgcgacgtggctcggtcattccaccgtcctgcttgaggtcgatgggaagcgcgtgttgactgaccccgtgtggggagagcgcatctccccacttcccttcacggggccgaagcggtttcaccccgcgccggtgacaatcggtcagcttcctccgctccacgcggtcgtcatctcgcacgaccactacgatcacctcgactacccgaccatccttcaactcatcccgctcggggttccgttcgtcacctcactcggggtgggtgcgcatctggaggcgtggggcgtgcctcccgagcgcatcaccgagctcgactggtgggagtctgcggaggtcggtggccttaccttcaccgccgcaccatcacagcacttctcgggtcgcagcgtggccgataggaaccggacggcgtggtcgtcgattgtggtgcgcggtccgcatcacgccgtcttcttcagcggcgacacgggcctgacccaggagtacgtcgagatccggcagaggctgggaccgttcgacctcatcatgctcgaggtcggcgcgtgggacccggcgtggggagatattcacctcggaccggagaatgcgttgcaagcgcacgacctgttgggcggtggcgccttcttgccggtccattggggcacgttcaatctcgcaatccattcctgggacgaacctgcggagacgctcgtgaagctcgccccaacgaatgcgccgctgatcatgcctcggctcgggcagccgatcgagccgctccaggtgcagtcgatcgacccatggtggcgcgaggtcgatcaaaccgagacggaaccggcgccggcggaggcggtgacggaaccctccgactga

SEQ ID NO: 2771 - DNA, 1134 bp, Myxococcus xanthus
atgaccaccacccgtcgtgacctgctcaagttcggtgcgctcgctgctgcctccgccgccctgccgggttgggccaagccgtccaagcccatcaaacgcgcggcgaaaccgctgaacatcctgatcctcggcggcaccggtttcaccggaccgttccaggtcaactacgcactggcgcgcgggcacaaggtgacgctgttcaaccgcggcaagcgcccgtcaccggaatggccgagcgcggtcgagcagctgttcggagaccgcaataccggcgacctcaagtcgctgcaaggtcgcaagtgggatgtgtgcatcgacaaccccaccagcctgccgttctgggtgcgcgatgccggcaaggtgctcaagggcaacgtcgggcattacctcttcatctcgacgatttccgtctatgccgacggcagcaagcagggcatcaccgaggacgcgccgctggcggtgtatgagggcaaggacgcgatggccgaaacgcaggactcactgagagcggacatcgagcacctgtacggcccgctcaaggcgttgagcgaggccgaagcgcacaagcagttcggcaagcgcgtcaccatcgtccggcctggctacatcgtcggcccgcgcgacgaaaccgatcgcttcacttactggccgcaccgcgtggcgcagggcggcgagatgctcgtgcccggcgatggctccgacccgatgcagatcatcgacggccgcgacctgggcgagtggatgatccgccttgctgaaacgggcacgcttggcacgttcaacgctgttggcccggcgaaaccgctgagcaccacggccatgctgaaaggctgcgagcgggtcaccggcaagaagccgacgtacacgcatgtgtcgccggaattccttgaggagaagaaggtcgagctgccgatctgggtgtcgtcaaagagcgggccctatgcgggctacggggcggtcagcaatacccgggcgatggcggccgggctcacttaccgccccttcgacaccacggtgaccgatctgcttgcgtggttccgcagccagccggccgagcgccaggcgacgctgcgtgccggcattacgcgggagcaggaagcggcgctgctgaaggagtggcacgccaagctctga

SEQ ID NO: 2772 - DNA, 255 bp, Myxococcus xanthus
atgatcctggcggttgcggtgttggggctgacggcatgtggcagcgatgactcggagcagagcgccgagtgcaagaagtacctggcctgcatcaaggccacgacccccgagtttcaggccaccgccgaagtgacctacggcgccgacggttcctgctggaactccgacgagacggccagggtctgcactgccgcgtgcaccgacggcctgacgcagctccggggccaccaccccgacgagtccgcctgcaagtag

SEQ ID NO: 2773 - DNA, 921 bp, Myxococcus xanthus
atggcgaacgcggcggcgagctgggagtacgtcgcggacgtcgacttcatctatgacagcacccaggacgcgagctgcaccaatgcgaaccccgcggtgacgttcgcggtgcagccgtggacggccggtggtgcgtgtgccttctttccctcgggaggtggctgtatcccgcgcacggtggtcatcgacattcccagcctggacccggcgccccccacctcgccgaatgtcacgacgggaaccgtgctcatccacgaactggggcacgtgctgggcttccgccacgagcactcggcttcgtcgctgaacccctgttatgaagactcgaactggagggagctcaccacctacgacgtcgcttcgacgatgcactatccctggtgcaacggcgtttcgacgtccacgctcaacctcacgtacctggatgccgcgggggccgccgccctttatggctggcataccaatgcaaacaatggggaccgccgctacccggcggcgcacaccaatgactatactgcggcgcttcagatgggacagtcgttcctcattcccttcgcggtgaccacgaacttcgcggaggggtgcttcctggtgggcaacggcccgaccgccgctcacatccgctacagtgatggcatggcaggcgctgtgctcgcgtccgcgacgagcgtcgtcgacacgggggttcagtgtggcgtcaacgcctcgtacacctggcaccgcgccaacttcccgggcgtagcgatgttcgcgaatagcgtgttcacggtggtcttcggcaatggcacgcagacgctccgcatggccatcaacattggaaatccatacaccagtggaaacatgtgggactcatttggcggcgggcgcagcctgtctccttgggatgggcgggtccggatggggcgcctgggccctccgtga

SEQ ID NO: 2774 - DNA, 834 bp, Myxococcus xanthus
gtctctctctgggtcgagtcacatgggcccgaggatgctcccgccatcctgctcatcatgggctccaccgtctcgggactcgtctggcccgacgagctcgtggaggccctggcacgacgccaccgcgtcatccgctatgaccaccgggacaccggcgcgtccacatgggcgttcgataccgtcccctactccgcgacccggatggccgaggacgcactcgccatcctcgatgcgctcggggtccagcgcgcacacgtcgtgggcctgtcactcggaggcgtcctggtgcagtggctcctggtcgcccaccccgagcggctgctcagcgcgaccgtcatcggagcgcccgccctcgacggggcgcccgccctcgacggaatgacagcacgcgtccccatcgaccccggcctgttcgagttctggcgccacatgttcgaaccccgggagcgcgaggcccagatcgagtggcgggtcgagaactggcgaaggctccacggcgcggtgctccccttcgacgccgaggagttccgcgccctggagcggcgcatcatcggccacgccggccgacacgacacctccaccgcccacgcgcgagccgacccctccggcctcgcacgcggagccgaactggcccacgtcaccatccccacgctcgtcatcgccacgccggaggacccgaccaaccccgagtccaacgcgcgcttcctcgctcggacgctgccgcgctccaccctggtgaccatcgacggcatggggcactcggtcccgcgcgccgtcgtgccctcgctcgcgaaggcgctgctgggccacatcgagacaatggcgcctcgctga

SEQ ID NO: 2775 - DNA, 933 bp, Myxococcus xanthus
atgtggcggctgcagcactacgggtggctcttcccaaacacgtactacgcgaagcactccggcaatcggctcctgaaccttccgctgggcgtctactacctcgtgctcgcgtgggcgccgtatctcgccgcgcccgtctcgttgggcgcgctcgcctgggtggcaacgccgacgcgggaggaagacccctccgcccggcggagcctgcaactggcgcttcatcttggcggggcctgccttgtctacgtgctctacatcgtctgggtgggaggcgatgaccgctccgcctttccgtcggtgcggttggttctccccgtgctccctctgctttggatggcgacggtgatgttggtggcgggcgcgagccgccattggacgaagctctcgccgcgcgcgtgcgcggtcggcgtcgccgcgttgatctccctggcctgggcggaggacgggctgcagttgctcaaggcctcggtcccggccggtggtgactcccgacaaggcttgctcaagaccaagctggctcaattcaccgacgaaccccacggtcccctcccggcgtggatcctcgagcacacgcagcccacggatgtcattgcagtcccctgggcggggcgcgtgccctatgcgacggggcggcccaccctcgacatgctcgggctcaacgacacacacatcgcgcaccttccgtcgcttcagcgcggaatcgacgtgaagatggacccggaatacgtcctggctcggcgtcccaagctcatcttcgtcaacgtgaaccactgctatgtgcagaaggagtgctcgttcgcggatgcggggggctggaagattggcgaccggcagctcatcgaactgctgcgtcagtcgcctgactacgattgggtgaaggacgctccgacggacatctccgtcttccgccgccgtgagtcactggcacagtag

SEQ ID NO: 2776 - DNA, 723 bp, Myxococcus xanthus
atgggcaaacgaggcttggatgtccaggaagtggtcatctcccgctcccagagcactgagttctcctctggcatctccgtggcatggtcagaggatcagtacctggtcgcatggacggatacgcgatacggcagccatgacattttcgccgccagggtccgcgccaatggttcggtgctcgacccaaatggcttcatcatctccgccgcgccgggcaaccagaactaccagtccgtgacagcgacgaagtatggcttcttcgttgcgtggagcgactcacgctcaggctcggcagacatctacggcacccgcttgaagcgcgggtctgcgaacgtcctggaccccttgggcatccgcatctccaccgcgagcacgacggagttatcgcccagggttgcctccgagggtgacgaggtgctcgtctcctggagcgccctgacggcggacaccgcccgtgttcgcgctgcacgggtgaagcgtaatggggacgtccgtgaccgcaacggcttcgccatctccaagggccctgcgaaccggcaactcctcttcgggaacgtcgcgtatgcgagcggacgctacttcatcgtctacggccgcgctcccgtcatggacgaaccgccgtatcaggtcatggtgggcacccgcgtgaagaacgacgatgtcgtggacaaccccgccatccgcatctcgcacgcgccctccgtcgagcagctcgcgccttga

SEQ ID NO: 2777 - DNA, 408 bp, Myxococcus xanthus
atggactgtgtcgcgcgcttcctgggcgagatgaaggcctcgccggcgccgggcaagccgggcaagacgctgctggatgacacgctggtgctggtgatgagcgagttcggccggagctgggcctcgcgctcgagcaacggcacctacaacctgccggatgaccaccacccgtacacctcggtgatgttcgccggtggcaacgtggcggcgaaccggcaggtgggcacgtacacgacgcgcggcctcggcgtcccggtggacatcatcgaggagacgggacagacgcagaagcgcgtcccgcggtccgcgggcgtcgtcaccacggcccttcgcatcatgggcatggagacgcaccacttcttcatccccggtgggtacggcgaggtggtggggctgcggaaggggtag

SEQ ID NO: 2778 - DNA, 1152 bp, Myxococcus xanthus
atcaccgtgcgggcaaacgccggtgacctggagctgctccgcgtggccgtgggcgaccacatcctgctgggcggcgacaacatggacctggcgctggcgcacacgctgaaccagcgcatggcggccgagggcaagaagctggacgcctggcaattcaacgccctcacccatggctgccgccaggcgaaggaggcgctctacgccgacccgtccatggagcgcgcacccatctccatccccggccgggggtcgtcgctcatcggcggcacgctgcgcacggagctgacgcgcgaggagctggaccgcgtcctcaccgacggcttcttccccgtgacgcccgtcaccgagctgccgcgcaccgcgcgccgcaccggcctggcgcagatggcgctgccctacgcccaggacgccggggtatcccgtcacctggccgccttcctcacccggcaggcgcaggcgctcgcgtccagcccggacgcgccggtggacgtcagcggcaaggccttcctccaccccacggcggtgctcttcaacggcggcgtcttcaaggccggcccgctgaaggcgcgcgtcatggaggtgatcaacggctggctcacggcggatggcggagcgcccgccgaggcgctggagggcgcggacctggacctcgcggtggcgcgcggcgccgcctattatggttgggtgcgccagggccacggcctgcgcatccgcggcggcacggcccgcgcctactacgtgggcgtggagacggcgatgcccgcggtgcccggcatggagccgcccgtgaaggcgctctgcgtggcccccttcggcatggaggaaggcacgcaggcggacgtcccgccccaggagttcgggctcgtcaccggtgagcccacccgcttccgcttcttctcctcttccctgcggcgcgacgacaaggtgggcgtcatgctggaggacgtcgacaccgagctggccagcggcgggctggaggagctggctcccatcgagacgaccatgcccggtcagccctccgtcttcagcgacctgacgcccgtcaacctccaggcggcggtgacggaggtggggacgctggagctccggtgcctggagaaggatggccccgggcgctggaagctggaactcaacgtccgcatgaaggagtag

SEQ ID NO: 2779 - DNA, 390 bp, Myxococcus xanthus
atgctgggccgctcgacggcgaaggtagacaactacctggagggcctgcacggctcgctgtcgtcggtctcccgcgtgcgggcgacggatgtcgcgtccgtgttggagaaggccaagggcatcgacgcgctgaggtcgaaccggcccgcgtacctgtcgatctacctgagcgaggccttcacttacacgttcggcaacgcgaacttccgcctcgtggggttggacccgcggatggacatggcgctgcgactactcaagtcggacctgtgcacgtcggtgcatgtctcgctgcggatggacttcgacacgcacaacggcgggggccatgccttcagttgcgcgcacggccgggggggatggactgtgtcgcgcgcttcctgggcgagatga

SEQ ID NO: 2780 - DNA, 1104 bp, Myxococcus xanthus
atgagcgaacatcaggtctacgagttcgtggcgctggaccggcccttgacggcaaagcagctggtcgaactccgggccatatcgacgcgggccgaaatcacaccgacccggttctggaacgaataccaccggggtggcttgatggcggacccagcccagctcctcctgcgctacttcgatgcgcacctgtaccattcgaactggggcgaccgttggctgatgctgcgcctgccgcgtgaggggctcgacatgaaggcgctcaaggcctgctttccggcacgaggtccatcaacgctcacggtgtctgggacctccgtgttgctcgacttccaggtgagggatgaggagcccccggacgaggaatctccgcccgcctcgctcgcggcgctggttccgctccggaccgaactccagcgcggagacctgcgcggggcctatctcgcgtggctgggcgccgttcaggcgggcggggtggcgtcatccgcgaaggagccctgtgttcccgagggactgggcacgctgtccgccgctcagcaggcgctggtggcgtggctccggatcgacgaggacctgctcgcggcggcggcgcacggagagaagaagcacgaggatgacagccgcgccttccgggcctgggttcgtgacctcgccccaaaggaccagatgcgctggctcctccgcgcggtggacgcgccggagcgcccgctgggctccgagttgctccgtgccttccgcgcggagcacgcgccagcaagccatcggcccgcgcggaccgtccacgaactccaagcgctcatggtggcccagcgagccgcacgggagcgagccgagtccgcccgcgccagcgcggccaccgccgccgcgatgaggcgcctccagcggcggttgacggccctgtcgcgggacgtggacggggcctgggttcggctcgaggaccgggtcgctgccagcgaatacgacgaggcggtgaagctcgccgaggacctgcgggcactggccgcgcgtgatgacgacctggccgggttcgccgcccgtttcgcggccctgcgtgggcggcaatcccgacgccgtgggttcttcgaccggtggaagctgcgcgactga

SEQ ID NO: 2781 - DNA, 858 bp, Myxococcus xanthus
accttcacggcgcgcgcggagagccgcctcttggtggggcatggcaacgcgtcacccacgggggtggggctgacgctgcaccacacgtggggcgtccccgtcgtgccgggctcgtcgttgaagggcgtgctcgcgggctacctgcgcgcggtgtacggcgatgccgcgatggaggcgcggcgcaggctcttcggtgtgccgggggaggatggcgaaggcgcgcacgctggcgaggtcatctttcatgatgcgcagtgggtgccgtatcggcgtgtcacgggcgcggaccgttcgccgacgttcctgtcccgggacgtgctcacggttcaccatgcgggttggtatggcggcacgtcctcgtggccgaatgactacgagtcgcccaatccggtggccttcctctcggtgcggccacgaggttgtttcctcgtggcgctgagcctggcgccagggatggaggcggatgcacaggcagaggcgttcctgaagtggaccgcgcagaggctggacgaggccctgcgccactggggcgtgggcggaaagacggcggcggggtacggcaggctggtgcgcgaagggccgttggagcttcagcgtccccagcgcccggtccgcgcctcgcccgcgctgacggagttcctgtcatgggtggaggctcggcgcgccgacaaggtggaacaacggcaagtcctggtgggcttcgaggcggagtggctggagcggttggtgtcgctggcgccggaggcgcgtgaggccggtgcgaaggcgctgcgttcactcgtcaagaaccccaagctcgaagcgcgcagggatgagttgctcgcgaggatgggcgtggccgtgggaggtcgtcggtga

SEQ ID NO: 2782 - DNA, 411 bp, Myxococcus xanthus
atgacggcgcagacgcgggagcagcagcgggcgctggatgtctatgcgcgggttcgcacggcgcgtgacaaaggcaaagcgttgtgcgcggagtacaagcctcgggtgaacggcctgggcgcggcggtgttgcgtgatgggctggcggcggcgctcgccttcctggaacgagaggtcaagagcaacgcggcggcccagcacctgttggaagacctgacgtggtgtctggagcgggcgcggttgccggggttgtcggagccgtccctgaagaggctgggcttgcctggcgccgtccgcgcgctggggctgaacgaatacatgctggccacgcgcgagtcgctccggctgttggtgtggttccgccgcgcggtgcaggccaccttccccctggaggagcgcgaacatgcgtga

SEQ ID NO: 2783 - DNA, 955 bp, Myxococcus xanthus
atggagagccgaccctatcttcttcacgcgctgtccccgctgcacgtcggcactgggcagagcgtgggtgtcatcgacctgcccctggcgcggctgaaggccacgggaatccccttcgtcccaggctcgtcgctcaagggcgtgctgcgtgaattgcggcggcctcgcgaggagacgggcgacgcgcgagggctgcacgacgccgtcttcggcccccggcgggcgaaggcgggtccggagggggacgagccgggggactacgcgggcgcgctggtggtgggggacgcacggctgctcgcgctgccggtgcgcagcttcgtgggcaccttcgcgctggtgacctcgcccatgctgctcgcgctcgcgcggcgggacctgggcgggctgagcgggaaggagggggcctggccgaaggtggagccgctggcccagcgcggcgcgcgcgtggcgtccctgccgagacagcgccgtcgtgtacggcgcgggcacgtcggaggcttgcgtgtacctggaggacctggacctgcaggtggcctcgaaggatgacgcggctctgggcgcctgggcccagggcctggcggggctgctgccggaggcggagcgcgcgctgctgacgaagcggctggtgctggtggacgacgagacgatgtccttcctctgggagacagccacacaggtggacacgcgcgtgagcatggacccggagacgggcaccgcggcaaaggggcagctctggacggaggagagcctgcccgcggagacgctgctggtgggcgtgatgggcgccacgggtaccttcaacaaggcgccgcgcaagttggcggcggacgcggtgctggatgcggcgtttggcggcgagggcacggtgctccaactgggaggcaaggccaccgtggggcgcggccggtgccggctgctggcctggatggctccggatgcgcgaggtgggcgatga

SEQ ID NO: 2784 - DNA, 1206 bp, Myxococcus xanthus
atgagtgacgcgagcttcgcgctgctgccgcgtgacggcctgtcggccaaggacgggcgaggttggtacacgtcggaggtggggcgtgggtactccttgccgtggcccctgcccaccacagtgcggggcgcccttcgcgccgcctgggggcatgacgccatggcggtcagcggtgcggtcctggccccggatgaatgggagcgctgctcagaggaggtccggttgcggcacctcgtcgcgctgcgccgcccgttgggcgagtccttctcgttggcccaccgcatgtggccgtttcccgcggatgctgtgtgcgtgcgcgacgcggacgggtccgagcatctggagcggttggagccacgcccggatggggccgccacgctgggcccggatgacgacgacgcgcgcgaggcgctgtggcacccgcgccggaactcgagcggaaagcccatggccgcgcccctgttctggcccgaggcgcggatgatggcgtggctgcgcggcgcggtggagccgtcctccgagacaccggatgcgctgaccccgcgcacggacatccacctggccatcgacgtggagacgcaggcgtcgcaggactcgatgctgcactctcgtgaggtggtggagttgctgcgcctccagcgccactcggggcgaactcccgtgctggaggagtgggcgctgggactgagctgcgcgtggccggcccccgcgagcggcgctccgcgcgggccgctgggcctgggcggccggcgccggctgtcggccgtggagccactgaaggtggacctcttcgcgattccggatggcgtggcccgggcgacgcgaggactgcgcctggtgctggccacgcccgcggagttccaacgtggctggttgccggacggcttcgagcgcgtggctgggacacccccacgttacgtgggccggctgccgtgcatcgacgcgcccgtggtgcttcgggccgcgctggtcccctggccgctggacgtgtccggctgggacatggtgcggcggcggccccggcccacgcggcggtgggtgcccgcaggcgccgtctacttcttcgagaaacacagcggtggggacttcaccgccaacgagctgcgagcgctgtggctggcctcctggggcggcggccacgcggaggcgctgggccaggtgctgcccggcgtgtggcaaccgccccgtcacggacaaggagcctga

SEQ ID NO: 2785 - DNA, 1791 bp, Myxococcus xanthus
atgaaatacgtcgtcgttctcaaagaggggccggtgcagggctacatcgcccagtctcgccgcacgcgggacctctggtacggcagccacctgctgtcgaatctggcgcgaaccgtggcggtctccctcacggagtctggtgcgacgctggtcttcccgcatccggagcaggcgaaggacacgagcaccggcgtggccaacaaggtggtcgcgctggtggaggacgcgcccgagcaggctgcacggaacgcgcggcgcgcggcgaaggagcggttgctcaaggactggcgccgcgtcttcaagacgtgcgagtccatgctcatccccgaggcgtccgtgctggccgaggagcaactcgacaccttccttgagatccacgctgcctgggcacccatcgcggacacgcccacgggttacgccgacgcgctgcacgaggcggagcgtgccctggaggcccgccggggcttgcgtgagttcgtgccatggaagcagccgccgccggcgggcacgcacaagtcgagcctcgacggcgctcgcccgtcattgctgcgacgcgagcgtcacgtggggcacctctggcgtgacttccgcattggcctgcgcgaggagctggatgcgctcggggtgctcaagcgcgtcggcggcaatcccggccagttcgtgcccgtgccctccatcgggatggcggcgtggctccagaccgcggccacgcgacacccggcgctcctcgccgcgctcaaggccgagtgcgcgcgccgcgggttccagacggtgagcgtgaggaatcgtccctgggtggaggccttcccctacgacggccagttgttgctgcccgagcgcgtggccccgtacttcgaggagtacgccgtccccgatgcgcgtcaggccgccgcgcgtttcgtccacgagttcgtggagccgcttcgagacgctgtgcgcgccgagcccttcccttacgtggcctgcctggtggcggatggagaccgcatgggccgcgcgctggaggcgctcgcgaggcagccggacggccacgccgcgcaccaacgcatctcccgggcgctcgcggacttcacgcggcaggcgaagacgattgtcgaagtggagcatcggggcgtgctcgtctacgcgggcggcgacgatttgctcgccttcgtcacgcccatggacgcgctcgcgtgtgcccaggcgcttgccgttgccttccgcgccacgctggaagcggcgctggcgggaacgcgcgcggaggtgcccacgctctctgtggggctgggcattggccacgtcctggagagcctgggcgagctgctggagctgggccgccgggcagagcgtgccgcgaaggacgcgggtcgcgacgcgttggcagtgctggtggcgaagcacgccggacgtgagcggctgtggacggcgccgtgggccaccgaccccgtcgagcggctgacgcgggacatggcgctgctgtcgagcgacacccagccgctgcccttgaagaaggttcatgaggtggcggccctcgcgcgccgcttcccgtctggcaccaccatcgcgcccgagctggctgagctgctgtcggatgaggccgcgcgcatcctcgcccgggcggaggcggggcgttcgcccgtgaagctcaccccggaggccgtgggcttggagctgcccacgtcgccgaactccctcgagccaccccatgcatcgctggaccgatgggcatcccggctgctggtggcggatgtcctcgcccgggccagcggaaagctcattcccgcgagcgacaaggaaggtgtgagatga

SEQ ID NO: 2786 - DNA, 750 bp, Myxococcus xanthus
atgcctctgctgcggggcgcgcgcctcttccgggggaacgcgggcgccaagccgcgtgacgggagcgaggtctggttgatcgcgctcaagtggctgcgggaattccgccagggcaccgagcccgcgcccgccgggagtgctgaacaggtgggaatcgcgcgcaagcctggtgaaggaaatcgcgcgggccgctccaactggccggaggccgacaagattcgccgcttcgcccggccatctggcaaggacagccgaggcggcttcgctccaaggtccgagggcaaggcctatcccgaggtccacgctccgcgcccacagcactcggcgaccgcggcctggccgcgcgctggcttcgggttgcccattgtcttccatttccagcagaagcggcgcgaggacaatgactactaccagccgaaggagcccgaggacatccagctccagtgggaggagagcggttcggagaagctgatggaccgcctcgcatcgccgctcatcgtcaaggcgctgccgctggcggatggccgcttcgagcccatcgcgctgtggctggagcgcggagcgcctcggggtggacaggtcgtcatgacgcagcgggggacggcagtcccacggacgcgggttccttttgaaagcagcttccgggcccgcgatgaccaaccccttttccagacactccagcaggcggacaacctacgcgacgccttcttctggtggctggaggaaacccgccgtgcccaggaggcgtga

SEQ ID NO: 2787 - DNA, 837 bp, Myxococcus xanthus
agagacaccggcatcgcgcacgtcggagccgcgtccgaagccgaatcggaaggttcgaacatcgcgccggacgccgagctcgcgttgccacacaggcatggacggcgcgtggaccacttgagccgggcccacctgttgcgcgactgggacgacctcgctggcgcgctcaccgagtgtcgccgtgcgattcatgacgcccccgacgacgtggccgccttggcgctggcggcggagctcgccgggctcacgggccggacggacctggccgtgcgtgcccatgcccagctcggccgcctgcttcccctggatgcccgccccttggtgcgtcaggcaaggctgctggtgtccctgggccgccatgccgaagcggtgtccgtgggcgaagaggccgtgctgcgcaatcccgagtacgtggaggcctatcaggtgctcgggcgcgcgcaccttgtgcagggtgagctggcgaaagcgatgctgcgcttcgagcaggccgtccacctccaccccgagcacgggtacgccctcaacaacctgggcctcacctacctgcgtgccggagaagcccagaaggccgcggacgtgctcgtccgggcggcggagctgctccctcacgtggcttatgtgcacaacaacctgggcgtggcctacgagcggctcggacaggtggaggaggcccgggcggcctatgccgccgccatgcacctgtcaccgcgctacgtccaggcccgcgtcaacgcggaccggatgcgccgcacggcccacgcggacatggccggcgcccggacggctcgtgagcagctgctcccctcccagggagaggcgcctgcttcccggtag

SEQ ID NO: 2788 - DNA, 484 bp, Myxococcus xanthus
atgctgtcgttcgcggaaggtgaagtcaccaagctccggcgggaattcaagctggtgctggaagagaagacggccgcggccctgggcacgcgcctgtcgctggagctggaggggcacctgccgtcgcccacgcgcatcgtgtccgtgtacttcgaccggcccggtggcccgctggcggcgcgggccctgctcactccggaagactgtctcaaggttcggacgaaggagtactcaccggaccggggcgcggacggcgaggcgcgggtggtgctggaggtgaaacgagagcgccacggcctcacgcagaagcgccgcgtctgggtgccgcgctcggacctgggccgcgtgctgcgcggcggggccagcctgctgccgctcatcgccggaggcagcctcagcccagtgctggccgtgacgtacacgcgcaacgtgtaccagtcgtcgcaggcgtggcgggcgacggtggatcaggacattcggtacc

SEQ ID NO: 2789 - DNA, 2610 bp, Myxococcus xanthus
atgccctcttcgcccgattcctccacacccactccccccgcgccgccttcgcgaccggggttcggtgcccggctgtggcgctggacgaagcggctgctcatcaccggcctcgtgtgcctggtgctcggcgccatcaccctggcgagcggctacgcgtactacagccaggacctgccctccgtggacgcgctgcgcaactaccagccgccgcaggtgacgaaggtgacgtgcggtgacggcacgctctgcgccgagttcgcgcacgagcggcgcacgttgattcgcgtggaggacctgccgccccacgtccgcaacgccttcctggccgccgaggacgcggacttctacaagcacgagggcctggacttcttcggcatcacccgcgcggccatcaagaacctcatccccaacagccgcaagtccggcgcgtccaccatcacccagcaggtggtgaagaacctgctgctgtcccctgagcgcagcttctcccgcaaggcgcgcgagtggattctcacgccacgcgtggaggaagcgctcaccaaggaccagattctctcgctctacatcaaccagtcctactacgggcagcgccgctacggcatggaggaggcggcgctcttctacttcggcaagcacgccaaggacttgaacgtgggcgaggccgccgtgctcgcgggcacggtgcagctcccgcaccgcatcaacccggtgacgaacatcacgcgggcgaagtcgcgtcagcgctacgtgctggaccagatggcgcgcaacggcttcgtgtccgcggacgtggcggaggcggagaaggagaagcccatcgtcctggctccccggcggggcaaggtggtggggccgtattacacggaggagattcgccgcacgctcatcgcgcgctacggcgagcaggcggtgatggagggcgggctgcgcgtggacatcgccatggtgcccaagctccagctcgcggcggagcagtcggtgcgtgacggcctggaggcggtggaccggcgccagggctaccgcggtccccgtggcgcgctggagaagggccagtgggagcgataccgggccctcatcgccacgcgcatcgaggaggcgggccgccggcagaaggaccagggctacgtcgcggacctgtcctcgctggcgaaggtggagaaggaagagccgaagacgcccgagatcgcgggtgcgcccctggacccgctggaagaggaaggcaccgaggagcagcggccggacctgtcgcccgaagacgaggcgcccctctccgcggaccaactcctggcgcagtccgtgcgcctcaagcccatggaggaaggcctgcgcctcacgggctacgtcatgcaggtggacgacaagcgcaacgtggcccgcgtggacctggtgggccgcaccgccgaggtggccttcgccgccgcctcctgggcgcggcagaagggcaagagcgcgccgaagaagatttccgacgtcttcacggagggggagctcgtcttcgtgcgcgtgctcaaggcaccgcccgcgccagccttcgtggaagcggcgctggaccaggttcccgaggtgcagggcgggctggtggtcatccgtccggagaaccggcacgtggtggcgctggtgggcggctacgacgcggagcgctcgtccttcaaccgcgccacgcaggcgaagcggcagcctggctcgtccttcaagccattcctctacgccgccgccatgggcagtggccgctacacgccgctgtccaaggtcaatgacgcccctgaagccgtccgcgacccgtacacgggcaagacgtggaagccgcagaactacgaccgtcggttccacgggccgatgacgctgcgcgaggcgctcaccaagtcgaagaacacggtgtccgtgcgcctcatcgaggcgctcaccccggccaccaccatcgacgtcgcgcgccgggctggcatccactccccgctgccggagaacctcacgctggccctgggcaccggtgaagtcacgatgctggaggccgccaacgcctacgccacgctccaggccaatggccgctatgcggagcccttgctgctgctgcgcgtgcgcgatgcgcgcggcaaggtgctggaggagcatcagccggccttcgaggagacgctgccgcccgcggtggcctacctcaccacgtcgctgatgcgcagcgtggtggaggacggctcgggccgggccgtgctcgcgctggagcgccccgccgctggcaagacgggcaccacgcagcagtcccgcgacacgtggttctccggctacacggcggactgggtggccagcgcatgggtgggcttcgacaacaactcgccgctgggcggcagtgagacgggtggccgcgccgcgctgcccatctggctccagttcatgcgcgtggcccacgaagggctgcccacgcgggagttcgaggtgccccccggcgtcgtgcaagtgcgcatcgaccccatcagcggactgctggcgggcaactccgtcccgggccggctggagcccttcctcgaaggcacgcagcccaccgcggaggcaccgccgccgggacaggtgaccaccgaccagttcttcctcgacgaaggcaacaggcggggactgtga

SEQ ID NO: 2790 - DNA, 1155 bp, Myxococcus xanthus
atgctcgcctcgcagctctcctccgcgggcctgtcgcccgtggtgctggaggcgcccacggccgatgccgccgagacgctggcgcgcgcgcaaggtgcccggacgctggtgcgactctcgctgaacgtcgaaggcggcgaactgcgcgcccgaggtgatgtgattggcacctgggtgaacttctggtccggccgcacgcccacgcggccgcccaagcccgccgccacgctggtggagacggtgcccgcggacccgaccgtgttggcgctcgcgttggagggcgcaggcacttcgcccacgtcgcccccggaaacgggccctcaaggcatccgactgctgggcgcggcgctggcgcgtctggagcatcccctggcggcgctcgccgccggggacctggacggggatggccgggatgaagtggtggccctgacggagcatgacgtctctgtcttcgacgcggaggggcggctcgtcgcgcgcaaggagctggactccctgcccgctggaagcgccaccacccgggagccctttggcgcgttggcgttcctgccggggcccccccggctggccgcgtggagcacccgccatgcgcacggcgagttgctggcgctggacaaggcccgcgccaccctgcgcgccgtggggacgctggacacggcgccgctgggcgccaccgagcgaggcactttcgttccgggacagacagccttcgcgcccaccctgaagctggcggagggccgcgcgctgacggtgcccgcgcccttcaccaccgcgagcatggatgcccagcggatgctgttcgtccacccggatggcaccgcggccttctacgcgcacgcgggcgcggcaccggcgcgctggacgaacctgggcgccggcagcgcgctgggagacctggatggggacggcgtgccggagctcatcaccacctcgactcagctcacccccgcccccgatgtgctgcgcgtgcacggcacctccgggggcgaccccggcacgcacgaaccgctgtggcagggcgccctgcccacgggccgcgcgctgtacgtggtgacggcccgcctggacggcgacacgcgccgcgaggtcatcgtgggcctctggaagccggacggcaccagcgagctgttcctcctgcgccagggggcgccatga

SEQ ID NO: 2791 - DNA, 324 bp, Myxococcus xanthus
atgctgcacgcgctgctgctgccccccatccccgggcccgcgctggcggtggtgctggatgccggtggacgcaaggacttgctgggcgtggagctgcccgccatcggcgcgcttgcgtccaccgcggcgcgggacgcgcgagcgcgcgagcgggccctggccctggcagcgtccgtgcccctggtccccctgtacgtgcaggggctgggaatgcgcttcgctccggacgtgggcggggtgatgatggatgcacaaggcctcccctcgctggacggactgcacgtgcttccaccggaggggacggcgatgggaggacgtccttga

SEQ ID NO: 2792 - DNA, 1719 bp, Myxococcus xanthus
atgcgcttgaggacgcggctggcgctcgccttcgccctgctggccctggttccgctcgcggtcgtcgtgccccccaccctcacccgcttgcgcgacacgttgtcgcgcgagctggacgcgcgcatggaggccgccaccgcctccgcacaggagtccctggagcgctccagcgccacggcccgccgcgcggtggaggagctggtggacagcaccagcatggaggacctggcccgcgaggcccgcgaccgccccacccgcgccatccaggccggcaccgccgaggccctgatgaagagccgcggcctgagcgtgctggccctcttcgaccgcgaaggaagggtgctctcctccggccacctgcccgcgcgccggggagacccggacccggccctcttcgccgttacgcagcagaagtcaccccggcccgtgccagtgcgcgtggaggtgcgcacggcctccggactccgtcagcttccggcgctcgtcaccgcgcgcccggtggacttcggggacctgcggctgtgggccgtgggcggcgtgctgctcgatgagagcctggcgcagcacctggcccgcctcacccagacgcaggtgacgctgctggcgggtgacacgcccctggccagcgcgggcacggccgaaccgccgacggtgacgaaggcgctgccgctgggagacgcggccacggtgcggctcgtcttcagccgcgccgccgcgcgtgaagcggaacagggcgtcatgcgcgccttcctcctgctggcggcgctgggcggcactttcgcggtgctgctgggcctgctggtgtcccggtggatgacgcggcctgtggaggccctcaccgagggcgcccggcgcgtggccgaaggcgcgctggagtcccaggtgacggtgaaggccagcggcgaggtgggcgagctggtgcggacgttcaaccgcatgacgtccgagctgaaggccaccaccgagcggctgatggccagcgagcgcatcgccgcgtggcaggaagtggcgcggcgactggcgcacgaaatcaagaacccgctgacgcccatccgcatgtcgctggagacgctccaggccgcgcaagaagcgaagcacccgcgcttccaagacatgttcaaggagagcgcgggtgtggtgctggaggaagtggaccggctgcgccgcatcgtcgacgagttcagccacttcgcgcggatgcccaagccgcagctggcgcccgtggacctgggcgagctggcgcagagcgtgctggcgctgtacgccacgcctccgaccggcatccagattctgcccacgctccagacgggcgtggtggcgcgggtggaccgcgaccagctcacccaggtgctggtgaacctggtgaagaacgccgaggaggccatggcgtccacgggtggcaccctgcgcgtgcgcgtacgctccaccgaagccgacgccatcgtcgaggtggaggacagcggccccggcattcccctggagcaccgcgcccggatcttcgagccctacttcaccaccaaggacggcggcaccggcctggggttggccatcgcctcgcgcatcctccaggagcacggcggcaaactggaggtgggcggagagcccggccacggcgcgcgcttcagcctcgtgctgccgcgcgcggcctgactcagacgctgcgctccgcgaagcggacgtggaccagcgcgggcaaccgttccttcacccagggcagca

SEQ ID NO: 2793 - DNA, 363 bp, Myxococcus xanthus
atgggcgccgaacgaatcaaggtcttgctggtcgaggacgacggggacagccgggagctgctggcggagctgctggagtcggagttcgacgtgaagacggccacggatggcttggccggcctcgagatgttcgaggccgagcacccggacgtggtggtgacggacgaatccctcccaggcatgtgcggcaccgagctcgcgcagaaggtcaaggagcgcgagccccgggcccgcgtcatcctcgtgtccggttacacacaggtgcagggctccgaacactgtgacgtggtgctgcgcaagcccatcgacgtggaacgcctcagcgccgcggtgtgcaggctgggcgacgaagctcgacactga

SEQ ID NO: 2794 - DNA, 387 bp, Myxococcus xanthus
atgcgcagcagggggctgccgctcccgcatgagctggatacccgcatcttcgtccgggctggctccgcagaggaccccttcaccgccgaggtctacgcgcagctcctccaggacgcgaacatccccgtcctggtgcgcgctggccgctcgggcgtcgtggacaagctgaccaccggcaacgtgctgccctggtgggaaatccacgtccccgccgaccagcaggtccgggccgcgacgctgattgagcaggagcgcctgcgggagctggccaccaacgacgaggccgcggccgccgccgaggccgaggagcgggagaccgaatctcccgccgctgaggccaaggagcgggagaccgaatcccccgccacgccgccaccggcctactga

SEQ ID NO: 2795 - DNA, 318 bp, Myxococcus xanthus
atgaagaagctgatggcgttggtggcggtgtcggggacgctcaccgcgtgcggccccgtgaagtccaccgcgaacatcctcgacgctgaagtgcagattcaggccgcgcgcacagccggggcggagaagctcgcgccctacgagtggtccgcggccaacctgtacatcggcaaggcccgcgaggaggtggggtactcggactatcaagccggcgtcgacttcgcagtgaaggcctcccgctacgccaacgaggcccgcgagaaggccatgcccgtggccggaagcaccgagcccggcgcccgtactccgaacccgtga

SEQ ID NO: 2796 - DNA, 240 bp, Myxococcus xanthus
atgacggagcgcttcccgatgaggcgtccttccctggtcacgctgcttcccctcctcttctccctctcgtgtgtcagcggcagcaagattcgcgcggacacggaggtgctcgcggccaacgtggagcgcgcccgccgtaacggcgccctgcgctgcgcgcccgtggagctggccaccgccgaggcccacctcgacttcgcccgtggcgagctgagccagggcagcagctttagagcacgg

SEQ ID NO: 2797 - DNA, 825 bp, Myxococcus xanthus
atgcagacgcggtacgtgccgaacctcacggggattccggagacgatgctctggacgcttcattcccgggcaggggaggcgaagcggccggacggcgtcctgaaggacgcggaggcgctgcgcatctacggcgccatcgactacgacttcgagaagtcctttggccgcgcggagccgtccctcgcgattcgcgcggtggagatggaccggagcattcgcgcgtggctggccacgcaccctgacggcttcgtggtgtcgctgggagaggggctggagacgcaggcgcagcggctggacaacgggcggctgcgctggctgagcgtggacctgccggaagccgtggccatccgggagcgcttcctcacgccgaacgagcggctgatgcacttcccggtgagcgccatggaccgcgcatggatggaccgcgtggacgccagcaagggcgtgttcatcgtcgcgcagggcctcttcatgtacttcgaggaagacgacgtccgtcggctcatcgtggacatcgccgagcgcttcccgggcgccgagctcctcttcgacacgattccccgctggctctcacggcgcacgctcaaggggctgcaccgcacccgcgcgtaccaggtgccacccatgccctggggcatcaaccgcgacgcgctggaggcgacgctgcggcggtgggcgccgcgaatccgccaggtggaattgaagccctacaccttcccgcggggcttcttccggtacggttacaacggtctcaacatgctgccctgggtgaaggaacggttgcccgcgctggtccacgtccgcttcgcggagcgcagcgtctga

SEQ ID NO: 2798 - DNA, 333 bp, Myxococcus xanthus
atgcacaacgcggtctatctggggattgccatcgtggccgaggtggtggcgacctcagcgctcaagagctccaacggcttcacgcggctggggccgtccatcctcgtggtgctgggctatggcgtggccttcttctgcctgtccttcgcgctgaggaccatccccacgggcatcgcctacgccatctggtccggggcgggcatcgtcctcgtctccggcgtggcgtggctccttcacgggcagcgcttggacgtccccgcgctcgtgggcatcgggctcatcctggcgggcgtcatcgtcatcaataccttctccaggtcggcggcgcactga

SEQ ID NO: 2799 - DNA, 1716 bp, Myxococcus xanthus
atgcgggtccctggctcccaggagccggtgattgtgggtaagctccggaaaagtccagtccattcaccttcagacagacggcctttcttcgtgagctcgccccagacggccattccgttcggtaactacctgctgatcaagcggctcgccgtgggaggaatggcggagctgttcctgtcccagcgaccgccggaccccgaactggtggtgctcaagcgcatcctcccgtacctctcggaggagcccgagttcgtccagatgttcctggacgaggcgcgcatcgccgcgcagctccaccaccccaacatcgtgcaggtgcacgaactggggaaggagggcgacaacatcttcatcgccatggagtacgtggagggcgtggacctgcggcgcgtcatggccgaggagtccaagttcggcgccacggtgccctatggtgttgccgcgcgcatctgcgcgcaggtggccgccggcctggattacgcgcaccacagccgcggcgtggatgggcgcccgctggagttgatccaccgcgacgtcagcccgcagaacgtgatgatcggctacgacgggcgcgtcaagctggtcgacttcggcatcgccaaggcgggcgcgttcatggaacgcagcaagccgggcgtcatcaagggcaagttcctctacctggcgccggagcaggtgtcgcaggagcggctggaccaccgcgcggacatcttcgcgctgggcaccatgctgtacgaaatcaccaccggccggcagcccttcgccaagccgacgacggagggcatcctctacgccatccgctacgaggacccgtcgccgccgcacctgattcgcgacgattacccgccagcgctctcgcgcatcgtcatgcgctgcctcacgaaggaccgcgccctgcgctaccagcgcgcgtcggaggtgcacgacgcgctggagtccttcctcgcctctggcaccctccggcagagcctggacgtgtcggagtacatcggccggctgctgggcgaggaggaggagcgcaccatcctccacatccccgaggccaagggcctcggccggcgtgaagccaccgtgccactgcagggcgctcggctctcccaggacgccgagccgccgcggcgcccgtccgtgctggagtccaccgcccccacgctgtcttcgaccacgcccgagtccgacctggcctcggtgcccagcgcgcagctcacgcccggcctcaccgctcggcccacgcctcgccgcgcctccagggactcggtgccggtctccttctccggcgacgagcccgagcccgccacgctgatggcgcgtccgcgcgacctgcctgccctccaggcggaggacgacgacgaggattcggagatgtccactgccgtcgccacctcgcccgtggggtaccgggccacggcgccggtggtggaggacctggacatcggcgacggagagtccaccgtgccgcagcggagtcgacccagagacgttccatcccgtcctgccccgacaccgccggctccggttcgtcgctcctcgccgcacatggcgcctcctccggcgcgtgtggcggagccgtcccgcacgcgtcgccctggcccgtcgtctccctcccacgtggcggccccgcgccggccccctccgccggaagaggacgcagctccttccgtgtccatcacgccggtgcctccgcgtcgcgcattctcgctggacctggagctctcc

SEQ ID NO: 2800 - DNA, 1251 bp, Myxococcus xanthus
atggtgggcgcgcgccgcgcgctggccagcacgccgctggaggtgctcgcgatcgccagcacgcagccggtgctgggcatgctggccgcgtatcagcagaacgcgctgttcgccctggcgggcctgctgggcctgagcctcctgtggacgctgatgatgggctccggccgcaaggcggctgacgcggaggcgtccagtggcagctccgacacgctgagcctgtcggccgccatggcctccgcgcctgcgccggccgcagtcacgccgccgccggcccccgcgcccgccgccgacccgttcgctttcgcgccgccgcccgccgcggacccgttcgccttcgcgccgccgcccgctgctccggcacccgccgcggacccgttcgccttcgcgccgccgcccgccgctcccgcgcccgccgccgacccgttcgccttcgcgccgccggccgctccggctccggcacccgccgcggacccgttcgccttcgcgccgccgccgtcgggagacccgttcgcgaattcgcgaacggcgcaggctcccatgggcgatccattcgcgttcgccccgccggctccgcctccggcccccgcggcggacccgtttgcctttgcccctccggcgcccccgcccgcggcggaccccttcggctcggccgaggcgttcccgttccccgcgccgccgcagcagcagcccgcgcacgtgggggcgatgccgttcgagtcctcacccgagtccttcggtgggcccgagccgctgtcgcccgcgtcgcctcgccggggagcgttcgccttcgaggaccagcccacggcggcgtactcgctgcagcaagcggcggaccccttcgccctggcggcctcccaggccgcaccggacagcccggagacgacgcgcgtggcggcgattccgcgcgagctgctccaagccagcgcgcggcctccgacgtcggacgccatccccatgccgccgccgcgctccgcccctcagcccgccgcgattccgctgccgggcctgggcaactccgcggtggcgctcaccgacgagcagcacttccaggaggtcttccgcgagttcctcaccacccgtgagcggtgtggcgaagcggccgacggcctgacgtacgacaagttcgtgcagaagctccgcaagaacaaggagcagctcgtccagaagtacgcgtgcaagacggtgcgcttccaggtctatgtgaaggaaggcaaggcggccctcaaggccacgcccgtcaaggactga

SEQ ID NO: 2801 - DNA, 618 bp, Myxococcus xanthus
atggtccgcctcaagttcctcgtcttcgcattcctggtcatcggactgggcgttgctcatctgccgatgctgtcgggaccgctgcgcgagcgcgccgtcgccggtgcatcggcccaggcttccgcgggcgccgccgaggtggcgcgccgtgtggattctcgtcgtgccgaagtgcagtcgctggcgctgaagctcgcggccatgccggaagtggtgtccgtcgccgcgccgccgcttccggagcagcccgcgccgcgcaaccagcgtgagcgtgagcgcgagcgcgtcgaggtggatgccgccgccgcccgcgccttcaccgccgagcgcttcgccgcggtgcgcagcgccgtcgaaggcttgattccccaggaactcaagggcgcggtggtggccgtggtcgcccaggacacgcagttccacgcggtggccggggccgagccgtcctcggacgcggcgaagctggacgtggtgagcctcgtcaagtccggggccagcgtggtggatgccttcggtgcgccgcatgcgttcgccgcggtgccgctgtcgtggaacgccggggcgcccgcggtgacgctggtgctgggcgcgccgctgctggacgagggtgcgctgtag

SEQ ID NO: 2802 - DNA, 360 bp, Myxococcus xanthus
atgaaggtgttgctgcgtggagtgcacctgaacctgtcggatgctctcaagtcgtatgtcgacgaacacctggtgcgccatatcgaacggttcgcggatgacgaggcagcggaaatcgacatctcgctggtggacaccaacgggcccaagggcggcatggacaaggaatgccgggtcacggtgcgactgcccgggctctcctcggtgcacgtgacggagacggcggactcgttgttccccgccatcgacgcatcgcgtgaccggttggagacgagcctcaagcgcatgctggggaagcggcgcgacgttcataccaacggcctgcccgaggacgtggcggtcgacgttcccacctactaa

SEQ ID NO: 2803 - DNA, 966 bp, Myxococcus xanthus
atgaaggtcgtcgcggtcctggccgcggccctgctgtcgcaggcgcccgcggtccccacgcccctggaggacgtggacacccggcccggtgccgaagcgctcctggagtcgccctcggcgtccaagcagctcgccacggcccgtccggcgaaacccaatggttgggtggggctcagcgcggaggcgcgcgccgcgctcgtgtcggaggacgcggacgcgccgctggccgggcggctgctgcggatgagcgagcgcttcatcaacacgccctacgtcctgtcgccgctgggcgagggccagggcgtggaccccgaccccaccttccggctggacgcggtggactgcctcaccttcgtggagcagtcgatggcgctgagcctcgcgggcagcgaggacgaggtggcgccgctgctcgagcgcatccgctacgcgagctcgcccacctatgaggaccgcaaccacctcatggaggcgcagtggctgcccaacaacatccgcaagggcttcctgacggatgtgacgcggcgctacgcgggggatgacgccgtcacggtgacgaagtcgctgacgaaggtctcctggcagtcgcgctcgtcgcaggcgctgggcctgcccaaggcgcagcatgtggtgggcacgtacccgctgaacatgctgcccctggagcgggtgatggcgcacgcgcgcgacatcccctcgggcaccatcctggtggtgatgcgcgaggacctgccgctgaaggtcacccgcatcacccacctgggcttcgtggtgcagcgcaagaagcgcacgtacctgcgccacgcctctcgcggcggctacaatcgcgtggtggacgaggacctggagacgttcctggcccgcaacggccgctattcgaagtggagggtgacgggcgtcagcctcttcgagccgcgccgccccgatgtggcgagcggcggctcggtggcgcgcccggtgccctga

SEQ ID NO: 2804 - DNA, 513 bp, Myxococcus xanthus
atgggcgccctgttggtgaagaccgcccggaaagagccggaggtggaggtgcgcgcggccctgctcgccgccgcgggggaggccggggacgccaagcaggcgccggccctcaaggagttcctcgccagcgattcggagagcacccgcttcgcggcggcgcgcggcctgtgccggctgggctcgccggagggcttcgccttcgcgggcaagctgctcggctcggacgaccgcttcgtgcgccggcagggcctggagctctacgaaggcgtcagcgcgaagaaggcttcgcccgcgctcaagccgctgctggaggacaaggaccgcgcgctggccgccggcgccgcccgcatcctccacgagggcggggacgcgtcgatgttggagtggctggtgctggcgtcgtggaacgcgaagtccgacgagaagctcgcgtacgagcgggagctggagacgctccaactgcgtgacgaccggcgcaaggccatcctccgcaaggcgggtgtcgcgcaatga

SEQ ID NO: 2805 - DNA, 87 bp, Myxococcus xanthus
atgaaggtattgctgaaggcccgaaactcctcggacgtggtgttggcggtcgccatggccgcggttctggctttagagcacagggga

SEQ ID NO: 2806 - DNA, 204 bp, Myxococcus xanthus
atggcgggcctgttcctgatggcccacccggccgacaccgcacgggagctcaccatcgcggtgccactgcccggcgaccgggaaattgtcaccacctgccagattcgccgccgcgaagtggacggagtggcgctggagttcggcgagctggactgggacgacctcatcgccctggcgcgctacctccacccgcgcctgccctga

SEQ ID NO: 2807 - DNA, 762 bp, Myxococcus xanthus
atggacgcccacaccgtgccgcacctgcgcgctgggttggacatcgcgctccagccgcttcaccccttcgaggcgcacattgcttcgttcatcgacggggaccatgccgtgccggacctggcccgggcggcacggctgcccgaaatcgaggtgaaggtcgtcctcaaggccctgctggagcgcggcgtcgtggagctgcaccgcctgcccggcgcacccgccatgcgcacgatgacggacgagctgcccatcctggacgggcaggacttcctcgtgccagagcccatggcactcggggacgaggagcctcccgcgcggccagtgcccgtgatgagagcaccccaccgcccactgcccaccacccccacgcgcgcggcgccgcccccaagcccgcccgtcccaccgcgcaccgtccggcggctcggaatcgagccagggtcggcggaggacttcctccagcgcgccgtgcggttggagcgcgagggccaggtggaccgggccatcgacgtgctcacacgggccattgcccaagcgcccgaagccgcggtgctctacagcaagctggccctcatcctggttcaccagcgcaaggactaccggcgggctgtcgagttgctggagcgcgcggtggcactggagccggcccatcccgtcttccagcagaacctgctcaaggtgacaggcctcgcggcggcctcccccggccctcgcaaggaagagaagcgcggcctcttcgcgcgcctcacgggccgccggagctga

SEQ ID NO: 2808 - DNA, 687 bp, Myxococcus xanthus
atgcagcggctcttcagttggcgcccctgggtggaactggcgaagacgctgctgattgtctgcctggtgggggcgctcgtctggagcgatgtggaggaggccgctccggatgcgatgaagaccgcgtggctgggcggtgcggagggtttgagcttggcggtcgcgcacgtgtccggactcgcgagccgcctggcctgtttgctggtggtgctgggcgtgggggactacgcgctggcctggcggcgccacatcaaggatttgatgatgactcgcgaggagataaagcgcgagtacaaggacagtgagggcgacccccggcacaaggggcagcggaaggccctgcatcgccagcttgctcagggcggtgcggcacgcggggtgcaaaaggcgaccgccgtggtcgtcaaccccacgcacatcgcggtcgcgctccgctacgacgtcgacgaatgcgaggcgccctatctcgtggccaaggcccgggaaggggatgcgcgcgccatgcgggagcaggcacgccgacttggcattgcggtggtgcgggacatcccgctggcacgcagcctcatccactacgacgtgggcgagcccatcccagaggagctgtaccaggcggcggcggtcgtcctgcgcacggcgatggatgcgcgggagttggacggccatccacggagacagacgtcatga

SEQ ID NO: 2809 - DNA, 741 bp, Myxococcus xanthus
gtggtggcgctgtgtgccgcgcggctgctgcctatgacgttcctgtgtccgctactgggaggtcaggccacgccgacgatggtccgcctggcattggtgctgtccctgtcgctcttcctccgggtggaggcaggcgtggtgctggatgcgcctgtcacgtccgcggtggccctgggcggattggtgattcgcgagctgctcttcgggacatccgtggggttggtcgcggcacttcccttcgatgccgcgcgcatggggggccgcttcatcgacctgcttcgtggaacctccgccgaggcgagtctgcccctggcggggagccgtgagtccgcggcaggggaggggctctaccatctgctggtggcgctggtggtctccggtggcatgtggccgctcgtcatctccagcgtgctgcgtgggttcggcgtggtgaagctcggcgccttcgttccaaccgaggcggccacgctgcatgtcgtcctgctggcgggcgcggccatggccacggggctggcggtgggggcgccgatcaccgcggcggtgctgaccgtggactgtttcctgggtctggcctcgcgagcggcacctcaggtgaatcttcaggaggtggggacgccgctgaagattctgggagggggcgccctgttgtggctggggacgggcgtgttgtgtgagcggctgctggcgggtgtgttgtccgtggaaggcgcgctggcgctgttgggtgaggtggcgcggtga

SEQ ID NO: 2810 - DNA, 1098 bp, Myxococcus xanthus
atgcaactgcgcaagacgctaggcgcggcggcgctggtgaccgcggcgacgatggcatccatggctggctgttctggccgtgacgacgatacggatccgctgccggacgctggctgcctcggcacctgtagcccggactccgggactggcgacgcgggcacgggtgacgcgggtacgggtgacgcgggcacgggtgacgcgggcattcagacggtgaccatccgcgaggcgcgccttctgggcgaccgtcctcagatcatcctggagggcgtcgtcgtcacgacggtggtctacgtctcttcgaaggacacgggcgtttcggcggacttctgggtggctgatccgaacaacgctcaggacggcatcttcgtccagaagtaccggacggatccgccgaccacgtacgtgcctgcgaagggcgacatcgtgaccatccagggctacgtccagaacaacagccgcttccgggaccgcgagggctaccgcaaggtcctgaagaataacttcgacttccgcggcgcaagcgaagccaccccgatggtcatcaccaagacgggcacgatgacagcgcccaacgacatcgcggtcagcatcgacaacggcttcggtaacgcggatggtggcgtcggccggcccaacctggagcacctgggcgctcgtgtccacatccaggggccgctgactctgactgacgccaatcccatggccatgaagcggctcgccactcccgatgatggcgaagacaccatgcacttcggcttcgaggtctccggcggcgtgctcgtgaacaacctcaccaccttcggtacgacgaccgatggtggcacgccgcgctgcgactaccgcgtcatggtgaacgacggtggctccgtgaccttcccggatggcatccgcggcgtgtgggacaccttcacccacgcgccctgcatggacggtggcaccagcacgttcagctgcttcaatgacgcgggcgtgatccccggcacgacgaacacgtggacgacggtgctctaccccgaggggtgtgacgacctgcagggtgtggtcacggagcccgagacgtttcgtccggccgcccccggcgcccagacggagtaa

SEQ ID NO: 2811 - DNA, 270 bp, Myxococcus xanthus
atgacccaggacgttttcctcaccctgggacgcgaggccctgctgttgatggtgatggcgtcgctgccacccattggcgcgagcctggtggtggggttcttgtcgagcctcttccaggccaccacccagcttcaggagtccacgttgtcggtggtgcccaagctgtgcgcggccgtcctggcactggtcctcgccggaccctggattgccgggcagctcacgcgtttcacccaccagctcctgatgctcatctccgaggtcgcggcatga

SEQ ID NO: 2812 - DNA, 633 bp, Myxococcus xanthus
tcgatgatgggcatgctcgcggtgatgtcgctgctgccgttcgcggtgctgatgctgacgagcttctcgaagattgccgtcgtattgtcgctggcccgctcggccatgggcacgcagcaggcgccgcctaccatcgtgctcacgggcctggcggcggtgctcaccgggcacatcatggctccggtgatggagcgcatgtacgacgccgggcaggtggcctacgcggaggtggcgtcgggctccggcgcggagatgctctccgccgcgagccgcgtgtcggagccgctgcgcgccttcctgatcaagcacgggagcgctgaggagcgcgcgcgcttcgtggacctggcgcgcgagctacgtccggtggaggagatggacgcggtgcgggagacggacctcttcatcgtcattcctgccttcgtcatcaccgagttgaaggaagccttccagattggcttcctcgtcttcctcccgttcctcgtgctggacatggtgattgccaacgtgctgctcgcgctgggcatgcagacgctgtcacccagccaggtgagtctgcccttcaagattctcctcttcgtcgccgtggatggttggtcgctgctcgcgcggggcctcatcctcggctaccggtga

SEQ ID NO: 2813 - DNA, 345 bp, Myxococcus xanthus
atgggcccggtggctggggtgtccaccacgatggccgcgcggtggctgctgggcgtcgtggcgctggccgtgctggggtggtggttgcaccggcgcggcgctgtcgtcacgggcgcatccacggccccacggctgaacgtcgtatcgcgagcggggctctcgcagcggtgcggtgttgcgctcgtggaggtggatgggcgcagctacctggtggccttcggtgacgcgttcgcggagattcgcgagacggcagcgcctgcgccggagttcgggcatgtcctggcgcaggcccggcggcccatgcccaggtcccgcacgattcggggccggcgggaggggccatga

SEQ ID NO: 2814 - DNA, 600 bp, Myxococcus xanthus
atggtgaccgtgggcgagtcgcgcgcgggcgcgcggttgctgctgccgtcacaggtggtccagacggtgttccaagcgcttccggtggagcgtgcgccgggcatcgcgccagaggtgctggcggcctcgctggaggcccggtgcctcgtaggccagacgccgctgtccgcgaacgctctggacgcgctcgtggtgggggacgtcgtcgtcttcgaaggtgtgcgcacgcaggccggccagctcttcgggccggggcggctggtgacacgcggattcgcgctctcgggagacttcctcgccgagggcttttcactgacccgcgcgcaggggcgcgggattccccaggagtcggacatggtggtcgtgaacaagcaggaggagggcatgcctccgctgcccgtggatgtggaaatcgagctgacgcgggtgatgattcccctctcggagctcgcggcgctcaagccgggcgcgctgcttcccctgcacatcaatgccagtgagccggtggtgctgcgagtgggagaccgcgcggtggcccgcgccgagttggtggaaatcgagggcgaggttggagcccgcgtcctggcgctgctgccgtga

SEQ ID NO: 2815 - DNA, 768 bp, Myxococcus xanthus
ctgctcgtgagcgtcaccgcctgccgcgagcgcatccagcatggtctggatgagcggcaggccaacgagcttcaatccgtgctcgtcgagcgagggctcgacgcgcgcaaggtccccgaggcgggcaagaagcccacatggtccatcgaggtggcggatgagcacgcctcggacgcggtccgaatcctgtcggagctggggctgccgaggccgaaggaggaggtgggctgtgacgtcttcggcggtggcgggctggttcgcacgccggtggaggagagcgtctgccgagtgagggtgatggagcggagcctggagaagacgctccaatccgtggaaggggtgctgctcgcgcgcgtccacctggtggtgcccgcgccgccgagagtggggcaggccccgggtccatcgaaggcatcagccatgcttcgcgtggcgccgggcaatgcggcccgggtgcggcaatcctccgagacgttgaaggtcctcctcgcggggggggtggagggcctgtcgccggaagccgtctcgttgttggtggacgaggtctccacccgagtggaggctccgacggaggtgggcgtgtctccgctgacccgactgcgtgccctcttggcggtgttgggcctgatggtgacggggctgtcggtggcgctggtgctggtgacgctccggatgcggcactaccgcgaccggacaccgactccgtccgcgccgcccggacccgcgcggcccgtgttgtcaccgggaccggcgcgcaaggtggcgtga

SEQ ID NO: 2816 - DNA, 486 bp, Myxococcus xanthus
atggccatggacacgttggggccggtggggggagcgggcgcgtcgcccgcggtggagcccagccgggagcgattcagcaaggtgttggacgaggtgcaggggcctgcgaagggcactggggttccggtggccacggaggggccgccgaagcccgcgctcacttcggcgccgcggggtgtctcccgggccgaaggggtggggcccgccgcgccgggctgcgcggacgtgaagccgggcactcgcgtggactcggtgcaggcggcgagatcgcagcaggcggcgcaggtgctggaccgggtggggcaggcgcaaaagcggctggaccacatccttcagctagcgcagtccggccgcagcttcacgcccgcggagttgctcgcgttgcaggcccatgtctaccgggcgagccaggagctcgacctcgccggcaaggtcgtcgagaaggcgaccggcggcgtcaagcaggtcctccagacccaggtttga

SEQ ID NO: 2817 - DNA, 240 bp, Myxococcus xanthus
atgcccgcgacggcggatacggggagcgcagcgggcgcgggggccgcggcgggcaaccaggaggcgtgggacctgctggaggcgcagaaggtgctcgccgcggagggccagaagttcaacatggcctacctgcagctccagaacgagatgcagaaggagagccgcgagcacaccgccgtctccaacatcatgaaggtccgccacgactccgcgaagtcggccatcaacaacatccgctga

SEQ ID NO: 2818 - DNA, 441 bp, Myxococcus xanthus
agaaccatggctggcaattcccaggcacccttccacatccttctcgtcgaggatgagccggtcatccgggagctggttcgctccatgctgagcgacggcaccgtggaggtggtgtgcgccgccacggggctggagggcctgaagctggccaagagccagacgttccacctcatcctgatggatgtggtgttgccgcaactggacggtatctccgtgtgccgcatcctcaagggagaccccgttaccgcgggggtgccgctctacatgctcaccgcgaaggcgaagcgctccgacatggagagcgccacccaggcgggggcggacggctacatccacaagcccttccggggggccgagctgatggcgctggtggagcggctgcgcgaagcgaggccgaagctgccctgagtcaggcgggcttcagggcaggcgcgggtggag

SEQ ID NO: 2819 - DNA, 390 bp, Myxococcus xanthus
atgccaggaggtcgtggccctgtgttttcggtcgaggcactcgttggcaagaaccggttggtcatccgcctctggggtgtcgtcacggaggaggaagcactccagattggcgatgcgtcgctgcgcgagctcgagcggctccggccaggcttcgacatcctgtctgacctgacgggcgtgacggagctcccggagtcgggctcggggcagattgagcgcgtcgtcgaagcggcccgggtccgcggctttcgccgggtggtgcgcgtggtggggcgctccgcgatggcggcggtgcggttccagcgcagcagccggaacgtggggcacgaggcctacctggccttctccctcgaagaggcggagcaactgctggagggcggctggacatga

SEQ ID NO: 2820 - DNA, 1395 bp, Myxococcus xanthus
atgcagcagatggaagaggccttcggcgacatgatggagccggaccggcccacgattccccggggggactccgacctcttcctgcgcgccagcctggaccgggacaacgtgtacgtgggcgagcaggtgacgttgtcgctctacatctattcgcgcgtggacctgtccagcgtggacgccgtcaccatgcccaagctggagggcttctggacggaagaggtggagagccccacgcagttgtcgggcgagcagcgcgtggtggacggcatcccgtaccgcgcctacctgctgcgccgccgcgccatcttcccggtgaagtccggcacgctgtccatcacccccgcggaggcggacatcacgaccggcttcctcttcgccggccaccgcgtgcaccgggtgtccaacgcgctcaaggtgaaggtgaagccgctgccgcccggtgggccggaggacatgcccaacgcgcacgtgggcaactggcggctgtccatggacgtgtcccagacgcgcgtggagctgggccagcccgtcacggtgaaggtcagcctggaaggggtgggcaacgtgaagaacgtcacgccccccgcgctgaagggccccgccgcgctcaagatttatgaccccaccacgacggacaaggtgtcgccgcagcgccaccgtgtgcagggccggcgggtgatggagtacctggtgatgccgcagcgcacgggcagcttcacgttgcccgcgctggagttcacctacttcgacccgcgcgcccgcaagtacgaggtggcgcgcaccgacccggtgacgattacggtggaggcgggcgcgggcggtgcatcgtccatcgcctcggcgtcgcctcagtcttcgtcggaccaggccaacgagcagaagaacgtgctgacggcgggaggtctgcggccagtgcgctaccaggcccgcttcgaggcgccgggcgtgcctgtgtggaagcggggcttctttgtcccgacggtgctggccccgctggggctgctgttgggcgttgcgctgattggcggcgtgcgcgggcggctggcgctgcgctccgaggcggggcgtgggcgtcagcaggcgaaggccgcgcgcaagcgtctggcggatgcggagaagctccagtccagcggggacgtgggggccttctacggcgaggtggagaaggcactgcacggcttcctggaggcacggctgggcatgccggtggtgggcctcacccgcgaggtgctcgccgagaagctgacggcggggggcgcggatgcggagcggcgcgccaaggtgctcttcgtgttggaggcgtgtgacttcgggcgctatggcggcgggggcgacccggccgagcgacagaaggtgatggatgccgccgcggcggccatggagggctgggcgtga

SEQ ID NO: 2821 - DNA, 396 bp, Myxococcus xanthus
atggatatggacagcacccccacgacttccgccgcccccgccgcttcgccggcttcccaggccactccggtggccgtgcgcctgacggatgccgccatccagcaggtgaaaagcgtcatcacggcccaaggcttcgagggctacttcttctccatccgcgtggtgcccgctggctgcagcggcctgggctatgacttgaacctggtcaaggagtccaaggccggtgacaccgtctgggagcaggacggcgtgaagatcgcctccgacccgatgagcagccagtacctcgggggcacggagattgactacgtctccgccatcaccggttcgggcttcaagttcaacaacccgaacgcgaagtcctcctgcggctgcggcacgtcgttcacgacctga

SEQ ID NO: 2822 - DNA, 360 bp, Myxococcus xanthus
atggacggcggtgccgacggtggcgacggtgatggtggcagcgacggcggctccgacggaggcgcggacggcggcgagcagggcccaccggacaagggcgacgggggcgcggatggcggcgcggatggtggacaggacgacggagagggcgagccccaggacggtggcagcgacggcggcagcgcgggagaagaagactcggaggaatccgaggcggatggtggctccagccagtcggacctggatcggcaggaggcggagcgcctgctggatgcgatgaagcagaatgagaagaacctccagctctggcggttccagcaaaagaagaagcagaggaagccgaatgagaaggactggtag

SEQ ID NO: 2823 - DNA, 2000 bp, Myxococcus xanthus
tggcaggcctggcgggagcggcgcgcccgcgccacgctgcgcttctccgcggcgcatgtcttcgcccggggtggccgcggcttccgcgcgtacctgctgccgctgctgccgctgcttcgcgtggcggcggtgacggcggcggtgctggccattgcccggccgcaggtgcgtgactcgcgcgtgcgggacttgtcggtggagggcatcgacatcgtggtggcgttggacctgtccacgtcgatggaggccggtgacttccgcccgcagaaccgcatgcacgtcgccaaggaagtgctgagcgagttcatcgccaaccgggtgaatgaccgcatcggcctggtggtgttcgcgggcgcggcgtacacgcaggcgccgctgacgctggactacggcgtgctgaaggaagtggtgaagcagctccgcacgcgcgtgctggaggacggcacggccattggcgacgcgctggccacgtccctcaaccgcctgcgggactcggaggcgaagagccgggtggtggtgctcatcaccgacggcgacaacaactccgggaagatttcgcccatggactcggcgaacatggcccaggcgctgaaggtgcccatctacacgattctggtgggcaagggcggcaaggtgcccttcccgcagggcacggacctgttcggcaacaccgtgtggcgcgacacggagattcccatcaacccggagctgatgcaggacatcgcggaccgcaccggcggcgagtactaccgcgccacggaccccgagcaactgcgagagggactccagaaggtgctcgattcgttggagcgctcgaagctgatggagggcggcgccagcgccacctaccgcgaggagttccatcccttcctcctggccgccttcggcctcgccgcgctggagctgctcctgcgcgcctccttcctgagggtcttcccgtgacgcccgtggaaccctggcgcttcaccgtgctcggttaccaggcggggctcgcgcagcccctcttcctgctgttcgtgctcgcgggcatgatgctgggcctgctcgcgctggtgggggcgctgcggcgccgctcgcgcgtgcgggcgctcttgcatgaacgtcacgcagagcgcttcacgccgggcgtgtcggtgtggcgtccggccacgcagggcgggttgtacggcctggggttggcgctcttcggcttcgcactggcgcagccgcagtgtggcaccaagagcgaactgacgaagcggcgcggcatcgacgtggtggtggcgctggatgcctccaagtccatgctggcgcgggacatccagcccagccgcctggagcgcgcgaagctggagctgaccacgctgctggacgagctgaagggcgaccgcgtgggcctggtggtgttcgcgggcgatgcgttcatccagtccccgctcacgtcggactactcggcggtgaagctgttcttgcgcgcggtggacccggaggtgatgccccagggcggcaccaacgtgggcgcggcgctgcggctgtcgcggcaggtgctggagaacgcggaccgcggctcgaaggagcgcgtggtcgtcctgctgacggacggcgaggacctggtcggcgacgtggcggaggctaccgaggcgctgaaggattcgggcgtgcaggtgctggcggtgggcgtgggctcggagtccggtgagcccatccccgtcttcgaccggcgcggcgcgttcgtggactacaagaaggacgccgcgggggagacggtgattacgcggttggaccgggcggggctgacggccatcgccgaggccaccggaggcaccttctatttccagccccgtggcgtggccatgtcgcaggtggtggagcgcatcgaccagatgcagaagagtgagctggagagccgggtgacggtccgctacgacgagcgcttccagtcgttcgccatcccggggctggccttgctggcgctgggaatgttgttgctgccgtcgtcgcgccggaggccgtcaccatga

SEQ ID NO: 2824 - DNA, 579 bp, Myxococcus xanthus
tctaaagcgctgtcgccggacgcggaggggcagggcgcggacctcttcgactacaagccgccggaggaggtgcccatccgttcgtggcgcctggtgctcacggtgctgggcgtgctggccgcggcgctgctggcgtgggtgctcttccgctggtggaggaaccggcccaagcacgtggaggtggtgccgacgctgcccctggacgtgcgcgcccgcaaggcgctggacgcgctgaaggcggaggacctgccctcgcgcggccgggtgaaggacttctacttccggctgtccgaaatcatccgaggctacctgggcgagcgctacggcttcgaggcgttggagtgcaccagctccgagctgatggcgtcgctgcggcgcctgtccacgccggggctgccggaggacaagctgatgcgcttcgtgtccgagtcggacatggtgaagtacgcacgcgcggatgcctccgctgacgcctgccgcgacgcgctggccttcggctactcgctcatcgacacgacgtacgttccgccaccgccgccccaggctcccgacaatgccgccgctccccgcgttcaataa

SEQ ID NO: 2825 - DNA, 447 bp, Myxococcus xanthus
atggctcagcgcggcatccggctggagctgtccggcggccctcgcccgttgaccatggtggatgtggaggacgtggtgcacatcctcttgttgcaggccacccacccggcggccatcggtgaggccttcttatgcgcgggccccggcgagcccctctccttggagaaggtgcaggacctgggcgcgcaggccctgggactgacgccccgcaccgtgcgcgtgtcccccgcgctactgcgggccatgaccacggcgacggacggcgtgtcccaactgacgggccgcaagctggccctgagccggaagatggcgaagcaactgttggcgcctgcctggacgtgctccggggccaaggccgagcggctgctcggctttcacccccagcgcgacctggcggactccatccgtcgcagcgtgcagtggtaccgggagcagggctggctgtag

SEQ ID NO: 2826 - DNA, 2380 bp, Myxococcus xanthus
ccccttctcccccgagccgccgggaggcacgccaaactcccggcatcattgacctcccccccctcgaagtgtcaggaagcccgcagccccatgtcctcgaaagctgccttcttcgatgtcgacgggacgctcgtgaagacgaacgtcgtccacgtctacgcgtactacgcgatgaaccgcggctccgtcctgggcatcgcggggcggaccctgagcaccgccctcagcgtgccgctcttcggtgtcatggacgcggtggaccgcaagacgttcaacgagttcttctaccgctactacgcgggcctgagcgaagaccgcctggtcaccatcgccgaggacatgttcgaggacgtgctgcagcccgccctcttcgagcagacgcaggacctcatcgaccaggctcgccgcagcggctgcaagattgtcctcgtcacgggcgcgctggacttcaccatgcgcccgctggcgcgccacctgggcgccgacgacatgatcgccaacaagatgcagttcgtgggcggcaaggcgaccggcaaggtgattccgcccatcatcgaaggcgcgaacaaggcgaacgccatccgcgcctactgcaccaaggaaggcctgtcgctggacaagtgccacggctactccgacagcgcctctgactacgcgatgctcgcggtggtgggccgtcccaccgcggtgaacccggacctgcggctgcgctccatcgcgcgcgcctacaactggcccatcctcgacctcaagtaagagcccccacgccatgcgcccgttcaagacgctccagaagctgtacgacgaggaaagccaggtcgtcatcaccgagaagggcagccccccgcgcgtgctgttccacggtgagaacttcctgcaggaagaccttccggtcggcacgcgcgtcatcttcccgcgcccgcccctggccggcgtgcccaacgtcaaggccgccatccgctacgccatcaacaacccggagggcatggagccgctgcacgcgctcctcaagccgggcatgcgcctgacgtgcgtcatcgacgacatcagcgtgccgctgccgcccatggtcacgccggacgtgcggcagaccatcctggaaatcgtcctggagctggccgccgacagcggcgtggacgacgtgcacctcatcatcgccaacgccctgcaccgccggatgacggaaggcgagatgaagcgcatggtgggcgagaagatcttcgacgcctactacccggaccgctactacaaccacgacgccgaggacccggacgggatggtcgcgctggagcgcacgtcccacggtgaagaggtgtcggtgaaccgccgcgtggcggagagcgacctcatcgtctacgtgaacgtgaacttcgtgcccatgaacggcgggcacaagtccatgggcaccggcgtgtccaactacgcgtcgctgcggcaccaccacaacccgaagaccatccgcgcctccgacagctatatggagccgaagacgagcgcgctctacaagagcaacgagcgcatcgggcgcaacatcgacaagcacctgaaggtcttccacatcgagacggcgctgaacaaccgcatgttcggcggccccaccgacttcctggcgaagaaggaagaggactacacggaggcggaccggctgaagttccaggccatgcgcttcgcgctgtccaagctgccgcgcgcggcggcgcgcaaggtgctcaactccgtccccgcgccctacgacgtcacgggcgtctacgccggagccacggagcccacgcacgcgaagacgctggagacgagctacaagcagtacgtggtgccggtggagggacagagcgacatcgtcatcttccccatcccgttcatctccccgtacagcgtcaactccatcctcaacccgctgctggtgcaggtgatggggctgggctacttctacaacctgaaccgcggtgtgccgctggtgaagaagggcggcgtgctcatcctgctgcacccggcctacgacgagttcgacccggagcaccaccccagctacatcgagttcttccaccggctgctgccggagacgcgcgactccatgaagctggagcacaagtacgagcgcgagttcgcggagaaccccagctacgtgcacctgtaccgcaagggcaacgcctaccacggcgtgcaccccttctacatgtggtactggggcgagaatggccgccagcacgtaggcaaggtcattgtcgcgggcgcggagaacaaccatgtccccgccctgatgggctgggaccgcaccgacacgctcaccgaggccattgaagaggctcgcgggttcatgggccgctcggccaccatcagcctgctgcgcatcgcgcccacggtgatggtggatgtgaagtga

SEQ ID NO: 2827 - DNA, 4413 bp, Myxococcus xanthus
atggccgcccttcccgagctgaacgtcacccagaccttcaccggcaagcgcctgctcttcgcgggcgccaccggcttcgtgggcaaggtgacgctgtccatgctgctgacccgctacgggcaggacctggacaaggtgtacgtgctggtccgcaagggcagcgccgcgtccgccgagcgccgcttcttcgacaaggtcgccaccagtgagcccttccagccgctgcgagacagcctgggggatgaaggcgcgctggccttcatccgccagaaggtggaggtgctggacggcgacatcaccgacccgtggatgggcctggaagagccccaggtggaggcgctcaccggcaaggtgcacgcgttcatcaactgcgccggtctggtgtccttcaacccgtcgctggaggtgggcctcaacgtcaacacccacggcctgaagttcgccgcggcgctggcggtgcgctggtccgtcccgctgattcacatgtccacggccttcgtggccggcaaccgcagcgggctcgtcttcgaggacgaggaggttcgcggctacttccccaagcgggaggagatggacggccgcgacttcagcctggagcaggaactgcaggacgcggcgcgcatcgtcgcgcggctgcgcgagcaggccgaggaccgggccctcacgtccaccttccgcaagaaggcgttggaccggctggaggaagaaggccgcgaccccaacgacgagaagacgctgcggctggcggtgggccgtgagcgcaagctgtggctcagcggcgagctggtgcgcgccggcatggagcgcgccgcccactggggctggcccaacacgtacacgtacaccaagtccctgggcgagcaggtgctcgcggccacgccgggcctgcgctactccatcgtccggccctccatcgtggagagcgcgcggcacttccccttccccggctggaacgagggcttcaccacctccgcgcccctggccttcgcgggcatcaagggccccggcggcatccccgcgggcgagaacaccatcctggacatcatcccggtggaccaggtggcgggcgccaccatcggcatcaccgcgcatgccatggacgtggaggagcggcgcatctaccagctcgcctccggcgatatgaatcccttctacgccggccgctccgtggagctggtgggcctgtaccggcggcgctactaccgcaaccgcgagtccggcaacgcgctgatgaacaagctgcgctcgcgcgtcgagccgcagccggtcagcaagaaggagttcgagctgttcagcgcgcccatgctgtcgcgcggcgcgcgcttcctgaagaaggccatcgacgaggtgcgtcccgcgtggggcgccccggccgtccaggccatgctggacaaggcgaaggtgtcgctggacgaggtggacgacaacgcccagggcatcatcgccctgacggagctgttcctccccttcctctacgagaaccgctacgtcttccgctgcgacaacacccgctccgtgtatgcgcgcatggcgcacgcggaccggctgaaggtgccctgggacccggagcacatcgactggcgcgagtacttcctggggacacacctccctggcctggagaagtgggtgttcccgggcatggagtcggagcgcgagaagcgcaccgtcatccccgcgcaccgcgacctgctggagttgatggaagccacggtgcatgcgtaccggcaccgcgtggccttccgcatggtggcgggcgagaaggaggagcgcttcacctacggcgaggtgcaccgctatgccgcgcgcgtgggcagcttcctgctggccgcgggcatcaagcacggcgaccgcgtgctgctggtgtcggagaaccggcccgagtggggcatcagctacttcggcatcctgcgcgcgggcgccaccgtcgttccggtggacccgggcttgagcgaggcggagctcgtcaacatcgcccgccgggcggacgcgcgcgcgtgcctcgtctccgaggacgcggcccgggacttccccggcctcttcgccgcgctgggtgacggcgtcaccgtggccagcctcgcggaggcgatgacaggcgacccggcgcacccggaccgcatcgggccagtgcgcaggtccgccgcggcggatgacctggccagcatcatcttcacctccggcaccacgggcacgcccaagggcgtcatgctcacccaccggaacttcgccgcgctggtggcgaagctggcggggaccttcgacatcggcgtgggcgacggcgtgctgtccgtcctgccgctgcaccacaccttcgagttcgccgccggcttcctcaccccgttctggcgcggggcggaaatcacctacatcgacgagctgacgtcggaccggctgggcgaggtgttcgagacgggccgcatcaccgccatggtgggcgtgccggcgctgtggcagctcttgcatcgcaagattacgcaggagttcgccagccgccctcagttcatcgaacaggcgctcaaggcgctgatggccacccacggcgagctgcgcaaccgcaacaacatcaacctgggcaagctgctgttctggccggtgcaccgcaagttcggcgggcgtatcaaggtcatcgtgtcgggcggctcggcgctgccggacgacgtgcacaaggccttccacgagctgggcttcaacatcacggagggctacggcctgacggaggccgcgccggtgctggcggtgacgaagcccggcaacaagcgccagcccggtacggtgggccgcgcgctgcccggcatcgagctgcgcatcctcaatccggacaacgacgggttgggtgaagtgctggccaagggccccaacgtcatgcccggctacttcggcgaccgcgaggccaccgaggcggtgctcaaggacggctggctccacacgggcgacctgggacgtctggacgcggagggccacctgtacctggtgggccgcgcgaaggacgtcatcatcgaccacaacgggaagaacatctacccggacgagttggaggagctgtaccaggaccacacgcacatcaaggagctgtccatcgtcggcctgcccgacgacgcgggcggtgagaaggtggcgtgcctgtgcgtgcccgactacgcggaccgcccacgcgaggaagtgcgccgcgagttggaggagcacttccgcaaggtgagcgcgggcatgcccttctaccggcgcgtgaaggtgctgcgcctgtgggacggcgagctgccccgcaccgccaagcgcagcgtgaagcgcaagcaggtggtggaggagctcaagcgccaggagcgcatggcggccagcgccagcaaggcgcgcgagaaggcggccaaccccaccacgggtggcatcgcggactggctcttcccgctcatcgcggacgtcagccaccggccggtgtccgacgtgcgtccggacgcgctgctcagcggggacctcggcttcgactcgctgatgctcaccgagctgtcctccgcgctggaggccgccggcgtgccgctgcccgcagtggaggacctgacgcaggtgcagacagtggaggacctgcgcaaggtggtggcgtcctccggcaagcgccccacggtggagacgcgcgcgaaggagatctccaaggagaacgagcgcgcggaaaaggtggagattccggggcccgacgtggtggcggacgtgggccgtcagctcttgtccttcgggcagaaggtgctctacggcggcgtgttcgacgtgaaggtgacgggcaagtccttcatcccgcagaaccgcaacttcctcgtcatcgccaaccactccagccacctggacgcgggcctggtccgcgtggcgctgggtgaccagggcgagcgactggtgtccctggcggcgcgcgactacttcttcaacacgccgctcaagcgcgcctggttcgagaacttcaccaacctgatccccattgaacggcagggctcgctgcgcgagtcgctgcggatggcgggcgaggcgctgcgtcagggcttcaacgtcctcatcttcccggagggcacgcgctccaccaccggtgagctgatggagttcaagtccacgctgggctacctggcgctcaccttcaacatggacgtgctgccgctgtacatcggcggcgccttcgacgcgctgcccaagggcagcgtgctgcccaagacgaagacgcccctgcgggtgaacatcggtccggcgctgggccacgcggacctgcgcacgcgggtgcagggcatggcgcgctcggagggataccgctacgtcacgcgcatcgccgaggactccatgcgggcgctgcgcgacggccgggtgctgaacctggagcgcgtggacctgcctccggccggggccagtccccgcgcgtccacgtccacggaagggaaggactcgtga

SEQ ID NO: 2828 - DNA, 783 bp, Myxococcus xanthus
atgttcgagctgcacgtggacagcacgcgcgagctgctgcgggacgtgcgcgaggccggcgtgaagcgcgtggtgctggcctccacctccggcaccatcgcggtgtcgaaggaggcgcacgtccgcgacgagagcgccgactacccgattacggtggtgggccagtggccctactacctgtcgaaaatctacgaggagaagctggcgctcgcatactgccgcaagcacgagattcccctggtggtgctcaaccccagcctgctgatggggcccggggatgaccggctgtcctccacatggacggtggtgaagttcctcaaccgcgagattccggccatgccgggcggcggcatctccttcgtggacgcgcgcgacgcggcggacgccttcgtccaggcgctcacccggggcgaggtgtacggccgtcacctcatgggggtgaatctgtccatgaaggacttcttccagcggctggagcgcctgtcgggcgtgcccgcgccgaagctgaagctcccctccaaggtcaacgtgctcggcgggaagctgctggagcgctgggccaaggtgcgcggcaccacgccgacgctggacccgcaggaaatcgacatcggcgagcactggttctggctggacgcatccaaggcggaggccgagctcggcttccgcgcgcgcgacatccaggagacgctctccgagacggtgcagcacatctacgggaagatgccgccccagagcctgcctggcaccaagggccggctggcggagctgcgcgagaacacctga

SEQ ID NO: 2829 - DNA, 609 bp, Myxococcus xanthus
gtcctggcgatgattctggctggaggcgctggcacgcgcctggagcccctgacgcgcgagcgcgcgaagcccgctgtccccttcggcgggcgctaccgcatcatcgatttcgttctctcgaacttcgccaactccggtgtgtaccggatgaaggtcttgacgcagtacaagagcgactcgctcaacaaccacctgtcccgcgcgtggcggatgacggcgttcctgggccactacgtggaagccgtccccgcgcagatgcggacggggctggactggtacaagggcagcgcggacgccatctaccagaacctcaacatcatcaccgacgaggagccggactacatcttcgtcttcggcgcggaccacgtgtaccggatggacacgcgccagatgctggacttccactgcacgaagaaggcggcgtgcacggtggccgcgattcccgtccccatcgagcagggccgcgagttcggcatcatcgacgtggggccggacgggcggatgcggcagttcctggagaagcccaaggacccgccgcccatgccgggcaacccgaagatgtgcctggcctccatgggcaactacctcttctccaccgacgtgctggtg

SEQ ID NO: 2830 - DNA, 2232 bp, Myxococcus xanthus
atggccgaggtctggctggcgcgccagacgggcatcgaggggttccacaagaacctcgtggtgaagcgcatcctcccgcacctcgcggaggaccgtgagttcgtggagatgttccggaacgaggcgctgattgccgcgcgcttcaatcatccgaacatcgcccaggtctacgagttcggcgaggccaacggcacctattacatcgccatggagttcatccacggcgaggacctgggccgggtgatgcgcaaggccgccagcacggggcagtgggtggcgcggccgctggccattcgcatcgtcgccgccgcttgcgagggcctgcactacgcccacagccgcacggatgacgccggccggcccctgcgcgtggtgcaccgcgacatctcgccgcagaacatcctgatcagcttcgacggctcggtgaagctggtggacttcggcatcgccaaggccgcggatcaggcgtcgctcacgaagtcgggcgccatcaagggcaagttcgcgtacatggcgccggagcaggccggcggcaagccgctggacgggcgcgcggacatcttcgccatcggcctggtgctctacgaactgctcacgggcgtgcgtccgttgaagcgcgactcggagttggccacgctgcaggccgccatggagtgcgccatcgccgcgccctctcaggtggcggacgttccggaggagatggacccggtggtgatgcgggccatcgcgaagaactcggacgaccgctaccgggacgcgcgccagttccagatggcgctcgaggagattctcgtcgggcagcgctgggtggccggctcggtgcagatctccgagctgatggagacgctcttcgccgaccgtctggccgaggagaaggcccagggccaggtggttcccgtgggcgaggactccgcgaactccggcacgcccatgccgcccacgccgccgccgcaggagcgtggccgcagccgcacctccgccgccgcggacatgaactgggaggcgcctccgggcgaggcctcggttcgccagcgcggctcgtcttcccgcacgtccatggggccccggcgcacctcggccgcggtgcccgcggtggagcccgacgaacagggggagtgggatgcgccgtccggaatcgaggaggccccgccgccgcgccggagcaggacgtccgcggagctgcgccgtccgtccaaccccaactccacgcagattgcacggacgagctcccgttcggacctgagccggaccggcatgggcgagccgcccccgcctcgccgctccgccacgcgcgccgcccaaatcgtggaggacccggggccgcctccgtcccgctcgcgcgcgagcatggcggcggtcgatgagcgcacccggatggaggacgaggagctggacgacgagcggaccatgcttccgccgccggagcccgcgccgcctcctcgccgccggactgggatgcattccggcatccacccctccgaggcccctccgcgccgccgcacgtcgagccgcgcggagatgccgtcgcccccgccgcgttcgaggacgtcgagcgtggccctgtcgcgttcgcgcgccgaggacgccgaggtggaccgggcgctggagaagtccgcgcggagcgctcgcgcgggtgtggccaagcgcaacatcgccaccgtcgggttcatcgtggggctggtggccgtgggggtggtgttccacaagcccatcctctcggtgctcaacagccgcgcctccgacgggcagtcggtgacgctgtcggtcaacaccaacgagaaggtgaaggtctcggtgcgccacaccgaacgctgcggcagtccgcagccggtgacggagctgggggagacacccctcgtcaatgcgacgggcgtccatctccaggacacgctcatcctggtgaatgagcagcagggcatctacaaggaggaggtcgacacgctcgccttcggtgagcccggtcaggccaagtccttcacctacgagttccgccggggccagctccagctgacgctgaagccggacggtctgcgcggcatctccgtgaagcgcaatggccaggaccagggcacctacctgggcaacaagggcatgaagctcgacctcatggagggccgccacaagctggagctgcagggcgggcccctgaaggagcccttcatgttcgaggtcgagatcaagcccggcctcatcaacaagcagaccgaagacttgtccgccttcgtgggctag

SEQ ID NO: 2831 - DNA, 2689 bp, Myxococcus xanthus
atgacggcggaggccctggccgaagggctctacgcacgcgtccaggcggagctggatgcgcgtccccacacgcccctgtccacgtaccgagtgcagttccaccagggcttcaccttcgaggacgcgcggcaggtggtgccgtacctggcccgcctgggggtgagtgacctttatgcctcgccctatctgaaggccacgcctggaagcacgcacggctacgactgcgtggaccaccaacagttgaatcccgaagtcgggacgcccgaatcgcacgcggcgctctgcgcggcgctgcgtgagcagggcatggggcaggtgctggacgtggtgcccaaccacatgggcatcgagcgggacaaccgtctgtggttcgacgtgctggagaacggcccgtcctccgtctacgcgaagttcttcgacatcgactggtcgccggtgaaggaggagctgcgggacagggtgttgctgccgattctgggggaccagtacggcatcgtcctggagcgaggggagctgaagctgtccttccgcgacggcgccttcttcctccattactacgaccacctgttaccggtggcgccgcgtcagtactcccgcatcctccgccatggcctggagcggctggagtcgcggctgggggaggagcaccccggcatgctggagttcctgtccatcctcaccgccatcgactacctgccctcgcgcacggaggtggagcggccgaaggtggtggagcgccaccgggagaaggaggtcatcaagcgccggctggccgcggtgacggcggagttcccggagatgctggcctacatcgaggacaacgtccgcgtcttcaatggagagccgggcaacccgcgctcatatgacctgctggactcggtgctggcggcgtgcagctaccggttggcgcactggcgggtggcgggcgaggaaatcaattaccggcgcttcttcgacatcaacggcctggccgcgctgcgggaagaggacccggacgtcttccaggaggcgcacgcgctcatcttccgctggctgcgcgaggggctcgtcacggggctgcgcatcgaccacccggacggcctcttcgacccgaccgcctacttcctggacctgcaggaggcgtacttcgtggagcgggcccacgctctgtttctccagacgcatgcggaggatgacacgcgctggccggcggtggagtccacgctgcgcgagcgctggcgcgcggaggtgacgcagcagccggacagccggctgcgcaaggcgctgtacgtggtggtggagaagattcagggcggccgtgagcgcatgcccgaatcctgggccgtgcacggcaccacgggctaccgctacgccaacgcggtgagcggcgtgttcgtccagccggacgcggagaaggcgctgacggagacgtacgagcgcttcgtgggagggcagacggacttcgccgagctcgtctaccagaagaagctgctcatcatgcgcgtgtccatggccagcgaaatcaacgtgctggcgcacgcgctcaacggcatctcggagatgaaccggcgcacgcgcgacttcacgctcaactcgctgcggcgggcgctggtggagttcatcgccctgttccccgtctaccgcacctacgtggacggctggcgcccggagctggacgggcgcgacgtgcagtacatcgagtggaccatccagcgcgccaaggagcgcaacgccaccaccaacgcgtccatcttcgacttcctgcgcgacatcctcctgcgccgctacccggagcacgcggacgggcgagagcgggcggaaatgctgcgcttcgccatgaagctgcaacaggtgacggggcccgtcatggccaagggcctggaggacaccgtcttctacatctacaaccgcctggcgagcctcaacgaggtgggcggcgagccggagcgcttcggcgtccacgccaacaccttccacctgcgcaaccaggagcgcgcggagcggtggccgtccagccagctcacctccagcacccacgacaccaagcgcagcgaggacgtgcgcgcgcgcatcaacgtgctgaccgaggtgccggaggagtggcgcaagcgggtgaagaagtgggcccgccagacggagaaggcggtgtcccaactgccgtccggtccggcgcccacggccaatgacatgtacctcttcttccagacggtggtgggggcgtggcccatgggcgacgcccactccgcggaggagctggcggacttccagcgccgggtgcgcgagtacatgggcaaggccatcaaggaggccaaggtccgcacctcgtggaccaaccccgacagcgcctatgacgacgcggtggcgcgctacgtggacgcctgcttcgactcgaaggtgacgggctccttcctggcggacgtgcgggacttcaagcgctccatcgagcgcgcgggccagtacaacgcgctggggcagttgctgctgaagatggcctcacccggcgtgggtggacacctaccagggctgcgagctgtgggatttgtctctggtggacccggacaaccggcggccggtggacttcgcgctgcgcgcgcggatgctggagacgctggacgccgaggcggagaaggaccgggccgcgttaagcgcacggctggcggcgaacctcgatgacggccaggtgaagctctacgtcctgacgcagtccctg

SEQ ID NO: 2832 - DNA, 243 bp, Myxococcus xanthus
aacgcgtcgttcatgaaggagatgacgccgtctgccgcgctcgctgagatcgtcggcgcgaagccgctgccgcgcaccgaggttgtcaagaagctctgggcctacatcaagaagcagggcctgcaggacgcgaagaacaagcggcagatcaacgccgacgacaagctcaagcccatctttggtggcaagaagagcgtcaccatgttcgagatgacggcgctggtgaacaagcagctgagctga

SEQ ID NO: 2833 - DNA, 972 bp, Myxococcus xanthus
atgtgggagaagcgccgcaaagggccgaagaaccggcccccgctgcgttgcatggcgtctgccgaggctatcgtgctagcctcgtttccgatggccggcgacgaaacccgcgtcaccaagatctcaacgctcaacgtgcatgcccaccgcagcacggagtgttgtctcgtgcagattcatggccccgagctcggcaagaagtacctcatcgaggatgccgaactcaccattgggcgggatcagcacaaccacatcgtcgtggacctggacaacgtgtcccgccgccacgcccggattctggggcgtggggggaagatgctcgttgaagacctgggctccaccaacggtaccttcctcaatgaccaggaagtgcttcaggcctctccgctgcgcagcggagacctggtcaaggtcggaggctccatcttcaagttcctcgatggcgacaacatcgagacccagtaccacgagaccatctacacgctgaccatcgcggacggtctcaccggcatcaacaacaagaggtacttcctggagtacctcgagaaggagatgggccggtcgacccgctatcagcgcaccctcacgctgatgatgttcgacatcgaccacttcaagcagatcaacgacgtccacggccacctcgccggggactacgtgctgcgggagttggcccagtccatcaagcgcctggtgcgccgcgagcagtgcttcgcccgctacggcggcgaggagttcgccgtcgtcctcccggaggacggcccggacaaggcgcgcctgttcgcggagaagattcgccggctcatcgagggcaagtccttcgtctacgacgacaaggaaatccccgtcaccatctccattggcgtggccgagcagacgtcggacatgctggagcccacgcacttcatcaaggtggcggacgccaacctgtacaaggcgaagaagtcgggccgcaaccgcgtggtgggctag

SEQ ID NO: 2834 - DNA, 180 bp, Myxococcus xanthus
atgctccccctcccgttcgccaccgtggacatcgcacccgtgggagagcagctgatcgccgtgggcggcctcgtggtcgccgggctgggggcgctctgggccgcctggacgcggccgtccgcgcagccggtgcccattcccgtgcgcggcggctcgtcgcgccgcaacccgcgtcgctga

SEQ ID NO: 2835 - DNA, 468 bp, Myxococcus xanthus
atggccgcgggcgtggtgctggcattggcggaggtggtgctggcggtggcgtcgggggacaacccgatgcatccggtgcggatgtccgccggggtgctcctggggccgtccgccttcacggccgcggtctccgacagcacggccctgctgctgggcatgggcgtccacctgatgatttcggcggtggtggggctcttctactccgtgctggatgcgttcctgccgccagacgggcgcagccgctgggagttccaggccgcggtggggatgctctacggcatcttcgtgtggctggtgaacttccagttcatcgggcgtggctcgtatccgtggttcctggacgtgccgcagttcccccagattgtggtgcacgccttcttcctgggactgccgctggcgtcgctgttcaccgccgcggagcgtcgccggctgctgctggatgcggcggagagcacccccgctcgctga

SEQ ID NO: 2836 - DNA, 324 bp, Myxococcus xanthus
atggggctgacgcaggcggatgtcgccgagcgcattggcatggcgtcggaggtatacgggcggttggagcgcggccacatgctgcccagcgtccagaacctgcgccggctgtgcatggtgctgaatgtgcctcctcacgaactgctgggcctgggcgagggcttcaccgccccgccgccggtgaaggagaaggccgccgcgaagaatcgcgaggaggacacgccggagatgcggcggctgatgcgcaacctgcgcaagctgacggcggtgcagttgaagctgatgaacctgatcgcctcggcgatgcagcacaagaagaagtag

SEQ ID NO: 2837 - DNA, 1026 bp, Myxococcus xanthus
atgcgggtgacgacggtaccgacggtggcgactccgggcgaagacgcgcagcacacgccgggagtccaggtggacgtttacgtgaaaccgggcgacgcgaagcgcgccctccgggaagaggcgctccagggcctgtgcggcacgcccaaggagctgtctcccaagtggctctacgacgagcgtggcagccagctcttcgacgacatcacccggctgccggagtactacccgacgcggcgcgagcgggaaatcctgctggcccacgccggtgacatcgcccgcttgagcggcgcggacacgctcatcgagctgggcagcggcaccagcgagaagacgcgcctgctcctggacgcgctggaggaggcgggccggctggcgcgcttcgtccccttcgacgtgagcgaggccttcctgcggcgcgcggcgtcgggcctggcgcgcgagtacccgggcatcaccgtgcacgcggtggtgggcgacttcgagcgccacctgggccagctccccaacggcggccggcggctggtggcctttctgggcggcaccatcggcaacctgaagccggcgcagcgcgcgctcttcctgaggcagctctccgccgggctgcagccgggagacgggctgctcctgggcaccgacctcatcaaggaccgcgagcggctgtacgccgcctacaacgacagcgcgggcgtgacggccgagttcaaccgcaacgtgctcaaggtgctcaaccgcgagctgggagggaacttcgacccggacgccttcgagcacttcgcgcccttcgacgagaagaacgcctggattgagatgcgcctggtgtcccggcgcgcgcagtcggtgtggttgtccacgctgcgcaagcaggtggacttcgccgaaggggaggtgttgcgcacggaggtgagctgcaagttccaccagcagcaggtggcatccgagctgtcggccgcgggactcacgctggccgagtggtggacggacgccgcgggcgacttcgccctctccctggccttcaagcgctga

SEQ ID NO: 2838 - DNA, 1281 bp, Myxococcus xanthus
aagtcccgtgcctggaccgagctggagacggcgcgcgcgcgcgtgctggcgatgctcggcgggctgcccgaggacgagctgcgccgtcagcattccccgctcatgtcgccgctcatctgggacgtggcgcacgtggccaactacgaggagcagtggctgctccgggcgctgggggcgccggccatcaccgacccggcgttcgacgccatctatgacgccttccggcacccgcgctccacgcgcgccgagctgccgctgctgccacccgaggccgccttcgcctacgcgcggcgcgtgcgtgaggcggtgcgcgagcacctgcaccggctccccgaggacagcaccgcgccgctgctggcgggcggctacgtcttcggcatggtggcgcagcacgaacagcagcacgcggagacgctggccgccacgctgcagctcatgacgtcgccggagtaccacgtgccctcggcgcgcccgcggccccggcccggcgccgtgccgcaggcggaggtcttcatccccggcggcgaggcgcggctgggcagcacgtcaccgtgggcctacgacaacgagcggcccacgttctcccagcacgtcgctccgttcctgatggacgcgcaccccgtcaccaacggcgactacctcgtcttcgtggaggcgggtggctacgaggacccgcgctggtggcaccccaagggctgggaggtcatccaggcagaagggctcaagtacccgggcttctggcttccccagggcaaccacacctggctgcggcggcgcttcggccaggtggagccgctgcccaaggacgagccggtgcagcacgtgtgctggtacgaggcggacgcctacgcacgctgggccggcaagcggctgcccaccgaggccgagtgggagaaggccgcgcgcggcagtgacggccgcccccgcgagtacccctggggcgacacgccgcccacccgggcccgcgccaacctggacggaagcacgtggggcccggcgccggtgggcagctacccacaaggcgtcagccaggacggcgtctggggactgctgggcgacgtgtgggaatggaccgcgagcgacttccgcccgtacgcgggcttcagcgccttcccgtaccccgagtactccgaggtgttcttcggcgagtcctacaaggttctccgaggaggcgcgtgggccagcgcaccggtcgcaatgcgcaacggcttccgcaattgggacttccccaaccgccggcagattttcgccggcttccgctgtgcacggaacgcgaggtga

SEQ ID NO: 2839 - DNA, 201 bp, Myxococcus xanthus
atgacggcggagaccttccatgcactccagcaggtgctggagcgcctgggcgacccggccctgcgcgagccccaagcggccaacggcctggtggcgcggcatgtcgtgccgcagcacgggctggagctggagtacgcgtgggacgaacgctcacgcacgctcaccctgctcggcctcgcccgcgtccccaacgagccctga

SEQ ID NO: 2840 - DNA, 1149 bp, Myxococcus xanthus
atgtgggccgcgttggtcgtcgaggcactcttcgtgctgctcaccgtggcccccctgctttggctccacttgaaggggttgctgagccgcaatgccttggttctgctcgcggtactcctgctgctgagtcccagcatggtggaggccatgaagttccccgtccacccgacgacgtggtccgtactgccctgggtgctgacgggattggccttccatctgcgccgccaaggattgctcctggcgtcgctggtcctcctgtttgcctgcaaggaggagttcgctttcggaggcgtcatgctgaccctcgcgctgttcctgcgtggggagcgacgcctcgcgacattcgtgggggcgctgtcgctcgcctggctcacatgggtctatgggctgcgcccttggctcctgggccccaccgtggactacaccttccgcctcagacaggggatggagggaggctggttccactatctctcgctccgtctggctccgcctcatgtgtcgcgcatcggcaccctgacgctgctgttcgtcccactgggggtctgggcatggcgtgaacggctgcggcccgactggacctggctgctggtcctgctcccgatgctgggcatccgcttcctcgccatggcctggcggtttcactatggcgtatcggttgtcgccgcggcgctcatgggcttcctgcctgtcctccgcacccggagcccgccctggtgggtcatcgcctccaccagcgtggtgctcctcgccagcaacgagccgaacctgcggaagctcacgagcacgcttgtctctccccagacctccccgcgtcattgtcccaggacaccggagcgactggcgagcctctctcggggcgtggacatgctcacccagcacagcgagggctcggcgctgctgagcagcaaccttgtcaccttgctggcgcaccgcagcgagatttacgccgtgggcggcccacagccggacgaggggcgcgtccatgagtgggtgctcgtcgagaagcctccgcatggtgacgtctggcccctcacctccacgcgagtgcgggaactcatcgacgtctggcgcacagatgcaagcacgcaagtcattatcgatgacgagaacgttttcatggcgcgagggcgctttactgcgcaccgctga

SEQ ID NO: 2841 - DNA, 2643 bp, Myxococcus xanthus
atgttcggcctcgcgaacgcgcgcaccaccggctacgacctggacgcgctcacgtacaacgggcgcaccaaccgggagaacctggagttcatcgccgggcggctcgtctccgaacaacgcgcggacggctcgtggttccacgagggcatcttctatcccaacgcgaagacgagctactccgccttcgggctcgcgggctacgacgcacacctgggcacgcggtactcggacgcgttggtgctcgccgcggactgggcgctgacgcggcaggaggccaccggccgctggcgcgaggacttccccttctacccggtgggctacggccacgtcggcgtcaccgcgcggatgatgacggccattgcccaggcccggcagcgcgtggacccggccaaggcctcgcagtaccaggccgcgctggaccgagcggccgactacgtgcgcgcgcacatgaatgactggacggacggcccggccaccgacggccagcgctacacgcaccaggtggcgtgggccatggtgggactcaaggccgccggccccggcgccaacgcggtgaacacccaggccctggacaccatggccacgcggcttctgtccacgcgcgcgggcggaggcgcaccgggctggggctcgctggaaggcgacgtgccggacgagttcgccaccggcatctccctgtacgcgctgtgcctcgcgggccggaagcccggcgcggacgggcgcatgtcagaagcgctggagtggctcaaggcgcggcaggcggtgaacgggagctggggcgcggacacgcgctatccggacatccccaccaccttcgcctcgctggggctggcgtgcttcggcgactacagcgtgggcgtcactgtgagcggcgggtcgcgccggcccttcgagcatgatttgccacgcatccagtccgtcacctaccccgtcacggtgcgcaaccacggctaccggacggacagctaccggctgagcacccagggcgggctcaccggttggacggcgacgctgagccgcaccacgctggagctggcaccggacaccgaggccaccctcacgctcaccatcaccgcgccggaggggctggagccgtcgctcacctcggacgtcatggtggtggcggcctcccaggaagcggagggagtgaagggctcggtgcgcgtcaccacctacaccaacccgccgccgcccaccgacggcgtgcccaccaccaccacgctgctttcgcccgtggacggacagctcacggtggcgctgaacaacaccctgtccgcgcgcgtggtggatgaccgcggctgggaggcacgaggccccggcatgggcgtggtgacgttctccgtggcgggtgtcacggtgggcgcggacaacgacgcggacggggacggcgtctactccttcgtgtggcgtccgcgcgcctccacctggagcgaggtgggcgtccgggacctgcgcgcggtgtattcaggcgtgacgctggcgcccgcgcgggagaaccggctgggcagctccgcgtcgttcgcggtggaggtgcacccgtcccccttccccgcgccgtcggtgacgctgtgcggactgccgggcttcacggacgcgctgacgctggaggtgtgcggcttcgtcactccgctggcggcgggcgcggaaatcgactcagccaccttcgtcatccagggcgtcagccacccggtggcccccgaccccagcggcggctacgtggacacggtgctgccgctgatggacgggcccaacgtcatccggctggtggccaccgactcgttcggcggcatcgccagcgaggaagccgtggtcatggtggacaacaccgcgccggagctcaccttcctctcaccggccaacggcgcggccctgcgttcctacagcgtggatgtgcggatggtggtgcgtgactggtcgccggtgcgcgtggagaccaactgggtgcaggtgacggacgtgcccgcgggcggcggggacgtgacgcaccgggtggacctgtggccgggggagaacctcatcctggtccgagccacggattcggtaggccacgtcacggagcagatgctgacggtgtgggtggacgcggaggcaccgtgggtgtccacgggcctgccggatgggtggctcgtcgggccgcagccggggaacgcgatgccctacgacatcggcgtgtactccgcgtccgccaccacggtgacgctgtccacggggcggacgtacacgctgccccggggtggcggcggcgtgcaggcgacgctggacctggtgcccggggacaacgcgttcaccatcgacgtgacgagcgagacgggcatgcgcgccacgctgtcgcgcacggtgcgctacgacgacgccgcgccggtggcctcactgctgctgccggtgccggggcagacgtacagcggcgtgattcacatcaccgcgcgggtgacggacgcggtgagcggcgtgcggtgggtggccttcacgcgggatggctccggcatccgggccgccacgctccagccggacggcacctggtcggcggagctggacacgcgcgagctggtggacggcgagcacaccgtggaggtgtggatggatgacccggcggggaacttcgccatccagacgttccccttcgtcacgcggaaccagccgtag

SEQ ID NO: 2842 - DNA, 1689 bp, Myxococcus xanthus
atggggcgcctcaccggcccggagcagcgcttctggctgctcgtcgtcgcggtggggctcatcgcggggttgggcgcggtggcgctactcaaggtgctgcgcttcacccagcagctcttctggcgcagcgcgggcgaggacttcctggccggcgtcgcggcggcccccacgtggcgccgggtgctcatcccgattctcggcggcgcgctggtgacgctgctgacgctcatcgtcggccggcccatgcggggccacggcaccgcgggcatcatcgaatccatctgggtgaagtccggccgcctgtcgctgccgcgcgcgctgctgcgggggctggtctccatcctcgccgtggcgatgggcgcgccgctgggccgcgagggcgcgctgctgtccaccggcgcggccagtggttcgtcgctggcccgctggctgcggctgggccccggccaggcccgcctgctggtggcctgcggcgcgtccgcgggcatggcctccgcgtacaacgtccccattggcgcggccctcttcggcctggaggtgctgctgggcagcttcgcgctggagctgttcggccccatcgtcgtctcgtgcgtggtggcgacgctcgtgtcacgcggcctcatcgcggaccaccccagtttcgtgattccccactacacgctgctgcacccgcgcgagctagtgctggccatgctgctgggcgtggtgctgggcgtcgcgtccgccttctacgtgcgcggcatcaacgtcatgtcggacctgttggacagggccgccgcgtggctggcgcccttcctacccctgatgtccatgacggtggtgggcgtgacggcagtgtggctgccgcagcttctgggcaacggctatgacgcggtgaacggggcgctgctcggcaagctctccctggcccacctgctgctgcttccgctggcgaagctggccctcaccgccacctgcgccggcgccggcgtgcccggcggactcttcaccccatccctcttctacggcggactgctgggcggcgcctttggcatgctcgccgaatgggtgctgcccggcggcgcgcccagcggcgcctacgcgctgctgggcatgggcgcggtgctggcgggcaccacgcacgcgtcggtgtccgcggtgctcctcatcttcgagctcaccggcgactacccgctggtgctgccgctgatgctcagcgcggtggtgtccgcggtcgtcagccagcgcctggagccggagtcgctgtacacctccgtgctcaaccgccgcaacgtgcgcgtccccgccaccgtgccgcactggctgcgccaggaaggcgcccgcgcgctgctcaagcccgtgcaccagcgcgtacctccgtcagcgccgctccagcaggtgctcgcgttcctactggagcagcccctgggccaggacctctacgtcactgatgaggcgggccggtaccggggcgcgctggtgctcgaccagttgaaggggcatctgccggaccactcacagctgcacgccaccatcgccgcggacgtgatggacatgcgcgtgcgcccgattaccccgggactgtccctgagcgaggtcgccgtccgcttcacggagacctccctggagcggctccccgtcgtggacggagagcggcgcctgctgggcacaatctccaagcaggacgtgttgaagcaggggaccttctga

SEQ ID NO: 2843 - DNA, 2277 bp, Myxococcus xanthus
atggcccaggcgaagcagcgcgtggaccccgcgcgcgccgccacgtaccaggccgcgctggaccgcgccgccgcgtacctgcgcgccaacctcaacaacaacgacaccagcgcgcccggcaacggcatgccctacaccttccaggtggcctggacggtgctgggcctcaaggccgcgggccccggcctcaacgacgtcaacaccggcgccatcaacaccctggccgagcggctcatcacccgcacgtcccccggcaacgcgggctggggcaacctgcccaacgaggagtccaacgacttcgccaccggcagcgccatctacgcgctgtgcctcgcgggccgtgagcccgccaccgacccgcgcctgcgcaacgcgattgagtggatgaagacgcggcagtcgccggacggcagctggcgcaccggctcggccaccttcgacatccccaccaccttcgcggccctgggcctgtcgtgcttcggtgacttcagcgtgcgcgtctccgtcgtcggcgcggagcggcaggaactgagcatcgacaacccgtcgccgcagcaggccatgttcaccttcaccgtgaagaaccacggctatcaggcggacacgtacacgctgagcacccagggcggcctgcccgggtggaccgcgtccgtgagccccgtcaccctcttcctgcccgcgggtggcgaaggcaccgtcaccgtcaccgtcaatgcgccgccccggctgctgcccgcgctcacctccgcggtgacgctcatcgcttcgtccggcggcgcgcccggcgtcactggctccgcgcgcgtggcggcatacaccccgcccctgccgcccgtgacgggcctgcccaccgtcaccaccatcgtgacgcccgcggccaacgcccgcgtcaccgttggcaacggcaccctgctgtcggcgcgcgtgacgaacgggggcgccatcgtcccgggcccggcccatggcgtcgtcaccttctacgtcgcgggcgtgcccgtgggcgcggacgtggacgcggatggcgacggcatctacgccttcaactgggtgcccgcggtggacagttggaccatcaccggagcgcaggactaccgcgcggtgtactccggcgtggagcggcaggccccgctggccaacctgctgggcagcacggcgtcgagcaccctcatcatcgacccgttcccccacctgacgcccatggtcaccatcggcaacccgccggccttcacgcgggagacggcgctggacatctggggctacgccacgccgcgcgcgccgggcgccgtcatcacctacgccgcgttcatcatcaacggcggcgcgcccatcgtcctcacgccgggcaacggcggcctcatccacacctccatcaccctggaagaaggccccaacatcatccagatgaccgcgcgagacagcttcggcggcgtcaccaccaagcaggtcaacctcacggtggaccgggtggcccccatcctcaccatcctgtcgcccgcggagaacgccgcggtgaacacgccggtggtgacggtgcgctcgtccgtgcaggaccagacgcccgtgcgcgtggagacgcagtgggtgaacagctcgctcctggagttcggcaacggcaccgtggagcacccggtgaacgtcagctacggcaaccaggtcatcctggtgcgcgccaccgacagcgccggcaacgtcaccgagaagctgctgtacctgtgggtggacgcgggcacgcccgtggtgagcaccaacttcgcggacggccaaatctacggcccgctgcccaacggcaccttccagtacgccatcaacgtgcagacggtctccgccaccacggtgcgcgtcaacggaggggagcccttccacctgcctcgcggcggcggccagattcagacgtcggtgacgctggccccgggcgtcaacacgctgggcatctccgtcatcagcgagacgggcatgacggccaacctcgtgcgccgggtgaactacgacgtgcaggcccccacggccacgctgctcagccccaccgcgggcagcaccgtcagcggcaccatcaccgtgcgcgcacgcgtcaccgacaacttcggcccggtgacgaacgtgggcttcagccgcgacatgtccggcatccgcgtgggcacccagcagtcggatgggacgtggacggcgcagttcgacacgcgggagatggtgaacggcgcgcacaccatcgacctgtggatgaacgacggcgtgggcaacttcgccgtgcagagcttcaacatcgtcgtcagcaactga

SEQ ID NO: 2844 - DNA, 969 bp, Myxococcus xanthus
atgcccaccctcatcctcagcgcgaaggacctccgcagcctgtacaccgtcgagctcggcctcaccgccgtcgagcgggccttccgtgcccacggcctcggcgagtcgctgatgccgcccaaggtgtacctgtccctgccctcctacgacggcgacttccgcgccatgcccgcgttcctcgacggcgccgctggcgtgaagtgggtcaacgcccatccgcgcaacccggagaagcacggcctgcccaccgtccgcgcgctctacatcctcagcgacccggacaccgcctccccgctggccatcctcgacggcaccctgctcaccgcctggcgcaccggcgccgcgggcggcgtggcctccaagttcctcgcgaagaagcagccgcgcaccctgggcctcgtcggctgcggcgtgcaggcccgcgtgctcatcgactcgcaccgcgccctcttcggcgacaacctggagctcctgctcgccgacacctccgaggccgccgccaaggcgctccaggccgagaagggcggccgcatcgtcagcacccaggaagcctgcggcgccgacatcgtctgcaccgccacccccgctcgcatccccgtggtgaagcgcgagtggttccagcccggagtccacatcaacgccatgggcgcggacgcccccggcaagcaggagctggatgcgcgcctgctcaccgaaggccgcgtcttcatcgacgacaccgagcaggccctccactccggcgaggtcaacgtgccgcggcatgacggcctcctccgccccgagcaaatcgccgggaccctgggtgaagtcgtctccggcaagaagcccggccgcacccgcgcgaccgaaatcaccgttttcgactccaccggcctcgcgctccaggacgtggccctcgctcgcgccctctacgacgccgctctggcgcgagggctcggacagtccttcgacatcatcggaaacggatga

SEQ ID NO: 2845 - DNA, 267 bp, Myxococcus xanthus
atgctgcgcacctacttcgcgccgtggctggggacgcttccggaggcggagcaggaacgcatccgccaggaagccctgcgccgcatggggccggacgaagacgccttcgacgcgttccgctggtacctggggctgcgcacccggcatgacgcggaccaccgcgccgccgtgctgatgttgcgtggcaaacgcctgggctgctggtgcaagcccggcccctgccacgcggacatcctggcggagtgggtggatgcgcagccggattag

SEQ ID NO: 2846 - DNA, 279 bp, Myxococcus xanthus
atgaaggcatggatgacggtggtgtcgctggcggtggttcccctcgccgtgggttgcacgtcgtcgcgcgaactgacgcgggcgcgcgtggaggcgaacacgctgcgcaaggacgcggacacgctgcgcggggagaacgcgacgttgaaggagcgcgtcagcgagctggaagggcagctcgcgaaggtgcaggaggagcgcgacacgctgaaggccgccgcggagaagcccccggagcccgtcgtcgcacccgccgcgggcaagaagcgcaagaagtag

SEQ ID NO: 2847 - DNA, 666 bp, Myxococcus xanthus
atcagcatcgtgttcattgagctgttcacccggctcttcgacgtcctggtgctgctgagcaggccccggctgcttccgccctacctgggcctgtggctgcgcgaggtgcgcgtctcgccctaccgcctgaagcgctcgttcgaaacgacgcgagtcctccagacgagcgggcagattttcaaggaactgatgtacggcgagatgccagtgcacacaggggtgtggctcttctggaaggccgggctgggccgtggctcgcggctggtggacctgggcgcggggcggggccgcacgctgctggccgcgcgctggctgggcgcggaggctcgcggcgtggagttgatgcagcaccacgtggacctggcccgaaagtccgtggagaaggcaggcgcgcagctcatcgtgggcgacgcgacccgcgcggacctccaggatgccacgcatgtcttcaccaactggacggcgctgacgccgcggacgcgggcccggctggtggagcgcttccgcacctgccgccccggcacgcgcgtcatcaccgtgactcggccggtggaggccccgggcttcaccgtcctctccaagcatcggctgctcttcacctggggcctggagcacgtctggattcacgaggtccgcgacagtgtcgttggagatacaaccaattga

SEQ ID NO: 2848 - DNA, 1710 bp, Myxococcus xanthus
atgtcctcctttcgcatgacgtccaagctgcttggcgcgctgctgttgtccgcgagcacgcttcacgcggcaccctcctgggccgccgcgcccgcctccacgcccgtcgccgtgcccaacgggaacttcgagattgcgggcggctccggctcgctccccgccttctggaagtcccgagggcaggggaaggcatccggcagcgccgcggcgaaggtggagggcactcgcggcctggccatcgagaacccggtgggcggcgccgagacaacggtggaatccgaggcgatgaagctccaggtgggccagctctatcggctcagcgcctgggtgcgcacgcgaggcgtccagacggacccgcaggcgcgctaccccacggcgcatggcgcctgcctgtcgatgaagagcttccccttcaccaactgctcacccgcgcccgcagcggaagcgggaggccgcgcgtcggtgctcttcttcgccacccagtcctcggaccgggtgcagctccacctgggccgcaacggcaaggccacgggcaccgcctggttcgacgacgtccgcatcgagaaggtggacgacatcaccgcctacattccgctggagtcggtgcgctgggccggcaagggcttccgctatgacgagggcgggtggatctacgtccacatcgagggcgagccctacgagcggggccaccagttcggccagctggtgccgcaggaaatcgtccgctacatggagaagctcggcatcgagaaggacaggacggacgcctccaaggggtggaaccaccagcggctgctcgcggacgcgctcttcctgcgcaagtacgacgcggagttcctggaggagatgaagggcatcgcggacggcgccaacaaggcgggcgcgaagttcaaggaccgcgagctggacctgctggacatcgtcacgctcaactccgccgtggacgcggggcagctcgccgaggcgaaccgggccacgggcacgccgctcaccggccgcaccttcctcaaggcggaagaggacgcggagcgggcggggaagggggaccactgctcctccttcgtggccaccaaatccgccaccccggatggccgcgccatcatgggacagattttcatgtggggcggctacacgggcgtgcactgggacgtggtgctggacgtgaagcccaccaagggccaccgcttcgtgatgcagaccttcccgggtggcattcacagcggctcggactggtacgtcaatgccgccggcattgtcattggcgagacgacggtggggcagtcgccgttcgacatgaatggcccgccccagagcaaccgcatccgcaagggccgcgcagtacgcgtcgtccatcgacgacgtcgcccgcatcatgaaggacggcaacaacgggcctctacaccaacgactggacgttggcggacacgaagacggatgagggcgcgtgcctgctgctggggacgaagaagacgcgcctgtggcgcaccggcggcaaggggcaggccggggacaccccgggcaatctcaaggacttcatctgggccaacaacaacaaccgggatttggaggtgcgcaaggagtacgtgcccaacccggacaacgctccggtggacctgtccttcaacacctggaaccgcgacatcgccttctgggagtactacgcaaagtacggcaagaagggcttcgacctggacaccgccatccggatga

SEQ ID NO: 2849 - DNA, 1545 bp, Myxococcus xanthus
atggcccagaagctgatgttcctggcccactacggcaagacgacgctgcgcgagaagatggtgggcggccggtggattcccgacctgcctggcgccacgccgcacctgtcgttgggctacacggccttcagccccgtcttcgtcgcggagaagctgggggccgcgcgcaaggggtggacgcctcccacggagccggccgcgctgaagcgcgacgtgtcgaaggtgaaggacgcgctcgtcttcggcaggcccctgctgtgggccaacaccatgttcccggcgacggacggagagaactggctggtcagcggcaccgccgcgtattggaagctgctcaaggacctgccggcggacggagactcgtccgacaaggccttcgagtaccagcgcaacgccctggccgacctcaacgcgcgctacctcttcaccacctcgcgcgaggcggacgtggtgccagcctccgcgaagacggactacggccgctacggcgcctacatgctgccgcgcatcaagggcaccttcctgctgcaccagctccggttgctgctgggcaacgcccacttctccaaggcgatgaacgccctgcatggccgctacgccaacaagaacgtcaccaccgcggacttcaagcgcgcggtgctggaggccaccggcagggacgtgggcctcttcgtgtcgcagtgggtggagcagaccggactgccgcagccgcgcatccgcaccagcgccgcgcaggtgaaggacggctacgaggtgacgctgaaggtggagcagcccggctcgcgcccctggcacttcgttgcgatggtggaggtgcgcaccgcgaagggcgccacgctggagcgcgtggaggtgaagggcctcaacgagacgttcaccttccgcacggcggagccacccgtccgcgtggtgttcaacgccggcaatgacatcccggtgccgcgggagcagcaccagacgctgtcgaaccagctcgacgcctgggagaagctgctcctggtgcacggcacggcgcgccagacggagtccatgcgcacgctggcgctgggctaccgggaggtgctggccgacgcgttcgtggagtacctgatgcccatcaagccggacgccgaggtgacggacgcggagctggcggaccgggacctggtgctcttcggcggcgcggaggacaacgcgctgctggcgcggctggcgaccgagaagaagctccccgtggagctggggcggcgctacttccgctggcagggcaagacgtacggccgcccggatgatggcctggccgtcgcgctgccgaatccgtggaacccgaagcggtcgatgtacctgttcgtgtccaacagtggacttcagctctggcacatgacgcgcgcctaccagcgcggcctgccgggctgggccctgtaccggggcgccgaggtgagcgccaagggcttccacgacgtggacgcgctggcccaggacgtcgcggtgacgcccgccgccccgcccgccgcgccagcgcccacgcctgtaccggcgccggtgctgggccagccgcagcgctag

SEQ ID NO: 2850 - DNA, 1944 bp, Myxococcus xanthus
ggcgtggagctgaagcacctggaccgcgatgtccggccgcaggacgacttctacgccttcgtcaacggcaactggctgaagacgacgtccatccccgcggaccgcgcgcgctacggcaccttcatcgagctggcggacaaggccgagctggccatgcgcgccatcatcgaggagtccgccgcggcgaaggagcgccaccccggctccaccgcgcagaaggtgggtgacctctacaacagcttcatggacacccagcacatcgagtcgctgggcctgaagccggtgagcgacgaactggagcgcgtgaaggccgtgaagcgctcggacgcgctgccggagctgttcgcgacgctgctgcgcgaaggcgtgccggtgccgttcggcatcttcgtgggccaggaccagaagcaggccacgcggtacaccgtctacgccacgcagttgggcctgggccttccggaccgggactactacaccaagcaggagccgcgcttcgtcgaggtccgcgccgcgtacgtggcctacatcgagaagctgctcacgctggccggtgagaagaacgcgaagaaggccgcccaggacgtgatggcgttcgagacggcgctggccgcgaagcagtgggaccgggcacgcaaccgcgaccgcgagaagacgtacaaccccaagacggtcgcggagctggacgcgctgaccccgggcttctcctggggccgcttcctcaaggcgtccggtgcggaggccacgccctccgtcatcgtccgtcagccggactacctggagtccctgggcgggttgctgaagtccacgccgctgccggtcatcaagcagtacctggcgctgaaggtgctggacacccgcgcgccgctgctcagcagcgccttcgagcaggcgcacttcgagttccgcggcaagacgctccagggcttggaggagaaccgcccgcgttggaagcgcggcgtggcccaggtgaacgaggtcgtcggcgaggccgtgggccagctctacgtggagcgccacttcagccccgactccaagaagcgcatgcaggagctggtggccaacctgcgtgaggccttccgcaagggcatcgacggactggactggatgagccccgccaccaaggcgcaggcccaggccaagctggagaagttcggcgtgaagattggctacccggacaagtggcgggattactcgtcgttggacatcgtcgccggtgatctggtgggcaacgtccgccggggcgagctgttcgatcaccagcgcgcggtgggcaagctgggcaagcccatcgaccgcgaggagtggggcatgacgccgcagacggtgaatgcctactacagctccacgatgaacgagattgtcttcccggccgccatcctccagccgccgttcttcaatccggaggcggacgacgcgacgaactacggcgccatcggcggcgtcatcggccacgagttcagccacggcttcgacgaccagggcagccgctccgacggcgacggcaacctgcgtgactggtggacgcccgaggacaagtcgggcttcgagcagcgcaccaacatgctggtgaatcagtacaacggcttcagcccgctggatgccatgaacgtcaacggcaagctcacgctgggcgagaacatcggcgacctgagcggcctcaccgtggcgtaccaggcctacaagctgtccacccagggcaagatgccgcccgtcatcgacggcttctccggcgaccagcgcttcttcctgggctgggggcagatctggcgtggcgtgtaccgggacgatgccatgcggcagatgctgctgaccgacccccactcgccgccgcagtaccgcgtcaacggcgtggtgcggaacatgccggagttctacgaggccttcggcgtgaagcagggggacgccaactggctgccgcccgagcagcgcgtcaagatctggtag

SEQ ID NO: 2851 - DNA, 303 bp, Myxococcus xanthus
atgtatgacgccaagacccaattgctcatcaacaaccccatcaagcggtatctggtgaacagcgcgatgctggagatgggcgagttcaagactggggaagacggctccctcaccttctacctccagaaggcttgcccccggaaggaggacggggagaagaagaactggctgccagcccctgctgccccgttctacgcggtcatgcgactctacgtcccggagcctcgcgcatacgaaggcgcagacaggtggattccccctccgatgaagcgcgcgggctcagtgtcggaggagagcacctga

SEQ ID NO: 2852 - DNA, 1311 bp, Myxococcus xanthus
atggccctgctcgccacctccgcgcgtgcggcggagccgtccgccgtggagcagcgggcgcgcgaggacctggaccgtcagctccaggagatggtgaagacgccgccgccggagatcgtcatctccttcgagggccttcccggagcgggcacgtcgcgcggctacaagctggtggaggcggacttcctcgtcaacggccagcccctggccatccccggcctggacaagctcaacggccctgggctgcaccggctcgcggtgctcacggtggaggagggctcctacacgctcgtctcgcacgtcacctacgccaacgaatcctggaacctcttcagcgaggagagcggcttcctctggaagctgacggcgtcggtgacggtgcaggtgcagcgtggcctgcgggcgcgggtgcgggtgctgcccgccatcaaccccaccgcgccggacccccggctgaagctgaagctgtcccatgacgtgaaggcggagatgacggccgccatggcggacgtggccattcccgacgtgccggatgcgggtgcgcccgtggccgcggtggcgcaggctcccgcgaagccgaccccgccccccgtgacggcccccatctcgccgacgccgcccgttgccacgcccgtgaagacggtggaggcgccagagcaagggccggtggctcccgcgaagctgctgctgaaggtgctcgcggggaagcggcccgccgcggccaccgtgtacgtgaagtccgccaccggggcgccgcagcgggtgatggtggaccgcaaggcgcgcaagccggtggaggtcatgttgccgcccggggagtaccggctggacgtcctgtcccagggctacctggcgcagacgcgaaaggtgacgctctcccgggaggcggtgcccacggtgtccttcaccctggcgaaggcgccggtgtcgaagtcccagaaggtccgcctgaagaaggaggtcgtggagctgccgcgcatgccgcgcttcgcggagaagcaggccgcgccacgcaacggaacgaccgcgggactggccctgctgatggacatgttcgtgcgggacgagaagctccggctccgcattgaaggccacaccgacaaccgcgaacgccccgcggcggccgcccgcaagacgctgtccgaagcccgcgccgcagccgtggccaaggccctggtcgacgcgggactggacgcgtcgcgcatcgaaaccgtgggcctgggcgacacgcggcccaaggcgccgaacctgctgcctcgcgggcgcgagctgaaccgccgcgtggagttcgtgctggtgcgcaaggagtag

SEQ ID NO: 2853 - DNA, 240 bp, Myxococcus xanthus
atgtggggccgtgcctccgcggccgaagcccggaacgacctgcgcgccgagcacgccgcgctgcggacccggaaggccatcgcccgcgagctcgacgaaatcgagggactgcggcagcccggggccttgaactacaagcgcacgctcatcctggagctcatccaggtggcggagcgggaactgaaccagacccggcgggaagtccgtgacgaccggcgtacccccggccggcgccattga

SEQ ID NO: 2854 - DNA, 582 bp, Myxococcus xanthus
atgacggagcaagaggcctatgtgaagcagatggatgcggagaagcggaggctcgacgcccggattgccgaaacggaggcgcaggcagacgtccgccaggcgagcgatgagctcaaggacatgtccggcattcgccgcgtcttcgacacgtttcgcatcaagctggatgagctgagcaagcggcagacgcagaacttcgagcagggcaaggccgaactccggaagtcctacgacgacaccaatcaggccgtcatcgagatggatgccaagatggcgcttgtccgtgccggctacgagcgcaagcgtgaggcggagcttcgagcgcttggcgcgcaggtagatggttgggaggcgtccgtcgcgcagtcccgggccgaggactcacggctcacgcggcaggaactccagttcatccggcgctcactccaggacacggagtccgcgctgcgccgattgatgagcagccatggtgagaactggtcgaagctgaagaaggacttcgaggactcgtggcgagagctgcgggagcgctccgacaagattcggaggggcgcggacgtgcagccgtcctctcatgcctga

SEQ ID NO: 2855 - DNA, 694 bp, Myxococcus xanthus
atgacgaaggtcgcgacccgaaagaccgctggtgtgcttggggatgacctcgccctcaatgcccagcaggtctccggcgtcagcgccgaccgcgaactgcccgtcgtctgggccgtcgccaagggctcgatggtcaacaaggcgattctggtgcccgcggcgctggccatcagcgcgctggcgccctgggccatcatcccgctgctgatgctgggtggcgccttcctgtgcttcgagggcttcgagaaggtggcccagaagttcctgcacggcaaggaggagcaggcggcgcagaagcaggagcgcgtcaatgcagtggcggacccgtcggtggacctggtcgccatggagaaggacaagataaagggcgcgatccgcaccgacttcatcttgtccgccgaaatcgtcgtcatttcgctcggaacgctcaccgccgcgtccttcgggatgcaggttgccgtgctgacgggcatcgcactcctcatgacggtgggcgtgtacggcctggtcgcgggcatcgtgaagctcgacgacgcgggcctctacctgatgaaggcggagggcggggtcaagcggagcctgggccggggcatcctggccaccgcgccatatctgatgaaggggctcggcatcgtgggcacggccgccatgttcatggtgggcggcggcatcctcacgcacggcataggtagag

SEQ ID NO: 2856 - DNA, 1638 bp, Myxococcus xanthus
atgaccgacttccagttccaggacatgctgccgctgggcaaggacgagacgccgtaccggctgctctccaaggaccacgtctccaccttcgaagccggcggccgcaccttcctccaggtcgcgcccgaggcgctcaccctgctcacccgcgaggccatgcgcgacatcgcgcacctgctgcgccccgggcacctgaagcagctctcccacatcctcgaggaccccgaggcgtcatccaacgaccgcttcgtggcgctggagctgctgaagaacgccaacatcgccgccggcggcgtgctgccctcctgccaggacacgggcaccgccatcgtcatgggcaagaagggccagtacgtcatcaccggtggcaatgacgaggaggccatctcccgcggcgtgttcgagacgtaccagacgtcgaacctgcgctactcgcagatggcgccgctggacatgtacaaggaggtcaacaccggcaacaacctgcccgcgcagatcgagctctacgcgacggacggtgacgcctacaagttcctcttcatggcgaagggcggcggctccgccaacaagagctacctgttccaggagacgaaggcgctgctcaacccgcagagcctgctgaacttcgtggacgcgaagatccgctcgctgggcaccgcggcctgtccgccgtaccacctggccatcgtcattggcggcacctccgccgaatacgcgctgaagacggccaagtacgcctccgcccgctacctggattcgctccccaccgagggcaacaagctgggtcgcggcttccgcgacgtggcgctggagcaggagatcctcaagctcacgcagcgcaccggcattggcgcgcagttcggcggcaagtacttctgccacgacgtgcgcgtcatccgcctgccccgccacggcgcgtcctgcccggtggccatcgcggtgtcgtgctcggcggaccggcagatcctggggaaaatcacccaggacggcatcttcctggagcagttggaggccgacccggcgaagtacctgccggagacgacggacggggagctgggcggcgaggtggtgaagatcgacctcaaccgccccatgagcgagattcgcgcggagctgtcgcgctaccccatcaagacgcgcctgtcgctcagcggccccctggtggtggcgcgcgacatcgcccacgcgaagatcaaggaggtgctggacgccggcaacggcatgccccagtacctcaaggactacatggtctactacgcgggcccggcgaagacgccggaaggctatgcctcgggctccttcggcccgacgacggccggccgcatggacgcgtacgtggaccagttccaggccgcgggcggcagcttcgtgatgctggccaagggcaaccgctcccccgccgtcaccgaggcctgcaagaagcacggtggcttctatctgggctccatcggcggcccggcggcgcggctggccaaggactgcatcaccaaggtggaggtgctcgagtacgccgagctgggcatggaggccgtgtggaagattgaagtggtggacttcccggccttcatcgtcgtggacgacaagggcaacgacttcttcgccaacatcaacaagccgtcggcggcgaagaaggcctga

SEQ ID NO: 2857 - DNA, 732 bp, Myxococcus xanthus
atgccgaagctgaaccagatcatcgccgtcgagaagggcgtcaagaaccgctcccagcaagagctgacccaggcccatcacgacctccagaagccgcagttgctcagcggcatctcccgcacgtatcagccccgcgacgaggagggtgagcgcttcccccccgaatccacccgcgtgcaggtacgaacgcaagacgtcctcaagaagacgcaagagattctcacccggctcttcgacgtcaccgccaccaaggacctcaccaactgtcacgcgaaggcggacgtgcgcgtggatggcagggtcctgctcaagggtgttcccgccacgtatctgctcttcctggagaagcagttggtggaccttcacaccttcgtgaagaaactgcccacgctggacccgtcggagtcgtgggttcccgacccggcgcagggcctgtgggccaccgagcccgtgcagacggcgaagacgaagaaggttccccgcaaccacgtgaagtccgaggccaccgagaagcacccggcccaggtggaggtctattacgaggacatcgtcgtcggttactggaagacggtgaagttctcgggggcgctccccgccacgcgcatgaatgacctgctggagcgcgtggagaaattgcagcaggccgtcaagttcgcccgcgaagaggcgaacgccgtcgaggtggaggaaatgaaggccggcgaggccctcctcggctacctgttcggctag

SEQ ID NO: 2858 - DNA, 1284 bp, Myxococcus xanthus
atgcgtggggcccacccgcaacccgagccctatcccggcccggccatcccgcgagagaagtccatgcgagcctgcccgtgctgcagggaggtgctgaccgccggcatcctgggcctgggcgtccgccgcctcgcgggaagctgcgaggtttgcggcgacacggtctgccaggtgtgcctgagcacgcaggtcctggaggccggtgacttccggcaacgcccggtggcgcccggccacgagaaccggaaggcccggggccgcgtctgccgcgcctgctggtgggagcacctgacggagcgaggcatcaagcctccgttccccgccccgcctggacaacgcgagcgggccgcccacgcggcgaggtcatcctgccagcacccggacgtcacgcaggccatgggcttctgccctggctgcggcgacgaagtcgaatggagggccgagcacggcaaccccgtctgcgtggcgtgcgaggcaccctcgcacccgctcttcaatcactgctgggcatgtggcgagtccttcgacgaagccaacgcgcccgagcccgtggcccagggctaccggctcgagttcgactgcgacgcggatgactgcaccgggaagctggcgtggctgatgccctactgcccgtggtgcggagaaacgaagcactgggagcccgcgagcggtggcgacctggagtgcaccgagtgcgagcaccgcttggaccgcgcgtgggcccactgcgtgcggtgtggcgaagaagcccccctgccagacgactgcctccggtgcggccaggacctggacgacgctccctccgccgcgcgctgcgagtcgtgccgcaacatcgtgtgtggggactgcttcgacacacgcgtggttccctcggcctccggcgagccccaggagcggctcctgtgcaccacctgcggcgtgggcttcgaccggcccgcgcctcccgccgagccccccgaggaggaggaagaagcggaggccgaggacaccgccgaggacgccgacgacgcggacgacacgccagacgcggagcctgagcctgaaccggagcctcgtaccgaagcgcctcgcgcgcctgaaccggagccggtggcttctgcctgggaggtgctgggaatcacgcccggcactccgctcgcggatgcacggcgagcctacttgtcactggtggcccagtatcatccggacaaggtcgcgcagctcggccccaagctgcaggccctggcgcaggaagaaacgcgcaggctcatcgaagcttgggagtacgttcgcaggaaaacctaa

SEQ ID NO: 2859 - DNA, 675 bp, Myxococcus xanthus
atggcgcccatgggcttcctggtccagcttcgtcctcatgccttcgcgagcgagcggtacgccttcgtcgcggaggtggagggcgaggtggtgggcttcctgtcggtgtcgcccgtgtatgcccgcgaaggctggttcctccaggacctgctccgggacccgaaggcgcccaatggcaccgcggaggcgctggtggacgcggccatgcgcgaggcggccgccaccgggcggtgctacgtgacgctgggactggcgccgctcgcggggccggtgcggccatggctgcgactggcgcgggcgtgcggccggccgctcttcgatttcgaggggctgcgcaccttcaaggggaagttccgccccgacgcctgggtgcccatccatctgtcctatcccgagccgcggggcgggctggcgacggtgtacgacgcgctgcgggccttcgcgcagggcggcctgttgcgcttcggcatcgccacgctgcttcggcgcccgcgcctgctggtgcacgcgctcgccgtgctcctcgttccatggaccgcgctgctggcgctgccctccactgcgcgctggttcccgtccgttcaggtgcagtgggcgtgggtggtgttcgacgtgggcctacggtgggactcttctcgttggtgcggcgttggcgggacgccctggccacggtga

SEQ ID NO: 2860 - DNA, 177 bp, Myxococcus xanthus
atgggcgggctgacggcggcggacgcgtgtctgacgttcgtccaggccgtcgcctacaacgtgccgcttgcccggagcccgctggacggggccctcatcgccctggccgtgctcgcgccagcgacggcgtccgggttgctcttcagctcccgcgacctgcgcctgcctgggcgctag

SEQ ID NO: 2861 - DNA, 204 bp, Myxococcus xanthus
atgcgcccgccgtctggcgttgcactgtcgctcgccgtcctgctgttcgcccaagccgggcaggcccagaccgccgcgaaggaagcggcgcctccgcccgccgacctgccaccgggcgtgtccgcggcgctgtggaagctgtccgtcccagccagcctcgcgcccacgccggagcgggtgctgctgggcgagaagctcttatga

SEQ ID NO: 2862 - DNA, 1380 bp, Myxococcus xanthus
atgagccggagctgggcctccacgctggaggctggcgcggtccccctgccgccactcgatggcgagttgctgatggacacagcgtcgcggaccgcggccacagaggacttcggtcacatcctccaccgcacgccgtgggcggtgctcgttcccggctcggtgaaggacatcgtggccatggtccgcttcgcgcggcgccagggcgtgaagatcgccgccgctcggggcctcggtgagagccacagcaccttcggccagtcccaggtggcggcgggcatcgtcatcgacatgtccacgctgtcgaccgtccacgagattggcgagaacagcgcctgggtggatgcgggcgtccggtggcacgagctgctccaggcctcgcttccccacggcaagagcccgccggtgctgaccgactacatcgagctgagcgtcggtgggacgcagtctgcggggggcatcggcgggcaggcgtttcgctggggcctccaggtggacaacgtcctggaaatggacgtcgtcacgggtcggggtgagctcgtgcggtgctcgcgctggcgtgagcggcccctgttcgacgccgtgcgctcgggcctgggccagttcggcatcatcgtacgagcgagagtgcggctcgtcgaagtgccgccccgcgctcggacgtacaccgcgctgtacaacgacctccaccgcttcatggaggaccagcggcggctcatcgaggacggtcgcttcgactacgtcgagggctccgccgtcgcctccaacgggggtcgggcgtatcagctcgaggtggtgaagtacttcacgccgggctcggagccgaacgatgcgagactgctcgcgggcctgggcttccagccgggaacgctccaggtgagcgacggcagctacttcgacttcgccaaccggctcgcgccgttggtcgaactgctcaagcaactcggcgtctggggcttcccccatccgtggctggacatgttcgtccccgcccggtccgccgagtccttcgtccaggaggtcctctcgcagaccaccgaggccgacatggggcaggggcccatcctcctctaccccttccgctcctcggagctgaccacgcccttcctacgcacccccaacgacagacacgtcttcctcttctcgctgctgcgcaccgccattccaccgacgccggagaacgtcgcatccctcctgcggaagaaccgcgccatcttcgaccggctcacggccatcggcgggaagatgtatcccgtggatgccttgcccttgagccccgccgactggcgccgccacttccaccccggctgggagcggttcgagcacgcgaagcggcgctacgacccggaccacatcctcacgccgggacaaggtatcttctga

SEQ ID NO: 2863 - DNA, 60 bp, Myxococcus xanthus
atggaggcgtacatctacgccaagcgcaagggcgtgaagctggactccgggaagaagtag

SEQ ID NO: 2864 - DNA, 2708 bp, Myxococcus xanthus
atgagaagggcgtacgtggcgtcgttgctgaccgggctgttgacctcctccgtggcgacggccgaggccccaccccaggaccccttcctgtggctcgaggaggtccagggcgagaaggcactcgaatgggttcgcgcgcagaacgcgcggacgctcgcggtgttggagaaggacccgcgcttcgagaccttccacgcccaggcgctggagctgctcacctccaccgaccgcattccctcgcccggcttccgggctggcggtgtggacaacttctggcaggaccgcggcaacccccgaggcatctggcggcacacctcgctggacggctacacgcgcgcccagacaccgtgggagacggtgctggacgtggacgcgctggcgaaggccgagaaggccaactggatttggaagggcagcaactgcctgcctcccgcggaccagcgctgcctcgtctccctgtccaacggaggcaaggacgccgtcgagctgcgcgagttcgacgccgccgcgaagcacttcgtggaaggcggtttccgggtcccggagggcaagctgtccgcgtcctggctggactcggacacgctgctggtggggcgcgactggggcggggacacgctcacggagtcgggctatcccttcgtgctcaaacgttggacgcgtggcacgccgctgacggaggcgcaggaagccttccggggtgagcgcaccgacgtctccgcgtcgcccttcctgttgcggaacgccgacggcgcgttgcaggcggtgctggtcaaccgcgcggtgaccttcttcgagtcggagtactacctgctgggagacgcggcgcccgtgcggctcccgtttccccggaagtcctccctccaggccttcgtggacgggcaggtcgtcttcacgattgaagaggactggggccgcttcaagcagggcgcgctgctggcatacccgttggccgcgctgaaggcagacccggcgaaggcgaagcccacgctgctcttccagccgggagcgcggcaggccatcgaatcggtggcggcgacgcggggccaggtgctggtgagcctctatgaggacgtgaagggcgcgctggatgtctacacgccggggaagaaccgttggagccgcaagcggctggccctgccgaagaacgcctcggtcgccatcaccgcgacgtcgtcatcgcatgaccgcttcttcgtgaagtcccagggcttcctcgcgccgacgtcgctgtggctggcggatgcgaaggcgggcacggtgaagaaggtgaagtcgctgcccgcgcgcttcgatgcctcgaagctccaggtggaccagtcctgggcgaagtcgaaggacggcacccggattccgtacttcctggtgcggccgaaggcgcggaagctcgacggcacgctgccgacgctggtgtatggctatggcggcttccaggtgtccaagccgcccgtctacctgccggaggagggcaagttgtggatggagcgcggaggggcctacgtcgtcgccaacatccggggcggaggcgagttcggtccgcgctggcaccaggcggccctgcgggagcaccgccagcgcgcgttcgacgacttcgcggcggtgatggaagacctggtgcggaggaaggtcagctccccgcgccacctgggcatctacggccgctccaacggcggtgtcctcaccagcgtggcgatgacgcagcgcccggacctgttcaacgcggccgtcatcgaaagcccgctcatcgacatgatgcgctaccacctgctgccagcgggcgcgtcgtgggtgggggagttcggcaacccggaggtgcccggggatgcggcgttcatctcgaagtactccgcctaccagaacctccgcgagggcgtgcgctaccccgcgccgtacatcaccacgaacacgaaggatgaccgcgtgcatccgggtcacgcgcgcaagttcgcggcgcgcctggaggccatggggctgccgtacctgtattacgagaacaccgacggcgggcactccaacgactcggacccgatgctcaacgcgcgccggtgggcgctgcaccacgtctacttgtcgcggcagttgatggactgaacgcctgggggcatgcggccgggcaggcccatgctgtcacgaacgtccggaacccctggtcttcaccacgctacattcccgcgtcatggaaaacgtccctgacgccgtggaaccgaagcttggtgctggcgacggaaggggtggcgcacatggacaaggaccatgtgtggcacatggagacgctcgcccgggtgtgccaggcggacgcgacgttgctggtggcgacgccgttccgggtggtggcgctggaggatgaagccgcggtagcggagggcgtgcgctggtgggaggaactcacggcgcgaggaggcgagggcatggtggtcaagccgctcgacttcgcggtgcgtgggcgcaaggggctgctccagccggccatcaagtcacgaggtccggagtacctgcgcatcatctacggcccggagtacaccgcgcccgcgaacctggagcggctgcggcagcggggtctgtccacgaagcgctccctggcgctgcgcgagttcgcgctcggggtcgaaggcctggagcggttcgcgcgaggcgagccgctgcgccgcgtgcacgagtgtgtctttggcgtcctcgccctggagagtgagccggtggacccacggctttga

SEQ ID NO: 2865 - DNA, 342 bp, Myxococcus xanthus
tgggcggcattgcctatgcgcgccggtctcagtcgcccagggatgcacgggacgtgctcctgacccggctcccgccagatatctgcaaggaagtctgagaggtgctgtcccgcgtgcgggacaagcctgcgaggactcgagcgtgccggcttggtgtcgcgcaccgtcacgccgaccgtgcctccgtgcgtggactccgcgttgacggcgctgggcgaggaacggatggagcccatcgccatgctggcgacctgggcgctgcgccgccgggaggcggtgaagcaggcccacgccgcgtatgacgctcgcgaggagcctcctgcgccgcgcgagccgcgctga

SEQ ID NO: 2866 - DNA, 681 bp, Myxococcus xanthus
atggatgtcctggggacgctggacacgctggggctgtcgaaagcgtcgttcgcgggccactccctggcgggggatgacctgacgtggctggcgctccaccaccccgagcgcgtggaggcactcgtctacctggacgccaccgacagccggggcgagattgccgcgttcctggagggtgagcagttgccgccgctgccgttctccgtgctcgacggccttccttcacggcaggcggtagcggagcggctggcgcaggatttgggcggagggcttcccgcacacgaagttgaacaggcgtatgtgttcgacgccgcgacaggggcctacctgcgcgagcgccgccatcctggtgccacggagcagtccgtccggggcgcggccatcatggacctcgggcgcgtgcaggggcccgtgttgtccctgtcggatgggcagggcttcgcgggttgggtagaggccctggtggcggccgagtcgctgccgctggagttccgggagaaagcccgcgacttcctgcccgacatccagcagcacgagacggccctggaggactcgctgcggcgtcatcctggctggagacacctgcaactggaaggcgcggggcactacatctggctgacgaaccgggcggaggtggtgacgcggatgcgcgacttcttcgccgccaccgccgcgccgtag

SEQ ID NO: 2867 - DNA, 2553 bp, Myxococcus xanthus
atggcgcatccgaccgaagacaagaacttccgcctgccgacctccatccgtccccgccgctacgcggccacgctgaccctggacctggacgcgaagtccttctccggccagcagaccatcgacctggacgtggcggcgccgtcgaacgaaatcatcctgcacggcatcgccctggcgctgagcgacgtgacgttccgcgccggtggccagcagcgcaagccggcctccatccagcccgcgcaggcgagcgagacggtggtgctccgcttcgatgaagcgctgcccacgggcgccgcgtcgctggacgtcgcgtggacggggcgcttcacggaagggctgcgcggcctgtaccaggcgggcaaggtggcggccacccagttcgaggccgccgacgcgcgccgactcttcccctgcttcgacgagcccgccttcaaggcgcgctgggccctcaccgtccgcgtcccgacggggctcaccgtgctgggcaacggcccggtggtgaaggacacgcaggagggcaacctgcgcgcggtgacgttccaggagacggaggtgctcagcagctacctcatcgccctggtggtgggcccgctggtgggcacggacgcgcaggacgtgcagggcgtgccggtgcggacctgggcgctgccggagaaggcgcacctgacgcgcttcggccaggacgtggcgctggcggtgctgcccaggctccaggactacttcgggctgccgtatgccttcaccaagctggaccaggtgggcatccccgacttcgaggccggcgccatggagaacgccggcctgattacctaccgcgaggtggcgctgctgctggacccggccaccgcgccgctgtcggtgaagaagcgcgtggcggaggtggtgacgcacgaactggcgcaccagtggttcggcaactgggtcaccatggtgtggtgggacgacctgtggctcaacgaggcgttcgccacgtggatggccttcaagattgtggaccagtggcgccccgagtggcgcatgtggctggacttcgacgcgcaccgcgccagcgcgctgcatctggacgcgctcaagtccacgcaccccatccacggcgaggtgcgcaacgcgggcgaggccggtgagagcttcgacgcgattacgtacgagaagggcggcgcggtgctgcggatgattgagggcttcctcggggaaggccccttccgcgagggcatccgccagtacatgcgcaagcacgcgcgcgccaacgcagtgaaggaagacttgtggaacgcgctgggcgacgccgcgaagcagccggtggaggagctggccaccgcgtgggtgggccagagcggcttcccgttggtgacggcgacgctggacgggcgcgggctgtcgctgtcgcagcggcgctactacagcgagcccggtgtgcagagcgctgaggtgtggccggtgccggtggtgctgcgctacgaggacagcaccggcgtgcgcgagcagcgcgtgctgctgcgggacgcccaggccacggtgaagctggagggcgaaggcgcggtgaagtggctgacggccaacgcgggctccaccggcttctaccgggtcgcctacgacaagccgggcctggagaagctggcgacgaacctgaagtcgctggccccctccgagcgcaccgccctgctggcggaccagtgggcgctggtgcgcgcgggccaggcgtcggtggcggacctgctggaccttgcgggccgcttcggtgacgaggaggacgactccgtcctggacgagctggtgggccggctggcctacatcgaaggccggctggcggacggcgaggaccaggtccgcttccgcgcgtgggtggagaagctgctggggccagggctgaagaagctgggctggcagtccgcgccgaacgaggcggaccgggtgaagctgcggcgcgcgtcgctggtgcgcgcggtgggtggcctggcgcgcagccaggacgcgctcgccgaggcccggccccgcgtggagcgcatgctccagggacagcgagacgcgctggagcccaacctgctggacgccgcggtgggcatggtggcgcgcgcgggcgacgcggcgctcttcgacaccttcctccagaagattccgtccgagcccgaccctgccacgcagcgccgctacctcatggcgctcaccgccttcgaggcccccgaactcaccgcgcgcgcgcgcgggctgctctacacggacacggtgaagacgcaggacgtggccagcttcgtggcggggctgctgggcaaccgcgtcggccgcgacgcgtggtgggcgcagatgcgcacgcaatggaaggacgtggtggcccgcaccggcggcgcccccatgctgctgcgccgcatcgtcgaggccatgggcatgctgcgcacgcgcgagcacctggagcagatgcaggccctgctcaaggcccagcccatccccgaggcgcagcaggccacggcgcagacactggagcggctgtcccaggatgtggcgctgcgtgagcgctgcatgcccgaggtctccgcgtggctgaagcgccagccgtga

SEQ ID NO: 2868 - DNA, 306 bp, Myxococcus xanthus
atgtacaccctggagcggggccgtcgccctcgcatccaactgtggatgcggaccgcgaagcacgcgcgagtggtggccttccgcacctacttgcgcaccctgttgcacgagctgtgtcaccacctggactttcttctgctggagctgcccgcgtccttccacacggaaggcttcttccagcgggaatccagcctcttccaccagttggtgccccgcccggcccggccccggcgttccggggccaggaagggtgtgactgcggacacccctgacataagtccaggcaggcggcggcgcggaggctag

SEQ ID NO: 2869 - DNA, 588 bp, Myxococcus xanthus
atgatgatgcgcgctttactgcttccctgcgtgctgctgctgtccgcgtgctcggcggagattgccatccagaccgagcccttcgaccaggtggtgcccgtcacctcgctgctggagcccgtctacgcggaggtggcgctcgacctgccggaggagtccgtcaacacgcaggacctggacatcatcgtcaacgaagtctccgccaccctcgtggtggtcaacccctcccccacgctcaccctgcgcacgtccgcgcgcctgtcactcacggggaccgccacgccggacaacccgcggctctacacgaacttcaaccggccggcctactacgacacggcggcggaaatcctcgcggagcggaccttccagccggactcgcgcacgcccctgcgcatcgacgcgccggcgctcaagaacgccatcggccggcggcgcgtctgggtcatcgtcagcaacacggtggtccgctccggcctcaccctgccccagctcccggcgcagattcgcctggaggacatcgtcttccaggccctgctcaccaagcccttccccgggctgggcggcgcactggaggccggcggcctgtag

SEQ ID NO: 2870 - DNA, 459 bp, Myxococcus xanthus
atggccgccagtccccaccgcgtcgtgctgggcgcgcgctacacgcacttcgtgggcgcctccgtctattcggacgtcgtgacgtcgggggcggacacaccggcgctccagcgcttcgagcccgagctgtccggcccgtccttctatggcgtctacggcctttcgctgggccccgtgctggtgcagggcgaggcgcgctacggcctctacacgtccgactatctgtccttcaccggcgcgctggccttcaacttcgcgggccactggtccgtggtgggcgaggcgggcgtgcgcgtgaagggcggctccaccctgcgcgccgcggcgggcatccgctacggcggcgagcactttggcctgggcgtgggcgccacctacgtggacatgagcgacccggccctgccgggagagagcctgcccgtcctccccgtcgtcgacctgtcctggagcttccgatga

SEQ ID NO: 2871 - DNA, 249 bp, Myxococcus xanthus
atgtgggacccaggagagctgcgcgagggcatggccgtgagggacgaacacgggcggaggctgggcacggtggtgcatatcggagacacgcacttcgagctggagcagggctggccacccagccgcgacttcatggtgagcttccacctggtggcgcgggtggaccatggtgaggtgttcctccaccccggccatggcgccaccgtccccacggaggatgagatgcccgacagcggcgcgtacatctga

SEQ ID NO: 2872 - DNA, 1119 bp, Myxococcus xanthus
cctgagcaccgccttcgcggacaggtggttcgcatccgcttccgcattggcacggatgaggcggccgggggctttggctggttcatcgatgacatcgccttcacggggttggcgaacacgcccttcacggcgctggtggacgagcagggggtctgcacgacgggccatgtggatgcgcaggcgggcgaggacctggcggtcgatgagctgtccgtggtgcaactgcagggcagcggcagcagcctggcgggtggtgcgctcacgtaccgctgggagcaggtggcgggtcccttcgccgcgatgagtggcgcggacacggccacgcccagcttcaccgcgccggaggtgctggccgataccatgctgaccttccgcctgacggtgctggacggcggtctgcgggacagggacacggtccaggtgctcgtgcgccaggtgaacaaggcgccggcggtgtccgcgggcaccgcgcagacggtggacgaggggagcacggtgacgctccagggaagcgcggaggacccggacggcgacgcggtggtcagccagcagtggacgcaggtctccggcctgcccgtcacgctgacgggcgctgatacgctgaccccgagcttcaccgcgcccgcggtcgccaaggggagcgcggagctcgtcttccagctcgtggtgagtgacgggcagttgagtggcgaggccgcgacggtgagtgtgacggtgcgccacgtgccgctcgcgcccaccgtgagcgcgggggacgatgtggccaccttctcggcgaagtccgtcacgctgacggccacggcgacggacccggagcaggggacgctgacctacgcgtggagccagagcgagggccccaccgtgacgctccagaacgcgacgcaggcgcgtgtccagttcaccgcgcctgaggtctcagccgcaacggagttcgtcttcgtggtgaaggtctcctcggagagtggcctgtccgccgaggaccgggtcacggtgacggtgagcccggcgcccccggcgccgaaggagtccagcggttgctcgtccaccgggacgactgccgcgctcccgctggcgatggcgttgctctcgctcctcgcgtggaggcggcgcgaggactga

SEQ ID NO: 2873 - DNA, 1020 bp, Myxococcus xanthus
cgcatcccgctgttcgagaacgtgcgaggcatcctcatcaccctggtggtgatggggcatgcgctcgagcccctgctcggccgggagccgctcgcgaaggcgctctactccggcctgtacctgttccacatccccgccttcgcgttcctctccgggcacctgtcccgcgcggacagcgggccccgcgcactgagcgccatcgcctgggggcagctcgcgccgctggctgtgttccaagtgctgtacgtcgctttcgacgcgtgggtgctcggccggggctggagttcccactggctggtgcagccgtactggctgctgtggttcctgctgagcctcgggtgctggcggctgatgctgcccctgctcctccgcctgcccaagccgctgatgtgggccgtggcgctggcgctcgtcgcgggcctgctgccctgggtgggctacctgttcggcctgtcgcggacgttcgtgttcctgccttgcttcgtcgccggtcacctgacgcgaagggagtggctgctggcccctcgaaacacccggggctggcgcctcgtgctcgcggcgtccctggccgtgggcctgggcgcatgcgtcggggcggtggccatgggagcactgcccgcgcccgcgccgcagtggctctacgggagcagcggctacgcggtgctcggtgccacagcactcacgggcatggcggcgcgcgcggccctcttctgcggtgcactggcgctgacatgggcactcttcacgctcagcccgcgtcaggaaagcacgctcacgcggctgggcggacggagcctggcgcccttcctcctgcacggcttcgtcgtgcgagccgccgagcacgtgggcgcgtacgcgttcctccaggggcccgtgggcgtcgccctcgcgctgggagcgggggcgctgctcacggtgctgctgggccagccttccgtcgtccaggccacgcgcccgctgtgggagcctcggcggctcttccagcggaagcgtgacgccgtgccggacctggggcgctga

SEQ ID NO: 2874 - DNA, 615 bp, Myxococcus xanthus
gcgctggacgcactgcggccgtcctggaacgagctgccgctggatggcttcctccgggatggtggccgctaccgctcacgacggcactcctgcttcatcgtggacggcgacgcattgacacaggtgcctcaccgcgcgcactggcagccggtggaatacaacgcgcttcacggcggcatggagcgctggttcgagcccgtgcagcccgacatcgtgtcccagccggtgtgggcggggctgattcgaggcatcgccgcgtgctgctcccagctcaagggcgagcgcccctggtacgtcgaggcccaccagttccgcatcgacaccaccgacggtatcggccggcccacccccgagggcgcgcaccgggacggcgtggacttcgtggcggtgctgctcgtgggccgcgagggcatcaagggcggtgagacgcgcgtcttcgaagccgacggccccaacggcctgcgcttcacgctgacggagccctggtccgcgcttctgctggatgatgcgcgcgtgattcacgagagcacgcccatccaaccacagggagacaccggccaccgggacacgctggtcctcacgttccgggccggggggttccagggccccgagtag

SEQ ID NO: 2875 - DNA, 261 bp, Myxococcus xanthus
atgacaggacccagcgacaagggggagcggctctggccctgggtgggcgcggcgctcggagtgcggtggttcctcgcggcgggaggtagccccacgctgccgctcttccagcgcctgggcgaccgcgtcacctgcggcgtggtggatggcttcaccgtgtgcgtccccacccgggacagcgacttccgcgaggccttgaagcgcgcgcctccggctctcttctcccagcccctccccgcttccgcgggcccgtctcactga

SEQ ID NO: 2876 - DNA, 1158 bp, Myxococcus xanthus
atgaatgaagtcgtcatctacggcgcccccgtgacgggtgagccgcccgccaaccttccgcccacggtctccgccggagcggaccagacggtgatgctgcccacgaatgccgcgaccctcacgggcaccgcgacggacagcgacggaacagtcgtggcgcggcaatggacccaggtgtccggtcccaataccgcgaccctgacgggcgccacgacgctctccgcgacggcgtccgggctggtgcaggggctctacgagttcgagctgacggtaaccgacgacgacggcgctaccgccagcgacagaatgaaggtccaggtgacacccgcgcccacgggccgtggcaccacgcaggaggtctacaagtcaccctcgacgccgggcggctacggctatgtcgtgtacctgccgcccggttacgacgaaggctcgaactggcccgtcgtcttcttcctccacgggatgggcgagcagggagacggaggcgtcaaccagctcaagaaggtccgtgcgcacgggcctcaggcgtacatcgatcaggaggggaaggactatcccttcatcctggtctctccgcagacgagcacgtcgggattctggagcgcctacgaagcccaatacaacctggaccccttcttcgagcacatcctggcgacgttcaagacagacaggaagcgcgtctacctgacgggcctcagcatgggcggcgcggggacgttcaactacgcatcgctcttcccctcgaagctcgccgccgccatccccgtctgcaacggaggctacggttctagcgccgcggatgccctgaagatggttcaggcgaacctccccatctggggctcacacggcctgctcgacaacgacatcttctacaccgcgaccgccggctggttcacgcacctgggacacgccatgggcggcaccggtggcgtcatggatacctatccctccccggcgcgtacagcgacggcgttcttccggcccgggagcgggcagtgggaatggattgatggacagacgaacaccgacaccacgggcgccgggccggtgaagcccgtgctcttcaccctcttccacgatggcaatcactacatctgggaccgggtctacaaagagcccaaggtgttcgcctggatgctggcccagcagcgcccctga

SEQ ID NO: 2877 - DNA, 633 bp, Myxococcus xanthus
gtggcacgcgacttgggaccgcggggaaagatgtgtcgtcggctggggattccgctttcgcgcatcaccgcgaaggacccggacaaggacccggtgctgcgccggccctatccccctggccagcacggtgccaccgcgcgcaccagcgtgagcgacttcgcgcgccgtctgcgagagaagcagaagctgaagctgtactacggcctgatggagaagcagtgccgcgcggtcttccaggaagcgagccgggcgccgggcaacaccggcacggtgctgctgcaactgctggagagccggttggactcactggtgcttcgcgccggcctggccaccagcatccgccaggcccgccagttcgtgcgccacggataccttcatgtggacggcaagcgagcggacatcccgagcttccgcgtcaagcctggcagcgaagtccgcttccacgcggcacaccagaagctcgccgtggtgcaggagtccttcagccggatgaaatcgcggtccgtgcccgcctacgtccaggtgctgggtgagggcgaagggctgcgctacgtgcgcctgccggagcgggaggaaatccccgtggacgtgaacgaacccttcatcgtggagtactacgcgcagcggagctga

SEQ ID NO: 2878 - DNA, 522 bp, Myxococcus xanthus
tcacgcctggactacctcatcatcccgattctcttcggcctgggcacggccgtgctgacgctggtgggcaccaacgtgggtgcgggacagcacgagcgcgcccggcgcatcgcctggttgggcggcgggctgggcttcgtggcggcgggagccattggactggccgcggccctggcgcctgaagtctggctccatgccttcagccgtgagccggccgtcgtggcgccgggcctggactacctgcgcatcgtggcgccgttctacggactgctgggcctgggcttcgtgctcgcgttcgccgcacagggcgcgggccacgtgctgtggcccttcctggcgggcacctcgcgcctggtcatcagcgcgggcgtcgggtggttcgtcgccgcgcggctcgatgcggggctctccgcgttgttcgccatggtggccgccggactggtggcctacgccggcgtcaccatcgtggcggtgctcgcaggcgccatcttccgccgggaggcggcgccgcgcggcacctga

SEQ ID NO: 2879 - DNA, 528 bp, Myxococcus xanthus
atggccacgacgaagaccgagaccgaggcgacgcagaacgaagttcagagctccgaggccgctgcgaagagcggactggcgcagaatgtggagagctttctgaaggcccagatttcccaggcgcagaagcgcatcgaggagctggaaggcgaagcgggcaaggtcgtgaagaccttggagtcccgtgggcaggaggccgccaaggaggcccaggcgctgtgggcgaagttccaggccggtgagctgctgacggacccccgcgtgcaggagctgagcaagcgcgccaacgaggccagcaccgagctgagccggcgcgtggacgccgcgggcaccgagctgcgcaagcgctttgacggtatccagacgcgcgtcgtcgaggccgtgggcgtggccagccaggcgcagctgaaggacctcaacaaggagctggcgaagctgtcccgcaaggtggactcgctgctgaagcccgtccgtcgggtgaacggcgcgaagcccgcgagcagccccgcgtcctcgccgcgcgcctga

SEQ ID NO: 2880 - DNA, 351 bp, Myxococcus xanthus
atggacaacaagcccgaggccccccgagagaagcactccgtgacggagacgttcgagcgtctctggagccaggccctgctggcggtgaacacggccgaggaagaagcttcacgggccgtgcagcgcgtggccgcggtggcgggttggagccaggacgaggtgaagcgccaggcccgggaattcagcgagcggctggcgggccaccgcaaggacctggagcacaacgtggaagagcgggtgcgccagaccctgacgaagatgaagctgccccgccgcgaggagctggcggcgtttggaacccggctggacaagctggccgagcgcatccaggccctggagcaccggaagtga

SEQ ID NO: 2881 - DNA, 426 bp, Myxococcus xanthus
gatccgctgctgatcctggccatcatcgacgtggagtcggacttcacggaagatgcggtgtccgtgaagggcgcgcgcgggttgatgcagatcaaacccagcacgctgcacttcctggcggagaaggaaggactgcgcttgtcccgcgaggaggtgaccgcggacaccgcgctctgcgtgcggctgggcatccgttatctgcgctcgttacaggagcgcttcggtggggacctggacctggcgctgatggcctacaacgccggtcccacccgcatccgcaacgccatcaagcagggcgaattggagcgcttccggcgctatccgcgcgcggtccgccgggacttccggcgcttccgtgagggccacgggctgggcggtgactgggccttggcgcagcgcgaggtgcctcccgagcccatgccctga

SEQ ID NO: 2882 - DNA, 690 bp, Myxococcus xanthus
atgaagaaccccctgttccccagtgccgcgctcgccgccaccctggccctggccccgttcggggcgcacgcaggctccgtcttcctcaacggcgtcaagattgacggcgtcaccaaccagaagttcgagaaggccaccgtccgcatcgacgaggccggcaacgtgcacatcgacgcgccgggctacgcggcccgcgtgacggcggtgacgcctccggcccccgccgcgtcgccccaggcaccggcgcccgcctccccggggccggcggccccctccgcgaaggagcctcccgcggcgcagcaggcgcctggcgcgcctacggcccccgggcgcctcacccagcgctactggctggtgacggagcagacggtgccggggatgacggggtacgacatcgacgtgttcatcaattccacgtggctgcgcaagctgcgaggcaacgaggaccaggtggtggtggacatcacccgcaacctgcggccgggggcgaacaaggtgacgttcatcgcccggaagggaaacgccggggacgcgcgcagcagttcgcctgcccacgtgtttcgggtcattattggcgagggcaacgagggcggcgggaacgtgatgatcgacaatcccatccttcgcttccagaagacggcggcggacacgcaggatgcgacacaggagttcaccctcaccacgcgctga

SEQ ID NO: 2883 - DNA, 1857 bp, Myxococcus xanthus
atgacgggcgcgccgcaggaggactcctccggaggcggcggcaggcccaacgactacacgggcacgaacaaccaggtcgccggcgtgcacgaggccgacttcgtgcagaacgacggcacgcgcatcttcgtgctgtcgggcccccggctctacatccaccgttcgtggcccgcggagcagctcacgcggacggccgtgctggaggtggagggttggccgcgcgagatgctgctcgacgccgagcgcaaccggctggtcatcacctcggaagtagccgaggaccgccccgggacggtggcggggggccgcggcacggacgacatgccagtcgtcgactgcgccggcttcggttgtggccatgcgtacagcaacaccgtgaaggtgacggtggtggacgtggcggacctggaggcgcctcgggtgctggagcaggtctacctgcccggcggctacatcagcgcccggcgcgtggacagcgcggtgcggctggtgttctcggacgggttccgctggccggcggatgtgcgcttctatcccgagtactcgccggggttcttcggtgaccggtcccggctggtcgcgtccatcgacgcgctcatcaagcagaacgagcagcgcatccgcgcgcagtcgctggaggattggctgccgaagggccggcgcgtggcggcggacggcgaggtgaagccgctcgcgtatgactgcacgtcgttctaccgcgccaacgggcccaccgggctgggcctggtgtcggtgctgtcgctgaacctggacgcggaggattcgtcgcccagccagaccagcgtggtgggcacgcccggcgaggtgtacgcgtcccatgaggcgctctacgtggcgtctcgccactggtggtggtggccggagcccggccagacgacgcacacgtacctccacaagttcgacatccgcgacccggaccaggccacctacgtgggcagcggcacggtggagggatacatcgtcaaccagttcgccatggacgagcgcgagggcgtgctgcgggtggccaccaccgtggagctcccaccggagaacccggggaccgggaacggcggggacaccgtgtggacgcctccggagacggtcaaccgcgtggtgacgctgcatacgagggacgggcacctgaaggagctgggccgcagcgaggacctggcccggggtgagcgcatcttcagcgcgcgcttcatgggcacgcgaggctacgtcgtcaccttccggcaggtggacccgctcttcaccttcgacctgagcgacccggcgaacccgcgcaaggtgggcgagctgaagattccgggcttctccacgtacatccacccgctgggtgacacgcacctgctcaccttcggcgagcaccgcaacgaggacggcacctggcaggaccgcgccctcaagctgtcgctcttcgacgtgagtgacctggcgcagccccgggagaccttcacgcaccagctgggctcgatgggcagccacagcgaggcgctctacgagcacaaggccttcacctacttccccgccaagggattgctggccctgcccttcacggactgggactacaacgcctacgactactggtccggcttccgcagcgagctgcgcgtcttccgcgtggacacggccacgggcttctcgccagtgggcaccgtctccatgcgggacatgtaccagtcgttcaacttccggaactggagctggtactggcagccgacggtgcgccgcagcatcatggcggacgactacgtctacaccatctccgacgcggggctgcgcgtgtcccacgtggacagccttcagacaccgctggtcaccgcgcccttccatccgcccatgctgccgtag

SEQ ID NO: 2884 - DNA, 1968 bp, Myxococcus xanthus
gggcagctccagccagtaggtcagcccgcgcgcggcgcagccggtggccatgtccatcatcccctccagggcccaggcgtggagcctgtcgcaggcatgagggtagtccggacggatggcctggtagacgacgacgggcaggcccaggtggttgcccagaccgatggcggcatccagcgcgtggttctgctcggcgcgatggttgaccatgcaccaatagaggacgaagtcgcggcggccggaaggaagcgggaggtccttcaccacctggacgcgcgccgaatcgacgccgagttcggaccacgagaagccttcaggcatggggcctcactgatacgcgagccgtattcgcgtcgcggaggaaaagaagtgcgtggctgtgaacgaggggacagggaaggtcggatggcgctccaatttcccgcacccgaggacaggttgtggttttctgccgtccggccggaccgaaggagtccttgcgtgtcatcattgagaagctggagctatctccccatcaccgccctcgctctcgcgctggtccttccggagcccgcgaaggcgcaggctgacggaacctatccatccccgggggctgcgcagccgccgtctgcccccgcgggttatgcggcccctccgcagcccacgtatcgccagacggcgccgcagcagccggcggatccgtacgcgcagccgccgcagacgcagcagcccgcggacccgtacgcgcagccgccggcgtccgcgcagcccgcggacccgtatgcgcagccgccgcagacgcagctgccggtggacccgtatgcgcagccgcagacgcagcagccgtcagcggatccgtatgcgcaaccgccgtcgtccacgcagccggtggacccgtacgcgcagccgccgcagacgcagcagccggtggacccatatgcgcagccgcagacgccgcagggctatcccccggcgcagaatgcctatcccccgtcggatgcgcgggacccggctcgctatccgggcgattccgcgacggcgagcgacgcgcccacgctgcctccggatccggactcgcttcggacgaagccgcagtcgccgctgacgccggacgaccgggccatggcgaagcggggcgtgcctcccatcgaggacactggggtgatgctggacggcaggccgcgccagggtccgttcctctccggtccgggcagcttcaccttcatcgtgcaccacacgacgctgggcgcgctgggtggcttcttcacgcaggcgttcgccagcgacttcaacttcgacaagagctcgcgagaggcaatgctcgcgggcacgctcatcggcgcgggcctgggcttcggtgcctcgtcgtggtggcagttcaacaactgggtggaccgccccatggccaccttcagcatcgccaactcggtggtgggcggcatgttcaccgcgggcctgatggacctcttcacgcaggacgcgggcgtcctgacgtggtccgccttcctgggcgcggagctgggcgcatggctcacggcgggtatcggcggtggccagcttccgctcaacgacggcttgctgatttcgtccggtgcgggctggggcgcggcctactcggcgctgctgttggccatcatccacttctccgggacgcccgtgtccggcaagacgtggcgggacacgctgctgctggctccgggcatcggcgcgggcgcgctggcgctggccaccatgcgttacaacccgacgccgtcccaaatcgtccgagccaacatcttcggcggtggcgtgggtgcggtggtgctgctcctctccggcgtggtgctgggtggtttcgatcagtccacgccgtacgtcctgtcgttcctcggttcggcgggggccatcaccacggtgagcctgctgtgggaggagagcgtggaccgctccgccctgaagatggctggccgctcagagaaggaccggccgtacacgaacgtttggtggtag

SEQ ID NO: 2885 - DNA, 468 bp, Myxococcus xanthus
gtgttcaacctcgacgagcgctaccgcgggctgcccgccacgcgggaacaaatcctggcgctgcatacctccctcaacgcgccgcacgtggccattccgggcaagcaggccggtccggcgcaggcctttgtcgtgggcctccggggagggcaggggaccgcggccgtcttcgtgtacctgtacctggcggaggccgcggactgcgcggtgtacctgtccggccggcgcaacgtgtcagcggatgagtaccgcgacgacgagggggacgcgctggccttcgtggagtcgctcgggttcatgatggacgacgccaactggcgcgcgatggcccccgagcagcaggacgagcagctcaagacgttgccggtgttcttcaaggacccgacgctcgtgcccgctgtggtggcgcgcgccgaggagaagaagaacgtcaccaccaccctgggccgcttcctggccgccttctga

SEQ ID NO: 2886 - DNA, 762 bp, Myxococcus xanthus
  unsure (1)..(762): unsure at all n locations
atgttccgcctttccaccgcgtcctgttcgctcgcgctgctgctggtgtcctccggttgctcccacacgcccacggagaaggagaagcggagcgccgagattcactacgacctgncgttgcaggcccagcaggccggcgagctccaggatgcgctgcgcgagctgcaggtgtcgctgaagaacgacccggactaccccgacgcgaacaacgccatgggcatcctgctgcacctggcgtttcgccgtcccgacgaggccgtcaagcactacaccaaggcactggaggttcgccccgacttctccgaggcgcgcaccaacctcgccaacgtgcacctggaccagggccgctacgacgacgccatcaagctctatgagctggtcctcaatgacatgctctacccgacgcccttcatcgcccagggaaacctggggtgggcgtactacaagaagggcgagccggaccgcgcggtggagagcatcaaggccgcggtgacgaccaaccccaacttctgtttgggctacaagaacctggggctcatctacgacgagacggggcgcacctccgaggcgtgccgccagttcacgcactaccgcgagaattgcccggacgtggcggaagcgtacatgcgtgagggcgtctgccaggcgaagctggggcaggtcgatgcggcgaaggcagccttcgccacctgtgagaccaaggcgaaagctggtgaacaggtgctgaaggatgactgccggaggctgctggaaaagctctag

SEQ ID NO: 2887 - DNA, 441 bp, Myxococcus xanthus
atgactgccggaggctgctggaaaagctctagcgcgttgggtatctggggacccgtggaccacgtcgatttcggcaaatacctgagccagcagcgagagctccgagggctctcgcgtgacgacgtcgcgcgggagaccaagattcctcccacgctcatcaccgcgctcgaggccggtcaggtggaacggctgccctcgcgcatcttcgtggtgaactacatccgcgcgtacgcgcaggtcatcggcatgtctccggaagaggccgtgctgcgctacgaggaggtggacaagtccgtcccggcgccatctcccgtgcagttggagcaggagcggcgcaagcgggcctacgtggggctgtccgtgctgctggcggccctgctcctgggcgtgtacctgttcctggtgctgagcggaaagcttcccaatccgctcgcgcgttga

SEQ ID NO: 2888 - DNA, 735 bp, Myxococcus xanthus
atggagcgatacgacgacgacgcgctcgtgctgtcctcggtggactatggcgagtccgaccggctcgtcaccttgctgacgcgcgagcatgggaagctgacggccttcgccgcgggcgcacgcaagagcaagcggcgcttcgccggcgcgctggagccgttcatgcggcttcgcgtgcacatcgtggagacgcgcggcagcacggtgcggctggacggcacagacatcgtcgcgggcttctatgcggcgcgcgaggacctgtccctgattgcccgggccttgtacgcggtggagctgtgccgcgagctgacgcgggaccatgagccgcagccggagctgtttgccctgctggagtcgtacctgacgcgactggatgcgaaggaggccgggcccacgtcgctcttggctttcgagctgtccgcgctggcgcacgcggggttgatgcctcggtttgattcgtgctcgctgtgtggcggcgctccgggcgagcggcctcgtttcgaccaggcccatggcggcgcggtgtgtgagccgtgtggagtccgtgctcgcgagtccgtggcggtgccggtggcgctgctgtcgggcctgcgcgcgctccaggaaggggcgcgcacgccgctcccgccggagctgcgcgcgcgtgctcgcggcctgctcaacgtcttcattgcccatcacctgggtcgccgcctcaagagcgtggacttcatggcccaggtgggcctggattga

SEQ ID NO: 2889 - DNA, 996 bp, Myxococcus xanthus
atgccgccgctggatgtcgtgtgctttggcgagacgttggtggacttcctcccggcggctccagggcaccgcgtgcgcgacgtgcccgcgtggcatccgtgccctggtggctcgccggcgaatgtcgcggtggggctggcccggttggggctgcgtccagccatgctgggcgtggtgggcgcggatgagttcgggcacttccttcgcgagcgattggcggcggaaggcgtggacgtgagtcacctgcgccagacggcggaggctcgcaccgggctggtgttcatctccctggatgggaagggcgagcgcagcttcaccttcttccggacacgctccgctgagttcctgctgggacaggcggatgtcgacgcggcgttcctgtcgggggcgaaggcagtgcactgtggttccaactcgctccagtggccggaggcgcaggaggccgcggtgcggatgctggggctggcgcgcgacgcgggcctcatcgtgagttgtgaccccaacttgcggctgcacgcgtgggaggacacgtctctcctgaagggcctgctggcgcggatgctgccgctgtgcaccgtggtgaagctctccgaggaggagattggcttcgtcacggggacggaggtgccccacgaagcgctgacgcgactggccgcgatgggcgtgccgctgcccgtggtgacgctgggcgagcgtggcgcgctgctgcagtggaagggggagtgcatccacgtcgcggcgccgcaggcgcgcgtcgtcgacaccaccggtgctggcgatggtttcgtcgcgggcctgcttcaggggctggtgcgctggtacggcggcgctggggggctgcgtgatgcaaccggtgaggagttggtgacgctggccacgttcgcgtgtgaggtcggggcccgtgtcgtggagaagctcggtgcggtggatgggcttccccgggcggaagtgctggctcacgtcatgccgtcgcgtccggacagctctcgcgcatag

SEQ ID NO: 2890 - DNA, 228 bp, Myxococcus xanthus
atggcgccgaccctgttcgcgacgctggagtgtgccgtccgtgatgaccaggccgcgcatcgcgtgttccgcttcctggccgaattgggattccgtcccgatgggcttcacctggagcgctatctgcccggtgtcgccgaccggtacctcctgatgctgggcgtgcagcgcctgcgtcccgtggtggcgaacggggaagggggctcgtccccgatggcctcggaatga

SEQ ID NO: 2891 - DNA, 2718 bp, Myxococcus xanthus
atgcagtggggcgagtacgtgcagtggctccagcagcaggccggaaccaaggagcagacggcccacgagcgcttctggctgagccggcgcgtggagacgctgcccgcgctggagctgcccatcgaccatggccgccccgcgcaccgcagctatcggggtgcccgggagacgctgcgactggaccgcgccaccacccagtccctgcgggaggcggcggcgcagcagcagtccacgctcttcatgctgctgctctccgtctacaccacgttcctccaccgccttacgggccaggatgacgtcctggtgggcatccccaccgcgggccggggaatggagggcagcgaggggctggtgggctactgctcgcacctgctgcccatcgccagccacgttcagggcgagcagacgttctccgaatacgtccagggtctcaaacaagtgctctgggaggcgtatgagcaccaggactatcccttcgccctgctcatcaagcgcctgggactgccgcgcagcacgagccacaccccgctcgtcagcgtcacgttcaacctggagcgccccctggggaacctccagatggacggccttcgcacccacttcgtcccgcagcccgtgcgctacgccgccttcgacctgagcctgaacgtcatcgacgccgaggacggactcgtcctcgacttcgactacaataccgacctgttcgaagcggcgacgctggcccgctgggcacagggcttccgcacgctgctgtcaggaacgctcgcgcagccggaagctcgcgtcgccgacctgccgatgctcaccccggccgagcgccgcaaggtcctggtggcgtggaaccagaaccagttgggctaccgggaggacctcctcactcaccaactcatcgaacagcaggccgccgcgaggcccggcgtgcacgcggtggagctggacggccagtgcatcacctacgccgacttcaaccggcgcgcgaaccagctcgcgcaccacctgcgcggcctgggggtcggaccgggcgtgctggtgggcgccttcatcgaccgctcgccggagatgctggtgacgttgctggccatcctcaaggccggtggcgcctacgtgccgctggaccccgcgcaccccgtggagcggctgcgcttcctgctggacgacgcgcgcgcggccgtgctggtgacgaagcagtccctcgcggagcggctgcccgcgcacaccgcgaaggtcgtccacctggacaccgacgccgtcacgctggcgtctcgccccacggagaacccgcccaacaccgcgacggccacgtcgcccgcctacgtcatctacacgtccggctccacgggtgagcccaagggcgtcgtcatcagccacggccagatggcggtgcacttccaggacatgcagctccacttcgagctgaccgagcgcgaccgcgtgttgcagttcgcctcgttcaacttcgacgcgtccctggagcagattctcccgacgttcatgacgggcgccacgctggtcctgcgcggcaaccaggtctggacgcccgaggagctggcccgccgcgtcgttgaacagcggctgtcggtgatgaacttccccacggcgtactggcagcagctcacgcagagctgggccgaatcgccgccaaccatcggtgcccatgacttgcggctggtcatcatcggcggcgacaccgtgctgcccaaggtgctggagctgtggcagcacggcccgctgggcaacgtgcgcacgctcaatgcctacggccccactgagacgctcatcaccgcgaccacgttcgccatccccaagggctggagcgcaacgcgcgtccccatcggccggccgctgtcgaaccgcccctgctacgtgctggaccggcatggcgcgcccgtgcccatcggtgtggcgggcgagctgcacatcggcggcccgctggtagcggcgggttacctcaaccgcccggagctcaccgcgcagcgcttcgtcccggacccgttcagcgacgacccggcggcgcgcctctaccgaaccggagacctggtccgctaccggcctgacggcacgctcgagttcctgggacgcagtgaccaccaggtgaaggtgcgcggcttccgaatcgagctgggagaaatcgagtccgcgctgagcgcgcacgagcacgtccaggaagtggtcgtcatggtccgagaggagccgggcgcactggccggacatgacaagcgactggtggcctacgtggtgccctccgcgcagggcagcgtgacacccgccgcgctccgccagttcctgctggagaagctgccggactacatggtccccgccttcttcgtcctcatggaggccatgcctctgacggccagtgggaagctggaccgcaaggcgctgcccgcgcccgacccggaggccagcgcgcccacgcgccccttcgtcgcaccgcgcacgcccaccgagcagacgctggcggaggtgtggatgaaggccctgcgtctgcctcgcgtgggcatccacgacgacttcttcgaactgggcggtgactcgctgctggccacgcaggtggcctcgcgactgcgggacgcgctcaaggtggagctgcccctggagcggctcttcaagcagacgaccatcgccgggctcgcggagcacgtggacaccgtcctgtgggcggcgcgtgcggccgaggacaccagcgtcagcggcgcgagccgtgaagagggggagctgtga

SEQ ID NO: 2892 - DNA, 5499 bp, Myxococcus xanthus
  unsure (1)..(5499): unsure at all n locations
gtcaccgaggccgcgcaggacgaagccatcgcggtggtctcgctggggtgccgcttcccgggagccccgacgccagaggcattctgggcgctgctccagcgcggcggggatgccatcaccgaagtccccgcggaccgttgggatgcggcgagcctctacgcgccggacccgtccacgcccgcgacgatgaacacgcgatggggtggcttcctcgaagacgtcggcgcgttcgacccgctcttcttcggcatctcgcctcgcgaagccgtgcggatggatccacagcaacgcctgctcctggaagtcgcgtgggaggcgctggagcgcgcgggacaggcaccgcagggactccagggcagtcgcacgggcgtcttcgtcggcatcagcaccagcgactacgcgcagcgacagttcggcgaccgctccttgttggatgcgtacgcgggcactggcaacgcgcacagcatcgcggccaaccggctgtcgtacgtgttgggcttgcgcggtccgagcatggccgtggacaccgcgtgctcatcgtcgctcgtcgcggtgcacctggcctgtcagagcctccgcggccgcgagtgcgacctggcgatggcgggcggcgtcaacctcatcctgtcgcccgagctcaccatcgccttctcgcaggcggggatgatggcggcggatggacgctgcaagacgttcgacgcgtcggccgatggttacgtgcgctcggagggctgcggcatcgtcgtccttcagcgcctgtcggacgcgctggcctcgggcgcgcccatcctggccgtcatccgcggctcggccgtgaatcatgacgggctcagcaacgggctcaccgcgcccagcggcgccgcgcagcaggacgtcatccagcaagccctccgtcaggcccgcctgtcgccagaacagattggctacatcgaagcccacggcacggggacgccgctgggcgacccgattgaactagcggcactgcgcgccgtgctgtctccggggaggtcggcggagcagcgctgcttcatcggctcagcgaagagcaacatcggccacctggaagcggcggctggcatcgcggggctgatgaagtcggtgctggccctggggcacggcgagattccgccgcaggtccacctgcgcgtactcaacccgcacatcgccttggatgcgacccgatttccgattcccacgcgccccgagccgtggccccaagcgcccggcgcgcgcatcgcgggagtcagcgccttcggcttcggtggaaccaacgcccacgtcatcctgagcgagcctccgccgcgccccgcggatgcacctcgcgtccccgagcgcgacagccacgtcctgacgctgtcggcccggagcgatgcggccctgcggaacatggcccggcagtaccaggagcacctcctacggccgaacgcccccgcgctggcggatgtctgctttaccgcgaacaccggccgcaatgcgtggccgcatcggctcgcgctcaccgcgaactcccatgcggagatggcgtcgcggctcgagtccttcgcccaagggcacgccgttcccaggctgcatcagggcgaggtgcagcgtggcgccgcgccgcgaatcgtcttcctgtatcccggccagggcacccagtaccccggcatgggccgacaactgttcgacagcacccccgtcttccgtgaagccctggagcgctacgacgcgattctccgtccacacctggatgtcccgctgctgtcggtgctgtttccgacgacggacgccaccgcgcagctcatccaccagacgcgctacacccagccggcactgttcgcgctgggccatgccctgacggagctgtggcgttcgtggggcgtggtgcccgacgccgtcatgggccacagcgtgggcgaattcacggccgcgcacgcggcgggcgcgctcgggctggaggaggcgttggccctgctggccacgcgcagccggctcatccaggcactgccccagaacggcgccatggcggctgtcctgacggatgaagccacggtgcgcatggcactggaggacgagcccctggtggacgtcgccgccatcaacgggccaaggcacgtcgtcatctctggtgagcgtgaagcggtccagcgcatcaccgcggcgctacaggcgcaaggtgtcgagtcgcgaccgctcaccgtctcccacgcgttccactcgccgctgctggagccgatgctcgatggcttcgagcaggtagcccgcgtcctgcccgcccacgcgccgcgcctcccgctcatctcgaacctcacgggcgagcgcatgtcccaggcccccgacgccgcctactggcgacggcacgcgcgcgctcctgtccagttcttcaagagcctccagacgctgacacaggccggccccgcgctgttcatcgagctgggcccgcacgacacgctgctcggcatggcgaagcgctgcgttcccgagggcgcgagcctgtggctccccagcctgcggcgtcagcaggatgcctgggagacgctgctcgacagcctcggtgcactgcacacgcgcggcgtcaccgtcccctggcgcgcagtggacgcggaccgtccgcgacggcgtgtcccgctgcccacctatcccttcgagcgccagaggtacttgctggactccgcgctcccctcccctgcccataggccgacgatgatgacccagacctctgccgcagcgcccgtcgtgtcacgcaaggagcgcatcctcaccgagctccgcgcggtcgtcgccttgctgctccaggcccctcccgagaagctcgacccgcgcatgtccttcctggagatgggcgccgactccctcgtgttgctggacgccatccgcaatgtggagaagcgcttcggcgtgaagctggccatccgtcagctcttcgaggaactgacgacgctggacgcactggcgagccacctcgaccagacactgcccgcgagcttcgcgctgagttccgcgccagccgcgacgagcgttcccgcgccgctccccatgagcacgcctcccgccgccgcgaacgcgctctccgcgccgccgggaagcgccgtcgagcagctcatccagcagcagttgcagctcatggcgcagcagctcgcgctcctgggcggacgtccctctgcgccgctgcagcttcccgtcgcggcgcaggaagctcccgtccccaaggcagttcccacgaacaccgcgaaggcaggaggcgcgtcaccctttggcgcgggacccaagtccggcacgcccgagcgagaactccccgcggtacagcagcgtcacctggacgcgctcatcgcgaagtacaccacgcgcacgaagcgctcgaaggaagcagccgtccgctaccggtcgaagtggagcgacgtgcggtggctgatgaacttccgcgccgagctgaaggaggtctgctaccccatcgtcagcgtgcgttcgaagggctcgcgggtctgggacgcggacggcaacgagtacatcgacttctccatgggcttcggggtgcacctgttcggtcacaacccgcccttcatcatggaggcgctgcaacaacgtctggcggagggcatggagttgggcccccaatcggacctgggcgggcaagccgcggaactgctctgcgagctgaccgggatgaagcgcgtcaccttctgcaactccggcacggaggcggtgatgacggcgctccggctggcgcgcgccgcgacgggccgcacgaaaatcgtgatgttcaccggctcctaccacggccactccgacggcacgctggtggtgggacgcatggtcaacggtgagccccagtcgctgcccatggcggcgggcgtgtctcccaaggtcgtcgaggacgtcctcgtgttgccctacggtgaggaccgcacgctggagctcatccgcgagcaccttcacgaactggcgggcgtcctcgtcgaacccgtgcagagccgccgtcccaatctccagccacgggccttcctccaggcgttgcggacgatgacgcgtgaagcaggagtgcccctcatcttcgacgaggtcatcactggcttccggctccatccgggtggcgctcaggcgtggtacggcatcgaggcggacctggtcacctacggcaaggtgctcggtggcggcatggccattggcgccgtcgcggaccgcggcggattcgtggaccgcatcgacggaggcgactggaactacggtgacgcgtcgtaccccgctgtcgagacgaccttctccgcgggaacgttctgcaagcacccgctgaccatggcgaccacggtggccacgctgagccacctcaaggcccaggggcccgcgctccaggagaatctgagccgccgcgccgcagggctggtcgctcggctcaacgacatcttccagcgcgagcaggcgcccatcgaggcggtccacggcggctccgtgctgcgcttctccgccgcgggcaacaccagctacctgtaccagtcgctggagatggacctgttcttctgccacctcatccagcgcggcatctacatctgggaggggcgcacgtgcatgctctccaccgcgcactcggacgaggacctcgacaccatcgtccgcgccatcaccgagacggtggcggacatgcgcgcgggcggattctggccacgcaccacaccgcccgatcccacccgtgtggaagcgcgcacgctgccgatgacggaggcgcagcggcaactgtgggtgctcgcccagatgaacgccggcggctccatctcctacaacctgtcgatgagcctgcggctcgaaggcgtgctccagcccgaggtgctccaacgtgccatccagcacgtcgtcgaccggcatgaagccctgcgcatccacatccacgagtccggcgagcagcagaccgcggccgcttcgctggcgctttccctggcgctgcacgacctctcccccctgcccgcgccggagcaggccgagcgcctctccgcctggtacgagcaggagaacaacacgccgttcgacctgcaccgcggtgcgcccttccgcggcccaacctgctngaaagctggggntggncccaaccaaggggnaaagnnccccaaatgtcttcgtcctcaccgcgcaccacgtcgcggtggacggctggtcgctgggtgtcatcgtccgcgagattgccgcgcgatacaccgagctccgagcaggcaagagcaccccgcctccacccgcgatgcagtggggcgagtacgtgcagtggctccagcagcaggccggaaccaaggagcagacggcccacgagcgcttctggctgagccggcgcgtggagacgctgcccgcgctggagctgcccatcgaccatggccgccccgcgcaccgcagctatcggggtgcccgggagacgctgcgactggaccgcgccaccacccagtccctgcgggaggcggcggcgcagcagcagtccacgctcttcatgctgctgctctccgtctacaccacgttcctccaccgccttacgggccaggatga

SEQ ID NO: 2893 - DNA, 900 bp, Myxococcus xanthus
atgacggcggtggtgctcctgctgggcacggcggcgctggcccagacgccggacacgaagcgttggaggcgtatcgagcgggccatggtcctgagcgcgagcgcgggtgagcccgtccagcgactcaggctggcgcccggcgtggtgacgacggtgctgctcgactcggacgccgtgctggaaggtgagctgcccgaggccctgcacgggctgttcacccggctggacgtcacggagacgcatctgctgctccagcccgccgtcgcgatgcccgcacggggcgttccgccgctggttctgcgcttcacggacgcagccgcgccacaacggctcgtcctggagctgaccaccgaggccaacgtggtggactcggtcatcgatgtcaggcgccaccccgccaccgtgacgcaactggaggctgaactggtggccctgcgtgagcgcaacgcactgctggaggcccggctggccactgcgcgtcggcaggtgccacacccgggcctcgcgggcgccattctctctggcgccatcggcatcacgggtgttctcggcacgtggatggataccccagccagcgaggcggagctcaaggtccgccagcttgatagctatcgctccggctcgtgggtagcgctcgcggtgaatctggagaacccgccgggcgaggcgccctggcaaccgggcattgcgcggctgacctcgctggactcgaacgggcggccaacaggcgagccgatggagctgcccctgttgctgcaggagccgcgtctgttgcctggtcagagcgcggtcgccgtcgtgcagtggcccgcccccacgcgccctccccccgcctacgcgctggagctttgggacacgggccggcgccgcggcgtgcgatgggcgcgactgaaaccgtag

SEQ ID NO: 2894 - DNA, 360 bp, Myxococcus xanthus
atgcgtcaactcgggctcgacctgaggtcccgcgggcacatccagctcgacatccagcagccggacgactcgaaccagacgaactacagcatcgtcgtcagtgacggccccatcaccagccggctcgatgggcccatcgaccgcctcccggccaacacgctcttgtacgggcgcatctggaccggcggcgagaaaatccagggccgctatacgcgagtgaggacgccggacggcagcgagtacccggtgtgcttcatcctgggcaacgagacgggcatgtccaagtaccggggctcacggcccggccacacccgcgcgcatccctggtccaacgcccaggtggtggaccacttcccctga

SEQ ID NO: 2895 - DNA, 384 bp, Myxococcus xanthus
atggtgtcggcgctcatcgcgcatggagcggtgcaggtgagcgcgcaggcgttggcttactgcgtggagaacgacatcggcgtgcactggttcacgtccggggggcgctacttggggggattgggtggtggggcgggcaacgtccaccggcggttgcggcagttcgaggcgctacggcaggcgtccgtgtgtctggggctcgctcgccgcttggtggcggcgaagctggaggggcagctccgcttcctgcttcgcgcctcgcgcggtgattcggagtcgcgtcaggtgctggcctcggcggtgcgggacctccgggcgttgctgccgaaatgcgaggaggcgccgtcgctggaggtgctcctggggttggagggcgcgggcgca

SEQ ID NO: 2896 - DNA, 288 bp, Myxococcus xanthus
atgagccttccctcgaggtcggtcgtcttccggctcacccaggaggccgcgccgcgcatcctgtatgccttcgagccgtcctcccgcgcggggggcgtggagctcgctgcgctgctgcgcaaggtgaagagcggcgacgtccccgcgaaggagttggtgttgggcgggcaggtggtggaggggctgggcgccgaggagcgcgaggtgctttcgggcgcggagctccacacgggcgtggtcgccgcctgccgcgcggcgtgcaagcggctggaggtgaggaagaagtga

SEQ ID NO: 2897 - DNA, 1554 bp, Myxococcus xanthus
atgacgccgctgctgcgcgcgggcgcgggcgggttggcggcatcgctccgcgccatcctcgggagcgcttcacccgccgcgccgtggccctctccggtgcggctggggcccgggacggcgacggtggagcaggaggccatccacctggactggggcggcaaggcaccggaggccacgctccgggcgctgttcggcgcgtcattccgggtgaagcagggcttcatcgacctgccgggcacgcgtccacccggagcgccggagccaccgcccgagttggccgccgcgctccacgacgcgctcaaggtgacgttcctccagcatggcaagtcgacgcagggaggcgcgcgaaggcgcgtcactttcgaggtggacgcgcggcccgtcatcgtcgagtcccagggctacgactccttcgtccaccagacggcctggcagagcgtgctcgaggcgctggaggtgggctcgacgtcgttggcgagctgggcctatccgggcgcggccgagcggcacatcggtgtgcgcgtcaccaaggtggaatacacggcggcggaggcgctctgcgcgtgcttcgcgctggtggggtgtgtttcctacaagctgccgcagctccggggcggggccttcgtggcgctggcgccgacgaacctggtccgcttcgcggagctgcgccctgggctgacgcccaagcggctccgtgacgtggcggtggcgggggcgtcggacgcggtgctcgcggctcagttggtgatggcgcaggaggcggggaagaagcggctgggggccgtgctggggaccaccgaggccgtggcgctgcggcagatgccatggaacgcgcagcagaagattcgcggcgcggtggtgcggcaggacgccgtgctcgaggaggtcctggaccgctacgaggccgccgccgccgcgctgccgcacacgctgcgagtccgcaagcccgagggcaaggcgacgggcgaggcgagctacttcatcgcgatcagtgcgctgcgcgccttcatcacggagaacctcgcggcttcacgcccctggtacgcggacttcgccaccgcgacgacggcggagggccgcttcattcacgactaccgcgaccgggacaacctgggcgcgctgctgtggcacgaaaggaagggactcatcgccatgcatccgtacctgggagaggccgagcagtggctcgtccagagcgttcacctcgcgctccggagccggttcaagagcatttatgcggacacgaaggagagcgccccggccacacgctccaaccggctcaagggtgagcgtgagcgattgcggctgagcttcgcgggggccaagacgccggagcaggtgcgcgcggcgctcgcggacctgtggagccgcgcgggcaccaaccgtgagctccaggagcattggcgggacatcctccaactgctggggcccgagcggtggcgcgcggcccgcgacctcgcgctggtggcgctggcgagctaccagggcaaggggggcgaggccgcggaacttgaggacgcggacgaggccgctggcgcgtccgagcagtcttga

SEQ ID NO: 2898 - DNA, 855 bp, Myxococcus xanthus
gacaagcgccggctcatcttctccctggtgctgacggccaccatcgcgctggcggaggcggtgggcggctggctgacgaactcgctggccctgatgtccgacgcgggccacatgctgacggacgtgtccgcgctggcgctgaacctggtggcgctgtggttcgcgggcaagccggcggacgtgaagaagacgtacggctactaccggatggagatcctcagcgcgctgctcaacggcgtgctgctgatgggcatcaccggcttcatcctctatgaggcctgggagcgggtgcgctcgccggcgcaagtgaacatcgggcccatggccatcgtggcgtcggtgggcctcttggccaacctgggcgcgctggggttcctgcaccgctcccactccatgaacgtgcgcggggccttcctgcacgtgctgggggatacgctgtcgtcggtgggcgtgctcgtgggcgcgggcatcatggcgtacacgggctggtacgtcgtggaccccatcatctcggtggtcatctccatcgtcatcgtcatcggcgcggtgcggctggtgcgcgacgcggtggacgtgctgatggaggcggttccggcgcacgtggacctggcgcaaatcaaggagctgatgctgcgcgcgcagggcgtcacggcggtgcatgacctgcacgtgtggaccatctccagcggcgtgtacgcgctgtccgcgcacctggtggtgcaggaccccatggtctgcaacaacgacgagattctctccgcggtgaagcacgacctgttcgaccgcttcggaatcgaccacaccacgattcaaatcgagagcgagacctactcccacctgggcgaggtccactga

SEQ ID NO: 2899 - DNA, 1449 bp, Myxococcus xanthus
ctcgcgggacacacaccgcgaccgttccaggaggaggtggctcgcagcgccgcgccgctgaccctggtccgcgcgggctgtggcagtggaaagacggccgctgcgtacctctgggccgcaagacagcacccaggccgtccgctgtggctcacataccccacgatgggcacggcgacggagggcttccgggactacctccacggcgcggacgtggaggcccgattgcagcactcacgcgcggaggtggacttcgacatcttcggactccgcgacggcgcggcgcctgggacgagctcccgcgaccaggaccggctcgacgcgctccgctcctggggcgccgatgcgatgagctgcacggccgacacggtgctcgggcttgtccagagccagcggcaggggctctatgcctggcccgggctctgtgcggcctgcgtcgtcttcgacgaagttcacgcctatgacgaccggctcttcggctgcctgctgcgcttcctggaagccctgccgggaatccccgcgttgctgatgaccgccagcctgcccgccacgcggctcgacgtgctgcgcggcatgtgcgagcgcgttcatggccggagcctcgcggaggtcgaagggccggaggatttggagacactgccgcgctatcagcggctggacgtcgcggagccgtgggccctcgtggcggagtgcctgcgggaccacggcaaggtgttgtgggtcagcaacacggtggatcgctgcatgcggaccgccgaggccggcacgtcgcacggtgcgcgtgcgctgttgtaccacagccgctttcgttacgaggaccgcgtccgtcgtcatggtgacgtcatcgaggccttcgccactgagggccgcgcggcgtttgcttcgacgacgcaggtcgcggagatgagcctggacctgtctgcggacctgctcgtcacggatttggcgcccatcccggcgctcatccagcgcttggggcgcctcaaccgccgcagcactctggagcggcccgcgccagtgcggcctttcgtggtgctccccttcgatgggccgccctacgccgcgccggacctgcgcgacgcgcgtgcatggatggagcggctgggaacggggccgctgagccagcgggacctggtggacgcatgggggccgcccgggatgatggatgcgccgcggcggcagtccagcacctggctggatggacgcttcgacacctggcccgctccgtgccgagacggaagccccagcctcacggtcctcttggaagaggacgcccgtgctgtcctggacggagcggtgagcgctcaccgggtcaccctgcccatgaacctgccacccgagtccttcaagtggcgtgcatggccccgcgcgggccggctgccataccccatccctccagcgaacgcgctggactacgacggcctgcgaggtgcgcgatggcgaaagccgtga

SEQ ID NO: 2900 - DNA, 612 bp, Myxococcus xanthus
atggtgtttgttgacctgctgttccccgtgcagggcggcccggtgccgctcgaccatgcctatctgctgttctccgcgctctcccgtcaccttcccgcgctgcatgagcgctcggatatgggcgtgttctcgcttcgaggtgtgagcaacacgcgggagttgctttacctggggcgaggcacgatgcgcctgcgatgccccattgaggccgtggccacgttgctgccgctggtgagcgcgccgctggagattgctgggagacgcctgtccctgggcgcgccctcgctccatgcgctggagcccgtgccctcattgttcgcgcggctggtcaccttcaagcacgcgatggacgaggccgcattcgtcgcggcggcctcccgcgcgctggaggcgcttggcgtccaggcgacgctgaaggtggggcgccggcgcatcgtgcgcataactggaaagaaggtcgtgggcttcgcgctcgaactccatggcttgtcggccgagcactcgctgcgcgtgcaggagcagggaatgggaggccgccgtcacatgggatgtggcctcttcctcccgcccggccgggcggcgcgtgtccagtcccatgggaaggccgcgtga

SEQ ID NO: 2901 - DNA, 1281 bp, Myxococcus xanthus
atgcaggtgaagtggcacgtcgaccaccgggatagctactccctggcggggctggtgacgccgcctcgggtgggccgctcgctgctgcggaagctgctggagagctggttggtgctgcggcccctggggcccgtcgaaatctggctgttgagcaactgggcgtcggcggcggacctgggccgctatctacatggccgggaccactgcttcaccgaggcgttcttcgagcagccgccacgaggcgccctgaagaaacactgggcggagtgggaacaacggctcggtgtatcggctgagatgctgcgggcgttctgcaaggacttgcgcttgcggctcggcgtgggcggcatcgccgacttggaagagcaggtggatgaccggatggggcggcttggcctgcgcatgggacggcagccgcgcgccatcgcggtggacgggcttcgggagtggattgaggtcggcggcggcaggaagcacgtcaccccggagtcgctgcggggggccattcgcgcgtggggactgctggcctcacgggaggacgcgcccgccgtgagcctctggattcatgggtgggcgcgacgtgagtgggagcagcctcccaccgaggagctggactggacgcctcacttcgaccgcgacacgcggaaggtgccgtcggagtcggtgtggcgggacgtgttgctgccttcgctgctggctgtgcgacagcggctatcgaggcggcctgacggcgcgttgattgacctgcggggcaagctgccgctgagcacggtgctggcggtgggctttcacttcccggaggtgggcggctaccgcttccgcgtcgagcagcccacgcaaggagagaccttcttgtggcgctcggacgcgaagccgtctccgcgccgactgcgtgtcacggggcacgagggtgactcggacgctgcggggctgctggtggtgttccagatgaccggggatgctcgcgcggacgtagagcgcttcctggccgagcggccagggcacttccgcgccgtgctctacctggagccggaggacgggccccacgacggcgccgttggctcggatgcggacgcggaggcgttcgccgtccaggcgcgtgagcaactccggcgcgcgcgcaacgagctgcgcacggcggtcacacatctcatcctctatgcccccgctgcgtgctgcctgttcctgggccagcggctcaacgccgtgggcccggtcgtggcctacgagcgcaccggctcaggtgggtacgcgcccgcgctcacgttgcagacggggtga

SEQ ID NO: 2902 - DNA, 906 bp, Myxococcus xanthus
tggctgtccgcccaccgggtgccccgagcgctcgcgacggtgctggcgctgctggtgctgctcctggtgggggcggccggggtgttcctgctcgtgccccgcatcgtccagcaggtcggcgcggcgggctcgaacgtgaaggagggaatggagggcctcgtcgggtggatgacgcaggaactccccgtgtcccgggagcagatcgacggcctgttcgagaaggggctcgacttcttgaagtcgaacctggggcgcatcaccaccggcgtcctcgcgggcgccaacttcgccgcgcaggccgtggcgggcgggctgctgacagtgacgctgctgttcttcttcgtgaaggacaccgagcggctcggaggctgggtgctggcccgggtgtctccgtcgcggcgtgacacggtgcgcgccgtgggcctgcgcgcctggggaacgctcagcggctacctgcgtggcgtcgtcatcgtcgcgctggtggacgcggtgggcattggcgcgggcctggccatcatcggcgtgccgctcgtgcttccgctggcggcgctcaccttcgtgggcgggttctttcccgtcattggcgccaccctggcgggcgtggtcgcggtgctggtggcgctcatcaccaacgggccgctcgatgcgctcctggtattggccgtggtgctgggcgtgcagcaactggagagcaacgtcctggagcccgtggtgatggggcgcgcggtgccgctgcacccggtggtcatcctgctgtccatcaccgccgggggcgtgctcttcggcgtggccggggccttcctctccgtgcccgtcgccgcggtcctctccgccgcgggcaacgagctgcgcctgcgcgacgaggcgcgcgtcctggagaagcctacggcgagttcaccgccgtga

SEQ ID NO: 2903 - DNA, 903 bp, Myxococcus xanthus
atgaaaggcatcaagttcggcggcttcaagagcccctccatccccaagagcagcgggccgaacaagccgagcgcccctccgcccgtggagtcgaagcctgcgtccaagccgagccccgtcaaggacgggttcgacgcgcagggcagcaagccctccacgagcacggtgaacccccagcccacgcggcagccgggcaaggacgtcacttcgtcgttcggtgcgaacccgctgggctactcggggcagaacgtcctgaacgcctacaacatgtccccaagcggcgcgctccagggcgtggccctccccaccgcccagaagcccttcgtcaacgccagtgacgcggtggtgaccctcaatgcccaccagcaccagggcaacacgaacctgtccgtctcgcccgccggtggccagggcatcccggcgcactacatgcactacctctccacgggcgagggcaagttcgcgggcatccagggggtgccgctgcatccgcgtcctggggagccgcacacggtggtgacgggcgcgctcaacggttgcgccatccatgccctgcacgacacgaagaacaacagcctgtcctttctccaccacgcggactactcgaagaacggcaaggcggagctggacggcttcctctcgcagcacccgaacctcaagccggcggggagcttcacgcccagcgactattcgcaccctaccggcaagtacaacgacccgacgggcgccacgcccttcatccactactcccagggggccggaaaccggccggggcagtggaccatcgccggtcagctcaacaccttcaagagtggtggcgccgagggtggccgccccgcgctgatgcgccccacggacctccaggtgcccctcatgcagaccatcccggtggacgtgccttga

SEQ ID NO: 2904 - DNA, 123 bp, Myxococcus xanthus
atgatgaacgccgagtacgagctgaagtacaccgtcctggtcggtgacaagaagagcgacaaggccttggaggacacctacgcggcgaccctgaagaagatctgcatccgtaagtccagttga

SEQ ID NO: 2905 - DNA, 1086 bp, Myxococcus xanthus
atgagctaccgggagttctggggctggacgtccgcgccgaagcggccgccgcccgagcatggcatcaaggtgaagaaggctggtgccacctggtgggggcagcggtggctggaggcgctcgagcacgtcctgaagggagagtcgggacggctggcccggggccggacgtatgcgcgggcggggcgcacgcatgacctggtcatccggcgcggcaaggtcaccgcgcgggtgacgggctcgcgcccgacgccctacgccgtctcgctggcgctcaggccgcacggcgaggccgtctgggagaaggccatcgcggagatggctggcagggcgcagtacacggcggagttgctcgctgggacgatgccccaggccatcgacgaggtcttccgcgcggcgggtgtcagcctcttcccgcggagccgcgaggaactcgtgacggactgctcgtgtccggactggggagacccgtgcaagcacgtcgccgccacgcactacgtcctgggcgaggcgttggatcgcgacccgttcctcctgttcgagctgcgcggccggacgaaggagcaggtgctgagcgcgctgcgggccgcgcgtgaggctggctcagccggggcggcgctcgagccgcgcggcgcggcgaagcggaagcgggcggcgcggggcgcgacggcggaggcgcccgaggtcccgagcgtgaagccgggcaagctgacgcgggacagctacgacgtccctcgcgagccgctgccggcgctgagcttctcgttcgacgcgcccgccacccatggcgcggtgctgcggcagttgggggcgccggcgtcatggggcgcgaaggcctcgccggaggacgtgctcgcgccgccggtccgcgcggcggcggaggtggcgcggcgcatcgcgcttcgggagccgggggaggcgagcgcgccagacagggcgccgcgtggccggagccgcgcgaagcagccggcccggcgcgcgaagcgtgggcccccaacgcagccgtctcagcagcctctccacactccctcaacatctcgacgcgatggtggggccaggtcgaaacggtcgcccgtgggggcgccgtaa

SEQ ID NO: 2906 - DNA, 1539 bp, Myxococcus xanthus
  unsure (1)..(1539): unsure at all n locations
gccccccgcgcgctgcgcgccacgntgcggccctaccagtcgcgcggtctgcactggctggacacgctggcctcattggggctcggcgcctgcctcgcggacgacatgggcctgggcaagacggtgcaggtgctggccttcctgctgcggcggctcgagcaggcgcctgacgaggcgcgccccacgctgctggtggcccccacctccgtggtgggcaactgggagcgtgagctcgcccgcttcgcccccaccttgcgcctgacgcggcactacggcgccgagcgcgcccgcgcggcgaaccgcttcccccgcgcgcccggcgccgtcgtgctcaccacctacggcttgctgcgccgggacgccgcgctgctcgcgcgcgtggactggggcgcggtggtgctcgacgaggcgcagaacatcaagaacgcggcgtcggctaccgcccgcgcggcccgggcgttgcgcgccagccagcgcttcgcgctcacgggcacgccggtggagaaccgcctggcggagctgtggtccatcctcgagttcgccaacccgggcctgctcgggccgctggagacgttccggcgggagctggcgctgcccattgaacgccatggcaatcaggaggcctcggcccggctgcgccggctcgtgagccccttcgtcctgcgccgcctcaagagcgacccgaccatcatcacggacctgcccgcgaagaatgagatgaaggtcgtctgcacgctcacgcgcgagcaggcctcgctctacaaggcggtggtggacgaggagctgcggcgcatcgaggaggccgacggcatggagcgccggggccgcgtgctcgcgctgctgctgtacacgaagcagatcgccaaccacccggcgcagtacctcggggagtccgggcccctgccggggcgctcggggaagctggcgcgcgtggtggagatgctcgaggagtccctggccgctggcgacaaggcgctcgtcttcacgcagttccgggagatgggcgacaagctggtggcgcacctgtcggagtacctgggccacgaggtgctcttcctccacggcggcacgccccgcaaggcgcgcgacgagatggtgcggcgcttccaggaggacgtccacggtccgcgtgtgttcgtgctgtccgtcaaggcgggaggcacggggctcaacctgacggcggcgagccatgtgttccattacgaccgctggtggaacccggccgtcgaggaccaggccaccgaccgcgcgtaccgcatcgggcagacgcgcgcggtgcaggtccacaagctggtgtgtgcgggcactgtcgaggagaaggtggaccggctgctcgaacagaagcgccagctcgccgagaaggtcgtgggcgcgggcgagcactgggtgaccgagctggacacgacggcgctgcgcgagctgttctcgctgtccgagggcgccgtggcggacgatggcgacgcggaaggggaagacgacgcgcgggtgcgcgccccgcgacggcgcggccgtgcgagcgcgaaggcggtgtcgcgatga

SEQ ID NO: 2907 - DNA, 633 bp, Myxococcus xanthus
ttcgagggcgacaacacggtgctgatgcagttggtcgccaagggcctgctcaccggctaccggcagcgcttcgaggacgaccgcgtcttcgccgtgctgaagctgctggcggaccgggccaccgccgtggtggaccgcaaccccttcgccgcgcggcgcaccgacagcgaccacctgcgcgacaacgactaccacctgcgcgcgctgcgcttccgcgaggaggagctgctggccaccgtgtccaagcgcatccgcaagcggctgagcgcgggcgtggaggccttcgaggcgttcaaccaggtccaggtccacctgctggagctggcgcacgcccacgtggagcggctggtgctggagcagttcctcaagggcgtggcggacgtgaaggaccccggattgaagacggtgctggggcgcctgtgcgacctctacggactgtcctgcctggagtccgccaacggctggttccaggagcacgggtggctggagggcaccaaggtgaaggccatccgcaaggaggtgacgcggctgtgcgccgagctccgcccggacgcggtggcgctggtgaacgcctttggagtaccggacacctgcctcgccgcgcccattggattgggccacctgtcgccatga

SEQ ID NO: 2908 - DNA, 486 bp, Myxococcus xanthus
atgacacgacacacgacgattctgatgtgcgccctcgggtggctgtcgggctgcgccacgatgtctcccgtggagcgcgcggccgccctggaggcccagaacaaacagcgggtgcggcagctcaccgaggagctctacaacctgcgcatgctggaccgcatcccggagttcatcgccgaggacttcgtggaccgctcccaggacgcgcccctcaacgccgtggggcccgccttcatccgtcagcaggcggaggccagcttcaaaacgttccccgagctgaagttcgacatcctccacctggtggcggacggcgacctggtgctcgcgcactggaaggccaccgcaccggccccccagcccctcctgctgcaagggcactccctgtaccggctgcgcgacggcaaggtggtggagtcctgggacatctccgaccgcctgtcgccgctgcttcagcgcggctacaaggtggtgccgcccacgctgtag

SEQ ID NO: 2909 - DNA, 249 bp, Myxococcus xanthus
atggaccggctgttcctcacgcccaaggtcgtggcgggctacacgcggctggatccagcgcccgtggaccccgacgagggcgacccgggacgcgccgtcaacgcgcccaacgcgggcctgggcttcggcgtggagtacgccacgggcatggaccacttctccgtcggcgcggacctgctggcccgctacatcatcgggcccaacatcacctccttcgccatcttcccgaaggtgaagtacacgttctga

SEQ ID NO: 2910 - DNA, 1437 bp, Myxococcus xanthus
atgacttcacgactccggctgctgccgctgctggccctgctctcgctgacaacctgcgtgcgcaaccccgccaccggcaagcgcatgctgtcgctcgtctcccaacaggacgagattgccctgggcaagcagagcgcggaggaggtgcgcgggtccattggcctcatccaggagcccaaggttcaggaatacgtcgcccgggtgggcctgcccatggcgaaggcctccgaacggccggagctgccctggacgatccaagccgtggatgacccggtggtgaacgccttcgccctccccggagggcccgtgttcgtgacacgaggcctgctcaccgcgatgaactccgaggcggagctggcctccgtgctggggcacgaaatcgcccacatcaccgcacggcactccgtggaacagatgtcccaggcgcagctcgcccaggcgggcctgctgctgggcagcgtgctcagcgaggacgtggcccgcttcgggggcctggccgccgccgggctccagttgctgttcctcaagtacggccgcgacgacgagcgccaggcggacgaactgggcttcaagtacatgctgaaaggcggctacgacgtgcgccaggcggccaacgtcttcgccaccctggaccgcgtgggcaaggccgcgggcggacagagcctccccacgtggctgtccacccaccccgacccgggcgaccgcgtgaagacagcgaaggagcgcgccgcgaaagccaacgtggacttcaaccaactcaaggatggccgggaggaatacctcgccatgctccagggcatggcctacggcgacgacccgcggcagggcttcttccggggcaacgtcttcatgcacccgggactgcgcttccagctcaccttcccccagggttggaagacggcgaaccagccgcagcaggtggcgggcatcagcccgcaggaggacgccatcgtcgggctggtgcccatcggcaacatcgcgccgcaggaggcgatgcggcgcttcctcgcgcaggaaggcatccagccggtgagcgcggcgcccacgggattcccgcagggcaccgcgttcttccaggcgcagacggagcagggcgtcatcgccggcgtcacggccttcgtgtcccagggcggcaccacgctgcagctcctgggttacaccggcgcgcagcagcttcccgcctacgaggacgccttccgcgccaccttctccagcttcggcgagctgacggatgcgtcggcgctggccgtccagcccgcacggattgaactggcgaaggtgacgtcacccatgacgttgcagcagttcaacgagcagcacccgtccaccatccccgtggaggagctgtccatcatcaacggcgtgcagcccggtgacacgcttcccgcgggccgcacggtgaaacgagtgacgggcggggtgcggtccacgcactga

SEQ ID NO: 2911 - DNA, 468 bp, Myxococcus xanthus
atgagcggaatgagccaccacgaacgcgagcggttggcgacggcctacgcggcgacgcgctacatcatccggccccattccagcacgggtggtgtcgagcaaatcctgcgggcgggcgccttgcacccggcgctggacgcaacgcttgcggcgcgcggccaccgcgagtgggccttcctgacggcgtggaatcccggctcgcagtggcggagcggcgaggagaaccgccgcgcgcaggagcgcatggtcgcgcagctcgtcgccgggggttggggggccgcccccgcgctgggcgaggcggatgacggcagttggtgcgagcagagcctcttcgtccccgggcttccccgcgaggaggccggacgcttcggccgcgcctacggaaaggtcgccgtgctcgtgggacgcacgggaggccaggcggagctgctgttctgcgaggaagcccgcgcctcacccgccccgtga

SEQ ID NO: 2912 - DNA, 1626 bp, Myxococcus xanthus
atgtcggaccaagccccctctgtgaaacccccggcgttcggaccgggagtggtggtgaaggggacctggcaccccgactacgccgaggtcctcacgcccgaggccctggaattcgtggcgaagctggcccgcaacttcggcgagcgccggctggccctgctggagcgccgcaagacggtgcaggcggcctggagcaagggagcgcggccccacttcctgccggagacgaaggccgtccgggagggcgactggacggtggctcccctgcccgccgaccttcaggaccgccgcgtggagatcaccggcccggtggaccggaagatggtcatcaacgcgctgaactccggggcgaatgtcttcatggcggacttcgaggacgccaacagccccacctgggacaacgtggtgcgcgggcaaatcaacctgcgcgacgccgtgcgcggcaccatctccttcacggcggagaacgggaagcactacgccctcaacccgaagcgcgccgtgctcttcgtgcgcccccgcggctggcacctgccggagcggcacatcgaaatcgacggcaagcccatctccggctcgctgctcgatttcgggctcttcttcttccacaacgcccgtgagcaactggcccgcggcaccggcccctacttctacctgccgaagatgcagagccacctggaggcccggctgtggaacgacgtgttccacctggcccaagcggagctgggcatcccgcgcggcaccatcaaggccactgtcctcatcgagacgctgcccgccgcgttcgagatggacgaaatcctctacgagctgcgcgagcactccgccggcctcaactgcggccgctgggaatacatcttcagcttcatcaagacgctccagtcggacacccgtgtggtgctgcccgaccccggccaggtggctatggacaaggcgttcctggacgcctactcgcaagtgctcatccagacctgccaccgccgcaacgtgcacgccatgggcggcatggcggccttcatccccatcaagggggacgcggcggccaacgacgccgtcatggacaaggtccgcgcggacaagctgcgcgaggtgaagaacggccacgacgggacgtgggtggcgcaccccggcctcgttgaaatcgcgcgcgacatcttcgactcgcacatgaagggccccaaccagctctccaacaagcgcgaggacgtgaagattggcgaggcggagctgctcaaggtgccgtccggcacgcgcaccgaggaaggcctgcgccacaacatccgcgtgggcatccagtacaccgccgcgtggctgggcggcctgggctgcgtgccgctctacaacctgatggaggacgcggccaccgccgaaatctcacgcgcccaggtatggcagtggatccaccacggcgcctccctggaggacggccgcaaggtgacgctcaccctcttccgcgacgcgctgggcgaggagatgggccgcctcgagaaggaaggcgccaaggagcgctacggcgccgcccacctggagcgcgcacgcgtcctcttcgagcagctctccaccgccggcaccttcgaggacttcctcaccctgccggcctacgacgccttggaagcccaacgctga

SEQ ID NO: 2913 - DNA, 1287 bp, Myxococcus xanthus
atgtacgacgccacgccgacgaccgccgatacctcccctcacgccaagctccacgctcagcgtttcgagggcatcaagcgcaactacaccccgaaggacgtggagaagctccgcggctccatcaccgtcagccacacgctggcggagctgggcgccaagaagctctgggagctgctccacaccgaggactacatcaacgcgctcggctcgctcaccggcaaccaggccgtgcagatggtgcgcgcgggcctgaaggccatctacctgtccggctggcaggtggcggcggacgcgaactccgccgggcagatgtacccggaccagagcctctacccggtggacagcgtccccaccgtggtccgcaaaatcaacaacgccctgcgccgcgcggaccagattgaccacgccgaaggccgcaaggaccgctactggttcgcgcccatcatcgccgacgccgaggccggcttcggtggcccgctcaacgccttcgagctgatgaagggcatgattgaagcgggcgccgcgggcgtgcacttcgaggaccagctggccagcgagaagaagtgcggccacatgggcggcaaggtgctggtgcccaccagccacttcatccgcaccctcaacgcggcccggctcgcggcggacgtcatgggcgtgcccaccctgctggtggcgcgcacggacgcggacagcgccaagctgctgatgagcgacgcggacgagtacgaccacgccttcatcgacaagaagtccggccgcaccccggaaggcttctaccgcctcaacggcggcctggactgcgccatcgcccgcggcctggcgtacgcgccgtacgcggacctggtgtggtgcgagacgagcaccccggacctggcccaggcgaagaagttcgccgagtccatccgcgcgaagtacccgaacaagcttttggcctacaactgctcgccgtccttcaactggaagaagaacctggacgacgccaccatcgcgaagttccagcgcgagctgggcgccatgggctacaagttccagttcgtcaccctggccggcttccacgcgctcaacttcgggatgtacgagctggcgcggaagtacaaggaccgtggcatggcggcctacagcgagctgcagcaggccgagttcgcggcggagaaggacggctacaccgccacccgccaccagcgcgaggtgggcaccggctacttcgaccaggtggccgaggccatctgcggcggcaacgccagcacgctcgccctgacggagtccaccgaggcccaccagttctag

SEQ ID NO: 2914 - DNA, 408 bp, Myxococcus xanthus
atgacccgcatcaactccttcaccggtccgatgattcagcccgccaccacgcaggcgcaggcccgcgccgcgagcacgagctttggcgcgctggtgaacccgatggcccctgccaaccggcctggggacccgctgatggtatcggggggcgcggtggtcgcctcggcgctcgcctcggtgggcagctcgccgaacaacggcatcctgaactcctacctgtccgccgtgggccgcgggcccatctccgaggacggctcgcggggctcggtgtcccaggctccggccggctcggagcaggcgcagcaggagcaggtcctgatggagctggcggagatgtccgccgcgacgctgtcgaactccatcctgcacatgggcaacaagatgaaggtggacctcgaccgggagtaa

SEQ ID NO: 2915 - DNA, 849 bp, Myxococcus xanthus
atgcttgtcctgcgtgacgtccagaagaccgacctgcccgggctcaaaaggctcgcggccgtgctgaacacggtgaacctgccgaacaacgaggaaacgctgtcggccatcgtggacacgtcggtgaagagcttcgcgggcaaggtgaagaaccccttcgagcgcgagtacctcttcgtgctcgaagacgtgcgcaacagcctcatcatcggcacgtcgatgatcatcgcgcagcacggcacctatgaggctccgcacatctattacgaggtgagcgagcgcgagcactactccgcgtccctctcccgtcaccttcgccacaaggtcctctccatcgcctacaactacgagggccccaccgaggtgggcggcctcgtcgtggacccgccctaccgcgccacgccggacaagcccggcaagcagctgtcctacgggcgcttcctcttcatcgccatgcaccggcggctcttccgccctcgcgtgctggcggagctgctgccgccgctgctgccggacggccgcagcctcttgtgggaggcctgcggcaagaagttcaccggcctcacctaccaggaggcggaccgcctcagccggcagaacaaggagttcatcaaggagctcttccccgcctcggacatctacgcgtcgctcttccccgcgcgcgtacagaaggtcctgggcgaggtgggcccgcagacgcgcggcgtgcagcgcatgctggagcgcatcggcttcaagtacatggagcgcatcgacccgttcgacggcggtccccacttcgaggccgacaccgccgacatctccctggtgcgcaagttccgtacgctcaaggtggcggaggaggacttc

SEQ ID NO: 2916 - DNA, 627 bp, Myxococcus xanthus
atggattcggattcgctcgaagcacggatggcgcggctggagcgcagttgccggcggtggcagggactgacgttcaccgcgctcgcgttggcgggactggggctgggtgcggcggcgctccggggcgaagacgtgtcctccgggacgctggtggcctcccggctggtgctcacggacgcgcgcgggcagacacgggccacgctggataccgatgaccagggcaacgcgggcctggtgctgcgcgacggcgagggccggccccgggcgctcctgggcgtgggcgaggacggctcgccccggctgcgcttctccaccgccgagggccagtccctggcggagctgatggtgtactccgacgaggcgccacgcctgacgctgtccacgcccggcggcggggagttgttcgcggtgggccttcaggtggatggctcgtcgcggctggagctgtcggacgcggacggacggccccgggccatcctgggtgcggacgagcatggctctcccggtctggtgctgagggaccgcaaggggctgccacgcgtggcgctccgggtgtcgccgtcggatggcgccagcctggtggtggaaggccaggacggcgcggtgttccgcgcgcccggcggctga

SEQ ID NO: 2917 - DNA, 357 bp, Myxococcus xanthus
atggcctgcgcgacggggcccaccggccgcccccccgcccctcccagctcggccgccgtgcagacggagctgggcgctcgggacgtggtccaggccggcgaggaatacgcccgcaacaactcattggtgctggccgaggccggggaggcggtggagatccgccccaacttctggcgcatccgctttggcctcgcggaccgacccggccgcgtgctggaggtcgagttcgatgagctggcgcggagggtcgtcaatgcccgcgagctggaagtcatcccggagaatccgggggactccgccctgggcggcagcggccccgtgccggcggcggggcagccccgaggccccattccctga

SEQ ID NO: 2918 - DNA, 612 bp, Myxococcus xanthus
atgaacgtccccttcgtcatcgagaccacgcaccgcggagagcgggcgtacgacctgtacagccggctcctcaaggaccgcatcatcatgctgggcacgcctgtcaatgacgacgtggccaacatcatcgttgcccagctcctcttcctggagtcggaggacccggacaagggcatcaacctctacatcaactcgccgggtggctccgtgacggcgggcctcgccatctacgacaccatgcagtacgtgaagtgtccggtgtccaccatctgtgtggggcaggcggcctccatgggcgcgctactgctgctggcgggggcgaagggcaagcgctacgccctgcccaacagccgcatcatgattcaccagccgctgggcggcgcgcagggccaggccacggacatcgacatccaggccaaggaaatcctccgcctgcgcagctacatcaacggcctcatcgtgaagcacacggggcacaccatcgagcgcatcgagaaggacaccgagcgcgactacttcatgagcgccgaggacgcgcggcagtacggcctcatcgacgaggtggtggagaagcagcgcgtcatcgccccgacgcccgctccggcgaagtag

SEQ ID NO: 2919 - DNA, 1401 bp, Myxococcus xanthus
gtgagcacgaagaacgtccgtaccgagaaagacaccttcggtcccatcgacgtccccgccgaccggctgtggggcgcgcagacgcagcgcagcctccagaacttcgccatctccaccgagcgcatgccgctggccctcatccgcgccctggtgctggtgaagaaggccgccgcgcgggtgaacgtggagaacggctcgctggcgaaggagaagggcgaggccatcatccgggccgcggacgaggtgctggccggccagcacgacgcggagttccccttgagcgtctggcagacgggcagcgggacgcagacgaacatgaacacgaacgaggtgctcgccaaccgcgcctcggagctgctgggcggcgagcgcggcgagcgccgcaaggtccaccccaacgacgacgtcaacaaggggcagagctccaacgacgtcttccccaccgcgatgagcgtggccgccgtggccgccatcaccgagcacgtgctgccggagctgaaggcgctgcgcgacgtgctcgcgcagaaggcccgcgccttccatgacgtggtgaaggtgggccgcacccacctgcaggacgccacgcccctgacgctggggcaggaggtcggcggcttcgtggcgcagttggaccacgcgaagggccacctggagcgcaccctgccgcatcttctggagctggccctgggcggcacggcggtgggcaccggcctcaacgcccccaagggctatgccgagcgggtggcgcaggagctggcccagctcaccggccaccccttcgtcaccgcgcccaacaagttcgaggcgctggccgccaacgacgcgctggtgcaggcgcacggggcgctgaaggggctggcggcggtgctcttcaaggtggccaacgacgtgcgctggctgtcctcggggccgcgctcggggctggcggaaatcaccatcccggagaacgagccgggcagctccatcatgccgggcaaggtgaaccccacccagagcgaggcgctcaccatgctgtgcgcccaggtgatggggaacgacgtcgccgtcaccgtgggtggggcgtccggcaacttccagctcaacgtcttcaagccgctcatcgcccacaacctgctccagagctgccggttgctggcggatggcatgcgcagcttccgcctgcactgcgcggtgggcatcgagcccaaccggccccgcatccaggagaacctggagcgcagcctgatgctcgtcacggcgctcaacccccacatcggctacgacaacgcggcgaaaatcgccaagacggcccacagggacggcacgacgctcaaggagacggccgtggcgctggggctcgtcacccccgagcagttcgaccagtgggtccgcccggaggacatgacgggccacaaggggtag

SEQ ID NO: 2920 - DNA, 222 bp, Myxococcus xanthus
atggtgaagaccgaagacctgattgacgctcaggcggtggccgggttgctgcgcctgcgccacgccaacagcgtcagcacctacctgcgccgctatcccgacatgccccggcccgtcctggacctgggcacggggcggccccggctttggcttcgtccccaggtggtgcgctggatgcgcgcccgtaagcccgagcagctccgcgctggaggtgagtcatga

SEQ ID NO: 2921 - DNA, 264 bp, Myxococcus xanthus
atggagctgctggctcgggaggcccaggaagcattgcggcagcgcagccatcggctgcgcgctcgggcctcgttgggggtggggggcctgtccttcacccaggcggaggcgcaggagctgcgggacatcgaggaggcgctgacgcgcatcgctcatggtgagttcggccggtgcgcgcgctgcggcggggccattggccggcaccggctgcgcgctgttccagaggcccggcattgcctgacgtgtgccgccctggcgcgctga

SEQ ID NO: 2922 - DNA, 606 bp, Myxococcus xanthus
atgctcgcgcaccacaacacccagctcgttgcattgagccccgcgccgtcgaccctcgccgagggcgccacgccaccgtggccgcctccaccgctgcgcgttcagccgaagccgcccgcgcattatcaagggaccacgaacaccatcatcatcggcatcggccttccgttactgggcgcctacgccctctacgaaaacgagcgcgccgtggccatggtgggcttcatcggtggactggtggcgtggatcttcgccgcgctccggttcagccaggagggcaaagcccgccagcacaaccaggccgaacacgctgagcacgtgcgccgcgccatcctgacgtgggcgcgcatcacggattcggccatcgtggagcaggtgccggacagcgacggccgcagcacccactacctgctcgacctccacgtcaccccgtggcacccgtcccacccagcgccgcgaaaggtgcccctccggttgagagtcccggtggcgcacggcccccatgtggtgccgggcgcgtacctcggcgtgctctccgacccggaggcggcatgggtcgtcccgcagagcctcctcaccctgcagggcgcgcagctccccctctga

SEQ ID NO: 2923 - DNA, 642 bp, Myxococcus xanthus
atgtcgtggagtggtgcggtcctgtccgcctgtgtgctggggctcaccgccggagcagcccgcgcggaagaggcgtggaagacggtggcggagaagccttacgtggtgaaggtccgcgcgcgcccgggctccgaggccaaggacgtgtgggcggagggcgagctggccgcgagcgccgcggatgtccagtcggtgctgcgggacgtggacgcctaccggcactggatgccgtatgtgaaggagtctcgcatcctgaaggacctgccggacgaggggcagctcacgtacacgaagctggacctgccggtggtgtcctcgcgcgactacatctgcagcgtggtgttggagtccaggctggcggaggacggctcgggtgtgttcgcgcagcgctggcaggcgacgccggacgccattccccagcggcgcggcaccgttcgcatccggctcaacgagggaagctggcgcgtggagcctcgaggcgaaggaaagtcccatgccgtgtaccgcttcaccgtggacccggccggctccattcctggcttcctggcgcgcatggggcagaaggacgccgtggaggacacgttccgcgcggtggagaagcgtgcccgggaacacgccgcatcccgggcacgagcggaatga

SEQ ID NO: 2924 - DNA, 204 bp, Myxococcus xanthus
atgtaccggctggtgcgctcggcggagggggcgctcttccttgacgtggtggtggggggcatcgcccagttcacggtgcgcgtggtcctcaccgagcaggaagccgaggcctacggccggctgggccgcccctatgcggaccgtctggcaatggatgtcatggccagcccggcgttcggcgggcgggccgtccgcgtgccgtag

SEQ ID NO: 2925 - DNA, 621 bp, Myxococcus xanthus
atgacgtggacgattcggagcctgctcctcggtgtcttcctgctgtccggctgcaagcacacgggtggcggcagcgtcacccccaccccgacgcagccgcaggcttgtgatgcgcagcaggcgcaaatctcccgcgaggccgatgagcgcgccagcccgtggagcgtggagcagcacctggcgaagaacttccctggcaagaaggtgtcgtggctgatgacggacgccgcgtaccagaacttcgtggtgaagccgaacgcgcagaactttggccgctgcaatgacagcgtttgctatctgttcgccgcgccgtcggagaccatccaggccgccgtcgagaagtcgatggtgaacggcgcgcatgacccggcggtgattggccaggcgctgggcctgccggcgaagaacttcgaaggcccgctgcggatgatgacgctggacctggcggccaccggcgtgtgcgtgcgcctgcccgtggacagcgacccgggcgtctggaagtgcaccagcgaggaggacacggactgcttcaagttcggtggctacacctctggcggcgtgccggagctgatggtcatcgacgcgcccgtctcccacgcggtggtgacggagattccgtga

SEQ ID NO: 2926 - DNA, 366 bp, Myxococcus xanthus
ctggacggccccacgccgtacaccttctacaagtggcagctctccccgcgcaccgtgcgcccggtgggcgaggtggccgcgtccaactggcaccgcttcggcgatgaggaggcggacgagctgctgacgcgcttcgagcgcacggacgccgaggacgcgcagcgcgcgctgatggcggcggtgcagcggcgctactccgagctggcgccgtccatccccctcttccccaacccgtcctggggcgagtccaactcgcggcgcttcaccggctttcccaccgagcagaacccctacgcgcgcctgtcccctcatgccgagcccgacagcctgctggtgctgacgtcgctcgcccccagggagccctga

SEQ ID NO: 2927 - DNA, 981 bp, Myxococcus xanthus
atggcctacgtcctgcggaggttgggcttctacctgctggcggcctgggcgtcgctgacgctcaacttcatcatcccccggctggcacccggtgacccggcgtccgccatgttcgcgcgcttcgagggccgcgtgcagcccgaggccatggtggcgctgcgtgccgccttcggcttcacggaggcgccctggtacgtgcagtacgccacgtacctgaagcacctgctgcgcggcgacctgggcctgtcctacgcgtactacccggcgcgcgtgtccgaggtgattggcaccggcctgctgtggacgctggggctggccgggtgcgcggtcatcatcagcttcacggtgggctccttgctgggcgtgctggccgcgtggaaccgcggcgggtggctggacgcgacggtgacgccggcgctcgccttcctgggggccttcccctacttctggctggccatgctggccctgtacctcttcgggttcgggctcggctggttcccgctgcggcacgcgtactcgcacgacctggagccggcgctgtccttcaccttcgcggcggacgtggcgcgtcacgccttcctgcccgcggcctccatcgtcgtggccacgctgggtggatggatgctgagcatgcgcaacaccatggtggccacgctgggcacggacacgctccggctggcgcacgcgaagggactcccgccccggcaggtgatgctgcgctacgccgcgcgcaacgcgctgctgcccaacgtcacgggcttcggcatggcgctgggcttcgtgctgagcggctcgctgctgacggagattgtcttctcgtacccgggcaccggctacctgctcatcctggccgtgcgcaatcaggactaccccctgatgcaggggctcttcctgaccatcaccttcgccgtgctcgccgcgaacttcgccgtggacctgctgtgtctgtggttggacccgaggacccgcgcccatgcgtga

SEQ ID NO: 2928 - DNA, 1761 bp, Myxococcus xanthus
atgcgtgaccttcttcgacggctgctgcgccaacgcaaggcggcggtgggcgggagcatcctgctgggcttcatcgtgctcgcgctcatcgggccctggctggtgatggaccccacggagctggtgggccgtccccaccagccgccctcctccgcgcactggttcggcaccacgggccagggccaggacgtgctggcgcagacggtggtgggcgcgcgagagacgctggccatcggcttcgcggtgggcgctctcgtcacgctcatgggcgcgctcatcggcgtgacgtccgggtacctgggccgccgcgtggatgacgtgctgacgctcactaccaacgtcttcctcgtcatccccggcctgccgctggccatcgtcctgggcgcctacctgccctccggccccttccgcatggtggtggtgctgtcgctggccggctgggcctggaacgcgcgtgtcttccgcgccgaggccatggccctgcgcaaccgggacttcgtctccgccgcgttcgtcgcgggggagagccgctcgcgcatcgtcgtccgggagctgctgcccaacatggcgtcgctgctgggctcgtcgttcattggcaacacgctgtacgcggtaggcgcgcaggtgggcctggagttcctcggcctgggcgacgtgggcgcggtgacgtggggcaccaacctctactgggccggcaacgacgcggcgctgctgacgcgctcctggtgggtcttcgtgcccacgggcttgtgcatcgcgctggtcggcttctcgctgacgctgctcagctccgccatcgacgaggtgaccaacccggcgctgaaggcgccgccagtggcgaccacggcggtccgctcggcgcggtcctcttcggcggacgcggcgccgccgcccggcgccctgctgagcatccgagacgtgtgcatcgagtacgccacggagcgtgggcccgcgcgggtggtggactcggtgtccttcgacatcgcgcccggtgaggtgtttggacttgcgggtgagtccggtagcggcaagtcgacgctgggatacgcgctgctgcgcctgctgcctccggccgccagcatcacgcagggccgcatcatcctggatggcacggacgtcacggcgctggatgaaaccgcgctgcgcgcataccgctggagccaggtgtccatggtcttccagagcgcgatgagcgcgctcaacccggtgctcacgctgggggaccagttccacgacaccctcgccgcccatgggcggaccacccgcgccgcggcccatgcccgagcacgggagctgctggccatggtggggctggcaccgcagtgggtggacgcgtggccgcaccaactctccggtggaatgcggcagcgcgtgggcatcgccctggcgctggccctggagccgaggctggtagtgatggacgagcccaccacggcgctggacgtcgtggtgcagaaggagctgcttcagcgcgtgctggagttgaagcagcggctgggcttcgcggtgctcttcatcacccatgacctgccactgctgctcgcgctgtcggaccgcgtcggcgtcctccagggcggcaagctggtggaggtggacaccgccgagcgcctgcgcacggaggcgcgtcacccgtacacgcgcctgctgctgtcctccttcccgcacctgagcgcggcggacgcgcaagtgccggcggacgtgacgctggcgagctcggagcgcgcgccgccccaggccgccgcgcagggaggtggccgatga

SEQ ID NO: 2929 - DNA, 120 bp, Myxococcus xanthus
atgagcgccccgctgctggaggccacggagctgctgcgcacggtgcccgtgggcggcttcctctcccgttcgcgccgcaccttgctcaaccgcgtgtccttcaccctggagcgcggctaa

SEQ ID NO: 2930 - DNA, 2134 bp, Myxococcus xanthus
atgggcggcgagcacgtgctcaccctggagcgcggcggcgcatcgctcgcgtaccggggccgcgtgcagatggtcttccaagatcccttcgcctcactcaaccccgtccacaccgtggcccatcacctggagcgcccgctgctgcgccatggccgggccacacgcgccggactcgaggaccgcgtccacgccctgctggagtccgtgggcctgacgcccgcggagcaactggcacagcgctacccccatgagctgtccggcggccagcggcaacgcgtggcggtggcgcgcgcgctggccgtggagccagacgtcatcatcgcggacgagcccacatccatgctggatgtgtccacgcgccggggcgtgctccaactgctgcgcggcctgacgcgcgagcgcggcatcggcatcctcttcatcacccacgacctggccagcgcgcgccacatggccgaccgcgtcctggtgctgtacgcgggcagcgtcgtggagtccggcaggacggcggacgtgctcgccgcgccccggcacccgtacacccggctgctcctgtccgccgttccggacggcgcggacttcctcaacaccccgctgccggtgcggcccgccacgggccccatgccggtgttcggctgccccttcgcgccccgctgtccccatgcggacgcgcgctgccacgacaccctccccccagctcacgtccacggcgcggcccacacggtccgctgccatctcgaatcctcgaaaggagcctccgacaatgcggcagttccccaatgacttcctgtggggtgtggccacctccgccttccagattgagggcgccaccagcgccgatgggcgcggtgagtccatctgggaccgcttcgccgccacccctggcaaaatcagcgacgggtcggacggcaaggtcgcgtgcgaccactaccaccgctggcgcgaagacgtggcgctgatgcgctggctgggcgtgaagtcctaccgcttctccgtggcctggccccgcgtgctccccaccgggcgcggcgccgtgaatgccgcgggcctcgacttctactcgcggctggtggacgggctgctggacgcgggcatcgagcccttcgtcacgctctaccattgggatttgccccaggcgctccaggacctgggcggctggccttcccgcgacaccgcgagcgccttcgtcgagtacgccgacgtgatgagccgcaagctgggcgaccgcgtgaagcggtggattacccacaacgagccctggtgcatcagcgtgctcggctacggcaacggcgaacacgcccccggtcacaagaactggggcgaggtgctggccaccgcgcaccacacgctgctgtcccacggccaggcggtgcccgtcatccgcgccaacgtgaagaacgcggaggtgggcatcaccctcaacctgtcgcccgcggagcccgcgtctcccagccccgaggacgcggaggcatgccgccgccatgacggcagcttcaaccgctggttcctggacccactctacggccgcggctacccgaaggacgtggtggaggactacgtgaaggacgggcgcctcgcctcgtccgcgctgcccttcgtgcgcgacggggacatggccgccatcgccgtccccaccgacttcctgggcatcaactactactcgcgcgccatcatgcgcagcgaccgcatccccgaatcccagaacgcgccgcgcaccgtgcaccccgagcccgagcgcacggacatggactgggaggtgtacgcccccgccctcacccggatgctcgtgcacctgcacaccgactaccagcccggccccctctacatcacggagaacggctgcgcctacgccaccggccccagcgaggacggcaaggtgcatgacgacaagcgcgtggcgtacctgcgctcgcacctggaggcgtcactggaggccatccgccagggcgtgccgctcgcgggctacttcgcctggtcgctgatggacaacttcgagtgggccttcggctaccagaagcgcttcggcatggtctacgtggactacgactcgcagcgccgcatcccgaaggacagcgctcatctctacaaggccctggtggagaagaacgggctggatgtggagctcgccgcgtga

SEQ ID NO: 2931 - DNA, 3003 bp, Myxococcus xanthus
atgaactggggctacacgcccattggcgagaactaccggtactcgctgtggacggagaaggaggacttcatccgcgcggtgctgcaccgcgagatgacgctgctgcgcgacatgagcgtcaacgccatccggcaattcgacgacatcccgccgcagtgggtgacgtacatccacaagaactacggcatctacaccgtggtgaacccgctcatgggccgctacggcacgaacgtggatggcgtcatggtgccgaacacggactactccaacccgaaccaccgccgcgcgctgctcaatgatttggcgcagaaggtagagaagtaccgggacgtgcccggcgtgctgatgtggatgctgggcaacgagaacaactacggcctgcactggaccagcttcgaaatcgaggcacttcctggccaggaggacaccgcccgcgcggagcacctctattcgctgatgggcgaggcggtgcggaccatcaagcagcgcgacacgctgcaccccgtctccatcgccaacggtgacttgcagtacatcgacctcatcgcgcggctgatgcccgagttggacatcctgggctccaacgtctaccgcggcccctccgcccgtgacttgttcgacgaagtgctgcgcaagctgaacaagcccgtcatgttcaccgagttcggcgcggacgcctacgacgccaaggccggccgcgaggaccacgtggcgcaggccgaatatctgcgcaagcagtgggaggagatctactcccaggcctacggacagggccgcgcgcagaacgccctgggcggcttcgtgttccagtgggtggacggctggtggaagtacaaccaggaggccaacctctccatccacgacaccaccgcgtcctggcccaacggcggctacgaatccgacttcgtgcccggccagaacaatatgaatgaggagtggttcggcatctgcgcgctgggccccgaggacgaggccggcatcgcgcgcatccaaccgcgcaccgcgtactacgtcctccaagcggccttccgcatggacccgtacgcccccaccaccaatcccgacaccatccgcgagcacttcgcgtccatccgccccacggaactgtcgcgcggttacgagtcgtccatcgcgctggcccgggcggatgacctcagcgcggtgcgcgtctccaacctgcgcctgatgatggacagctcactctcgcgcgggagcatcgccacggtgcggcccaaccaggtggccgcggaccacacggagtccgtcttcttcgacctggcgctccagccgacctcgggcgtgtacgggcgcgcctcattcaacgtcgtgggcaacgtggcgcagaaccgcctcaacaacatcttctatgagaaccgcggcacgccccccgcgcctgccacggccaacggcggcgtgggccaggcccccgtgcccggcgtgggcaacccggcggggcagcagccgctgggcctggaccggctcgcgctgtaccaggccgagttcaagctggaccgcgcggacttccagttggagggcttctaccgcaccgcccactaccactggggcgaggaaggcgacttcttcggcctctaccgtgaggcgaactacggccccgccctggacatctacaagggcaacgcccccttcggcgtcgtcttcaccgggaagaacaacctggagggcctcaaggtggcggtgggcccggagctctactggggcgccaacccgtccatcgtcgccaagtaccgccggaacgtggggccggtgacgctgacgctgatgcaccaggaggacatcgcccggggctccacccagctcaccgcctccgtcatccgcgagcgcgtggcgcgcaggtccacgctgtcactgggatggacgaaggggcccatggcactggaggtgggcggcatcctcgcggccccgcagcgcgtgggggaggagttcatctggtctcgccccacggacggccccagctacctcgacagcggctacgaggtgatgcgggacgaaatccggatgctcgacaccctgggtgcgaaggcacgcctcacgtatgacctgggcgcggtgcgaacgttcctccagggctcctaccgcggcctggtggcggacggcggtccggagcagggcatcctgctgacgggctggagcctgcgcgagagcggccgtggcaaccacttcggtggacaggccggcgcggtggtgcaggtcggcagcgcgttccaggtgtcgcccaacctgctgtaccagaagcccctcatcgggcccaacccacgcatcgaggacgcgttcgacccggagtcggggcggtacttcgccggcgtgcgtccgcgcaacgtgctggtggatgccttcaccgtcctggacaaccgcgagacgctgggcgccgagctgctcctcaccttcgaccccacgcccggcacctggttctggcagtgggaccgcgacatgcgcgaggacgcgcccttcgccgcgggtctggacctggtgtaccggcggcaaccgacgtctcgtgacgcgggcatcgccatcctcgcggatggcagcatggtggccttcggcaacgcgccgtccgctcgggacgaatgggaggccacgctgcgattggtgaccaacccggtgcagcggctgaaaatcttcggcgccgccttcgccggcagcaaccagtcctccggcgaggacgaccggcaggtgcggcgcttcggcgtggatgcctccgtgctgtgggacacgctgatgctgaccacgcagctccacttcaacaactggggcccgtatgactaccaccgcgtcttcaacctcacctatcccatccagctcggtggggacctgtcctacggcctcaagcgcccggtgatggggacggtgacgacgcgcttcggcgtgcgcggattggtgcgcatgctggaccagtactcggaagggctcagtcagacggcgctcgaccagggactcgaaggccgcgaattcgaggtgggcgcgtatgccatcctgtctctctaa

SEQ ID NO: 2932 - DNA, 978 bp, Myxococcus xanthus
atggcgccctaccccgcctcgctcttcaagctgctcatcgcctttcgcgtcctccggtgggtggaccagggtcacctcacgtgggaccagccctggcgcttcctccgagacaccgaggacaagggcacgcgcccgatacgtgactggctggagccgatggtgaccgaatcggacaacaccgccaccgaggccctggtgaagctgctccacgaacaaggcgcgatggcgagcctcaacgcggagctggcggcgctgggcctggacacgctgcaagtccatggcacgtccccggtgacaggccggagctggaaccccggccagattcacatgacagcgctggatacagcgcggctgctgctgctcatcgaaggaggccccggtgtcctctggcgcaccgcatcgggccgcgatgtgacggcgaaggaactctctggcgcgtccagaacccacctccaatccctactcgccgaccaggccctgcacgaagcgctgtcatccacgctgctgtgcggagatgcgcgcgcggaaccaggcatccccgcggccgtccctactcgatgggtgaactccgaggacggcaccgtaacggcggcggagaccgccttcggccgggacacgcgcccctgcaacgcgacggcggaagtcacattcctccataagacagggctgacggagaactacggcagcgacggcggcatcgtccgctccctgcccggcaaaccctggcgccgatacatcgtcgtgttcctgtccaacctgggctaccgctactacgacgcgaaagtggccgacgcggcggacttcgcgaagggcgaagacggcttcccttacgtcagcacgtccatcagctacacgcagcgaatccctgcgctgggccgccaaatcgacgcgatgatgcgggagcgtcagcgcgcacgcccccagagtcctcctgcgaaggacgccgctccccaacaggcgcctcggcccgctcgatag

SEQ ID NO: 2933 - DNA, 555 bp, Myxococcus xanthus
atgaagacgtggcttctgctggcctgcgccggagtcgtcaccggctgctacgaccccgccagcttcgtgtatggcgaatccctggacggactcacgctccagttccacagcccggacgtcggcatctacccggaccagtccgttctggacgatccgaacaatccgttccgaagcagcacgcccggcgcggagacgaagtgggacatcgaatcccgcgccggaaacgtggccgcgttctattcgtgggccacgttgctggcccgcgagccgggcggcgaggcccagttctacgtgggtaacaacctgctcgccatctaccagaacggtgaggcgcgtcaggaggacctgccgcaagtgcggctccaggccatccgcgcgtatcaaacgatgctcgattccttcccggacgcggtgacgtacgacgccacgggcacctacgcctatgacctggcgacgcccgcgtacaagggcatcgtggagatggaaggcgcggtgcagggcggttgggtgttgatgagcacggctggcggcggagaccgggcggtgcggccatga

SEQ ID NO: 2934 - DNA, 618 bp, Myxococcus xanthus
atgctcctggcgggctgccgtcccgacccgggcgtgccggactacacggaccagggctacaaccggcccgacgcgggcggggaacccaacgacgaggtgctcccgggcccctacccctatgtggagggtcagcggcgcctgggcgtgggtttctacgaagggggccgctcccaggacatcccggtggacaacaccaccgtgcacatctacctctacgagggcacgctctccctggagccctccaccacgcgcatcgagggccgccagtccgacctggtggtgcacgcgggcaagacgtggctgggcttcggcgtgcactggaacaccccgcgcaacctggatggctggacgacgttgcacgtgagcctcaactcggccgacccgggcttcgccaacgtgtccattggcatgaatgacgaccagagcgtccagttgcccgcgtcacagtacggttacacgaatgatgggcagtggcaccacctggccattccgctggcggacttcgtcgcgggcgggttgcagctcaacgcagtgcaggcgccgttcgtcttcatcgctggcgcgggcccagccgcggacacgctcctgctcgacaacgtgtatttcaccgcggactga

SEQ ID NO: 2935 - DNA, 957 bp, Myxococcus xanthus
atgccgccgataatgcgaacaggcgaaggaagtccgggagggtccgccgtgaccaggattgtcaccaccgtgttcaactcagcgccccaggccctgtccaagcccatccagccggtcgtgttgaaggacgccaggacgcccatggagacgtcgctcgccaggccggtgagcagcccggccccggcgacgccccgtccggagcgggacactttccaggacacgaagcccgcggccaaaggcgtgccgcggctgtcggtgccggacgccacggggaccagcgagcttcccttcctgcgagacctggccccagagaatgaagcggcgcaggcgcaggccgacaagggctgggcgcccaccgcgtcggtcatcgctcagaactcggacacgggctgcggcgaggcgacgctggccttcctgagccgggcgagccgcagcgtgacgaagggcacgctgtgcgagaagcaggagcgagagacggtccgcgagcgcgcgtcgcaggtcagcggcgcccggtccgtccacgccccggtggacgtcaacctggatgatggcgccacgcccacggagatggcgaccgcgttggggggcatgggcatcgaagtcacggacggcttcgccgacttcgacgcggcggcgacgagcaagatgatgaaggctggtcagttcggcctggcgctcgtggatgccaatgccatcctcaatggcgcgctcgctgcccgagcagcggcgcggcgggccgggccagctccactgggtcaccatcgacggcgtcaacagcaacgggacggccgacacgtcggacgacttgttccgcgtgaaggaccccgtcaatggcgagtactgggtgtccgccagggacttggagagcgccgtccaggccggcaaggagcaccacggcagcggcggcatcttcgcgctggagaaccgcacgggcgtgggcggacagaaggagcgtga

SEQ ID NO: 2936 - DNA, 351 bp, Myxococcus xanthus
atgtccgactgtctcttctgcaagattcgcgacgggctcatccccgccaaggtggtctaccgcgacgacgtgtgcgtggccttcgaggacatcaatccccaggcccccacccacgtgctcttcatcccccacaagcacatccccaccgtgaacgacatcacgacggaggaccgcgagttggtgggccacctcttcatcgcggccgccaaggtggcccaggagcgcgggcacgcggacccgagcgacggctaccgggtggtgatgaacacccatgcgcacgccggccagacggtcttccacatccacctgcacctgctggccgggcgcccgctgggctggccgccgggttag

SEQ ID NO: 2937 - DNA, 399 bp, Myxococcus xanthus
atgtggggcctggcctatgccatggggctccagaacgcgctcgtcacccgcgtctctggcgccgtggtgcgcaccacgcacatcaccggcatcctcaccgacatcggcatccaggtggtgcggctgggttcctggctgcgcgagggaacgcggggccagggcttgctgggcctgcgacgccgtctctgggcgctgcccaccgctgttgaattcgagcggacccggctgcacctggggctcggctccgccttcctgggcgggtgcacgctggggccgatgctcttcgcccggctcggcgcggccaccctggcgattccctgcggggtgctggtgatgctggtggcgctcgacctgagcgccgtcgcaacctccggcccccaggcgatgccgcgcgcctga

SEQ ID NO: 2938 - DNA, 246 bp, Myxococcus xanthus
atgaggaagaaggacacggacaaggccggtccctcgtcttggtatgccctctgcgacgtgcgggacagcaactacatcctgctcgatgtgagccaccagttggacggccgctaccccattcgcgacggctacaacgaagcgtttccggatccggcctactgccgccaaatcgcgcgctctttctcggagtttctagcgggcgcgctacgctccaatgggcgttggttttggctgccagagcagtag

SEQ ID NO: 2939 - DNA, 2703 bp, Myxococcus xanthus
gtgccgcgcagcgcgccgcatgcggcggagtctccctccgcgcgcgacgcgtctggggattggcgttcgcggagcccgctgggccagcgggtggggcgcttcattccgttgaagctgctggggcagggcggcatgggcgcggtgttcgcggcctatgacccggacctggaccgcaaggtggcgctcaagttgttgagcgtggaggcccgctccgcggacgaggagggcgggcgggcccggctgctgcgcgaggcgcaggccatggcgcgtgtctcccatcccaatgtcattcccatctacgaggtgggcacctgggacacgcaggtcttcttcaccatggagtgggtggcgggtggcacgctggcggactggcggcgcgagaagctccgttcctggcgcgaggtgctggagaagtacctgcaagcgggacgcgggttggaggccgcgcacgcggcggggctggtgcaccgcgacttcaagcccgccaacgtgctggtggggcgtgacgggcgcgtctatgtcaccgacttcggcctggcgcgtcccgtggacaacctgcctctggacgaacagcccacgctggcgcgcgtgcgcgacgcctcggagacgtcgcgcacgctgcatgacccgctcaccgaaacgggcgtcgtcctgggcacgccgccgttcatgtcccctgaacagttccgcggcgagtccctggacccgcgctcggaccagttcagcttctgcgcggcgctgtaccgggcgctctacaaccagcgtcccttcgaccccgacgagctctctcgggccgcgaaggcgctgcggtccgcacccgcgaaggtgacggcgccgctggagcgagccgggcgggagccctcgcccatccacgagccgcccagcgacgcccgcgtccccgcctgggtgcggcgcgcggtgatgcgggggttgtcactggagccggaggcgcgcttcgcctccatgggggcgctgctggaggcgctgtcgcaagagcagcagcgcgcacgggcccgcaaggcgggaggcatggccgcggccacggtggcgctggtgggggcggtgggaggcgggctgtggtttcagtccagcgtctgcgcgggcgcggaggggctgctggcggacacctggggggccgaggcgaagcagcgactgtcctcggccttcgcggccacgggcagccccctggcgggggacatggcgggccgggtggggcaggtgttggatgcctatgccagcagttgggcgcagcagcacaccgacgcgtgcgaggccacgcgcctgcgcgaggtgcagccggaggcgctgttcacccagcgcgtggtgtgtctggagcggcggcacaaggatttgcgtgcgctggtgggcgccctgtcccaggtggacaaggcgggcgtggagaaggcgctggacgcggcgtatgcgctgccttcacccgaggactgcgcggacgtggagtccctggcgagccagcagccccggcccgcggacccggcaatgcgcgcggagctggagtcattggaaggcgcgctgtcggaggtgaaggcgctggtggacaccagccgctatccccaggcgctggcggcggcgaacgcggtggagtcgcgggtgttggccgcgcggtacgcgccgctgacggcggagctgcgcttccaccagggatggctccaggccgtgctgggggagaaggataggggcgcggggctgctggagcaggccgtctatgacgccacgtcgggccgggcggaccggctggaggtctccattctcaacaagttgctctacgtggaaggggagcgcgagcgcttcgagcacgcctctcaatgggcacgtctgggcaaggcgaccctccagcggttgggcggggacgcggtgctgcggggcgacctgctggtgaacgaggccaacctcgcgttgatgcgcggtcagacggacgacgcccgggcgttgctggaggaagccaacaccgtgctgacggacgcgctggtgccgggccatccgaagcgcgcgcgggtgacgttctcactggggcgggtgctgctggaggtgggggccttcccggaggccgtgcgggtgatggaggatgcgctgcgccagacggaggcggcggtggggcctcggcacctggacgtggctcggcgccaccagggcctgtccatggcgctgcgcgagcagcgagagttcgcgcgggccttggcgcatgcccaggcctccgtggcgctgcaccgcgagctgctgggcgacagtcacctgaagctggcggaggcgctcgacgaggagggcatgagcctgctcgcgctgagccgccacgaagaggcgctgaaagtctatgaggcggcgctggcggtgaagcacgcccaactggggcccgacgacgaggacctccagtactcctacgacggcgtggggcaggccctgctgggactggggcgcacgcgcgaggcgctggcgccgctgcgcaaggcggttgccttcacgggcgcgcaggaggactcgctgggggagtcgggcttcgcgctcgcgcgggcgctgtggaaggaagggcagggtgtggaggcgcggaccgaggcggcgaaggcgcgtgagcgcttcacggcctcgggccgggcgctccaggccgaggcggtgcgggcgtggttggacgagctgcctccggagacgaaggcgaagcccgctcgtccccagcagcggaggcgccgctaa

SEQ ID NO: 2940 - DNA, 255 bp, Myxococcus xanthus
atgaatcgctgtcaggtgaaccacatcgacccggcgacgctcgacatggtccgctcgcatgacatcgtcgtcatgtacgggacgaaccatgtgagctcctgcgcgctggaccagacggacggcggcgcgacgctggtcgtctacgggacgaaggggggcccgctgccgggtgaggtgggcaaccgccccaactacgtggccacgtattacgacttcttcaccagcaccacgccgcctgtctattacacctactga

SEQ ID NO: 2941 - DNA, 825 bp, Myxococcus xanthus
atgtccgggtccggtaagtccaccgccatccgcgcgttggaggattcgggcttcttctgtatcgacaacctgccggtgttgctcttgcccaagctcacggagctggcgggcggcggccacttcgagcgcatggcgctggtggtggacgtccgcgaaggcgtcttcctcaaggacgcgcctcgcatcctcgccgaggtccgccgcgccgggcaccaggtggaagtgctcttcctggacgccagcgacgacagcctcatccgccgcttcagcgagacgcgccgccgccacccgctggcgcccaacggcaccgtcgccgagggcatcaaggcggagcgccaggcgctgcgtgacttgcgcgagctggccgaccaggtcatcgactcgtccacgctgaacgtgcatgacttgaagcgcatggtgcaggcgcgcttcagcccggagcccgccgcgggccccagcctgtccatcatgtcgttcggctaccgctacggcgtgccgccccaggcggacctcgtcctggacgtgcgcttcctgcccaatccgtacttcgttccggagatgaaggggctcacgggcaaggtgccgaaggtggcggcctacgtgctggagcgtgaggagacgcagcagttcctcgagaaggtcgtggacctctgccgcttcctcttccctcgctaccagaaggaggggaaggcgtacctcaccgtggccctgggctgcaccggtggcaagcaccgctccgtcgccatcgccgccgagctcacccagcgcctgacggacgaagacacccgcgtccagctctgggaccgggacatcgagaaggaatag

SEQ ID NO: 2942 - DNA, 420 bp, Myxococcus xanthus
ggctcccacgggccggccggagaggtgcgcaagctggcgaaccggacgcgggatgcggtggggcaggtgcagacgctgctgagccggagcgaggcggacacgcgggcggcggcggacctgatgcgccagggcaccacggcggcgcaggaagggctgggcttgtccacgacggcgggagaagcgctgtcgcggctgctctcgggtgtgaatgagattggcgggaaggtggagcggatggcggacgaaaacacgcgccagtccgcgtcgggggagagcatcgccgggagcatccaggcgctctcagtgcgctcgacggagtcggtggctggcgtgcagcagattgcccgctccgtggaagacctgcgggcacgggcgtccaagctgaaggacctggccggacgcttcacggcgcgggggtga

SEQ ID NO: 2943 - DNA, 966 bp, Myxococcus xanthus
atgaaatccatccgcatctcccaactcctcgaggaccgcgactacgacatgcggctcagtctcgtcgccggcggcggcgggctgtcgcgcattgtcgtgtcctcgcgcatccagaagccggggctggcgcttgcgggcttcaccgagcacctgcatccgcaccgcgtccaggtgttcggcaacacggagatttcgtacctggccacgctgccggaagcgcggcagcgcgagtcgctggcgcagctcttcggcgaggaggagctggcgtgcgtggtggtgaccaaggacctggacattccccaggccctcgtctccgcgtgtgaaggcgcggggctggcgctgatgaagacgccgttgctctccagtgacttcatcatgcgggtgcagaccttcctggaagaggccctcaccgagtccagcagcctgcacggggtgttgatggacgtgttcggcgtgggcatcttgctgctgggcaagagcggcatcggcaagagcgagattgccctggacctggtgatgcgggcccaccgcctggtcgcggacgacatcgtggacgtcacccgccgcaagggggccgtctacggcgctggcaacccggtcatcaagcaccacatggagattcgcggcctgggcatcatcaacatcaaggacctgttcggcgtggccgccatccgcgaacagaagaaaatcgagctggtcatcgagctccaggagtgggacccccaccaggagtatgatcggctgggcgtggaggacaggcatctgcagattgtgggggtggacatccccctgtcggtggtgcccgttcgtccgggccgcaacatggcgaccatcatcgaggtcgccgcgcgtaatcagttgctaaagctacagggccaccactcggcgagagagttcgccgagcgactcaaccgggccatcgccgaaggggcgatgcgccgtaccctgggagaagaggtcgagtga

SEQ ID NO: 2944 - DNA, 2238 bp, Myxococcus xanthus
atgtcccgctacgccatcgccatcttcgccagtgcgttcctcctgttcggcgtgcaacccctggtggggcgctattcgctgccgtggtacggcggaacgcccggcgtgtggacggcgtgcatgttgttcttccaggcggtgctgctggggggctacgcgtacgcgcacggactcgcctcgcggctggcacctcgcacgcaagcccgcgtccacctgggactgctagcggtggcggtgctgctgctgggcgcacgtgcgttgctggcgggctcgccggtggcacccgggcctgaatggcgtccggagggcaccgcgctggccgtgccccggctgctggcgatgctggcggtcaccatcggcctgcctttcttcgtgctgagcaccaccggtccgttgctccagtcgtggttcgcccgcgcgcggccgggccgctcgccctatccgctctatgcgctgtccaacgcgggctcgctgctggcgctgctcggctatcccttcctggtggagccgtgggtgggacgcggcgcccaggcgtggggctggggcgtgggcttcgtcttcttcgccgtggcctgcgcggtgtgcgcgctggacgtgatgaagcagccggacacggcgcccgtcgccacggccgcgcccgtgacggccacgccgctgacggaaggcgccgggggagaggccggcgcggaggtggcacgccccaccgtgcgcgccacgatgacgtggctgggcctgagcacctgcgcgtcggtgctgctgctggcaacgacgaaccagctctcacaggacgtggcggccggccccttcctctgggtgctgcccctggccgtctacctgctgaccttcatcctcgccttctcccgcgagtccttctactcgcggaccgtctacgcggtgctgctcatcgcctcgggcgcgggcgtggcgcacgcgcagacgcaggggccgcagtcgtcgctcgcgctccagctggccgcgtactccgtggccctcttcgcgggcagcatggtgtgccacggcgagctgtaccggctgcgcccaccgccgcgccacctcagcgccttctacctgtgggtgtccgcgggcggtgtgctgggcgggctgctcatcagcgtgctggcccccgccgtcttcagcgcctactgggagtaccccttgtcgctgggcgcgtgctgcgtcgtcgcgttggtgggcattgcgaaagaggcgggcgaagcgacgcggacgcagcggctgcagcgcgtcctgcgcggcgccatgctgctcctggtggccggacacctgacgtacaccatggcccgcgagcagggccgcgcgcgcttcgcctcgcgcaacttcttcggcgtggtgcgggtgatggagcagggcgtgggctcaccggaggaccaccgcttcacgctgctgcatggcgccatcacccacgggctccagtacgtgacgcccgagcgcaggggcgtgcccacgacgtattacacgccagaggcgggcctgggactggccatcgccgagcatcgccggctgcgcgaagccgtggggctgcccgcggggcttcgcgtgggcgtgctggggctgggggtgggcaccagcgccgcgttgctcgaggcggaggacaccgggcgcttctacgaaatcgaccccgcggtcatcgcgctggcgcagggcgagggcggctacttctccttcctgggagacacgccggcgaaggtggagctggtggagggggacgcgcgcatctccctggagcgggagctggagacgggcggcgcgcagggcttcgacgtactcgcgctggacaccttctcttccgacgcggtgccggtgcacctgctcacccaggaggcggtggcgctctaccgcgcgcacctggcgccccatggcgtgctggcgctgcacatcagcaacgtccacctggacctagtgccgctgacgctggctcacgcgcgggccctggggctgcatgcggcgctggtggtcaacgagacgcaaggggacgcgctgcgcagcaactggatggtgctgagcccggaccgcgagttctcctggggacccaccttcacccgggcctccgcgcgcgtgcgccggctgggcctgcgggaggaccccgacttcacgtggacggacgagaagagcagcgtgctgcacgtgctccgccgcggcaggccctcggcgagcgtcaaggacgtggaggcgtcctccggcccgcctggccccgcgtccgcccagcccgggacggagtga

SEQ ID NO: 2945 - DNA, 411 bp, Myxococcus xanthus
atgacggagctcggcattgcgcacctgtccgagcggcccgcggaggccctctctggaggcgagcgccggatgttgatgctggcgcgaggactggtgcagcagcccgagttgttgctgctggatgagcccaccgccttcctggacgtggcccaccaggtgggctcgctcgaccgcgtgcgcgcgcgcgtggacgcggggctgggcgcggtggcggtgctgcatgacgtgaacctcgccgccgccttcgccacccacgtgctgctcctccgggatggccaggtgctcgcgcaggggccggcgaacgaggtgctggagcgtggctccctggaaacgctctacgggctgcccatggaaaccgcgctggctccgtccggcgcccggctcttcgcgccccgagcaccctcgcgctga

SEQ ID NO: 2946 - DNA, 1059 bp, Myxococcus xanthus
  unsure (1)..(1059): unsure at all n locations
gaacgccacgacgacacccagcccgncgtcgcacataacgccgacacggaccctcgcgtcacccgccatgacgacacgcatccgcgcgtggtgctggacgcaggcctcttcaaagatgtggatggctccgaggacgaggagcggtccggcgtctcccggcccaggcctcggcgggcccggccatcttcgccggggatggcaccggccagcaccgcgcgcaggacaggttccgtctccgccgtgcgtcccaccgcgcccgcccccgtcgtgacggacgaagaagaggacgaaagcgacgacgatgtccgcgtctccctcacgcccaacgaggagacgcggcgcacgacgatgcccgtccgcccggagacgcgctcggctgagcgcatcgcgaaggaggacacccgccgcacgacgatgcccgaacgccccgagcgtcgccgcaagggcccactggtgctcgtgctggtgttgctgttcttcatcctcgccgtggtcggagccttcttcctggcccccccggagctccgcgcccaggtgctgagccagttcatgccggagcaacccgaagggccgccgcccgcgcagcccctgcgtccctccgctcccgacgaggcgctggcgggcaaggctgccaacgagaacggcccgcctccggagggggacgcggcgcaggctccgggaacccccgcgcccgacgtcgtgccgccatccggtgccacggaaggcagaggctcgctcgacgactccttcctcgcgccgctggacgcgcagcagaagaccaccgaggctcccgagaagcgcgcggcgccggtccgcaagattcgctccgcgcgctcccgtcagctcaccgtgctggagagggagtggcgcgagacgaacgcgctcttcaaccagctcaactcggagcattcgtgcgtggtgctcggcctctggtgcacgcggtacgccgaggtgaagagcgaggtggaggccgcgggtagcggcgaaaacccggaagcgctgcgcaaggtccgggcgatgaagcgcttcctgctgcagaagcagaaggagctgtactag

SEQ ID NO: 2947 - DNA, 873 bp, Myxococcus xanthus
atgagcaacctgagtgcgagcgagatgaacacggtgctggcgcagcggctcctgtccatcttcgagcgaagcagggaccggaagtacacggcggccaaggcggcaaagaagaagaagccgaagcccgcagccagcgccgcggacgacgccgaccacgtggacgacagcgccccgccccggggcgtgctcggcaaagacagcgactacgcgcagaacggctctgactacatcgcgtccctggacgggcgtggcgtgtaccgcgtcttcgaccactcctacctggatgaaatccgggacctggtgaagcagaccgctgagttccccggggggccaccggagaatttcaacccgagggccaaggacaaggacaagaagcccgcgctccagaagtacccgtacgcgtgggaggcacaccacatcctcccgggctcggcgttctactacgaattggaggacggcccggtcttcacataccggcagctccgcctcatcctccagtccgactacaatctgaaccacggccacaacatcatcatgctgccggaccaggcttgggccgtgcctgtccacgcgctgctgcagcacccgggcgaccatcccaactacacgcagcaggtgatgcgggacatgaaaaccatcgcccaaaagcttcaaaaggcgatcgactctcaaaaagaacacaaggcgttgatcgaggatgtttttgaccagctgcacaagctggagaacaagtactggaaactcctcgttgcactgagccgagcagttgtggcctcggtcaccgcaggaaaagagtacaagcacgcccttgtgcgctatgccccgaaggacaagaaggccaagagtcgttatgagtggggctctctctattaa

SEQ ID NO: 2948 - DNA, 1044 bp, Myxococcus xanthus
atggggcacccctccaccgagaacctcacgcccttcaccttcgagccgctgttcctcaccgacgaggcgctgcggcccctgttcgtgcccgtgttgaaggccacgttcgacctgcggcctcggggcgcgccgacgctgtccgcggagcaggcgccgctgctgaccgggggtgagcgctgggacggcggggatgtggccagcctccgcctggaacccgaaggcgccttcttcaaggccgccacggacgtggtgctggtgggacatgcccatgcgcccgcggcggggacccgcgagctcctcgccgagttgcatgtcgggcccgtgcacaaacaggtccgtgtgctgggggaccgcacgtggttcaagagcatgggcggcatcggggtgacgcagcccctccccttcgagcgcgtccccgtgcgctatgagcgcgccttcggcgggaaggacggcagcgccttcgagtcgcgcaacccgctgggcatgggctttcgcgagaagggcagccgcttcgaggagaacctgcggctgccgaacctggagtctcccaccgagccgctgaggtcctggggccagcgtcctccgcccacgggcttcgggttcatcgaaccacactggcagccccgggccggctacgcgggcacctacgatgacgcgtggaagaagtcgcgcagcccgttgctgccgaaggacttcgaccggcgcttcctcaacggcgcgccgcaggaccagctcgtcccgggctacctgcgagggggcgaggccgtgctgctgaagcacatggcgccgggtgcgccgctgacgttcagattgcccgcgctgccgtctcctgaggtcctcgcgcccagggcccgggggctggatgacctggaaggagcgctgcggctggacaccgtggtcctggacacggacgcgatgaagctgttcctcgtgtggcgcggcaccttcgcgttgcagcgcgagcccacggagctgcgctccatccaggtaacgtgcgagggcgcggagacgctggagccggggcaacccgtcggaacggactga

SEQ ID NO: 2949 - DNA, 1609 bp, Myxococcus xanthus
atgttcgagttccagctcaatggcgcgacggtccgcgtcgatggcgtctcccccaacaccacgctgctcgacttcctgcgtgcccgcggcctcactggcaccaagcagggctgcgccgagggcgactgcggcgcgtgcaccgtggccctggtggaccgggacgcccagggcaaccggtgcctgcgcgccttcaacgcctgcatcgccctggtgcccatggtggccggccgtgagctggtgacggtggaaggcgtgggcagctgcgagaagccccacccggtgcagcaggccatggtgaagcactacggttcgcagtgtggcttctgcacgccgggcttcatcgtctccatggcggaggcgtactcccgaaaggatgtctgtaccccgtcagccgtggcggaccagctctgtggcaacctctgtcgctgcaccggctaccgccccattcgcgacgcgatgatggaggcgctggcccagcgcgacgaaggaccgtcgcctgccacggcgatcccctccgcgccgctcggaggtcccgccgagcccctgtccccgctgcgctacgaggccggtggacagaccttcctgcgccccacgtcgtgggaggagttgctcgacctgcgcgcgaagcacccggaggcccacctggtggcgggcgccactgaattgggcgtggacatcaccaagaagtcccgccgctaccccttcctcatctccaccgagggcgtggagtccctgcgcgcggtccgccgtggggaggatggctggtacgtgggcggcgccgcctcactggtggcgctggaagaggccttgggtgacgagctgcccgaggtgaagaagatgctcaacgtcttcgcctcccggcagattcgccagcgcgccacgctggcgggcaacctggtgaccgcgtcgcccattggcgacatggcgccggtgttgctcgccctggatgcctcgctcgtcctgggctcggtgcggggcgagcgcacggtggcgttgtccgacttcttcctcgcctaccggaagacggcgctccaatcggacgaggtcgtccgccacatcctcatcccccacgctgccgtgcccgagggcggccggcggctctccgactccttcaaggtgtccaagcggcgcgagctggacatcagcatcgtcgccgcgggcttccgcgtggagctggacgcgggcggattggtgaagctggcgcgcctgggctacggcggcgtcgcggccacgccggtgcgggcgcgccgcgcggaggcggtgctcaccgggcagccctggacggccgagacggtggcgcgcgtgctgcccgtgctcgcggaggaaatcacgcccatcagcgacctgcgcggcagcgcggagtaccggcggggactggtggcgggcctgctgaagaagttcttctccggctcgcacagcccggccctggacgccgcgccgggcttcgacgcgggtgaggtgcaggcccccgaggacgcaggacgcgcgctgctgcacgagagcgcgctgggccacgtgacgggcagggcgaggtacgtggacgacatggcgcagaagcgggccatgctggatgtctggccggtgtgctgcgcccatgcgcacgcccgca

SEQ ID NO: 2950 - DNA, 693 bp, Myxococcus xanthus
gctctcagcgcggcctgcatgtcccgggcggagaccatcctgaacacggagaagggcgcgctggagcagcggctgagcgaggtggcgcgggagcgggacacgctgaaggcgagcatcgagaaggagcgcaaccagcatcaagccgccctcacggagcagctcacgcgtcacgacgccagcatggagcgggcacgcaaccagatgcatgagagcaacaacctgctcgcggaggcgctgggtgaagcagcgaagaagcccgcgccctcggcggtggcgacggccacctccacgtccagcagcgagggactggcgaacacgcagaccgactccacgcagcgcagcgacgcggcgctccggggtgacgtgtcgtcctctgcacgacggagctcgtcgtcgcagggcccccagaccgcgccaccgcccagggtggtgaagcccatcatcgacaccacggacgacacaccgctcatgtgcgaactgccgtcggcgacgaagacgaaggcgaatcagtcacgcgcgtcctcaaagaagaagcggccgggtgtccgatacgcgtctgagtgcacgcagatgaagcctgaaccatcctttcagcccgccgagccggaggaggccatcctggcaacgcccgcgcagcagacggcgaaggcgcccatccctctggtgccccaggacgctgacgccgtgaagtag

SEQ ID NO: 2951 - DNA, 354 bp, Myxococcus xanthus
atgcgtgccgtcgaggcagccgcgagcgccaaggccgcgttgctggaggaagagctggagcagggccaacgtccgccggacgaggtcgagcgcatcctcttccatctctcgcggcacacgcgcgccgccgccatcgcccagttgctcgcgtatgcggatggagccaccttccgcgatcggctggttcgctccgggcagccccaccgccggcggctccaatgggcgacgggcgagctgcggcccttcaaccgcttcaccgcgacgggccattacgggccgctctgcgactcactggccccggggtgggcgagttggcccacgacattgcccgcctgtcggcggacacgcccgtga

SEQ ID NO: 2952 - DNA, 1119 bp, Myxococcus xanthus
atcatgcgtgtggatatcgggcagaatgagcgggcgttcgtgctggtggacgagaagccggagcgctacctcgttcccggccggtactggctgctccaccccttccgaaaggtgcggctggtgcgcgtgagcaccgagcagccgctcgtccagctcgacccggcgttcctgcccctcgtgccggagacggacctgcaggtcgtggagctgagtgccgacgagcgcgccatcctcttccacaagggccgccccgtgcggtggctcggccggggcctgcaccaggtgtggacggtggagcgccttcccagccgtcagctgacgcccggcgcgcccaccgtgcgcgtggagcgcgtggacacctcgggtgtcaccacggcgccgctgcgtgacgacgtgcgtgccctggtccccaccagcgactacacagaggccaccgccactgagggcaccgtcgtgctccgctacgtggatggcgtgctggacgccgaacttcctccgggccgtcacgccgcgtggaccgtcgcccgcaaggtgcagctggccgtcatcgacctgcgtgagcgcctgctccacgtcaccggccaggaggtgatgacgaaggaccgcgtcacgctgcgcctcaacctgtcagcggccttccgcgtctcggacgcgcgccggctcgccgtcgtgtcccgcgctccggatgacgtcctctacctggccatgcaactggccgcgcgcgaggccgtgtcggagcggacgctggatgagctgctcgcctcgcgagaagccgtggccgaaagcctcttcacccaggtgaaggaccgcgcccacacggtgggcctggacctgctgcgcttcggcatcaaggacgtcgtcctcccgggtgagatgaaggagctgctcaaccgcgtcatccaggcgcagaaggaagcggaggccaacgtcatcctgcgacgcgaggagacggccgccacccgctccatggcgcagacggccaaggtgctggcggagaacccgctgctggtgcgcctcaaggaactggaagcctacaaggacctcgcgtccaaggtggggcaggtgcacctcgtcctcggcgagggcgcggtgcccaccctgcaactcaagagtcactga

SEQ ID NO: 2953 - DNA, 1815 bp, Myxococcus xanthus
atgtcgtcttcgaaccactacgtccccaacctgcgcgatatcgaattcaacctcttcgagttcctcgatatcggccaagcctcgctgggccacgcaccctttggcgacctggacgagacggccgcacgccagatgctccagatgttcgcccagctcagcaccaacgagctggcccagagcttcgaagagccggagcacaacccgccgaagctcgagaatggcgaggtgacgctgccgcccggactgaagaaggcgatgaacgccttcttcgacgcgggcatgcacctgctggagcagccgccacacctgggcggcctgggcgcgccgccctccctgggctgggccgcgttcgagctgctggtgggcgccaatgcctcgctggccttctacacgctgggcaacctgctggcgcgcatcatcgaccggctgggcacggacgcgcagaagcagcgcttcctgccgcacatgctggaccgccgctggggtggctccatggtgctcaccgagcccgacgccggcagtgacgtgggcgccgcccgcaccaaggcccgccgcgtctccgacgacgtctgggaaatcgaaggggtgaagcgcttcatcaccaacggcgactcggacatgtccgagaacatcatccacatggtgctcgcgcgtccggagggcgcggcgcctggcaccaagggcctgtcgctgttcgtcgtgcccaagtactgggtgaatgaggacggcagcctgggtgaagccaacggcgtggtgtgcaccaagctggagaagaagatggggctcaagggctccgtcacctgtgagatgaccttcggcgacgggaagccctgtcgcggcctgctgctgggcgaggtccacgacggcatccggcagatgttctacatcatcgagcaggcccgcatggcggtgggcgtgaagtccatggccacgctgtccgccggctacggccgcgcgctggccttctccaaggaccgcctccagggcgcggacctgatgcaggcccgggacaagacggcgccccgcgtgcccatcttccgtcaccccgacgtgcgccgcatgctgatggcgcagaaggcccacgcggagggcatgcgcgcgctgtgcctctacaccgcgttcatccaggacggcgtggagcgcaagggcggccaccgcgccaccgaggcgggcgagctggacacgctcaacgacatgctgctgccgctggtgaagggctactgctcggagaaggcctacgagctgctggcgctgtcgctccaggtccacggcggctccggctacctgcaggactacccggtggagcagtacatccgggaccagaaaatcgacacgctctacgagggcaccacgcacatccaggcgctcgacttgctcatgcgcaaggtggcgcgtgacggcggcgcgacgctccagggcctgctgtcccagattcgcgagacggccgagcgcaccggagagggcaaggagttggaggccgagcgcgccgcgctgggccgcgcgctgggcgacttggagacgatgctcggcacgctgatgggcaagctgggcgagtccatctatcacgtgggcctgcagggcaaccgcgtgctggccgccgtcgcggaggtcgtcatcggctggctgctggtgcgccacgcggaggtcgcgctggagcgcatgaagagcaaccccggggaccgcgccttctacgtgggcaagctcgccagcgcccgctggttctgccacgaggtgctacccggcgtcgcccacgccgcccgcatggtggagcacggcaacctggacctgatggaggtgccggaagagtcgttctga

SEQ ID NO: 2954 - DNA, 711 bp, Myxococcus xanthus
atgagcagcagctaccgcatcaagtcgggcgacaccctctcccacctggcgcagcgctacaacaccagtgtcagcgcgctgatgaaggcgaatccgcagatcaagaacgcggacctcatctacgccggcaagtcgctgaacatccccggttcgaaggactccttcgagagcggctctgcgggccgcgcgggtggcgccacgggcggcggcggcagcagcggcggtgcgcaggacgtgcagggccccagcagctccggccccggcgtccgcggccccaagggcagccccttcgaaatcgcgtcgcagcacctgggcaagaacgcgggctcgctgaagctggagaagaacggcgtgggcgcggacatggaggactgggtccccaacaacgtcaactgcgccaacttcgtgtccgccgtgctggagcagtccggccagatttccgactcgcagcacgacaacagcgtgatgggcctgatggccaagctggacagggaccccaagttcaagcgcatcgacctgaaggacgcgaagccgggtgacgtggtctccatgaagaccaacggcggccagcacgtggtgatgttcgcgggctggaaggacggcaagccgacgttcatcggctccaacaacgtcaactcggatggctcgcagcgcgtcaccatctccagcatgaactaccccatcatggcggtgcaccagtaccagggctga

SEQ ID NO: 2955 - DNA, 261 bp, Myxococcus xanthus
atgacgcaggaagaaggagccctgcacgccaagggcacgttcggtgggcagctcaccgacttccaggtgacgccgcagacgctcaagggcgacgtgggccggtgcagctaccagctcaaggcctccgaggaaggccgctatcaaggctggcgttcgtgtctcgccggattggagaacccggtatcgctgtcgattccgcctgccattggcggcgacgacgcccggctcgtggccaccctggctttgattctgtcgcggtag

SEQ ID NO: 2956 - DNA, 789 bp, Myxococcus xanthus
atgcacgaagtggacttccacatctacggcgaggacctgcagttcgtcgaggtggagttggacccaggagaagccgcggtcgccgaagccggcacgctcatgtacatggaggacggcatcgagatggagaccatcttcggtgacggctcggagaagacgagcggcttcttcggctcgctgctcggcgcaggcaagcgcctgctgacgggtgagtccctcttcaccactgtcttcctcaacaagagcggtagcggcaagcgcaaggtgtccttcgccgcgccctacccgggaaaaatcatcccggtgaacctgagtgagctcggcggcgagctcattgcgcagaaggacagcttcctcgccgcggccaagggcgtctcgctgggcatcgccttccagaagaagctgggcaccggcctgttcggcggcgagggcttcatcatgcagcggctccagggtgacgggctcgccttcatccacgccggcggcacgctgcacgagcgcacgctgggcccgggtgaaatgctgcgcgtggacaccggctgcatcgtcgcgttccagcccaccgtggactacgacatccagatggtgagcggcatcaagacggccttcttcggcggcgagggcctcttcttcgccacgctgcgcggccccggcaaggtgtggctccagtcgctcccgttcagccggctcgcgggccgcattctctccgcctcgcgcccgggtggcgctcgcgacgagggcagcgtgctgggtggcgtcggcctgggcagcctgctcggagacgactag

SEQ ID NO: 2957 - DNA, 1266 bp, Myxococcus xanthus
gaccatcgacctgaggaggagctcgtgaccgcggcacaggccgccgcgctcctgggcgtgaagcgagccacgctctacacctacgtgagccgaggcctcgtgcgctgcgtgccggagcgaggcaccaaggagaaccgctatgtgcgctccgacctggagcgcctgaaagcgcggcacgacgcgagagcgggacacgcggccgtcgcctcgggcgccttgcgctggggcgagcccgtcatcgactcgtcggtgtcccgcgtgggcgcggaggggctcgcataccgaggccattcggcggtgacgctcgcggtggagggacgcgcgttcgaggacgtggccgagctgttgtggacaggcacgctgcccgaagaagcgtcacggtggccctcacccgagccggcgtttccaccgtccgagctggcgaagctgttgccccgtggaacacctcccgttgccgcgctgtctgcgttggtgccgctcctaggcgcaagggactcggcgcgctttgcctctcctcccgagcaggagcgggcccgcgcccggaggctgctgcgccacctgtccgcctgggtctgcgtggcgaacgcgccggggcgagtgacgcatgccttgaacgagcccacggtggcgcaatccctggcgcgcgcttggaacacccgcgtgaagcgcgcacctgagctgctcaaccgcgcgctggtgctgtgcgcggaccatgagctgaacgtgtccacgttcaccgcgcgcgtggcggcctcctccagcgcggacctgtacgcctgcttgagcgccgcgctggccgcgctctccggtcccaagcacggaggggcctgcgaccgcgtggaggcgttgctcgtggaagtgggccggccggagcgcgcggcggaggtcatccgggagcggctgcggcgaggcgaagcggtccccggcttcggtcatcagctctatccagacggagacccacggacaccaccgctggtggaagccgcgcggagcgtcaggcccgagacgcccaatgtccgtatcgccagcgccgtgctggaagccatgcgcgcggcgggacatccgcccccgtccgtggacttcgggctggtgatgctcaccggagcgctggggcttccttcaggcgcgggcgccacgctgttcgccgtcgggcgtgccgcgggctgggtggcccatgtgctggagcagcgggaacagggccacctgctgcgccctcgggcacgctacgtggagccggcacaccccgccggtggcagggcgccatga

SEQ ID NO: 2958 - DNA, 165 bp, Myxococcus xanthus
atgttcctcgtcctgcgggtgggcggcatgtggctcttcgcctcgcgccacccggaggaggaacgcccacgcatgcggcgcacggcgaccctcaccaccgtgctggcgctcatcgccgtgggcatctgggtctacaccgtgctgcaaggcccgcgcggcttctga

SEQ ID NO: 2959 - DNA, 1083 bp, Myxococcus xanthus
gcgcgtttctcctcctgtccggacgcgcgcttccagcctgcgcctgcggacggcgtgttgccggagggcttcttcaccacgacgaatctacccacctacgtgcgcgtgggcggcgcgtggcgcatgccgcgcgagccgcgcatggacggggcgctggtgctggatgcccaaggcgagctgtggattcgcgaaggccgtcgcgtgcgtgcgggcgagcacgtggtggtaggcttcgcggaggatggcagcgaaggcgtgttcgtgaactccgcctacctcgcggatgagggcgagggggagttcaagttcatgacgagcgcggtgtcccgcgagaagcccatcgactacgcgcacatggcccgggtgctggtggacgagcgagagcgcgggggctaccccatctgggtgacggggccggcgctggtgcattcgcgggcgcgcgcggacatgacgtggtttgtcgccaatggcttcgtgggcgcgctgctggcgggcaacgcggtggcggtgcatgacatcgaagcctccatcttcgggaccacgctggggatgagcggctcgggcgaggccacctcgggcggccacggcttgcacatgcgcgccatcaacaaggtgcgggcggcgggctccatcgccaaggcagtggaggccggggtgattaccagcggcatcatgcacgcgtgcgtggtgcacaaggtgcccttcgtgctgacgggctccatccgtgacgacgggccgctgccggacgtggtgacggacaacctggaggcgcaggtggccatgcgcgagcacgcggtgaagtccaccatggcggtgatgatcgccacggcgctgcatgccatcgccaccggcaacatgctgccggcgttcgtcacggagaaggacggctcattgcgggagctgcccaccatctgcgtggactcgtccgagttcgtggtgagcaagctgaaggaccgcggcacgcaccaggcctttggcgtggtgacgaacgcgcaggacttcatgcatgtcctgcggctgtacgtggagcgtgacctggcggcgcgcgggctgccggtgccgggggacgcgctgaggaagtag

SEQ ID NO: 2960 - DNA, 390 bp, Myxococcus xanthus
atgaaccccgaaggaatgatgaagcccgacgtgtaccggaaggtggcggtcgccaccggcagcaggcaggtgcacatcgcagggcaggtcgcgtacgacgcggatgggcagctcgtcgcacgaggagatctggctgggcaggtcgcgcaggcctaccgcaacgtcgccatcgctctcgcggcggccggtgcgacgttcaacgacgtcgttcggctgacgatttacgtggtcgactggaagcacgagcggatgccggacttcctggccggcatcgagcaggtctccaaggagttgaacatcgtgccggcgccagcctcgctgattggtgtctccgtgctcttcgagccgggcgtcctcgtcgagattgaagccacggcggtcgtggattga

SEQ ID NO: 2961 - DNA, 564 bp, Myxococcus xanthus
atgagcgcgctgtcccggagattgaacctggactgggtgctgccctcgctggcggtggggggccgcttccccatcgatacggcggagcacctcgcgggggcgcttggcatccgctatgtggtggacgtgcgggtggaggactgtgacgacgagcacgtcctgcgcgagcacggcatcaccttgttgcacctgcccaccgaggacctccgggccatccgtggcgaccggctggatgacggcgtcgcgtgggtgacggaccaactggctcggggccacaaggtctacatccactgtgagcatggggtggggcgcagcgcgctgctcgccttgtgcgtcctggtggcgctggggcatccaccgttggaggcgctgtccctggcgaagcggcggcgctggcaggtgtcacccagcacggagcaactgcgcaccttcatggcgtgggcggatgcctggcgtcagcggaacgcggcgacgtggcgtgtgcccaggttggaggagctggccgcgattgcgcacagccacctgacccagccgccacccgcttcccgcgggaatgaggactga

SEQ ID NO: 2962 - DNA, 774 bp, Myxococcus xanthus
atgagccacgcggccaccttctcagagcggctggtggatgcgggccggggtctgctcaccggtgtctcgagcgcgtcggtgggagtggctcgcagcgtgggggtggtgctgaaggcgatgggcggaggcgtggcgcagtgcgtgcgcggccggcctcgcgagggactgccccaactgggccagggcctgacgcgcgtggcgcagcttcccgcggatgccgtgttgatggtgggcgggcgcgtgctcagctcggtgcaggtgctggtcggtctggagccgccgggccgccgcctctcggcggaggaaatcgcccgcctgcggcccatctttggagacagcctgaactacgcggtggtgcgggtgaaggtcggtcggctgggcctgctgggccttcccgggcgggccttcgcgcacggcaacaccgtcttcgtcccgcctcggagcgggggcgtggacttcggcctgctcgttcatgagctgacgcacgtgtggcagcaccagcacggtggcacggcctacctgagcgccgcgctggccgcgcagtggtccggcgatggatacgactggcgcaagggcgtgagccgcgagaagcgttgggcccagctcaaccccgagcaacaggctcagctcatcgaggacgccgccgttgccggcctcatccccttcaccacgtctgtgtccccgcgcatgaagcttcggggctggtccgacgcggcgctcgacctgctggatgaggccgtggtctgcctgcactcgggccgcggcgcgccctga

SEQ ID NO: 2963 - DNA, 384 bp, Myxococcus xanthus
atgctcgtctcggaggagccgctcttccggctggcgatgggccgcgagctggcgtcagacttcgaactggtccccacgttgggcatcgcgtcggcggatcgtcggatggacctgggtgtggtgcccgaggccgtgatcgtggacctggactccgtggagcgagcggccgtgccgaccttcctggctcggctggtggagcgcgacctggcggggccacgcatcctcgtgtcgtcctacttccgtcccgaggtggcggcggcctacagcgcctccagcctcacgcacttcgcgctgtcccgcccgtggcgcccgggtgcgctgcgcacgctggtggagtccgtgatggggctctccgggctgcgcgccatgacggcggggcgctga

SEQ ID NO: 2964 - DNA, 1062 bp, Myxococcus xanthus
acgctcaacaagctgctcgcggtcggtgtgcagaacggtgcatcggacatccacttccggccgggggatccgcccatctaccgggtcaatggcgcgctccggcccttgaagatggaaaagcttcacgcggaccacacgcgacaggtggcagtccatgtcgtgtcggaccccgaggtgaagaagcagattgacacgcttcaggagtgcgacgcgtcctacagcctcccaggtgtggcgcgcttccgggtgaatatctaccggcagcggggctcgctggcgtgcatcctgcgcatcatcccggatgaaatcccaaccattgacggactgggattgccgcaggtgttgaagaagattgccggcaacgagcgcgggttggtgctggtgacgggcgcgacgggctcggggaagagctccacgctggcggcgatgattgaccacatcaatcgcacggagaacctgcacgtcctcaccatcgaggaccccatcgagttcatctacaagaacatcaagtcctccatctcccagcgggagattggcccggacacgcagagcttcgcgattgcgctgcgcgcggcgctgcgccaggacccggacgtcatcctggtaggcgagatgcgcgacacggagaccatcgacatcgcgctcaaggcgtcggagacgggccacctggtgctctccacggtgcacacgacggatgcgtcacgcaccatcaaccgcctggtgtcggtgttccccgccgaagagcagacaatggtgcgcatgcgcctggcggactgcctcaaggccacggtgtcgcagcgcctgctgccccgggccagcggcaagggccgcaccgtggcgttggaaatcatggtgcagacgaagacggtggagcagtacatccgcgacgaccgcgccaacgagctgaaggacgtcatcgagaagggccgagacatgttcggcatgcagtccttcgaccagcacctgacgcagctctatcgggaggggatcatcaccctggagacggcgcagagcgcggcctccaacccggccgacttccagcgcgcgctcgagttcgagtga

SEQ ID NO: 2965 - DNA, 1140 bp, Myxococcus xanthus
atgtcgctgggtggcatcctcacgttgatgggcgggctgcacgcgtacatcgcggtgcgcctgttcgtgagcccgcagctaccgctgccgtgggcatggctggggcccgtcctggtggcgctgctcttcctgtcgctgcccgtaggaatggtggcgtcgcgccgcgaaccgactctctgggcgcaggtgctccagtggacgtcctacgtgtggctgggcgccttcggcatcctgctgagcgcggtggtggtcgtggacctggtggggctgggcctgtcgtggtcgggcgtggtgacggacgcgttggccctggcccgaggcaaggccctggtggcggtgggggtgacggtgccggcggtggtgtacgccttcatcacggcgcgtggccgggcgacggtggagcgggtgacggtgccggtggcgggtttggcacccgggctcagcggcctgaaggtggtgcagatttcggacatccacgtggggcccacgttggacggccgctggctgcggcgcgtggtggagcaggtgaacgcgctccagccggacgtggtggcggtgacgggcgacctggtggacggcgccgtggacgcgctacgggacgaggtgaagcccctgtcggagctgcgcgcgtcactgggcgtcttctacgtcaccggcaatcacgagtactaccacgggggaccggcctgggcggcggaggtggcgcgcctggggctcaccgtccttcagaacgagcaccgggtggtggagcgcgacggagcgcggctcaccatcgcgggggtgacggaccatgacgcgggccacatcattccctcgcatgccagccgtccggagctggcgctgcgcggggcgccgcagggcgtgccgcgtctgttgttggcccaccagccccggtccgccctgcgcgtggcggaggctggcgtgatggtggacctgcagctttccgggcacacgcacggcggacaggtgtttcccttcatgttcctcgtcaaattgcagcagccggtggtgcgtggtctggcaaccattgccggggtgcgcgtctatacccacagggggacaggctattgggggccgccgctgcggttggggccctcgcctgagattgcggaactgaccctggtgtctgccccggggtaa

SEQ ID NO: 2966 - DNA, 2067 bp, Myxococcus xanthus
atgggccactgggagctggcgcgcgtgaaggcggtatcggagtcgccgcccgggctgcgcttctccgagcccctggtgcatgcctacaccgcgccgggcgcgcaggtggtcaccgtgcccgagtacacggacgtcctcgtgtccgcgggtgcctcggtcgtagcccatccatgggatgggcgcagcggcggcatcctggccttcctcgccacggggagcgtgacgaaccagggcctcatcagcgcggaaggaatgggcttccggggcgggctcttcgtcaatcacgcggacctccttggctgctccgacctggacatccctcccgaggcagggggggcctacaaaggggagggcctgcggatgggccacttcggcacggcctcggggcgtggctccgtggcgggtgagggtggcggtggcaactgccacaacgcgggtggtggcggaggcgggaatgggggccggggcggtgtcgggggccgcacgtcggaggcggacatgatgcgggacgtgggcggtttcggtggcgcgcccgtgaagtactcgctcatcgacaagtttgtcttcgggagtggcggaggcgcgggcgagggcaacgatgacctgggctcgaatggcggcgcgggcggcggtgttgtgttcatccgggccagggcgttctcgggcgccgggcgcttctccgcggatgggctcgccgccagccacacgccgggagacgatggcgcgggcggtggtggcgcgggcggtgtcctcatccttcgcgcgcaggactcactgtcctgcgggagcgcccgagccgcgggcggcaacggcggcaacgtcagctacccgggctgggtgctcggcccgggcggtggtggcggtggcggcggcgtgctgctgcagggggcgacggcgtcgtgtcccatgagcgtgtcgggcggcgctgccgggaccctcaccccgtcggatggcggaacgaatggcgcgggtacggggagcgaaggcttcaccgaggaataccacgtggcctaccgcacgcccgggacgccgtctgtcagcgctcccgtgtccggagcggtgggcgttcctcaccgtcctcgcttcgaaggccgggcggaccctggcgttcgagtcctcgtgttcgtcgatggcgtggagctgcttcaggtgagctctggcgcggatggcgtgttcaccgctggcatccctccgcatcaggcgccgctcgatgtcggcacgcgcacggtccacgtggtggcggaggcgatgggggcgtacagcgcgccctccgcgcctgtgtcgttctctgtcgcgaccacgctggaggatggtggcgtggtggtggagcccatcctggtgattccccaggacggggagacggtgggaaccacgccgctgttcgcgggcgtcgcgcccaacgggcagacggtgggcatcgaggtggacaatggccccgaggtcatcatccccgtggatggcgcgggccgcttccgctaccagtggcctgctgaatcgccgctggcgccgggccctcatttcgtcaccgttcattcgcacaacgaggcgggaatcagcgggccctactcgcagcccatccgattcgagtcccaggtggtgagcggcgagggggacggagggacgtccgggcaggatgcgggcacgtcccagggagatggcggcacccagttcccagaggacggttggccggtgctggtggttcccgctgatggcgaggtggtggactccacgccgctcttcgcgggcgcggcgacggctggcgccacggtggtcatcgaggtggacggcattgaagtcgccacggtgacggccgatgacaccggggccttccgttaccaggtgccccgcgagagcgcgctgtccgtaggctcgcacagcgtcgcggcgcaggagcgcctcgtcacctccagccgcgtgccggcgcgctcgcggaccacgggcttcgaggtgcgggggcccgcggcgctcgacgtggggtgtggctgcggcgcatcgcccgtgggcgtggtgggctcctgggtgctgctggcgggactggccggcctgtcgcggcggcggcgcggatag

SEQ ID NO: 2967 - DNA, 498 bp, Myxococcus xanthus
atggccccattgctcgacgtgctcacccgggagcggctcctcaaggaccgcgctgccgccgcggcgctgctgccgcgtggcgagcctccccatgtgtccatgctgcgcctgtgtgacgcgggcctgctcgaaggcggcttgtccgtggggtacggcgtgcgcgccgacgagctggtggggccgctcaccaccgccatgggcggcgcggcccgccgcttcaaggtggtggacgtgcgcgagcgccccgtgctggagctccacgtcatggggggtgacgtgacagagcgctgggaggtggaggacctgtccgcgttggtgcacaacctcaacagcctctaccgcgatgcgccggacgtgcgcgcggtggtcgagctgggcgagtgggaggatgcgctccagctctggtgcgtggacaagcgcgccctgccgaggctcgcgcgccagcccttcttcgcaccgcgcaacgcccgggcgctgatgaacccctcgggcgagtga

SEQ ID NO: 2968 - DNA, 504 bp, Myxococcus xanthus
atgtcctcgcatcctcacgtcgtccacgagcccgagcttccctggaccgaagtcacgcaaggtccccgggtggagtaccgccgcaagcaactgggctccgccgccaagggccgcaagctggggtgcagcttgatggagctgccacccggtaaacacgcgtggccgcggcactaccacctggccaacgaagaggcctatttcatcctcgcgggcacgggccggctgcggctgggggacgacaccctcgccgtcacggcgggcgactatgtggcgctgccggtggggcccgggggcgcgcaccagctcctcaacgacggggccgaggcgctgcgctacctggccttctccaccatggtggagccggacgtcatggtgtacccggactcagggaaggtggtcatctccgcgggcagtgctcccgggggcgacaaggccgctcggaccctgttcaccacgctgcccctctccgcggaggtggactactggagcggcgaggagcgatag

SEQ ID NO: 2969 - DNA, 780 bp, Myxococcus xanthus
atgcaggtggacttcggacgcacgtcgtcggactacgtgaggcaccgggcgggctttccggaggccttcttcgaacggctcgacagggagggcctccttcgttcgggcctccgcgccgtcgacctggggacgggcacgggcacggtggcccgagggttggcccagcgcggcgccgtggtgacggggctggatgtgtccgcggacatgctggatgccgcccgtgggctcgcctctggaatggggctgggcatcgacttccgacaggcacccgcggagaacacgggcctgccgtcacaggcgttcgagctggtggtcgcggggcagtgctggcactggttcgaccggcccgccgcagcgcgtgaggccgcgcggttgctcgttcccgggggccgtctggtcatcgcccacttcgactggctgcccctgcccggcaacgtggtggaggccaccgagcggctcatcgagcgcttcaacccgggcgctcccgcgcccttcgtatccttgagccagtcttccggtgtctatcctccgtggttccgagacgccgccgaggcaggcttcacccagctcacctcgttctccttcgacgtgtccgtgtcgtacagcccccgcgcgtggcgggggcgcatccgcgccagcgcgaaggtgggcgcgtccatgcctgcgagcgcggtgagtggcttcgatgccgcgctcgcggacctgctcgccgggagctttccggcggactcgctcgacattccccaccgcgtcttcgcgctgctcgcgacgcgaccctga

SEQ ID NO: 2970 - DNA, 1110 bp, Myxococcus xanthus
atgggtctatccatcggaatcgtcgggctgcccaacgtcggcaagtccaccctgttcaacgcgctgtcggccgcgggcgcgcaggcggccaactatcccttctgcaccatcgagcccaacgtgggcgtggtgcccgtgccggatgaccgcctggacaagctgtccgcgctcatcaagccgctgaagaaggtgcccacctcgctggagttcgtggacatcgccggcttggtgcgcggcgcgtccaagggcgaaggcctgggcaaccagttcctgggcaacatccgccaggtcaacgccgtgctccacgtgctgcgctgcttcgaggacgacaacgtcacccacgtcgagggcggggtgaatccggtgcgggaccgggacgtggtcgacacggaactgtgcctcaaggacctggagacggtggagaagcgccgcgagcgctccttgaagaacacgaaggtgggcggcaaggctggcgaggaggccaaggccgaggtggcgttgctggaccgcatcaaggcgagtctggacaacggcatcaccgtgcgcgcccagaagctcaccgaggaggagagcgccgtcatccatgacctgttcctgctcaccgacaagcccgtgctgtacgtggcgaacatcggcgagtcggagctgggcaaggaggacgcgaatccccacgtgaaggccgttcgggagatggccgcgaaggagggcttcgaggtggtggtgctcgccgccgcgctggagtccgaaatccagcagctcccggagtcggagcgtccgggcttcctggagagcgcgggcctgtccgagccgggcctgcacaaggtggtgcgcgccggctacaagctgctgggcctgtggacgtacttcaccgtgggcgagcaggagtgccgcgcgtggaccatccaccagggctacaaggccccgcaggcggccggcgtcatccactccgacttcgagcgcggcttcatcaaggccgaggtgatgcgctgggaggacctggtgaagctgggcagcgagtccgccgtgaaggagaagggcatgctgcgcgtggaaggcaaggagtacgtcgtccaggacggcgactgcatgcacttccgcttcaacgtgtag

SEQ ID NO: 2971 - DNA, 525 bp, Myxococcus xanthus
atggacggcgccgccgagccgctctacttgtatgagatttacaaggggctcttcgccgccatcgtggagcccaccatccggatcgcctcgcgcgtcgaggtcgggccctgggcccagttctctcatgcgcagatgcgcattcgttgctccgctgagcggacgtgcaaaggcagcaacctgcgcttcggcctccaggggaactatcactggaacccatcgggacccatcgacctctggtcgggggtggcactcggctacgatacgagctcggtctcggtgcccgcggcggaagtcacctactcagggcctgacgtcacgctgcaggctgggttcgacaggaatttcggcgggaacttctgggccgggctcttcgtcgtcggtacaggtggccagtacgacaagctggatgtacgcctgctcaacggttcggggagcgaaaccctccgcgagcgcgccttccatctttggattggcttcggtttccgggtgcgcgttgccgctcctcacccggcggtcacgaattga

SEQ ID NO: 2972 - DNA, 462 bp, Myxococcus xanthus
gtcgtcctgaagtggaaggcgtggggccccatcctttcgctggtcgaggagcgcgagaagcagatcgccagctccatcgagagcgccaagcgtgagcgcgccgaggcggagaagctgctggccgaccagaagacggccatcgccgaggcccgtcgcgaggccgcggagatgatgcgccgcaacacgcaggagatggagaagttccgcgaggagctcatggccaagagccgcaaggaggccgaggagctcaagctgagcgcgcgtcgcgagattgacgagcagaaggcgaaggccatcgccgaggtccgctccatggcggtcgacctggccatggaagtcgccggcaagctcatcagcgagcgcatggacgacagcaagcagcgcgcgctggccgagcagttcgtccagggcctgccgctgaacagcaccagcgccaccggcgccgtgcgccgcactgcctaa

SEQ ID NO: 2973 - DNA, 633 bp, Myxococcus xanthus
acgcgcgccgagcccgacggcagcggctggtacgactcgtccgcgcacatgctgtggattggcgagcgcacccgccagctcgacggcggccacgtggagttcatgcgcggcatccagaaccccattggcatcaagtgtggccccaccatggagcccgacgaagtgctccggctgatggacctcctcaatccccagggcatcccgggccgcatcaccctcatcgggcggtttggcgcggacctggtcgcggaacggctgccccggctcatggccgccacccgccgggacgggcgcccggtcatctggtccatcgacccgatgcacggcaacacccacaaggccggcaatggctacaagacgcgctccttcgaccgcatcctcacggaggtgtgtggcttcatggacgcggccgccgcggaaggcgtccaccccgggggcctgcacctggagatgacggggcagaacgtcaccgaatgcctgggcggcccacagcccgtgacggaagacgacctctccagccgctaccacacccactgcgatccgcgcctcaacgcggaccaggcccttcagttggccttcctcgtcgccgaatccatgccgtcccttcgcacgcacgaagcccgtgcggcctga

SEQ ID NO: 2974 - DNA, 1113 bp, Myxococcus xanthus
atgcggctgttcagtctgtcagccgcgcagttcggaacgttggtgtcctcctacacgttggcctccgccgccatgggcgtgctggggctcgcgtgggtcgacaggtttggccgcagaagcacgttgctggtcatcctgggagggttcatcacagccacgctggcctgcggcgcggcgcagagccacgcgtggctgctggtggcccgaagcatcgcgggaggatgtgcgggcctcatgggcgcggtcatcatgtccatcatcgcggacaccatccccggtgaacgccggggccaggccattggcacggtgatgtcatcgctcgggttgtctgcggtggcgggtgttcccctgagcctgggcatggccaacatgctcggctggcgcgcgcccttctgggccattggcgtccttggggcgctcctgtggttcgggctgctcgccgtgcttccgcgactggatgcgcatgtcaccacggactcggatcgtcaggcgccttccgtcacggcgctcttcacgccgggcttcgcgctgggctggctgctgacgttcagcgtcgccttctccagcttcttgctgattccgtacctgagcgcgttcatggtcggaaacctcggactgaagcagaccgacctgccctgggtgtacctggctggcggcgccgccacgctgctcgcggcgcgtcaggtgggccgctgggtggaccggtttggccccgcccgggtgctcgggctgctgctggtgggcactatggtgccgcacctgggcttcacgcaccttcccgccgctccgctgccggtggtgatggtcgccttcgtcctcttcatgtccctgacgtccacgcggcccatccccaccatcgcgttgatctccgcgaaggtgccgccgccgctgcgcgggcggtacatggccatgaacatggccgccagcgacggtgcctccgggctcgcggcgtgggccagcggcctgatgctggccaccacgcctggcggtgcgctggtgggcttcgggctggccggatggctcgccgtgggcgtcaccaccgtttcgctcttcatcctctggacctttggccgtagcgccgtcccgctcaacgcggcgcccacgcctcggtga

SEQ ID NO: 2975 - DNA, 1473 bp, Myxococcus xanthus
atgattgtcgggacggcgggccacatcgaccatggcaagacgtccctggtgaaggtgctcaccggcatcgacaccgacccgctgaaggaagagaagcgcccgcgcatcaccctgcagctgggattcgcccacctgacgctggatgacggccccgtggccggcgtggtggacgttccgggccacgagcgcttcgtgaagcccatgtccgctgactcagacggcgtggacctggtgatgatggtggtgaccgcggacgagggcgtgatgccccagacgcgcgagcacctggacatctgccggctgctgggcgtgagggccggcgtcatcgccctcaccaagtcggacacgctgtcggagctgggcccggagtggctcgcactggtggaggccgacctgtccgcgctcaccgtggggaccttcctggagtcggcgcccgtggtggcctgctccgccagaacgggtgcgggattggacgcgctgcgcgccgcgctcacccgggccgcggcggcgctgcccgagcggccttcggagggccccgccttcttgccggtcgaccgcgtgttcaccatcaagggctttggcacggtggtgacgggcacgctgctgtcgggagcgctggcggtgggtgacgcggtgtcgctcctgcctgggctgcccggtccgctgcgcgtgcgcggggtgcagcgtcatggcgacgccgtatccgtcgtggaggcggggcagcgcgcggcggtgaacctcactggcgtggagccggaggcgttgcgccgggggatggtgctggtgcgcgcgggcgagctgccggaggcgcgcatgctcgatgtcgagttgacgttgctgcccgcggctccgtcgccgttgcctcgtcgctcgaagctgctgctgcacctgggcaccgcgcaggtggaggccacggtggcgctgttggatgtggagcggctggagcccggcgagacgacgctggcgcagttgcggctgggcgcgtccgtgggtgcgttggtgggccagcgcttcatcctgcgcggcgcgcgagcccttccggggagaggcgccacggtggcgggaggccgcatcctgtccatctccccgccgaagcggcgcaagggcggcgcgtcggcggtagcgcccctgctggaggcggacccggcggggcaggtggcctggctgctgcggcaggcgggctatcgcgggctgacgcagccggagctgttcggccgctcggcgctggggccccgggtcctcacgcgcgcgctggagttgctgggggcgcggggcggtgcgctcctcatcgaccgggagcggcggctgtacctctccggcgaggtcttcgaggcgttgcagggccgcgccctggcgctgctggccaccttccatgagcgcgaacccttgcgcgaaggcctgtcacgcgaggagctgcggcagcggctgtcgtgcgagtgcatgttacgccctgtaaaacgccccgggagagca

SEQ ID NO: 2976 - DNA, 579 bp, Myxococcus xanthus
atggatgatgatgcgcccgtggccgccaagcccgcgcgcaaggcgccggcccgtgcggccaaaaccgcgaccgtgggtggttcgagcctggcgcgtttcggtcggcccaagggggcttcggccgagggcaagcccgcgcgccgttcgttcggtggcgatgagggcgcgccgcgtggccgttccttcggcggtgacaaggctggcgctccgcgtggccgctccttcggtggtgacgagggcgcgccgcgtggccgctccttcggcggtgacaaggctggcgctccgcgtggccgttccttcggtggtgacgagggcaggcccgcgcgccgttccttcggcagtgacgagggcaagcccgcgcgccgctccttcggcagtgacgagggcaggcccgcgcgtcgttccttcggcggtgacgagggcaagcccgcgcgccgctccttcggcagtgacgagggcaggcccgcgcgtcgttccttcggcggtgacaaggcaggctcgccgcgtggccgttccttcggcagtgacgagggcaggcccgcgcgccgttccttcggcggtgacgagggtaagctttag

SEQ ID NO: 2977 - DNA, 174 bp, Myxococcus xanthus
  unsure (1)..(174): unsure at all n locations
ccggcattcacgaagcggatggagaagagcncgncggccagtgaagccgcgctgcaggacctgcaagaggccatggcggccgcggactggacacaaaaggtcagctccagcgtcctggacacgacgcccccggaacccgagacgggtgatacgacggggcccaagcccgagtga

SEQ ID NO: 2978 - DNA, 378 bp, Myxococcus xanthus
atgtcgaagtccctgtcccggcgcatcctggccctccccctgctcgcggcgctgttcgcggcgcccgccgcgatggcggaggatgcgccaaggggccggccctatgtcttcacgaccgtggacgactacagcatccggctcgatggccgcatcgacgtcacgggcgtgctccaaggcgaagcagagcctcggactgtcaccttcaagatcgttctttcacacggcgcgcaggagagccttcagacactggcgagccgctgcgaccggatggccctgcttgcgatgtcaaaacccggcgcgtacctgctcacgatgtccgtggaagaccatcccaacaattacatccagttcgcctgcaagctggcccgcgtcccctag

SEQ ID NO: 2979 - DNA, 2049 bp, Myxococcus xanthus
atcgccgcggaggacggccgggtgctgttccgcaagaacctcacggaggacgcggcgcacagctaccgcgtctgggcggatgccacgtctccgttcactccgttcgccggaccgtcgggcaactcgcacatcccgcacccgacggggacgccggatggcgaagtgccgctcttcgtcgagcgcaacctggtgacgctcgacaatgcgccattcagccgcaatgacccgtggctgcccgtggacgccagggagtcggtgggcaacaacgtggacgcgtacgcggacctggccgcgccggacgggttcagcgaaggggacatgcgcgcggccctctcggggcccgcgacgttcgactatccgcacagcttcaacctgctgccgtacgagacaccccagcagatccagtcctccgtcacgcagttgttctatgtgaacaactggctgcacgacgcgtactacgacgcgggcttcaacgaagcggcgggcaacgcccagcatgacaactacgggcgcggagggcttgggggtgacagcatccgggcggaggcgcaggacttcggtggcgtgaacaacgccaacatgtccaccccggccgatggtgcccgcccgcggatgcagatgttcatctttcccggaggcaccgcacagagttccgtcgaagtgacggcccccgcgagcatcgcgggaccgtatacgttcgtctcctcgcagttcgccccccgcgtgttctcggtgtccggccgcgtggtcgaagggctggatgcggagaacgccgacgggccttccaccacggatggctgtacggcgctcaccaacgccgcggaggtggaggggaacatcgccctcttcgaccgaggcacctgcagcttccatcggaaggcactcacggcccaggcggctggggccatcggggtcgtcatcgccaatatcgatggcatggccatgcccgaggggatgggcatcgagaacgggctctcgccgtcgcgcattggcgcggtgatgattccgaagggggacgcggaccgcatccgggggacgctcacggagggggtgcagctctcgatgattcatcgccccgagggtgacctggacggcaccatcgacacgagcatcgtggcgcacgagtgggggcactacatcagcaaccggctcgtccatgacggagcgggcctgggcaccaaccaggcgcgcagcatgggagaggggtgggcggacttccatgccctgctgctctcggtgcgcgaggaggatgcgcaggtcgcctcgaatccgaactggacgggcgtcttcccggtgggcgacttcgcgacgcggaacatgagcgcggacgccgcctacttcgggattcgccgcgtgccctactcggtggacttccgcaagaacccgctgaccttcaagcacatctccaacggagtccgtcttcccagcggcgtgccctatgccttcggagcggatgggagcagcaacgccgagtaccacaatgccggcgaagtctgggcgaccatgctgtgggagtgctacgtcgggctgctgcgtgactcctcgcggctctcgttcaacgaagtccagcggcggatgatgagctacctcgtcaccgcgtacacgctgaccccggcctcgccgacgttcctggaggctcgcgacgcgctgctcgcggcggcctatgcgggagacccggcggactaccaaatcttcgcggaggcgttcgctcggcgtggcgcgggaatcggcgcggtggcgccggaccgggtctccacgagccatgcgggcgtggtggagagcttccgcacgggcgcggacgtggtgttcgtctcggcggagctcaccgaggacggtagcgagaacacctgcgacgcggacgggtatctggacaacggcgagagcggcgtgctgcgcgtcacgctgcgctccacgggcaccgccccgttgcaggcgacgagcatcaccgtctcgtcgaacagccaggccgtgcaactggccaatggtggggcggcgagcttccccgccatggggctgtacgaaacggccacggtggaggtgccggtgcgg

SEQ ID NO: 2980 - DNA, 450 bp, Myxococcus xanthus
ttttggggggtccaggacgcgcggccgctccagcgactggagctccagtactccaccgacaacgggacgctgaacgtgagcttcgacctcgacccgggggccgagccgggacgtggcgacccaatgactcatttcggcttcgcggagctcctcgtcccgcgctgggccgacgtgaaggaccacaagccgtccctggtgggcctcgatggcgcgaagctcgcggcccgcgaggatgggacctggggcacgcccgaggcgcacgcgaaactcgaggagcacttggggaagatgctcgtcgcgacgctgctcgagctgcgggacagcagccagttcgaggccctgcgcgcctcggccaccgcggagctgggtgtcgaggagtacgaaggccacttcggctggcccgactacgaagagcgcgggcgcgagaacaggattgcgtcgtccccgtag

SEQ ID NO: 2981 - DNA, 201 bp, Myxococcus xanthus
atgatgagcatcctcggcgcccggacgctcatccccggcgccgagggcttcggcatcgcccgccgagagcccgccgtcgccgagcgccaccgctccgtgtgcttcagcgagattcccctggaccagctcgcccggctcgtccagcgccgcagcctgtatggcattggtttcagcaagacctacatcctctcccagggcggc

SEQ ID NO: 2982 - DNA, 363 bp, Myxococcus xanthus
atggacaatccggaggtcgtccagccgcagggcaaggtcccggccggcatggtggggcgctggaatctgtgggtgccgggcggcatctggtacagcaccgacggcagccgcatctatcgcaactatacgcaaggagccgccatgaacagcctgaccatccgcgccaacggcacctacaactggggcgggacggcgggccggctgacggagatccgcccctggtttgcgcaacccggcgagcgctatttcgccgtccagctcgatgccgacctcaagtacatggcgcgccacgatgcggggaagggcaagatcgacctgttcttctggggtgtgggcggccacgcggcgaccggcacgcgctga

SEQ ID NO: 2983 - DNA, 213 bp, Myxococcus xanthus
accgattccagcccgagcctgcacttgtggctgtggaatgcggactggggcccgtgcaaactggagagcgagattgccgccggctcctggctcttcaccgaggccaccgcggaggcggtgcttggccacgagccgtcgaaattgtgggatacgacgctgcgtggcatgggggtggaccccgccatgctggtgatgggaaggggaatgaactga

SEQ ID NO: 2984 - DNA, 258 bp, Myxococcus xanthus
atgctcgacgccgaattcatccgggcccgcatcctggaggccctgccgggctccgaggtagaggtgcgggactacaccgggacgggagaccactacgaggcccgggtggtgagccccgacttcgctgggaaagccatggtgcagcagcaccagctcgtatacgcgccgctccagcagtggctgaagagcggcgagctgcatgcgctcgcgctaaagacctattctcccgagcagtggaagaagctcgggactcgctag

SEQ ID NO: 2985 - DNA, 321 bp, Myxococcus xanthus
atgacgcctgaactcaaggcccggttggagcaggagacccggtcgcacaagattgtgctcttcatgaagggcaacgccctcttcccccagtgcggcttctccgcgcgggcgctgcagctgctgcagcccctggggcaggtccacacggtggacgtgctcgcggatccggagattcgccagggcatcaaggacttcaccaactggcccaccattccccagattttcatcaacgggcagttcgtcggcggctccgacatcctgatggagctggccgagcgcggtgagctggccgacctggtcgcgggcaagagtccggcctag

SEQ ID NO: 2986 - DNA, 303 bp, Myxococcus xanthus
atggccgtcttcttcttcggcggcttcatctacgacgtcctcaccatcagccgcatcgatgacacgctgacgctggcgcagaacttcggctacctgctggtcctcacgggactgctgctgctggagcagcgctacccggacggcgtcgagccgccgaagttcctgcagaaggtctggcgctggcgcgaggacggcatccacttcctcttcggaagcctgctcagcgcgttcatgctgctgctcttcaagagcacgtcgggcgcgctgccctacctgttcgtggtgggcctcttcgccctttag

SEQ ID NO: 2987 - DNA, 123 bp, Myxococcus xanthus
atgtcgcgcccgctggagggcatgcgcgcgtggatgccgccgggcgacgcggtgcgcgccgtggcggcggcgggaggcacggcggtgctggcccaccccgtccagaagcgcaacccctggaaa

SEQ ID NO: 2988 - DNA, 1710 bp, Myxococcus xanthus
atggcggcggtgggtctgtcaacgggcgcgtacgcgtatctcacgggcccggcgctgcgcttcgtgctgtcgggcggtgaagaaggtttcgccagcgcgcagcgcgtgccttggttggcgaacctgccccgcgaggcggccctgtggggcttcccgctggtgatggtcatcgttggcgctgcgaagggcgtggggtacctggcgcagttctatttcatgggcctgttcgcgcagcgcgtggtgaaggacctgcggcgcgacctgttccagcgcctcaccgcgctgtcgcccgcccagctcgcgcgcgagcggatgggggacctgctcagccgcttctcctcggacgtcagcgccgtggaagcggcggccatgtacacggtgggctcgtacctgcgcgacaccctccaggtcatcatcctggcgggcgtggcgctggcgatgagcccgatgttgggcggcctcatgttgctggtgattccgctggcggcgctgccggcctcgaagctgacgcgcaaggtgctcaagcgcacgcgggaaggccagacgcagctcggcaacctggcggggcagctccacgaagggctgggcggtctgcgcaccatccaggccttcaacgggcaggcggcggagctggctcgcttctccgccttcgcgcaggcgcacgagaaggcggtggtgagcgcggcgtgggcgcgtggcgcggtgccagggctgatggaggtgctggccgcggcggcactggcgggcgcactggcgtatgcggcgagcgcgcggctgatggagccggaggcgctgctctcgctgctgacggcggtcatcctggtgtaccagccggtgaaggacctgggccgggtgacgcagttcgcggtgcaggcgggcgcggcgggtgagcgacttttctcgctgctcgacatgaagcacccagtggaggacgcgccggacgcggtgcccgcgccgaccctgtcgcggagcatccagttcgagggcgtgcgattcgcctatggagagcggcccgcgctggacggcctgacgctggagctgaaggcggggcaggtgacggcgctggtgggtggcagcgtcggaggcaagagcacggtgacatcgctgctgctgcgcttcgagcggccacagaagggccagctcctcctggatggtgtggacgcggaccggtacacggccacgagcgtccgggcccagttcgcgctggtgacgcaggagccgctgctgttccacggcacggtgctggacaacctgcgctacgcgaggccggacgccacgcgggaagaggtggaggccgcggcgaaggtggcgcacgcggacggcttcatccgcgcactacccgaaggctatgacacgcgcatcggcgagcggggcgtggcgctcagtggaggccagcgccagcggttgtgcatcgcccgcgcggtgctggcgcaggcgcccgtgctggtgctggacgaagcgaccagcagcctcgacccggagagcgagcgcgaagtgcaggcggcgctggcggcggtccttccaggccgcacggcgctggtgattgcgcaccggctgtccacggtggtgaacgcggacgtcctcaacgtgatggaggcggggcgcgtcgtcgagagtggctcgcacgcggagttgctccagcgaggcgggcggtatgcggcgctgtggaggatgcagacggagggctcctcggagcgaggcgcggcgtga

SEQ ID NO: 2989 - DNA, 1206 bp, Myxococcus xanthus
gacggccccttccgagccctgctgctggagaacatccacccgtccgcgggggagatgctggccgccgagggcttccaggtggagcgcgtctcgtccgccctcaagccggacgaactggcggagcggctgaagggggtgcacctgctgggcatccgcagcaagacgacggtgccgctcgcggcgctggagcacgcggagaacctgctggccattggggccttctgcatcggcaccaaccaggtggacctgacgtccgccaacacgcacggcatccccgtcttcaacgcgcccttcagcaacacgcgcagcgtggcggagatggtgattgcggaagtcatcgtcctgacgcggcagctcttcgagcgcagccaggaggtccacgcgggccagtggcgcaaggtggccaccggcagccatgaggtgcgcggcaagacgctgggcatcatcggctatggccacatcggctcgcagctgggcgtcatcgccgaggcgctgggcatgcgcgtcctctacttcgacgtgatgaccaagctgccgctgggcaacgcgcagccagccgtcaccctggaggagctgctcggcgcttccgacttcgtcaccctccacgtgcccgcgctgcccaccacgcacatgatgatgggcgccgagcagattgcccagatgaagaagggcgcctgcctcatcaacgccagccgaggcacggtggtggacatcgacgcgctggcgcgggcgctccagtcccagcacctgggcggcgccgcggtggacgtctacccggaggagccggagagcaactcggacggcttcgtcaccgcgctccagggcctgcccaacgtggtcctcacgccgcacatcggcgggtccacggaagaggcgcaggcctccatcggcaaggaggtggccaccagcctgctgaagtacttcaaggcgggcgccagcacgggcgcggtcaacttcccgaacatcgaggcgccgctcatcccgggcacgcaccgcatcctcaacgtgcaccgcaacatcccgggcgtgctgcgcgacatcaaccgcatcgtctccgacctcaacgccaacatccacgcccaggtgctcagcacggacgccaacatcggctacctgctgatggacctggaccaggacgtgtccaccccggtgtgcgaggccatcgccgggctggagacggacatcaagacgcgcatcctgtcctga

SEQ ID NO: 2990 - DNA, 222 bp, Myxococcus xanthus
gaggcgttcctcacctcgtcgcaggagcgcgtgacgggtgacgtgcggctggtgctgcacccgcgcacgcaggtggtggaaggcgtgcgttcgccgcactcgctgatggacgcgaaggtggcgacgtacggagaggccaacgtgttgtggaacggctcggaagccgcgggcttcgccaagctgtacggcgtcgcgcagatgctctcgcatcgcgcgaagtga

SEQ ID NO: 2991 - DNA, 1062 bp, Myxococcus xanthus
atgaaggttttcgtcgacaaggtaggcagtgtcacccgcaacctcggcctgggccgtaccgtccacctcgcgtccgaggtgaaggccgaggagggcgcggtggtggccgtgcgcatccacggagagaagagcacgtacaaccagctcgaggacgtgcacgggcgcctggtgacgctgcacgccggtgacatcgtcgtgggcgcgctgggccaccgcaacgcgcttcacggctatgagggcgtggtgcccgcgtccgtcaccgtgggcgagcggctgcacatgctcaacatgggcggcgtcatcggcaagtgcacctcgcacaaccacggcgtgggcctgcccttcgaggcggaggtgctgggccaggtgctggagttcccggagctgatgtcgcgcaccgggcagccagcgcacgtgtcctccggcgctctgaagggcacgtcgtcgccggtgaagtgccccgtcgtctacgtggtgggcacctgcatgaactcgggcaagacgttcgcctcggcggccatggtgcgcaagctggcacaggcgggcttccgcgtgggcggcgccaagctgacgggggtgtcgctgatgcgcgacacgctgagcatgcaggactccggcgcggacgtggtgatggacttcacggacgcgggcatcgtctgcacgggccctcgcacgggcgcgcgcgtggcgcgggtgctcttctccgagctggcggcggagaacgtggacgtcatcgtcgcggagacgggcgacggcatcatgggcgagtacggcgtacagggcatcctcgcggacccggagctcaagagcctggcgggggcgtgggtgctgtgcgccaacgacccggtgggcgcatccggcggcgtgcggcacctgcgcgaggcgtacggcatcgaagtggacgtggtggccggaccggccacggacaacgccgtgggcgtgcgcttcgtggagcaggtggtgggcatccccgctcgcaacgcccgcgcggacgcggcggcgctgggcggactcatcctggaaaaaatcgcccccaagctgggcgcggggaggaagtcatga

SEQ ID NO: 2992 - DNA, 738 bp, Myxococcus xanthus
  unsure (1)..(738): unsure at all n locations
atggacaccacctaccgtgtcgcgaggctgcccgcgcgcctgcgtgccttcgcgctaccggacacgagcacgccacccgaaggctacgtcgaggcgggtgactacctcgtgctcgaggagaaggcccgataccccacgcccgacaccgactactcccggctggtggtgccgcagttgggtgtgctcggcatgtgggtttgcacgcgctggcgcacccagcgctacgcgacgctcgcctcccgggagcgcgcgcctgccatggcccggctgtcgttcgacgacgagcggctggccgtcccggaggagcggctcaccacgctcctgggggcgttcctcgactacaggtatgacgggagccgggcgtactacccgtgggcgctgccgggcgttcgtgtccagctcgcgccgcctcggctgaacaactgctgcaccttcgtcgaggccctgctggtgaaggccttctccgaggtgcatggcgcggccttctcgtgggacgcgcgtcgccaccggcagatgatgattgcctccacccaggactacttctcccctgtgacggctgccgtcgagtccggcatggcccctgccggcgccgtcggcggacgtgcctccccacccctggacactcatccaggggtggcgcagccagtggggctcggggcacaccttccttgccgtggaccaccaccccggagacggacaaggtgctggtgctggagtncaacgctgncttcgggctcg

SEQ ID NO: 2993 - DNA, 1167 bp, Myxococcus xanthus
atgagcgggctgctggtggtggacctggggcaggtggagcgcatcagctccttcggcgtgcggcggtggattgagttcgccgccaagctgccccagggggccctgggcctctacgtggtccacgcgccgcccgtcatcgtggaccagctcaacatggtggagggcttcgccggcgtcgcccgtgtcctctccatgttggcgccctatacctgccgcgcctgcaacgaggaccggctgcggctggtgaacctgctggacgaggcgcaggtcatctccgaggaacgtgcacccgaccattcctgccccgtgtgtcaggagccgctggagttcgcggacctgccgggcgagttcttcgactacgcgcggcggcagcagttcggtcaggtggacccggtcgtcatgcgctacctgcgcgccagcatgccggcggagcagccggagctgtcgcagcacctgaagatcatccaggacgacatcacgtacatcaccctggccagcgcgctgaagggtgacctcaacgtgcgccggctggcgtcgggcctggagggccgcgtcggcttcgacttcagccacgtcagcaaggtggagccggaggccctgccgaagctggagcaggtgctggagacggcggcgcagggcgcgcacgtggtgttgtgccgggtgccgccgcccgcgttggcggtgctggcgcgctcggccaaggtgttgccggtgcggctggccacgctgtggctgccgtgtgactgccgcaactgcgggcaggtgagccaccagcgcctccaagccgcggactacctggccaggctgcgggcgcaggcgtccggcgtggaggtgccgtgccccatctgcggcggcaacgcgcgcgtcccccacatgccccagctccaggggctgctggcgcgggtgcagctgacggaccggccgctggaggacctggaggcgctggagactcgcgccctcagtcagtacctcttcggcgccacgaacatcgacccggcggcccgtcagggcgcgtccacggacatctccaactcgctgggcagcaccaagctgaacatcatccggcggctgggacagggcggcatggcggaggtcttcctcgccaagcaggtgggcgtgaagggcttcgagaagttcgtggtgatgaagaagattctcccgcagttc

SEQ ID NO: 2994 - DNA, 513 bp, Myxococcus xanthus
tcggccatggagaaggttctcaactacatcggtggtgagctgctgcccgcacgcggaggcgggtggctggacaagcccgagcccgcgacggccgagacgtatgcccacgtgccggactccgacgcgtccgacgtccagcacgcggtggaggccgccgcgcgggccttccccgcctgggccgccaccccggccaccgagcgctcacgcatgctgcgccgtatcgcggacggcatccggagccgcctggacgccttcgcccgcgcggagtccatcgacaccggcaagccgctgtcggtcgcctccacggtggacatcccgcgcagcatcctcaacttcgagttcttcgcggacgcggtgacgcagttctccagcgaggcgcaccagacggacgacgtggccctcaactacaccctgcgcgcgccgctgggcgtggtgggctgcatctccccgtggaacctgccgctgtacctgctgacgtggaagattgccccggcgctcgccatggggaactgc

SEQ ID NO: 2995 - DNA, 258 bp, Myxococcus xanthus
atgaagcggggcattctcacgggcttcaccaccgggctgctgatgggcaccgcgggctccgcatgccccacctgccgccccgacgtggtggccaccatcctcgatgagcacttctggggccggttgtccctcaccgccctgcccttcctcatccttgtgatcgtcctgggcgcgcggttcttcgtcgcgcgagaaattcctccccccgtgccggtgaagcagcgcgcacggaaacaggggcgggagcgctcccgatga

SEQ ID NO: 2996 - DNA, 126 bp, Myxococcus xanthus
atgatggtcacggtggccatcgcctccatcctgctcgccgcggcgctgatgggcatccagacgcccgtcaaccgtcaacgcgagaatgaggccacgcgcgagctgtgggccttcacgctccgtgcc

SEQ ID NO: 2997 - DNA, 1320 bp, Myxococcus xanthus
ggaaacatcgccaacgtacgggtcgtcgtgagctggcaggagcaaggagcgcagcgaccggcaggtggtggtgctccagacgaggatggccccgtgaagacgactttgacgcgccatcgccgccggtcgctccatggcttcacgctgctcgaggtgatgattgccactgccattggcctcatcgtgttgggagcgggactggtcgcggccatgcagatgcagcggcgtgccctcttcgaagaacagacgatgctggcgcaggtcaccgggcgcacggtgaaggagttgattgccgccgacctgcagcgggccggctcaggcatggggaatgcccccatcgtcttcagtgacacgcgcacccatccagccatccagatgtggacggagcccgacctgtccatgccggacttgacgcgtcccttccccgaggaccccgccttctcgctgccgcccgcggggcaccttgaagaagaagtgtcggacgtcctgcggattcactggggggacacgcgaggcatggtgacgctgagtccctgcgctggaaccaacgtgcgcgcagacacacggacgttctgcacggttgagaatccctcgcccaggctccagcccaccaccgcgccgacgactccggccctgctcgtgaatcccgccaggaatctggcctgccatgttgaagtcaccaacgtggacgccgcggggcggcgaatcaacgtcgttccgggcactggcatcgagaccacgacgacagaccgctgtggtgacttcgcctcggagccgaacttctggaacaccgagcccgaccgggaatcctggcgcatcatgccggcccagagcgcgacctaccgcgtgaactgggccagtggaacaccgacgctggagtacctggggccgggcgcggcgaactgggtggtcctgagccgggatgtcgaacgtctctcggtgcggctgggggtcgcggccatcgcacagccattcggaggcatgcgctggttcccggatgtggccaacgggcgaccgaacgggctggatgcctgcaccatcaccacctgccccattgaacagcaccccaatgaacttgtcgcgcccgcgacggacgaggagctgcgccagcggctgttccagcgcgtccgcgaggtggaggtcaccctggtcgtccgcacgccacggcaggaccgtgaagcctttgacccggaccagcccattggtgtggatcgggagcggttcccgattgatggcttcaagcggcgcaccttcacgttccgggtgatgctccggaacttcgcggcgggtggacttcagcccctcctgacggaaaattga

SEQ ID NO: 2998 - DNA, 231 bp, Myxococcus xanthus
atgaccaacctcgctcttgccttcctcgccgccggtctgggtgccggtctctccatcatcggtgccgcgctcggcattggtaagctggccgccgccgccatggacgccacgggccgtcagccggccgcgggcggcgacatccgcaccacgatgatcatcgcggcggcccttatcgaaggcgccacgctgttcgcgctggtcgtttgcatcctgctcgccaccaaggcttaa

SEQ ID NO: 2999 - DNA, 843 bp, Myxococcus xanthus
tggcacgtcccgctgaaggccggcgcgtgcgcgccccggatgacggagcacgggaaggaaattccggcttggatggacggctgcctggacctgtccatcacgaagcacaccgtgatgatgtggctggccgctctgctgctgatggccaccctgttcatctggggcaaccgcgacaagacgaagctggtgccgcgcggcgcgggcgccaacatcctcgagatgctggtgctgttcgttcgtgacgagctggccatcaagaacatcggcaaggaggagggcccccgctacgtgcccttcctgctcaccgtgttcttcttcatcctcttcatgaacatgctgggcatggttccctggatggcgaccgccaccggcaacctggccgtgaccatggcgctggcgctgtgcaccttcgtcatcacccaggtggcgggtattcgcgcggcgggtctgggcggctacctgaagcacctgacgggtggcgtggccccctggttgtggcccatcatggttccggtggaggtgctgggtctgttcaccaagcccttcgccctcacgatgcgtctgttcgccaacatgctggcgggccacatcgtctacttcttcctcctgggcctcatcttcctcctcggccaccctgcggtggcggcggtgagtgtgcccttcgccttcgccatcttcctgctcgagctgttcgttgccttcgtgcaggcgtacgtcttcgcgatgttgtcggcgctgttcatcggcatgagcgtggccatgggtcaccaccatgacgaccacggccacgaccacccggaagcgggccccagccacgaccagggcaaggcgcaccacgcctag

SEQ ID NO: 3000 - DNA, 3222 bp, Myxococcus xanthus
atgccctacctccccctgcgctgcgactggacgcacttcgctccttcccaggagacgctcgccgtcacctacgacccgccggatgaagggcggctcgtctccgtccagttggaggtgcgcgactacgcggatgccctcgtgtaccgctcggacgcgctcgattgccgcggcggccctgcggccatcacctggtcgggcgcgctgaacgtgggcaatgacgccgtccaggaacccttcgccacgccgctgagggcgccctacacgctccgggtcgaagccgtcatcgaagaggatgcgcgcgaggacctgcgccagcccgaggacctgcccaacaccgagctgggcagcgtggcgccctgcgagtcccggcgcgatgaatccctcccggaggaagaagcgagggagctgccgctcccgcctcccaccaccgcgcgggtcaacgtcctctaccattccgtggaggtcgtccgcggcccctggctggccaccggcgaggtgttcgtccggggcaccgccgccagcatctgccacaagctcaaccagctcgggtactacgccggccctccggcacgcgcggcggccaccccggacctgctggacaaggccaaggagcgcttccgtcgcaaccacggcgacctgcgaatcatccccgcgcccacgaacgacgatttcgagaacgcgctggacggcgcgctggggcacgcccatggcgcacggccgacgctggtcgacgaccagagcaaccccgtcccggaaggcaccgcgattccaggagggaatggagcgccgctgcgggtctacgtggaggccgtgggcttcgacgaggacctcgccaaccagaccgacgagttcatgcggcagattccttccaaccggggcaatgccgccatcgactggagcacgctgcacaacaagacgaggagcgaggccggcaagctcaaccgcccgctcgtgccgctcgaagcggtcatctacctcaagggccatgatggaagccgcgtcgccgccccccaggccgtgggcgcggtgcgggtggactggtccgcgctcgagccgggcgaggacgtgtcgcacctgcccttgaatcacgacctgcacctgggaacccgggcctacgtcaaccgcgtcctcggcagcgacttcgtcgacctcgcgggcgacggtggcacgaactgccccgtggcctacggcggcatccgcacccaggacggcaacttccgcaaccccttctggcgggagccccagtcctatgccccctacgcaacgcccacggaggacgccagggccaagaagctctgggtccccgcattcacggacggcgccgcgcatccgaaccgcgtgggccgctcgggcatctacctccaaccgtcactgattgccggcgaccgataccaggtgcgcgcgcggctcagctacgcgggccgcggcaatgccatgcagcttgaggccgccaaccccgtctgccagtacgagacgaagcccatcgtcgtctggcgccgggtggaggtcttcggcatcgtaagctggccgctgcgcaaccacgggaacctgccgcagaagtgccgggaccgctacgcggaggcctacctggaggtcgacttctcccacacgcagtaccggcgcatctcccaggtcatcaacgacacggactactcggactggttcacccacatccggacgcacgtcaagccgtccgtcgccagcgtcgttggcctgctggacaccacgcacgtgcatgacgccagccccgtcgtgcggctccgccctgacgtggaactcagcgccaaccagaagaacaacatctggtttttcgtcagcgacatgttcaacgagctggtcagcacggcgaacgtccgcagcgccggcggattcctgctctcgcgcatctccgacagactccgcacgggggatgcgccctgcggcggcatcgtcatgctcgaatacaaactgtcggacgacatcgtggacgcgctcgagacgtcggacgccggagaggtgcccacgacctccaacggcaacggcgacctgctgggcatcatcgaccagagcgtggatgcgaaccccgacttcgtcttcacccacgaggtgggccactgcttctggttgacccaccacgaggcctcctcgggcgtggttccccagcaccacgacccgctcgaccacaactgcatgatgagctaccccgactgggagcagaagcggccgcagttcccgcataatgcgccggaccgcttggacccgcacttctgcggcaagtgcaacctcaagctgcggggctgggacatcacccacgatgacatcctggcgctcgacccggccgcgcctgtcgaccagctcagcaccctcttctattacgaccgcgcggaccccgggctgcagtggaacgtcgagctggggcacgtgagcaacgccttcgccctggcctcacggggtccgttccgtgagcgcttcttcgaccgggacgcgaacttcgacacctgggtgaaccagctcggcgactgcgacatctaccaccacgtcacccacgggaacgtgcgctgctcgaagcacgccatgcgcctcgcgtccatggacatggcctatccccgctacccgacgtggtgcaggaatgaccagtccaaggtggagggactggcggccaaggaggaggagctctgcgtggaaaccggcttcgacccggtcgcgctcacccagtgggcgaaagagtcactcatcatgccgaagctgggctggagcctcttgagccccgaccacacgctgagaagcgtcatccagtggaccgtggacgacaacgacagcagccgcgacgtcgagttcacctacgaggccatcgagcaggccttcaagcgcggcaagaagccgccccggctgctcgccttcttcagctcgtgcctgattggctgggagcatcacttcgcccggctcttcatcaaccatggcacgccctacgtcatcgcgttccgcagccgctaccagacctcccaggccctgcccttcagccaggagttctaccgcatcctggccctgggcaagctcgagccccaattcatccaccgcgcgttccagaccgcggcgacgggccacccccacgccgagccctgcctgttcactaaggacaacatcgtccgctgcgtcgcgaagaccaaggcgggcgaggcggagttccatgacgtcaagtgggactccaaggagttctacgagccgcgcttccccgcgcaatga

SEQ ID NO: 3001 - DNA, 1186 bp, Myxococcus xanthus
catctccccccagaagctcacaccgggcaccaccctccgcacctgccggagggcaagacgaaggaccccgtctgcggcatgttcgtggatccccaggcaccgaagggcggcagccatgtgcacgaggggcacacgtacttcttctgcaacccgaagtgccgcgagaagttcacggcggagccgcggaagtacctcgcgcccgagccccagccgccggagcctgcccccgcgggcaccatgtacatctgcccgatggacccggaagtgcggcaggaccatcccggcacctgccccaagtgcggcatggccctcgagcccgagcagccggtcctccagacgcgcaccgagtacgtctgcccgatgcacccggagatcgtgcggcccgagccgggagcgtgccccatctgcggcatggccctggagccacggaccgtcacccttgaggacgcgcccgacccggagtacctcgacatgcggcggcgattctgggtgagcgtcgtcctctcgctccctgtgttcggtctgggcatgtccgagatgattccgggccagcccatccaggcgcctcatcccagggccgctcatggcctgggtgcagttcgccctggcgacgcccgtggtgctgtgggggggctggcccttcttccagcggggctggacgtcggtgcgcaaccggcacctcaacatgttcacgctgattgcccttgggacgggcgccgcctacggcttcagcgtcttcgccaccttcttccccggcctcctgccccacgccttcaccggccacggcggccacgtgcccttgtacttcgaggccgcggcggtcatcaccaccctggtgctgctggggcaggtgctggaactccgggcccgccatgccacctcgggagccttgaaggcgctgctcgggctggccccgaagacggcgcgactgctgcgcgaggacgggcgcgaagaggacgtggcgctggacggggtccacgtgggtgaccgcctccgcgtccgaccgggcgagaaggtgcccgtggatggcgtggtcctggagggcgagagcgccgtggacgagtccatggtgacaggtgagccgattccctccgagaagacacctggcagccgggtgacaggagggacggtcaacggcaccggcggcttcgtgatacgggccgagcgcgtcggccgcgacacggta

SEQ ID NO: 3002 - DNA, 501 bp, Myxococcus xanthus
atggacagtgacgttgcccccgagcggctcgtcgtggacggcaactattccgacgagcggtttatcgacatgatggccgcgcaccaccaaatggccaccgagatggccatggtcgaggagcaacgcggcacgcgtcaggagctccgggcgctggccacgaaaatgattcaggaccagcgtcaagaaatcgaggaactgaaggccctcaagcaggccaacttcggctcctcggatgtgccgacgatgatgagcgagtccgagatgcaaaacagcggcatgctgatgaccgccgagctcgcgcgacaaccggacgtcgacaaggcgttcatcgattcgatgatgccgcaccactcaagcgccattctgatggcgagcgtcgcgcttcggcggaccagcaacgcggagattcgcgcacttgcccgcggaatcatcgacgcacagacgaaggagatcggtcagatgattgagtggcgcaagtcctggtacggcagtcaaccgtag

SEQ ID NO: 3003 - DNA, 576 bp, Myxococcus xanthus
atgagcctccaccgcatcgtcgtcttcgccctggtgactgtcctggccgccccttcggccgcgctcgcgcaggatgacttcctggcgccgctcaccgcgccgtcgaagcccaagacgggcaagcccaaggtggtcaagaagaagcccgccaagaagcccgcgcgcgcgaaggcgcccccgaagggaagcaagaagcccgcggccgaggacgacctgctgctggcgccgttgacgcccgtgaagacggaggtgctcgtccggatgacgggcaacgtgcgcggcgcgaagctgttcgtggatgggaaggagttcggcgtcctctcatcggccaccgtgccggtggaggtccgtccgggcgagcaccacctggtggtgcgccggcagggttacgccgacttcacacggcgcatcgacgtgaagtcgggcacgcaggcggaggtgctggtgtccatggacgccaccatgggcttcgcccacgctgacggcggacgtggcggacgcggtggtgatggtggacgggcagcaggtgggcgccgtgccgcaggccaacgtgttgctgcgcccgggttcgcgtga

SEQ ID NO: 3004 - DNA, 999 bp, Myxococcus xanthus
cacctgaaccgtgagttctcgctgttgacgcaggcccagagcatcttcctggatgggcacttcatcatcgagcacaccgcgcgcaaccgcgcgggctgcttcttcaacttcaacggcaccgccggcatctggcgccgtgacacgatttccgacgcgggcggctggcagcacgacacgctcaccgaggacctggacctgagctaccgcgcccagttgaagggctggcagttcgtgttcctgcccgaggtcatctccccggccgaggtgccggtggacatgaacgccttcaagagccagcagcaccgctgggccaagggctccatccagacggcgaagaagctgctgcccaccattctcaagagcgacctgccgctggtggtgaagcgcgaggcgttcttccacctcaccaacaacatggcgtacctgttgatggtgctgctgtcggtgctgatgcccatcagcatggtggtgcgcttccagcacggcctctacggcacgctgttcctggacctgcccttcttcctcacggccaccgccagcgtctgcttcttctacgtggcggcgcagcgtgagcgcggcgcgaaggggtgggagcgggtgaagtacctgccgttcctcatgagcctgggcatcggcatggccatcagcaacgccaaggcggtggccgaggcgctgctcaaccagcagtcgggcttcgcgcgcacgccgaagacgggcgccgagggcaagaaggccgtcaccgtcaagaaggcgtaccggggcagcaagtcgctgctaccgctggtggagctgctgttcgccgcgtacttcaccggcgcgctgtggttcgccatcgacgcgcgcatctacacgtcggtgcccttcatcgtcctgttcctggcgggcttcctgtacgtgggcagctccagcctcctgcagggactgtccggccggatgaagctggtggagtccacccccgcggtggacgccgccgacgagcagccccgccgcgcggcctga

SEQ ID NO: 3005 - DNA, 375 bp, Myxococcus xanthus
atgtggattgagagcatcatcatgccgcgcgaggacgactcggagccctacgtcccggcgccccagcgggaccggcgcagcgggctcgcggcggcgttggaggagagccgcaagctgcgcgacagggtgcaacgcttcgtgagcgcccatgacttgtcggacggcgtgaggtggctcagcgagcccggcctcctccccgtcatcaccatccactgcacggacttcgcgctggcgaagttgcgcgaagccgcggacttcgtggtgggctgcgcggcgcccatcgacgtctaccccgcgctggtcggcacgcagggccaggtggctcccgaggccctgctcacctcggcggtgtcacacctgcaacgccgcgtgtag

SEQ ID NO: 3006 - DNA, 654 bp, Myxococcus xanthus
tccgcgccccaggggcgctggattggcggcatcgtccatccggcgaacgccgccgagaaacgcgaaggcgcgctgtggctcggctacctctccgtgcccgacgtggaccgcgctgtcaccgaagtaagcgcgcgcggcggcaaggcgctcgacggccccatcgacgtgcggaacatcggccgggccgcggtggtcgccgacccgcagggcgcggcggtgggcttcgtgcgctcccggcccggagatccggccgatacgggcgtgccggatgagggccagttcttgtggatggagtacctggcccaggaccccgtcgccgcggcggacttctacaaggagctcctgggctacgaggtccgagatcgtccactcggcggcgggccccactacgtcctcgcccagggacagcatccccgaggcggcgtgctggccaacccggtgaaaggcgcgcgccccaactggctcacctatgtccgcgtgaaggaccccgcgacgctcgcttcacgggcccaggccctggggggccgcgtgctgatggccccgcgcccggacgcacggggtggctcgctcgcgctcatcgccgacccgagcggcgcggtgctcgcgctccagcgctaccccttcgaaacgtccaagtccgcaacggcgccgtga

SEQ ID NO: 3007 - DNA, 1245 bp, Myxococcus xanthus
atgttcggtgagtcgttcaaggagcgggtcgtcgaagccgttcgcgagcagattgtctccgcgattgaggaccggctcggccgcgaggtgcgtgagcgcgtgggggaggccatccgccacgcgatgttcgagcgcggcggtgggatgccgcaggggtatgggatgatgccccagggctacggcatgccggagccggagcgcatcgcggacgcgctttgttcccgcctgtcggagacgctgcgcgagcgcatcgcctccgtggtgcatgagcgcatccgcgacggcatccgcgagcggctggccgagtgcgtgcgcgcggcgctgttcgagcagtggcagatgtcctcccacggcttcggcgccccggataccgagcggctggcggaggcggtgcgcacccgcctgctggagtccctgcgcgagcgcatcaacaccgccgcgcatgacggcgtgcgcgaggccctgcgcgagcggctggcggacacgctgcgctcggtgatgtcggagcgcatgcccggcttcagcccccacgaggcggagcggctggcggacgccattcgcgggcgcctggccgaggccctccacgagggactggtgtacagcctgcgtgagcgcgtgcgcgaggccctgcgcgagcggctgtccgacgggctccgtggcgtcatgacgcgccagtggggcggcatggccgccggcgcgttcgaccccgagcgcatcgcgatgaccctgcaggaccggctgtccgagggcctccgtgagcgcatcaactcggcggtccgcgagcgcgtacgcgaggtgctgcgggagcgcatgggcgagatgctgcgcggcgccatggcccgtcaccggggcatgatggggcagggcgggatgatgccgcagggcatgatgatggggcaggggatgcaggacgtggagcgcctggcggacgccatccgcacgcggttggcggactccctgcgtgagcggttcatgagcagcatgcgctcggagctggactcggcgcttcgctcgcagctccccgaggccgtccggtccgcgctcggtgaggcgatgcgcgccggtccgtccatgatgccgatgcagcagggcggtggttccgtcgaccccgagcgcatcgcgagcgcggtgcgtgagagcgtgagcgccgacgtccgcgagcgcgtgggcgagatggtccgcgagcgcgtgtccgaggtcgtccgcaacgagctgtccaacggcgtgcacgccccgcaggcgtga

SEQ ID NO: 3008 - DNA, 432 bp, Myxococcus xanthus
cccctggggccggaggatgacgtgcgcgtcgggcctgagacgttccaggcactgcacacgccgggctcgcattacctgctggccggtgacgcgctggtgtccggggacaccgtgttcatcaatggctgcggccggtgtgacatgagcggaggcaacccggaggacatgtaccgctccctgtcccaggtgctggcgaaggtgcccgatagcgcgaagctgtttccgggccacgactacgcgggcgtcccgatggcctccatggagacggtgcggcggaagaacccgtgcttcgccttcgacaacgtggatgccttcgtcgcgttccgcatgcggccgaggaaggattggcctgtgccgcgccgccggtgtctggctgccaacggggcctcacaccgacgacacgtttaccctgaatgcgtgcctgtttattga

SEQ ID NO: 3009 - DNA, 486 bp, Myxococcus xanthus
tctacagacgcgggctatctcgatgatgccaagagcgtcgccgtgggccccgacggcggcgtctacctcgctggcgagacgttcggcagcctcgacggcaacgccaacaatggcaccgtcgacgtgctcctcgcccgctacgacaacgccggaaaccgccagtggagccgcatgctcggtggcgcgcagaccgactacgcgttcggcgtctccgtcaccacgagcaacgtcgtgcagctcgtcggctacacctgcgacgcgctcgacggcaacccgcccgctggctcccttgacgccttcctcacccgctacgacgcgcttggcaccaagctgggcacccgcaccctgggcaccccgttccaagacatcgcgcgcggcgtggccgtggactccgctggcaacgcctacgtggccggtaacaccttcggaggcctcggcggcaacaccaacgccggcggctacgacgccttcctcgctcgcttctga

SEQ ID NO: 3010 - DNA, 1669 bp, Myxococcus xanthus
gtcacgctggccttcgacgacggaatcgaggagcagcgccaggtgctggatatgctttcggcttcggggctgaaggcgaccttcttcatcatcagcgggcgggtcggccagacgggatacatgaacctcgatgacctgcgccgcctggccgcggccggacacgacatcgggggacacacgctgcaacactcggagctggcggtgctgacgcccgagaagcaacgacaggagatttgcgaggaccgcctgcggctgctcagttggggcttctcacccaccgccctcgcattccccttcggttcgaacgatgcggtggtgaaccagacggcagcggcgtgcggatacaacgccgcgcgcgacgtgcggggcctggtggacacctgtggctcctgccccacggccgagacaatccctccgctcgatccctacgaaatccgcacgcccgcgacggtgacgcgcgacgacggactgaagcagttgcagtcgtgggtcacctcggcggaggccgcggggggcggctgggtggtcgtcgtcttccacttcgtggcgccggactgcaccaagcgcacctattgcgtgaagcccgacgtcctccgggagttcatgggctggctctcgcagcgggcaccgatggggacagaggtgcgcacgatgcaggacatcctgggcggtgcggcgcggcccgcggtgcaccccgtgtcccagccgcccacggccacgctgaagaatccctcgctcgaggacgacgcgaacggcgacggcgtgcccgactgctggcagctgggccccgcccacggtggcgccgtgcgcgccgagcgctcagccgaggcgcacagcggcgcctggtcctaccggctcgaacgcgtggaagcctccgggggcgccgcctcgctccaggtgctgcgcgacgacggcacctgtgcaccggccgtgacgcctgggagcggttcgcgggtgagcgtctggtaccgctccagtacgccgctgcacctggaggcggccgtgaagggggcggatgggatgtggaaggtgtggaaccgcggcccgagcctgccacccgcggaggcctggacggaggcgtcgtgggagctgcccatcgcgctgccggccgacgcgttcgaactgagcgtgggcgtcgccctggaaggggtgggctgggcgctggtggacgacttcgggctggcggatgcgacggcgcccgcggcgcgcctggtgctggacgcaccgaccggcggagaagacttcgtcgtgggccaggacgtggaggtgaggtggtccacgctcggcgaggtgcggacgctggacgtggcgtactccacggagacgagcgccagttgggtgccggtagccacctcggtggagaacacggggcacctcatctggcgcgtgcccgacgtgccgagccaggaggcgctgctgcgtgtcgccagcgccgaggatgaaacggtgtcgggcacgagcgcgcccttccgcatcctgcccggggccccgcagcagcccggcatcgtggagccgccacccgaggaacagccccccgaggagatccgtggcgacgggcaggtgaatggcgagagcggtggttgcgggggatgtgagggcgcgggtacggggcaactgtttctcgcggtggccggcggactcatcgccctctcgcgttcgcgagccagga

SEQ ID NO: 3011 - DNA, 1188 bp, Myxococcus xanthus
atgcgggcggaggtggagttcctgagtggcatggcgcgcggcttcaaggggcgcgcgcacgatgtcctggatgggcatcagcggcccgtgtccgtccacgtcacggacgtggctccgggccggctcctcatccgaggcgcggcggaggattccaagacgctgcgccagttgctcggctggttggagtcccgccccgaagtccaggtggccacgtgtcagcgcagcacgggcctggtcaaggtgcactaccaggaggcctcgcgcttccctggcgcgttcgcgctgcgggtgcgggacttcgccttcacgttgcaccagcttccgcccaagccgttccaggtggaggtgctgcacgcactgcccggtcgcgtgcgcttgcacgtccgagggctcgaggacgacgacatcctcaagctggcggcctgggccgcgacgctggcgggggtgcacaaggcgagcgcctcgccggccatccattcgctggtggtgagcttcgacccggagatgctcaacgcgagccagttgatggcggccctgcgtacgagcgatccatccacctggcccgccgcgcccgagccgccccggcgggaatgggccgccactgtcttcaattcggcggtgctcgccgcgtgcgtcgtgaacgcggcgcccatgcccgtgttggccgcgggcgtcgcgttgacgagcctgccgctggcacagcgcgccttccagtccgtcgcggagcggcgcatcaccgtggacctgctcgacctggtggcggtgggggtatccctggccacggggcaggtgcggaccgcggcgctcatcacctccctgctgggcattggcgacttgttgattgagcgcagcgcggaccgcgcccggtccgccatctcccggctgatgcggctggaggtgctgtacgcctggcgactgcgggtggacggagaggtggagcaggtccgggcggaccggctcaaggagggcgacctcatcgtcgtgcacgcgggggagagcgtgcccgccgacgggacggtggtgtccggcactgcgtgggtggatgagaaggcgctcacgggtgaatccgagccccgcgtgcgcgaggcgggagaccgcgtgctggccgcgtccgtggtgggcgagggcagccttcgggtgcgggtggtgcgcgcgggcgtggagaccacggcggccaagattctccac

SEQ ID NO: 3012 - DNA, 585 bp, Myxococcus xanthus
atgaggctcgacccggactcgggcgccatcgaaggggagtggttgttgctcgtgcaccactccccgggccggcttcgtgtgcgcgcgagctgcttccgagatgactcggccgtcgcggaccgcgtgcgcggtgagctgggggagacgcaaggtgtgttcggcaccgtccattccccactcacgggcagcttgctcgtcgaatacagcccggacgcggccgacgtggagtcgctcctggcggccatcgtcgacacggcgggcctggacggcatcgtcgacgccaagttcatggcgaagtcgcggagggctccggccgagcacctggtgagaggcgcccggtggctggacggacgggtgcgtgagctgacgggggcgggcctctacgagttgattcccgtggtgctgacggccacgggcatctactcgctggtggcgaacccgtcgcagaagggctggctgcctcgctgggacaacgcgctgtactgggcctacagcgtgttccgtgacggtgtgcgagagcaggagctggaagacgccgcgcgcgtcagcgggacggtgcccttccggccccggccccacgtgtga

SEQ ID NO: 3013 - DNA, 228 bp, Myxococcus xanthus
atggcccggagcaccgtcgacaactcacgcggtgcggtcgtctccgtggcgacggcggcgtttgatttggtggcgtggacgcggcgggtcatcgccaccgagcgtgagtacctctccgacctggtggcggaggcgcgctcgcgggcgaaccttcatcaggcccacagccggcgtgcggcggacagtggtgcccggcccgtcgcggacagtcgagaggggcacgcatga

SEQ ID NO: 3014 - DNA, 927 bp, Myxococcus xanthus
atgttcaccctggacaccggcttcgtgggggcgctcgtggccgtccccgtggcaggatccgccatgggattggacacgatgctgcgctcgctcatccaggcccggatgatgtgcgacgtggcgtccgcgttcggcgtgcgcatcgacccggatgacccgtgggatctgctccacctgaacgccctcacggcgggctcggagacgtgggaggacgcggaccacggcggtgcggggctcgtgggccggatgctgaccgaggacacggaggcggcggagcggaagctgggcaaccgcttgatgggagagggcgtgctgcgaaacctccttcccttcgccagcgtcctgacctcctccgtcaccagttggcggcacacgcgccggctgggcgaggcctcggtggagtatgcgcgctaccgccgcgccctggacgatgcgttctccgccgtgcgggccgtggacgcgcggtgcgtggagctgctcatcgaaggcgcctggtgcctgttcggaacggatggggtgctgagttccgaggcgacggtcatgctggcgcacctgctgcgcaacagcccttccgcggcgcgcaagcgactgctggagcgcctgggcgaagacgaggcgcagtgggtcgagcgtctccacgaggtgcccgagcccgcgcgggatgccttcctgcacgcgctcgaagtgattgccgcggtggatctgtccatgtcgaacgcggagtggctgctgctgcggcaggccgccgccgcgctcaaccgtccggtgcgtcgcgagcgggtgcaggccctgctgaagcagttccggacccacggggtcgttcgttcgccgcagggcgactcgttcgagccgcgcgacgggcggatgccgtcgtctcccgtcgccgggctgggcgctgacgcccatgccgctccgggggggctatga

SEQ ID NO: 3015 - DNA, 342 bp, Myxococcus xanthus
tcttcgcccaggcccgcggtgaggcacctcgccagggggcacgtcatcgcgggggcgttgggggacctgcgcaatgcgtccatcctcgaacagaagcccgccgtcgccgggttcgcggacgcggccagccacctgtgtgaagtctgggccgcggtgacgacgaacgaagcggacgcggagacgaatccctgggcccgcgccaaggccgccgcgggcgccatggtgacggcgctggtggcgcagcgaggtcaggacgagaaagacccggcggcgaaggcgcaggcgcgtgtcgagctcaccgagctcctgcgcgctgtccgggcggccatcaccgttcgctga

SEQ ID NO: 3016 - DNA, 609 bp, Myxococcus xanthus
atgaaactcttctactcccctggcgcctgttcgctgtcgccccacatcatcctgcgtgagggcggcttctccttcaccaccgagaaggtggacatccgcgccaagaagacggcggcgggcgaggacttccacgccatcaaccccaagggctatgtcccggcgctccagttggatgacggcagcctgctgaccgagggccccgccatcgtccagttcctcgccgaccaggtccccgacaagaagctggccccggccaacggcacgctggagcgctaccgcctccaggagatgctcaacttcatctccaccgagattcacaagggcttcagccccctgttcaacccggcgttcccggatgacgtcaagcggctgacgcgtgagcggctcgcgcagcgcctgggcgtgctggaggtggtggtggcgaagcaggcgttcctgctgggcgaccagttcaccgtggcggacgcgtacctcttcacgacgctcaactgggccgggcacaccaaggtggacctggagcccttccccgcgctgcgcgcctatcacgcccgcgtggcggaccggccctccgtgcaggaggccctgaaggcggaaggcctcgcgaagtga

SEQ ID NO: 3017 - DNA, 1158 bp, Myxococcus xanthus
atgctcaaccccgatatccggctcgccctcactttcgacgacgtcctgctggtcccgggcgagagctcggtcgtccccaaggacgtcgacctgacgacccggctcactcgcaatctccgtctcaacatccccctcctgtcggcggccatggacaccgtcacggagtcccggaccgccatcgccatggcccaggagggcggcattggtgtcatccacaagaacatgacgcccgagcagcaggcgctcgaggtcctcaaggtcaagaagttcgaaagcggcatggtggtggaccccgtcaccatcgaaccggaggccccgctgggccgcgcgctggagctgatgcgccttcacggcgtgtccggcatcccggtggtgaagggccagcgactggtgggcatcgtcaccagccgcgacgtgcgcttcgagaccaacttcacccagacggtggagtcgatgatgacgcgcaagctcgtcaccggccgcgaaggcatcacgcaggaagatgcgcagaagctgctgcacgagcaccgcatcgagaagctcctcgtcgtcaatgacgccttcgagctcaagggcctcatcaccatcaaggacatcgagaagcgccgcacgcaccccaacgcggccaaggacggcatgggccgcctgctgtgcgccgccgccgtgggtgtgtccgcggaccgcgaggcccgcgtggaggcgctcatcaaggccggcgtggacgtcatcgtcgtggacaccgcgcacggtcactccaccgcggtgctggatggcgtgcgcgacacccggaagaacttccagggcttcgagctcatcgccggcaacgtcgccaccgccgaggccacccgcgcgctcatccaggccggcgtggacgcggtgaaggtgggcatcggccccggctccatctgcaccacccgcgtggtggccggcgtgggcgtgccccaggtgacggccgtggatgactgcgtccgcgaggcccagaagcacgacgtgcccatcatctccgacggcggcatcaagtactcgggcgacatcgtcaaggcgctggccgcgggcgccaacacggtgatggtcggctcgctcttcgcaggcaccgaggagtccccgggcgacgtcatcctgtaccagggccgcagctacaagagctaccgcggcatg

SEQ ID NO: 3018 - DNA, 2073 bp, Myxococcus xanthus
atgggcctgcgcttcctgaacgcggatgcgcccacccgccggttcctggattcgctggtcgtcaccctgccccacgcccagtcggatgttcccccggttcctcccaatgtagggccaccggactacaccgtcacacccacggagcaggcgcccgtcgcactcgcctccgagctctacgcgccggcccccgtgccaggcagtgcttcagccgaggcagccgccgcgccgccgcggatgatctccaacgcggcgttgaacctcagctcggaggacccgaagcgcgccggtgtcgtcatcggcatcgacctggggacgacgaactcgtgcgcggcctacgtccgcaacggcaagccgggcgtgctgcccagccgcgagggccacaacacggtgccctccatcatcgccgtcaacacgcgcggcaagctggtggtgggccaccccgccaaggggcagatgctcaccaatccgcgccagacggtgtacggcgccaagcggctggtgggccggcccttcgcgtccccggtggtggagcagctcaaggaccgcttccactatgagatcgcggccagtgagaatggcgacgcgggcgtgaagctgggcgaggacgtctacacgctccaacaaatctccgcgctcatcctccgggaggtccgggaggtggcgcagaaccagttgggccatcaggtgtcccgcgcggtcgtcaccgttcccgcctactacaacgacaaccagcgccaggcggtgcgcgaggccgggaagctggcgggcctgtacatcgagcgcatcctcaacgagcccacctcggcggcgctggcctatggcttcggccgcaagctgaaccagcgcgtgctcgtctatgacctgggcggtggcacgttcgacgcgtcggtgctggagctgaacgacaacgtctacgaggtcatctccaccggcggcgacacgttcctgggcggcatcgacttcgactcctcccttgtcacgtacctcctggacgagttccagaagaccacgggccgcgcgttccaaggggaccgggtggccctgcagcgcatcaacgacgcggccgagcgcgccaagtgcgcgctgtcggagcgttcggaggtgcgggtgcacgtcgcgttcgtgacgatgatcgacagcaagccgtgcgacctggacgtcatgctctcgcggcagaagctggtggagctgacggaggggttggtggatcgcaccctccaggtctgcgaggaggtcctccgcgcgaagaaggtgacgccgcaggacatcgacgaggtcatcctcgtcggtgggcagagccgcttcccgctggtgcacgagaagatcacgaagttcttcggcaagccgcccagcaagggcgtgcacccggacgaggccgtggcgctgggcgcggcgctgctggcccacagcctggggcagttggaaggcgtggtgctcatcgacgtgctgcccatggccattggcgtgggcctgcctggtggccgcttcaaggcggtgatggagcgcaacacgtcgctgccgtcgacgaagagctacaccctggccacgcaccgcgacggccagacggagctggagctcacggtgttccagggcgactccgacaaggccgctgacaacgagtacctgggcacgctgaagctggagggcctgccgaagctcccgcgtggcgccgtgcaggtgaacgtcaccttcgaggtcagcaacgagtcgctgctgaaggtcaccgcgcgcgaggcctcgtcgggccgcgaggtgacgagcaccttcaccacacgcgacaccccggaggccgtgaaggcgcggctggcgcagctcgagtcggaggcgccgccggcgcctgggccggcagccgcggcacggagcgcgggccacgccggggccacggccacggggccagccgctccggtgaaggtgcccatggccacggccgcctccgcgtcggccgcgcggccggtgctcgttcggcccgcgtcatcggctcccgtgtcctcgattccctctgtcagtgtggctgttgcacccaagcagaagggcttcatggggtggctcaaggggttgttcggaagagcctga

SEQ ID NO: 3019 - DNA, 165 bp, Myxococcus xanthus
atggacatgaatccccgtcttacctcagtggtcttccggctcaaccgcgagaagctcgacgccctcaaggacctgtcgcgcaccacgcgcatccgtcagagcgagtacctccgcgaggccatctccgatctgctcgcgaagtacgaagagcggctcgtcgactga

SEQ ID NO: 3020 - DNA, 3465 bp, Myxococcus xanthus
tctacagagctgctcgacttcggactcgcggagtccgcgttcgcggaggaggagcttcccgcctcggcggcgggcacggacgttccggcttcaccagggccgagccccaaagacacccggccgatgcctgggccacggcccgtggatacccggctgcctgccgcgccgggtgtcacggatgcggtgtcctcgccgggccctcgccccacggacacccggccactctccgtcatgctggggcgcgataccggcccgcgcgccgatgaggcccgccaggatttcgttccaggcacgccgctctatctcgcacccgagctgtggcgcggtgagcccgccagccgggccagcgacgtctatgcgctgggcatcctcctctacgaactgtgcgcgggccacgcgccccatgaaggcgtaccgttggagcagctcggggccgcgatacaggagcgtcccccaccgcctctctccgagcgcgcaccagggctgtcgccagccttcgccgccatcgtggaccgatgcgtcgacgcggacccggcccggcgctacgagtcgggtgacgcacttcgggaagcactcgaagcgctcagcacgcccacgcgcgccagtgccatccccaccggcaatccctacctgggactgcgggccttcgatgccgcgcaccggagcgtcttcttcggccgcgaacccgagctgcgagaggtcctggaccggctgcgcggcgacaccttcgtcctgctggcgggcgactccggcgtgggcaaatcctcgctgtgccgggcaggcattctccctgctgtcagccagagcggcctggaggatggcgggcccgcctgggcagtcatctccgggacacccgggcgccgtccgctggagacctgggtggagctgctagcccccgtggtcggagagagcgcggatgccttgcgcgcacgcctcaccaccgaggagcccggcgtcctggcccgagccctgcgccgccggccaacgaacgctccacccctgctcctcttcatcgaccagctcgaggagctcgtcaccttctcggagtccacgcaggcggcccggctcgccgaggaactggccctggtgctgcgccgcgcgccccgcttccgcctcctcaccaccgctcgcagcgactgcctcacacggatggtggccctcccgggtctgggtgatgaactgccgcgcgcgctccacctgctgcgcgccctctccgaacacgggctgcgagaagccgtggcaggccccgtccgcgtgctgggcatgcgcttcgaaagccccgccatggtggacgccctggtcgcctccgcggcccgggccgagggaggactgcccctgctccagttcgcgctggaggcactctgggaggcacgagattcccaacgccagctcatccccgccgccgcactggaggccctgggcggcgtggaaggagcgctggcccgtcacgcggacgccgtggtcgtccgtctccggcccgagcaacggcctcgcgcccgcgcaatgctcctggagttggtgacgcccgagggcacgcgcctgcgccgtacccaggaggagctgctgcgtggccccgacgacgacgccggacgcgcggtgctggacggactggtgcgcggccggctgctcaccgcgggcgaggcggaggacggagacggcgtgtacacgctggcccacgaaagcctcgtcaccggctgggacaccctgcgcgggtggttggggcaggacgagcaacgccgtgccgtgcgaatgcgcctggagcgcgccgccgcggagtgggaacggctgggccacccgcccgaactgctctacggcgagcggcagctcaccgagagccgcgccgcgggcctttcccatgtcgagaaaccgcgggagcgcgacttcctctcccgctcacgaagagccgtgcgtcggcgccgggtgacgcgctggctggccgtggccctggtgcccctggtgctgggaggcgtggtgggcgtcacgcgcgtgcaggcccgggcgcaactggatgcccgcatcaaccgccacctggacgaggccaaggtgcagcaggtcgcgttggacatgcgccgcgccgagctggaccaactgagcgccgaagccttcaccctgttcgacacgccgggccctcagaaccgcgaagcagccgaagccgtgtggagccgcgcccaacagacccggcaggcggtggaggagaccgcgctgcgcgccatgtcggagctggaggccgcctggggcctggcgcccggaaaccctcgggtgagcccgctcatggccaacttgttggtaacgcgcgtggagttcgccgagcaggaacgccaacccgagcagcgcgcgcagtggctcgcgcggctcggggcccacgaccccatgggcgagctgcgccgggggctgacggcaccggcacggctgacgctcaccagtgagcccgcgggcgctcgcgtgcggctgctggagcccacgccagagggagagcccgtcccgggacgcgacctgggacagacgcccctgcacgaggtggcactgcccgcggggtcccacctcctggtgatggaagcgccgggccggtttccggtgcgcgtccccgtgctcctcgcatccggcgagcggctggcgctggacgtgccccttccagccgcggggttggtacccgagggcttcgtgcacatccccgccggacgcttcctccagggcgcgtcggagagcgaatatctgcggcgtgcattcttcttcgcgccgccactgcatcgcgtggacacgggcgcgtacctcatcgcgcggcacgaggtgacgttcgcgcagtacatcgccttcctggagacgctgccccccgaggagcgcgccgcgcggatgccgggctcgcgccgccgcctcaccgtggtggacctggcccacgaaccagatggccgctggcggctcaccctgcgccccgcgtccgcaagctacagcgtgagggacggtgaacgactgcgctacggcaagcgggaccgtcggcaggagcaggactggctgcgcttccccgtgtccgccgtctccttcgacgatgccctggcctacgtggcgtggctgggccgcaccggccaggtgccaggcgcgcgcatgtgcacggagcgggagtgggaacgggccgcgcgaggcgcggacggccgccgctaccctgcgggcgactggctggcgccggacgacgccaaccatgacgccacttatggccgggagccctggggcttcggccccgacgaagtgggcagccacccgcgctcgcggagccccttcggcgtggacgacatggtgggcaacgtgtgggagtggacgcgctccgacgtggccccggagaagccgtccgcccagggcggaagctggtaccagagcgacctgacggcccactccgccaaccgggaccgcgtggaacgaacgcagcgagaagccctcatcggctttcgcgtctgcgccacgccgcgcccatga

SEQ ID NO: 3021 - DNA, 3810 bp, Myxococcus xanthus
ctctcgatgatggatcggggcggcgcgctggacggccaactggaatacagcctggagctcttcactccggacaccgctcgacggatggtggagcacctccgagtgctcctggccgcggtggcggacggggccggcgcgcagcggctcagtgagttgcccctgatggatgcaggggagcggcagcaggtcctctcgacctggaatgccacccaggccgcctaccccgtggatgcgaccgtgccgtcgctcttcgcggcccaggcgctgaagacgccgcatgccgtcgccgtggagcacgacggccgcacgctcacgtacgcggagctggatacgcgctccaaccagctcgcgcatcacctgaacgcgttgggcctgggcgcggaggcgcgcgtgggcgtcttcctgcaccggggactggacctgctggtgggcctgctgggcatcctcaaggcgggctgcgcctacgtgccgctggatcccgagtatcccgcacagcggctggccttcatggccgaagactcgggcgtggccgccatcctcaccgaggccgcgctggaggacgaactgcccgcgggcgctcaggtcgtcatcgtcctggatgacgaatggacgtggattgagcgccagccgtcgacgcccgtgacgggcgggatcgtgggcccggaccagctcgcgtacatcacctacacctccggctccacgggaacgcccaagggcgtggccattccgcaccggggcgtggtgcgcctgctcatcgggtcgcgcttcgtggacctggggccgtcggaggtggtgctgcaattggcaccgttggccttcgacgcgtccaccttggagatctggggcgcgctgctgcacggggctcgtctggtgctctatccccagcggacgctggacctggccgagctgggacaggccctggagcggcaccacgtctccgtgctctggctgacggctgcgctcttcgaccagatgcagcagcaccaaccggaagccctgcgcaaggtgcgtcagctcctcgccggcggcgacgtgctcccggcgcctcgggtccgcgaacggctggcgcaaggcgtggggctggtgaacggctacggccccacggagagcaccaccttcaccgcatgccaccggatggcggcgggcgacgccgtgggtgactccgtctccattggccggcccatcgcgaacacccaggtgtacgtgctggacccggcgatgcgggccgcgcccgtgggtgtgccaggcgaggtgttcatcggcggcgacggcctggcccggggatacctgggacagcccgcgctgaccgccgagcgcttcgtgcccaatcccttcgggcctccgggcgcccggctgtaccggtcgggagaccgcgcgcgctggctggcggacggtacgctccagttcctgggccgcgtggacttccaggtgaagctgcggggcttccgcatcgagctgggggagatcgagaccgcgctgcggagccactccgaggtggagacggcgattgccttggtgcgcgaggacagcccgggtgaccggcggctggtggcctacgtgacaccggaggacgtggacaccgcgtccctccgggagcatctgcgccagcggctcccggagtacatggtgcccaacgccgtggtggtgctgagcaccctgcccctgtcgccgaacggaaaggtggaccgcaaggcgctcccggcaccggacctgtcgcccgccgaggacacccaaacggcggccctgcccctgctccagcagcagttggcgacgttgttccgggaggtgctgcgcgtcgaacgcgtgcggcctcaggacgacttcttcgaactcggcggccattcgctcctggccacgcagttggtgacgcgtgtccgcgcggagcttggcgtggaggtcccgctgaggacgctgttcgaggcgcccacgctcgcgggcctggcggaacgcatcgaggcgctgatgatgcaggcgtcgcgtgcgtcgatgccgccgctggagcccgtgccccggaatgcggcgctgcccttgtccttcgcgcagcagcgcctgtggttcctgtcgcagttccagaagggacatgccgtctacaacgtgcccttcgctctgaagctcttcgggccactggacatggacgcgctgcggcgcaccttcgccgaggtggtctcccggcatgaggtgttgcgtacctccttccccgtgacggaagggctgcccaggcagcaggtcaacccggcgccggcggtgtgggacctgcccgtggaggacctgtccgcaatggtggggccggcccgtgatgcgcgcgtgcgccagcggatgatcgcggaagcccacttcccgttcgacttgtccaccgggccgctgttccggtcggtgctgctccgtctggatgcggacgcgtatgtgctgctgctgtgcgtgcaccacatcgtctcggacggctggtccttgggggtgctggtgcgcgaggtctccgccctctacgcggcgttcagcgaaggcaaaccgtctcccctgccgcccctggccgtccagtacgcggacttcgccgcgtggcagcgccagtgggtgctgcacgatggcatccagacccaactgaccgagctgcgcagccatctccagggcgtccccgcgctggagttgatcggtgacctgagccggcccgcggtccgtaccgttcgtggctcgagccagttcttcacggtgtcgccggagctcgtgcagtccctggagaaggtggctcgcgaccagggggccacgctcttcatggtgctgctggccgcgtacgaggtcctggtctcccgctactcgggacagcaagacttctgcgtgggcagccccattgcccaccgcacgcagtccgagctggagccgttgatcggcttcttcgtcaacacgctggccctgcgggcccggctggagggcgcgccgaccttcgcggagctggtgtctcgcgtgcgcgaggaggcgctggcggcctacgtgcgccaggacgtgcccttcgaccggctggtggaggccatgggggtcgagcgcggcggcggcaagtcgccgctcatccaggtgatgttcgccttgcagaactcgcccatgcagctgcctgcgctggcgggcatgcgggtggagccgttgaggtccgccacggaaacggcccggctcgacctcaccctgtcgatgatggatctgggcgacggagcgctggagggggcgctggagtacagcaccgacctcttcacgcccgaagcggcgaagcgtctgatacggcacttccagaccttgctggaagccatcgttcgggaccccgagatgcgcatccagtcgctgccgatgctgcccgaggatgagcagcaccaggtgctgaagggcttccagggacgggagatggcgccggcgtccgaggcgagcatccacgcactggtggaagcgcaggtggcacgcacgccggacgcggtggcagtggcgttcgagtcggagcgactgacgtaccgggagttggacgcgagagccaaccaggtggcgcaccacctgagggggctgggggtggcacccgagtcgctggtgggcgtatgcctggagcgctcggtggacatggtggtggcgctgctgggcgtgctgaaggcgggcgctgcctacgtgccggtggacccggcgtacccgaaggagcgtctggggtggatgctggaggacaccggagcgtcggtgctgctgacgcacgagaagtggaagtcggtgcttccgcccagcgccgcgcgagtcgtgtgcctggacagcgcagcgggtgaagtggcgaagcagccggtgacgaagccg

SEQ ID NO: 3022 - DNA, 2856 bp, Myxococcus xanthus
caggtgtccgcgatgacggacccaggcacggtgacgctctcctggttcgagcctgcgcagaacggcggcagcgcgattaccggctacgacgtgggcgtcgaacctctcgaggacggcatccaggtgcaggtggagggcaccaccgcgcgcgtcaccggcctgcgcgccggaggcacctaccgcttcaccatcaccgcgcgcaacgccgtgggcgtgagtcccgtggcgcgcgtggactccgtgaacctgccggatgtgcccaccgcgccggtggcgctcggggtggagcgaggcgaccggcaggtgcgtgtcacatggaacgcccccgcgtccgacggtgggcgctccgttcttcactacgtggtaacggcccacccgagcggcgcgagtgtcgcgacagacagccccgtgcggacaaccaccgtgagcgggctgaccaacggcgtggcctccaccttcaccgtgcacgcggtgaacgccgtgggcgcgggccccgcgtccgccgagtccaccgccgtggtgcccgccgcccagcccggcacgcccgtgtccgtggccgcctcgcccggtgtgcgcgaggtgtccgtctcctggcagccgcccgaggacaccggcggtctgcctgtctccggctacgtggtgacggcctcgcccggtggcaccacgcaccaggtggagggcctggccagcgaagccaccttcacgaacctccaggacgacaccgagtacaccttcaccgtgtccgcgcgaaacgacgtgggccagggacctgacagcagcacggcctccgcgcgaacgcatgcaccgccgggcgcgcccgcctccgtccaggccgaaccgggagtgcgctcgctcaccgtagcgtgggcgccccccgtgtccgacggacgctcacgcctcaccggctacaccgtcatggctcagccgtcgggcgtgcgcatcgaggtgagcgcggaccagcacggcgccgtgttggaggacgtgcccagcacgaaggcacagacaatctcggtggtggctcgcaacgccgtaggtgacagccccgcggccacggcgggtgagcccgtgaagtcgcagcccacgcccgtggaggtcacccgactcgacacgccgtcggcggtccgtggctgccagccggtgacctacacgctgcggcaggtggacggggaacgcgcggacgtcctggtggagttcgatgccacgggcagtggcgccttcacccgcgcgacccaagcggcggactcctattacgaacgcgcgtccggcctggtctcgctttcgacctccacgcagggcaccgaacacaccttccgctggaaccgtcccacggacctgccaggtaccgcgcccgaggcacggctccgcatcaccgccaccgtccctggcaccgcctccgcgacgcgcacgcacaccgtggcgctgaccgcaccggagaggcgctgcgaggtgaatctggacacgggccccgtgcagcgggtgacccaggaagtcgcgggcatgtcccatggactggcgcttggcgacttcaatcaagacgggaagctggacctcgccgcccgccacgacaacagccccggggtcaccttcctccgcggaatcggcaacggcgcgttcgaggcggagaacaccccccacctctccgtgacggccgagcacctggtctccgcggacctggaccgggacggcgtgctggacctgattgcggcggaagccaactactgccgatgcgtctccttcttgcgcgggcaaggaaacggcgcgttcgagcaacctgtcatcaactacgtgctggacgcagtcagccactcctcgacctatgacatcacgcctcccgccgtgctggacatagacggtgacggcgcgcctgaagtcgtggtgtcccagcgggacagcttgctcgttcttcgccacaccggcggaggccggctggccgtggcctttcgggagccgttcgcgcccaggggctccgttgtcacgggggacttcgaccaggatgggctggtggacctgatggtggtgggcccctccctccatggcttctatggcagagggctcctcaccttcaccaaggagttcctgggcacgcttgacggccccgtgccccatgcggtgaccacggacttcaacggtgatggccacctcgacatcgtggccctcgtggtggggaaccgggagtcctccatccacctgctgacaggtgacggccacggccgcttcacggcgcccgtgcgtctgcaccagcacacgtggcacagcttcggaaaccggagccacctcatcgcgggggacttggacgggaatggcacgcaggacctggcctatgtgcacgcggacagcgacaccctcaccctcctccaaggaagaggagatggaaccttcgaatccaggacgctcgccacggggatgaacccctcgtatctggtggcggcggacttcaacggcagcggcaagacggacctggcggtgctctccggcatgcacaacaccgtccatgtcatctgggacctggaactgcccacgcgtccggacatcggctggctcttcgcaacgggggactttgatggcgatggccacaccgatgtggcttcactcgtcgacggcggcgtccaggcccacctcacccgaacgggcggtggattcgagcaccggggcccagctccggttcccccgggcatatggaagctgctggcggaccgcttcgactccggcccgacaatggacctgctcgcgatgagtgccacgagcacgccacccaaccgctcgctggtgctgctgcgcggcaacggggacgggaccttcgccgcggcggaggagctttcgctagagggagtgacttcgggcgccctttcgagcctg

SEQ ID NO: 3023 - DNA, 420 bp, Myxococcus xanthus
cacgcggccttccagcacatcttcaccttgcccttcggcagcgacaccgtcaccgacttcgcgttccgcgagccgccgcctctgacgctgacgaaggtctccgactcagggagcctccggaggcagctcggctggggcgcgctggcgctgggcgtggcctccgcgggcgcgggcatgtgggccacgctggaggcccgagacatccggagcagcgtctcgcccgaactgccgcagcaggaagccgccgcgcacaaccgccgcatccggacctacaacaccgccagcggcgtgctctacggggtcggcggcgcggcggtgctgaacggcgcgctgctgttcctgtggcccgactcggacaccgtgccgctggccaccctgagctcggatggcgcggccctgggcctcacgggcgcattctga

SEQ ID NO: 3024 - DNA, 1257 bp, Myxococcus xanthus
ctggggctcatccagttctcgtccggttccacggtggatccgaagccggtgacgctgacgcacgaagccctgctggcgcaggtcgcggcgctggagatggcgatgccgctgggggcgggggtgccccgggtgggcgtgagctggctgccgctgtaccacgacatggggctcatcggctgtctgctgtccgcgctgtactacccgggaagcctggtgctgattccccccgaggccttcctcgcacggcccgcgttgtggctccgcgcgctgtctcgccaccggggctacatctctcccgcgccgaacttcgcctatggcctgtgtttgaagcgggtgaaggacgcggagctggacggggtggacctgtcgtcgtggcggcacgcgctcaacggcgcggagccggtgtccgtggacacgctgcgccgcttttcggtgcgtttcgagcggtggggcttctccgcgcgggcgttgcggccggtgtacgggctgtccgaggcgtcgctcgccgtcaccttcccgccggaagggcgggggccgcgcgcgctgggcgtggacgcggggctgctggcccgggagggccgggtggcggagggttcgcgtgagttggtgagcgtgggcatgcccgtggcgggcttcgaggtggaggtgcgcggcgagacgggcgaggcgctcgcggagcggtgcgtgggccgggtcttcgcgcgggggccgtccctgatggccggctacttcgcggatgcgcaggccacggaccggacgctgacgcgggacgggtggctggacacgggcgacctgggcttcatcgcggagggcgagctgttcctcacgggccgggcgaaggacgtggtcatcatccgaggcgcgaaccacgcgccgcaggcgttcgaggagccgctgcatagcgtggcgggcgtgcgcgcgggctgcgcggtggcgctgggcttcacgcccgaagggggcgaggacgaggcgctgctcatcctcgcggagcgttcggggcaggaggcggatgacgtggtcgaggagcgcatccgcgcggcggtggtggagaccacgggcgtgcggcctcacactgtgcggatgctcgtgccaggcacgttgccgcgcacgtccagcggcaagctgcgccgcgccgaggcgctgcgccgttacctggccgaggaactggcgccgccgaagaaggtgggcgcggtggggttggcggtggagatggctcggagcgcgctggcgatggtccgcgcggagagcgacacgtga

SEQ ID NO: 3025 - DNA, 1023 bp, Myxococcus xanthus
gggctgaacaccgtggtgctggagcgcggcacctcgccggtggacaaagcctgtggcgaagggctgctgcctcccggcatggcggtgctggagcggttgggcgtcctgcctctgctggatgaccagggcagccatcccttcgtgggcatccgctacgtccaggaagatggcagcacggcggagggcaagttcccaggcaagggcgcgctgggcgtgcggcgcgtggcgctggccacggcgctggtgtcgcgggcgcgcacggtgggcgtggagttgcgcgagcgcacgcaggtgctgtcccaccagcgggatggcaatggcgtggtgctgcatacggccgaaggcccggtggaggccgcgatgctggtggccgcggacgggctggcttcaccgctgcgccgcgcggaaggtctggaggtggagccgacggggccgcgccgtttcggcctgcgacgacacttccaggtcgcgccgtggacgccctatgtggagattcacttcgcgcatggcgtggaggcctacgtgacgcccacgggcgtgcggcgcgtgggcctggccttcctctgggaggacggcgtggtggaagggcgggtgagcttcgagacgctgctggcctgcttccccaaactgtcggagcggctctctggctcggagccggactcccagccccgcggcgcgggaccgctggcccgggtggcccgagcgcgcatcgccgaccgcttcgcgctggtgggagacgcggcgggctacgtggacgccatcaccggagagggcctgtcgttggccttcgtgtgtgcggagtcgctggggaacctgctaccggaggcgctcgtccatggcgccacgcgcgaggcgctgatgccttacgagcagtgtttccagcgggtcttccgcaagtactcccggtcgacaggcgcgctgctcatgctggcgcgacggccctggcttcgccgtcccgtggtgcggctgctggggaagacgccctggctgttcgagcgcatcctgcacgccgtcgtgacgtga

SEQ ID NO: 3026 - DNA, 359 bp, Myxococcus xanthus
cttgggggctgcctcttcgcgggcccccgccaccagggcccggtgacggagcacttcgacggtgagcagttccagaacctggagcccatcaatcgcctgagtccagaggaggtcttcaaggcgctgcgcaaggggcctcgcggcccgtggcgggactatgaggaattcgctccaggcaagccgcctccggagcgcgtggggccgggacagctccgggtgacgttcatcaaccacgccaccgtgctcgtccaggcggacgggctcaacatgctgacggaccccatctattcggaccgtccgagcccggtgcccttcatcggccccaggcgcgtgcggcctccgggcatcctttcgagggc

SEQ ID NO: 3027 - DNA, 1137 bp, Myxococcus xanthus
atggaagcgacggccctcgccggttacggtgcgggcctccgctcccgcatcatggaatcccgcgtcgccgccctcttcgcccacgtgcgcgagcacgccgagaatcgcccaggcgtctaccggatgctggggccttcggacgaagtgctctacgtgggcaagtccgtgcgggtgcgcacgcggctcttgtcgtacttccgcgcggaagcgcacgagaaggcggcggaaatcatcgcccacgcgcaccgaatcgtctgggagtacacgcccagcgagttcgccgcgctgctgcacgagttccgcctcatcaagtcacagcgccccctctacaacgtggagcacaagcgggaccggggccactgcttcatccatctgacgcgcgagcccgtccccaggctgcgcgtggtgagtcgcgccagcagcgagcgcggcgactactacgggcccttccacggacgaagcgccatgtccgacgtggtgcgcgcggtgagtgacttgctggagctgcgcgactgcgcggcggacacgcccatgcgactggcggaccagggccagctcttcccgctgaagcaggagccgttgtgcatgcgcgggcagctctcgcgctgcctggcgccctgcgccgggggctgtactcgcgcggagtacgacgcgcgcgtcgcccaggcccgcgccttcctcgaagggacgtccgacacgccgctgacgctgctgcgtgagcgcatggcgctggcggcccgcaggctcctgttcgaatacgccgcggagctgcgggacagggcggagcggctggagctgatgcgcggctgggtggtggagctgagccagatgctcaagcgcctctcattcgtctacacggtgcccggccatggcggcgatgaccgcgtctacgtggtgcgccggggcagcgtgcgcgcggagctgcccgcgcccgtcacgctcgagcaacagcaggcgctggaggcgaaggcccgtgaaatccttgagcagcccgagccggagacgctgggcttccgtgcacacgaagcgcaggaggtgatgctcatcgcccgctggttccgcctgcaccccgtggagctgaacgaagggccctaccaaccggtagggcccttttgttttacacgggcctcgcgatga

SEQ ID NO: 3028 - DNA, 549 bp, Myxococcus xanthus
atggtccccagcgccttcgagcggaagctgtaccgcatccgcaagctgacggagaacctcatccaggcgcgcggcgtggaccccaagggccgcttccacgtggcgtcgctgtcgtcggagacgctcgtctacaaggggctgatgctgccggtggacctgccgcgcttctactccgatttgcagcagccggacttcgtgagcgcgctgggcctggttcactcacgcttctccaccaacacgttccccacgtgggagctggcgcagccgttccgcttcatcgcgcacaacggcgaaatcaacaccatgcgcggcaaccggaactggatgaccgcgcggcgcggcctgctccagacggcgcgactgggcggcagcctggaggcgctccagcccatcatcgtcccgggcaagagcgactcggcgcagttcgacaacatggtggagctgctctacctgggcgggcgcaccctgccccacgcgctgatgatgatgattccggaggcgtgggagggcgacgcgctgatgtccgacaagcgcccacgccttctatga

SEQ ID NO: 3029 - DNA, 2889 bp, Myxococcus xanthus
atgctgctggtggacaccaccgaaggacgcatcctggaggacgaggacgtcaagcgcgacatcaccacgcgctggccctaccgccgctggctccagcgcaacgtctacaccttcgacaacctcccctccgtcgccgccccggtgcgcctgcgcggcgaggagctgtggcgggcccagcgcgccttcggctacaccgccgaggacgtgcgctcggtgctcacgcccatggcggagacgggcaaggagccggtgggctccatgggcacggacacgccgctggcggtgctcagcgaccacgcccccagcctcttctcctacttccaccagctcttcgcgcaggtgaccaacccgcccatcgacccgctgcgcgagtcgctggtgatgacgctggccaccgcgctgggtccggagagcaacaccttcgaggagacgccggagcagtgccaccggctgtccctccccggccccatcctcaccaatgggcagctcgcgcggctggcggccatcaatgacgagggcctgttcgagacgcgccgcctgtcgctcctctacgccctggacggcggcgaaggcgcgctcgaggcggcggtggagaagctctgcaacgaggccgtggacgcggtggacgccggcgccagcatcctgctcttgagcgaccgcggcgtggacgcggcgcacgcggccatccccgcgctgctggccatgtccgcggtgcaccagcggctcgtgcgtgacggcatccgcatgtacaccggcctgctgctggagacggcggaggcgcgcgaggtgcaccacttcgcctgcctgttcgcctacggcgccgcggcggtgaacccgtacctggcgctggacacgctccgggccctggcggacagcggcgagctggccgtggacgcggagaaggcgcaggaccgcttcatccgcgccgtggaggaaggcctgctcaaggtgatgtcgaagatgggcatctccacgctgcagtcctaccgcggcgcgcagctcttcgaggccgtggggctccagcgctcgctggtggaacggcacttcaccgacacggcgtcgcgcgtggagggggtgggcctgccggagctggggcgcgaagtggcggagcgccatgcccggggcttcggcgcggaagcggacgcagaggccggcatgctgcccgtgggcgggcagtaccgctggcggcggctgggcgagcggcacaagtggaacccggccaccatcgccaagctccaggcggcggtgcgcgcgaacgacgccgccaccttcgcggagtactcgcggctggcggacgacgagacgcgcgagcactccaacctgcgcggcctgctcgaaatcgcccacgagggccgcacgcccgtgccgctggacgaggtggagccggcgctctccattgcccggcgcttcgtcaccggcgccatgtccttcggctccatcagcgcggaggcgcacgagacgctggccatcgcgatgaaccggctgggcgggcgctccaacagcggcgagggcggcgaggagtcgcggcgctacacccgggacgagaacggagacctgcgccgcagcgccatcaagcaggtggccagcgcgcgcttcggcgtcaccacggagtacctggtcaacgcggacgagctccaaatcaaggtggcccagggcgccaagcccggcgagggcggccagcttcccggccacaaggtggatgagcgaattgcccgcgtgcgctggtccacgccgggcgtgacgctcatctctccgccgccgcaccacgacatctactccatcgaggacctggcgcagctcatctacgacctccagtcggtgaatccggccgcgcgcgtcagcgtgaagctggtgagcgaggtgggcgtgggcaccatcgccgcgggcgtggccaaggccggcgccagttgcgtggtcatctccggctacgagggcggcacgggcgcctcgccactgtccagcatccagcacgcgggcctgccctgggagctggggctggcggagacgcagcaggtgctggtgcacaacgggctgcgctcgcgcatccgcgttcaggcggacggcggcatgcgcaccgcacgggacgtgctggtggccacgctcctgggcgccgaggagttcggcatggccaccgccagcctggtggccgtgggctgcatcatgctgcgcaagtgtcacctcaacacctgttcggcgggcatcgccacgcaggacgcggggctgcgcgagcgcttccagggcaagcccgaggacgtggtgaacttcttcctcctcatcgcggaggacctgcgccagcggatggccgcgctgggcgctcgctccctgcaagagctggtgggccgcgtagacctgctgcggcagccgcccggcggtggaccactggaaggcgaagcgcgtggacctgtccgggctgctggccgcaccggccgcgccggacagcgagccgcgccactgcaccgagccgcgcatcaaggacgtgtccgaccacctggaccacgcgctgctgcgcgacgccagcgcggtgctggacggcggaccgcccatgctgctcaacgtgccggtggccaacacccaccgcgccgtgggcgccctgctgtcgggggagattgcccggcgtcacgggggccaggggttgccggatggccggctccacgtgcggatgaagggctccgcgggccagagcttcggcgccttcgtggtgaagggcgtgacgttggagctggaaggcgacgccaacgactacgtgggcaagggcctgtccggtggacgcatcatcgtctacccgccgcaggccagccgcttcaccgccgaggacaacgtgctggtgggcaacaccgcgctctacggcgccacggccggcgaggtctacctgcgggggctcgcgggtga

SEQ ID NO: 3030 - DNA, 1242 bp, Myxococcus xanthus
atgaagggctccgcgggccagagcttcggcgccttcgtggtgaagggcgtgacgttggagctggaaggcgacgccaacgactacgtgggcaagggcctgtccggtggacgcatcatcgtctacccgccgcaggccagccgcttcaccgccgaggacaacgtgctggtgggcaacaccgcgctctacggcgccacggccggcgaggtctacctgcgggggctcgcgggtgagcgcttcgcggtgcgcaacagcggcgcgcaggccgtcgtggagggcgtgggcgaccacggctgcgaatacatgacgggcggcgcggtggtggtgctgggccccaccgggcgcaacttcgctgccggcatgagcggcggcatcgcctacgtgctcgaccgcgagcagtccttccggcagcgctgcaacctggagatggtggacctggagtccctggtggacgaatccgaaatctggctcgttcacggcatggtggagcggcacctgcaccacaccggcagcgcgctggctgcggcgggtgctggacaactgggagctgatggtgccgcgcttcgtgaaagtgatgcccacggactacaagcgggtccttcaaacacggcgcgcggcgcgcagaccaccggagcccacatccgcggcgctgccccagtcccgcggcggggagggcctgagccatgggtaagccaactggattcatcgagtgggagcgcgtccacgcggacaagccgggacaaggccggaccgggctggggcgactggcgcgagttcgcgctgccgctggcccccgacgaggccaaacggcaggccggccgctgcatggactgtggcgtccccttctgccaccagggctgtcccctggggaacctcatccccgacttcaacgaggccgtgtaccgcgggcgctggcgcgaggcgtatgacttgctcagccgcaccaatggcttcccggagatgacgggccggctgtgcccggcgccgtgcgaggccgcgtgtgtgctcgccatcgaccgggacccggtcaccatcgaacagatggagaaggaaatcgtcgaacgggccttcacggagggctgggtgaagccccggcctccggcacgccgcaccgggaagacggtgggtgtggtgggctccgggcccgcgggactggcgacggcggcgcagctcaacgcggccggacacaccgtcaccgtgtacgagcgggatgcccgggccggcgacctgctgcgcgaacttaga

SEQ ID NO: 3031 - DNA, 489 bp, Myxococcus xanthus
atgccgtacaccccgatcatcggcacgctcggttacgtgatgtcaccggacgggcatcgcgtgttgctcgtccaccgcaacgcccgcccggatgatgcccactacgggaagttcaatggcttgggcgggaagatggagcgcgacgaggacgtggccgcctgcatgcgccgggagattcgcgaggaggccggcatcgagtgcacgcagatggtgctccgcggcaccatctcctggccgggctttggcaagcacggggaggactggctgggcttcgtgtttcgcatcgaccgcttcgaaggcaccccgctcgagcggaacccggagggctccctctcctgggtgcccgtggcggatatccaaggcctcaacctgtgggacggcgaccggcacttcctgccgctggtgttcgacgccgacccccggccgttccatggcgtcatgccgtattccggtggccgcgcgctgagctggtccttcagccgcctgtaa

SEQ ID NO: 3032 - DNA, 309 bp, Myxococcus xanthus
atgaaggtctatctggatgacgagcgggccactcccgacggctgggtgcgtgtgcggtggcccgaagaggcgatttcgctgctggcgtccgggcaggtgacggagctgagcctggaccatgacctgggcgatgacacgcatggcaccggatacgacgtcttgctgtggctggaagaggccgtggcgacccgtggcttcgtgccgccacgggtcgtccaggtgcattcggcgaacagctccgcgcgacagaagatgacgctggccatcgcccgcatcgagcgcttcgtccaggatgggcagggtggttga

SEQ ID NO: 3033 - DNA, 115 bp, Myxococcus xanthus
  unsure (1)..(115): unsure at all n locations
atggcgctccgccccgggaagaaggaggcggaacgcgcgcaacgcaacgccgagacgctcattgnggnctgncgcgcctaccaagcccggcacggacagctacccgacaccctgg

SEQ ID NO: 3034 - DNA, 234 bp, Myxococcus xanthus
atgcaagggcgggtggcctccgtcggaaaggaccacgtcgtggtccgcgacgcggagtccggagacaccttcaacctctttgtgaccaacaccacccgcatcagcgccaacggcaagcgcgtctcaccacagcaactctccgagggcacgcccgtgcaggccgcgttcaactacatcgcggatggtgacacctacgccacgcagattcgggcctatcccggccgcaggcgctga

SEQ ID NO: 3035 - DNA, 1260 bp, Myxococcus xanthus
atgctcgttggcattgcctccggcgcggtggcgggcctcgtcgccaacgtcgtcgcgggcggcgcgccctggctggccttcgtcgtggacaacgtggcctcgccggtggggcagatcttcatccgcctgctgctgatgctcgtggtgccgctgctgttctccgccatcgtcgtggccgtggcggagctggacctcaagcaggtggggcggctgggggctcgcacgctgggctacaccgtcgtcctgtcctccatctccgtcctcatcgggctggtgctggtcaacacgctggagcccggcgcgggcctgagcgacgaggcccgggcgttggcccagggcgggatgaccatccaggcggccgccgcgccaggggcgtcctcgttcggcgcggtgctcgtctccatggtgcccaccaaccccatcaaggccgcggcggatggagacttcattggcctcatcgtcttctcgctcatcttcggcatgggcgtggcgctcacgccgagcgagcctgtccagcgcctgcgcgagtccatccagggcctctatgacgtgatgatgaagctcatcgacggtgtgctgagcctggcgcccttcggtgtggccgcgctgctgttcgccatgacggcgcggctgggcttcggcatcttcgtgcagctcgcctcctacatgggcacggtgttgctggcgctgggcctgcacatgttcgtcgtctactcgctgtcggtgcgcttcctgggcgggcgcagccccatcgagttcttccgcagcagccggctggccatcgtcaccgccttctccacgtcgtcgtccagcgctacgctgcccaccgcgctcaaggtggcggaggagcacctcaagctgccgcgcagcgtgtcgcgcttcgtgctcaccgccggctcggccatgaaccagaacggcaccgcgctcttcgaaggcgtcacggtgctcttcctcgcccaggtctacggcgtgccgctcagcctgtccgaccaggcgctcatcatgttcatctgcatcctggcgggcatcggcaccgcgggcgtgccggcgggctccattcccgtcatcgcgatgattctgggcatgttcaagattccggtggagggcctggggctcatcctgggcgtggatcgcttcctggacatgtgccgcaccacgctcaacgtcaccggcgacctggccgccgccgtctacgtggcgcgcggagagtcggccgacagcccggccgaagagggggccgtggacccctctgcttcctga

SEQ ID NO: 3036 - DNA, 795 bp, Myxococcus xanthus
  unsure (1)..(795): unsure at all n locations
atgaaaggcgacgaggccacgcccggcctcgaagccggcgtcccctactggtcgaccccaggccaccgcgtcacgtacgcgagcggcaagcccgccggaaagacggtgcggctccacctccgtcccagcggcggcgagcagtccttcacctggcgtgacggcgccattgagaacggcttcatcggcagccccgacgatctcctgaacttcgaggccaccgtctacgtgcgcgtccacgaggacaacggcacgcaccactccatgtcctggaagatgcgcggcggccagcacacgaagcccgaggtagcgcgctcgagctgcgtcggcatggacgtcccgttcggcggcgtctcgccccaggcctaccgcgagctcgaccacccgacctacgaccacctctcgctcacgccctacttcgactaccagctgcaggaaggccgctggctcggcgtgaaggtggtctcgtatctggtcgagggcggcacccgaaacctgctgttcctcgacaccaatccntttcacggctaccgccccccccgtaaacagttccatttgttaaccgaacttcaccaccgcgacagctacagcaccgcccactacaatcgggcggccatcgtgggcacgcttgcacacgacgttccgcgtggatggctggcggcgggtcgacttcgcctacccctcggcacgcgagatcgnnccnnctactccgtaagggccccggcattccctgcgctcgccgtcgcggggatggtcgccccacccgatcgcgatcgcaacacgtccggccgacggtga

SEQ ID NO: 3037 - DNA, 543 bp, Myxococcus xanthus
atgcgccttcccgtcccgctcctggcggcgtccgtgctcttcgccctgcccgcgagggcggacatcacgctgttccccgaaagagagacctggctgtccgtgggccccctgtacagcgcggcattcggggcggacgcgcccggcacgggcgtgggcggggagttgacgctcaattggttcaagggcgtgggcgccctgggcctcttcgcgcaggcacagaagatggagcgcggcagcgcgcggctctgcgccgggcttcagggcaccctgctcttcgggggtgtggagctgggcgtcatgcatgaaacggcgagccggacgcgcgtggcgaccacgggcctgcacgtcgcgccctacctggccttcgtgttcggcagcctgggcgtgcgcttcgggattccgctggccggggaccgggacatcggccccggcggcgtggagcggacgcggcatgcccgcgaggtggggctggtgttgacgctcaagctccccatcgcgctgagctcgcactccgtctggggtcccctcttcccctggaactag

SEQ ID NO: 3038 - DNA, 486 bp, Myxococcus xanthus
atgagggtcgccaaggattccgtcgtctcgctcgaataccggctgcacctgggagacggccaggtcatcgaccagagcgcgcccgagcagccgctctcctacctgcacgggcaccggcagatcgttccggggctcgaaggggccctggagggcatgagcttcggggagagcaagcaggtggtggtggcgcccggccagggctacggcgagcacgacccagcgggcgtgcgcaccgtgcctcgcagcatgctgccgcccggcttctcgccgcaggccggccagtcgctgatggcgcagacggaccagggcgacatcccgctgcgcatccaggaagtgcgcgatgacggcgtcgtggtggacctcaaccacccgctggccggcaagacgctgcacttcgacgtcaccgtgaagggcgtgcgtgccgccacgcaggaagaactctcccacggccacgtccacgggccgggcgggcatgcgcacggctga

SEQ ID NO: 3039 - DNA, 1755 bp, Myxococcus xanthus
cagctcacggtgcgcgccgtcatcgccggcatggtgattggcgcggtgatgtgcctgtccaacctgtacgtcatcctcaagacgggctggagcctgggcgtcaccatcaccgcctgcatcctggccttcgcggtgttcggcacgctgcgctcgattcgggtgctgaagacggagttcaccgacctggagaacaacgccatgggctcggtggcgtcggccgccggctacatgacgggcggtggcaacatggccgcggtgcccgcgctgctgatgctgacgggcacgctgccgtcctcgggctggctgatggtgtggttcgccgtcatctccgcgctgggcgtcttcgcggccatccccatcaagcgccagctcatcaacgtggaggcgctgccgttccccacgggcacggcgaccgcggagaccatccgcgcgctgcacggccatggcgaggtggcccgccgcaagtcgcggctcctgggcatcgcgggcggcatcggcgcgctcgtggtggcgctgcgggacgcgcgcttcacgtggctggccaacatcccggagaaggtgagcctgcccttcacgatgttgggcaaaaaggcgtcggcgtggtcgctgtccttcgagttcagcctgctgctggtgggcgcgggcgcgctggtgagcttccgcacgggctggtccatgctgctgggcgccgtgctcacctacggcttcctcgcgccggccatggtgagccagggcgccatcggcgaggtgacctaccgcgccatcaacagctggatggtgtggacgggctcggcggtgctggtgtcctcgggcctgctctccttcgccttccagtggcgcagcgtggcgcgctccttcaagtcgctgtccggcctgttcaaggggaagaacgcgaaggaggaggatgccgacccgctggccggcatcgagtgcccgcccgcgtggttccccctgggcttcgcgattctcggcccggtggccgtgttcctcatggcctacctgttccagattccgtggtgggcgggcgtgctggccatgccgctggccgtcgtcatgggcgtcatcgccagccgggtgacgggtgagacggacaccacgcccaccaaggcgctgggccccgtcacgcagctcatcttcggcggcctggcgccgggcaacatccccgccaacgtcatgagcgccaacgcgacgggcggcgtggggctccactcggcggacctgctgacggacctcaagtccgggtggctgctgggcgccaatccgcgccagcagttcgtcgcgcagctcttcggcgtggtggccggcgcggccgtggtggtgcccgtgttcaagattctggtgccagacgccagcatgctgggcacggaggagttccccgcgcccgcctccatggtgtgggccggcgtgtcgaagctgctcgccacgggcgtggccgcgctgccgggctcggcgcgcatgggcgcgctgtgcggcgcggcgctgggcatcttcctggtgctgctggagcgctgggccccggcgaaggccaaggcctacgtgccgtcccccgcgggcttcgggctggccatcgtgattccgggctccagctccatcgccttcttcctgggctcggccatcgccgagctgctgcgccgcacgaagccgaagctggcggaggacatggtgctgccggtgtcctccggcttcatcgccggggagagcctgctgggcatcggcatcgcgatggcgaaggccttcggcgtgatgcccaagtag

SEQ ID NO: 3040 - DNA, 279 bp, Myxococcus xanthus
atgtacccgacggacgtgcgcgtggacttccaccaggaccgcgacgagaagctggcgctgcgcaccggcgaattggtgcacccgagcatctcctccgtgctgttcctcaaccgggtgcgcggcggcgcgctggtggtgacgcccgagttgccagacccggccaatccgtgcctggctgccacgcggctggacaccagcgacctggtgacgccccagcccaaccggctggtggtgttcgacggcacgctcacccacagtgtgctggacgcagacaaccag

SEQ ID NO: 3041 - DNA, 627 bp, Myxococcus xanthus
atggtcctgccgaccgccacaggcgtcctgcggtggctccaggtctccgcggaggtgcccttcatcgtcacccaggggggcacgcgcttccgggacttcaacgctccggaaggctcgggaatgggaacgccgtggctgggcctgcgcgcggcgctgaagcgtcaggactttggcttccagatggcggcggacgtgtcgcccgcgctcccggtgggcagcacggcgctgctggcccgggacgactacacggtgcacccccgcctgcaggtcggcttcctggcggagacgtggcaggtgggcggcgaggccggcgtgctggtgcgcaagaaacacgagctctccagcgtgtccggcttctcccaggacgtcatcggcagcgagctgcggctgggcgccacggtgacgtcgcgggccggggagagcacgcgcggcgaggtgagcttggtggcggggctgccgctgcaaggtggccgtccgggcggcgagttgctgctggccatccgcaagcacgcgctgtcctggctggacctctacgtcctgggcgggccgggcgtgggcgccggcatggacacgcccaccttccgcttcgtggcgggcgcctcgttctccaccttccgggtggactga

SEQ ID NO: 3042 - DNA, 1476 bp, Myxococcus xanthus
taagcagggcgcgaaggccgccgccggcacccccgccaaggcgctgggccggttcgccccgggcgtcaacgtggccatcgccgcggtcgacgtggccaacgctggcgcgacgctgatggacaagaacgcgagcacgggcaagaaggtgacgtccgtcatcaccgcggtgggctcggtcgccgcggccaccaacatcccgattgtcagccaggtgggcgccgcggtctccacggtgtccagcatcgtgggcgccttcttctagagcagagccccacccttcggggtttgtcagagcggctcggctggactatgccctggtccatgccgagccgtcgcttttccccccattggcgcgggcgctggcaagcctatctcccgggagcattcgtgagccgcaagcaagggacgcaaggaccaggtcatggagtcgagcgcctcctgaagatgagcccggtggtgagcctcggctccgccagggccctcgagcttcccaccgtacaggcgccctccctggaaggagtctcggtgcgggtccccaccccggacgacctgaccgaggaggacctgctgcgcgccttccacgagaagcgccgcgccctggcgacctcgcgcgagcgtcaacccggcgagtcgctggagctgggcgacgaggtgcggctcaacatcgtgggctactgcgacgggaagctcatccccttctccgcgcgcttcggcatgacgacggagctggcccccatcgaggccctgcccggcttcagcgaggccgtggccgagggtgccaaggtgggcgagtccctgcagattgccctggagctgccggagacgtaccccgtggaggcgctccaggggaagcccgcgcgcttcctggtggacgtcctcgccgcccacgaggtgacgctgccatcggagagcgcccccgagttcctcgagaagctcgggctgggcagcacgctgggcgagatgatgacccacctgcgcgacgagttggaggacgcggcggcggcacagctctgggtccaggcgcgggacatggtgctggatgagctggtccgacgtgctccggtggagctgcctcgcgcgctggtggacgaggagctgcgccgccgctgggtccaggccgagggccagggcatgctcgagcaccagttcgacgtcgacgagcagcgggaagcgctccagggctggctcacggaccccaccacgcgcgcggacgtcgagcgtcggctgcacatcggcatcgtgctgaaggccatcaccgaggagcagaagcttcagctcaccccggagaagctcgagcagttggtgcgcgaccagttggagcccttcgggctcaccgccgcggatgcgcacgccgccctgcgcgagtcgcccgagacgacgaaacaactcgccgagatgggttggtacctgctcgcggtggagcacgtcatgaacaaggcgaaggtcaccttcgagggctccgagcaggagggctga

SEQ ID NO: 3043 - DNA, 282 bp, Myxococcus xanthus
atggtctacctgcagatcaccctgcaaatttctcccgccaaccggcccgcggccgccgacgtgtacaagcgctacaaggcgccattcctcgagaaggtcgtcggcgcaaagtcgaaggagttgctcgtgcgtgacgaggacgtgcaggtgctccatgggttcgacacggcgcagcaggccaacgcctacctcaaaagcgacttgttcaccgccgacgtggtgagcgcgctgaagcccctcctcgacgccgccccggaagtccgcatctaccaagccgcctga

SEQ ID NO: 3044 - DNA, 357 bp, Myxococcus xanthus
gcctcgcactaccaacggctcctggaaggcgtcctggcccggccggacgagcgtgtcgccgcgctgccgatgatgcctcctgaggagcgtcaggccgtgctcgaagccgcgagcggcgctcgggagacgcttccgaaggacgcgcacatccacgcgctcttcgaggcgcaggtggctcgcacgcccgacgcgctggccgtggtggcgggcgctgagtccgtgacgtaccgggagctggatgcgcgggcgaatgcgctcgccctccgtctgcgcgcggcgggcgtgggactggagcaacccgtcgcggtgtgcgtggagcgctcggtggagctgctggtcgcgctgctgggggtactc

SEQ ID NO: 3045 - DNA, 300 bp, Myxococcus xanthus
atggagctgtcctctcccgaagggcgctgggggctggggctcgtgctcggcctgctcgtcatcggcttctggccgttgttgctgctggctgtcctcgacgtgagcgggacgccgcgcaaggtgctggtcgcgctggggcccgcgtcgatttgtctggggttcgccctgctcatcctggtgtgcggctaccggtatggtgagtcgctccggtggtcgcgcgctcagacgtgggggctcgccgcgctgttcctgggcatgggcctcgcgggtggcgcgggcctgtggttcagcgagggctga

SEQ ID NO: 3046 - DNA, 906 bp, Myxococcus xanthus
gtccccgacaccttcaccggcgtggagcgcgtggtggcggtgggggacgtgcacggtgacgtggacgccctgaaggaggtgctacggctcgccggcctcattgacgcgaaggaccggtggattggcggcaagacgcacctggtccagacgggcgacgtgccggaccggggcgaccagacgcgagcggcgttcgacctgctcatgcggctggagcaggaagcgctcgccgcgggcggacgggtccacgccctgctcggcaaccatgaagccatgaacatgctgggcgacctgcgatacgtgaaccccggggagatggcctcgttcgccgaccagagccccgagcaggacagcgccggctccccacccggcctcaacgggcaccgcgtcgcgtacagcctccagggccgctacggccagtggctgcgcaagcacgccgccgtggtgcgcatcaacgacaccctcttcgtgcacggcggcgtcgcgcccggcgttcccggcggaaacctggccgagctcaaccgctgggtgcgccaggacttcttccccgaccatccgcccggcggcgcgcgggacgcacagggccccttgtggttccgaggctacgcactgggcgagccacgggacgccgaacccgcgctggacgcggtgctgaagcgttatggcgccaggcgcatggtcatggggcacaccacgaaccgcgacggaaaggtgaaggtgcggttcaacggcaaggcgctgctcatcgacaccgggctgagcaccgggtacgggcggaacctcgcggccctggagcttcgcggcggcaaggtcaatgccctgtatcgcgaaggccccgtcacgctggactccgtggagccctccgccgcgccggctcgccccgcggggccgaagcctcggaagaaatga

SEQ ID NO: 3047 - DNA, 342 bp, Myxococcus xanthus
atgagcgccctgccctcgtgcccgaagtgcaactccgcctacacgtacgaagacggcagcctctacgtctgcccggagtgcgcgcatgagtggtcgacagtcgccgccgcagcgccgggggaagagaagcgcgaggtgcgcgacgcctacggcaacctgcttcaggacggcgatagcgtcactgtcatcaaggatttgaaggtcaaaggctcgtcgacggtggtcaaggtcggcaccaaggtccggagcatccgcctcgtcgacggcgaccacgacatcgactgcaagatcgacggcatcggtgcgatggggctcaagtcggagttcgtgaagaaggcgtaa

SEQ ID NO: 3048 - DNA, 1167 bp, Myxococcus xanthus
atgagtcttggcctccccggcatcttcctcgcgggcctgctgacattcctgtcgccctgtgtccttccactcgtcccgctctacctgtccttcctcgcgggtgtgtccctgtcgcagctgcgggaggcgggcagcggcgtgcggcggccatggggtgtggcgctggcgttctcgctggggctcggctccgtgttcgtcgcgctcggcatggcggccaccgccatgggcgggctgctcgcggagcatcggagcgggctcctccagttcggagggctcgcgctcttcctgttggggctcaagcagcttgggttcatccagattccctggatggacggtgaggtgcggcccctgctcgggcgggtgcggcgggggggcagcctgctgggcgccttcctcttcggagccgccttcgccctggggtggacgccgtgcatcgggccggtgctcggtggagtgctcacctataccgcctcctccacgtcggagcccctcatgggggcgctctacctcggcacctatgccgcgggtctctccgttccgctgctacttgtggccgccgccgctccgcttgcgctgcggtggatggagcgcgcgaagcggcacctgcgcaagttcgaggtcgccacgggggtgctgctcgccgggttgggggtgctgctcttcaccgactcgttggagttgctcgtgccctcggcggaagggggagaggcttccgcccccgtgatggagcgtcgcgcctcgtcctcgccggccgcctcggagactgcgtgcacttccgaggaaggcggcgatggcacgtgcgcgctcccggaggaggggggtgtcccatccttcatcggtccgtccgcgctggcccgggttgaacgcccgacgatggtggagttcgtgagccagagctgccccgtctgccagcggatggagcccacggtggccctggccgagcaacactgctcgggaaagggcgttgaggtcctccgcctcgatgtggggaccgcggcgggccggcgggccgcggtccaatatggcgttcgcggcgttcccacgttcctcttcctggacgccgcgggccaggaggtggcgcgccgcgtgggtgagcaatccctgacctccctctggcaaggactggaggtcatcgcgggcggccgctgtgcggggctcctcccctag

SEQ ID NO: 3049 - DNA, 924 bp, Myxococcus xanthus
aaatctttaccgcccatgaatgtgcccgaacacctcaacgccctgcgcgccttcgaggcgagtgccaggcacgagagcttctctgccgcggccaccgagcttcatgtgactccggcggcggtcggacaactcgtgcgaagcctcgaggaggcgctcggcacgccgctcttccatcggggcacgagtgggcgcaagcggctggtcctcaccgaagcggcccagcgggcgctgccagatatccgcgcggggttcgagcggctgagcgttggagtcgcgaggctgaaagaaggctcaccggtcggggtgctgacggtgacggttagccccgccttcgcggccaagtggctactaccgcgcctggagcgtttccaatccgcatggccagagctggacgttcggctcgatgcgtccatcgacctgctcgactttgccgcgcgcggtgtggatatcggcgtgcgctatggagcgggggactggcccgggttggtctcggagaagcttctcgacgaagaggtctatcccgtctgttcccctgtgcttcttcggcagggccgccgtctgcgtcggccttcggacctgggcggcgtacgactcatccacgaccgctccgtggattcccgggcgggattcgccacgtgggatgcctggcttgagaaggcgggggtaaaggacgtcgagacgaagcgaggccttcgtatcaacaactccgctgcggtccttcaggcagcaatcgacgggcagggcgtggcgctggcccgcagcatcatggcgcatgacgaccttgcggccgggcggctggtgcgcctgttcccggaggtcgagttcccgtccagactcgcctactacgtcgtctaccgacccgagtgcgccactctcgcgaagttggtggcgtttcgtgaatggctcgttcgcgaagcgtcctag

SEQ ID NO: 3050 - DNA, 792 bp, Myxococcus xanthus
gcgcccgccaagctggtggacgtggccagcctgtcgttggaggcgctgtcgcgcttcgtcaccgaggaactgggtgagcgcgccttccgtgccccgcagatctaccgctggctgcaccagcgaggcgccacctcgttcgacgagatgacggacctctccaaggtcctgcgtgagaagctcagggcgcgcgcggagatcgtccccctggtgaaggactgcgagctgcgcagcaccgacggcaccatcaagtaccggtggaagacgcgggacgggcgctacatcgaatccgtctacatgcccaccgaggaccgcaggacgttgtgcgtgtccacgcaggtgggctgcgccatggcctgcggcttctgcatgacgggcaccatggggctcaagcgcaacctgacccccagcgagattgtggcccaggtccacgcggtgaaccgcgaggttcgcaagaacgaggggcacgagacgctccgcccgctctccaacctggtgttcatggggatgggggagcctctccacaacttcgagaacctgaagacggcgctctccatcctccagtccgaggacgggccgaacttcagccaccggcacatcaccgtctccaccgtggggctggtgccgatgattgagcgtttcggcaaggagacggacgtcaagctggccatctccctcaacgccagcacagacgagcagcgcagcaagacgatgcccgtcaaccgcaagtggaacatcgcggccttgctggacgcctgccggaagttcccgctgcgtcaggggcgccgcatcacc

SEQ ID NO: 3051 - DNA, 438 bp, Myxococcus xanthus
atggctatcgagcgtacgctgtccatcatcaagccggacggcctggagaagggcgtcatcgggaagatcatcagccgcttcgaggagaaggggctgaagccggtcgccatccgcctgcagcacctgtcccaggcgcaggccgagggcttctacgcggtccacaaggcccggcccttcttcaaggacctggtgcagttcatgatctccggcccggtggtcctgatggtgctggaaggtgagaacgcggtcctggccaaccgggacatcatgggcgccaccaaccccgcgcaggcggccgagggcaccatccgcaaggacttcgccaccagcatcgacaagaacacggtgcacggctccgacagcctggagaacgcgaagatcgagatcgcgtacttcttccgggagacggagatccactcctacccgtaccagaagtag

SEQ ID NO: 3052 - DNA, 900 bp, Myxococcus xanthus
atggccatcctcgtcaacgaaaacacgaaggtcctctgccagggcatcaccggctcggcgggctcgttccacgcgaagcagatgctcgagtacggcacgaagctcgttgccggcgtgactccgggcaagggcggcaccacgttcgaaggcaaggtccccgtgttcaacacggtggccgaggcggtgaaggagacgggcgcgaacacgtccgtggtcttcgtgccgccccccttcgccgctgactccatcatggaggctgcggacgcgggcgtggccctcatcatcgtcatcaccgagggcatcccggtcaacgacatggtgcgcgccaagcgctacctgcagggcaagccgggcatccggctggtcggccccaactgtccgggcgtcatcaccccgggcgcgctgtgcaagatcggcatcatgccgggccacatccacaagccgggccgcatcggcgtggtgtcccgctccggcacgctgacctacgaggccgtgcaccagctcacccagctgggcctgggccagtccaccgccgtgggcatcggcggtgacccggtcaacggcacggacttcgtggacgtgctgaagctcttcaacgcggacccggacaccgacgccgtcatcatgattggcgaaatcggcggtgacgccgaggagcgcggcgccgagtacgtggcgcgcgagttcaccaagcccatcgccgggttcatcgcgggccagtccgcgcccccgggcaagcgcatgggccacgccggcgccatcatctccggcggcaagggcacggcgaccgagaagatcaaggccatggaggccgcgggcatcctgatggccgccagccccgccgagctgggcaccacccttcaggaggccctcaagcggggcgctccgaagaagcgctaa

SEQ ID NO: 3053 - DNA, 1161 bp, Myxococcus xanthus
atgaagatccacgagtaccagggcaaggaaatcttccggaagtacggcgtgcccacgccgaagggcatcctcgccgtttccgccaacgacgcggaggccgccgcgaaggagctcggcacttctgtggtcgtcgtgaaggcccagatccacgcaggtggccgtggcaagggcggcggcgtgaagctggccaagagccccgcggaagccaaggagctggccaagcagatgcttggcatgaagctcaagaccatccagaccgggccggaaggccagacggtccacaaggtctacatcgaagaaggtctcgccattggccaggagctgtacctgggcgtgacgctggaccgcgccaccagccgcatcaccttcatggcctcccgcgagggcggcgtggagattgaagaggtggcggagaagcacccggagaagatcctccgcgagtcggtggacccggccgtgggcttccaggacttccagggccgcaagctggccttcgggctgggcctgacgggccccacggtgaacaagttcacccaattctgctcggcgctgtaccggatgttcatggacacggacgcctcgctcgtggagatcaacccgctggtcatcctgaaggatggcggcgtggtggcgctcgacgcgaaggtgaccttcgacgagaacgcgctctaccggcacaaggacctgctggagtaccgcgacctggccgaagaggagccccgtgagatccaggccaaggagtgggatctggcctacatcgcgctggatggcaacatcggctgcatggtgaacggcgccggcctggcgatggccaccatggacaccatcaagctggtgggcggcagtccggccaacttcctggacgtgggcggcggcgccaacaaggagaaggtcaccgcggccttcaagctcatcctggcggacccggccgtgaaggcggtgctggtcaacatctttggcggcatcatgaagtgcgacgtcatcgccgagggcatcatcgccgcggcgaaggaggtccagctcaaggttccgctcgtggtgcggctggaaggcaccaacgttgagaagggcaaggagctgctgagcaactccggcctcgccatcaccccggcggacaacctgcgtcaggcggcggagaaggccgtcgctgcggtgaagtaa

SEQ ID NO: 3054 - DNA, 777 bp, Myxococcus xanthus
aagaccatcaccttccgcatctggcggcaggatgatcccgcgaagccaggccacttcgatgagttcaaggttccctatgcgaagggcgccaacgtcatctcgtgcctgatggagatccagcgcaaccccgtcaccgtggagggcaagcgcgtggccccggtgatctgggacgccgcatgtctggaagaggtctgtggcagctgcgccatgaacatcaacggccgcgtgcgcatggcctgctcggcgctgatcgacaagctggagcagccgatcacgctggagcccatgagcaagttccccgtggtgcgtgacctcacggtgaaccgcgaccgcatgttcgacgcgctcaagcgcatcaagggctgggtgcccatcgacggcacgcacaacctggggccggggccgcgccaggcgcccgtggaccagtcggtgatgtacgtgctgtccacgtgcatcacctgcggcagctgcctggaggcgtgcccccaggtgacgcaggagaacgacttcgtgggcgcggcggccatcagccaggcccgcctgttcaacatgaaccccacgggcaagatgaactccgaggagcgcgtgcgctcgctcatggggcccggcggcatccaggactgcggcaaggcgcagaactgcgtgaaggtctgcccgaaggagattccgctcgtcacgtccatcgcggtgatgaaccgcgaggtgaccaagctcaccatcaaggacatcttcttccaggacgaggcccccaagggccacggcagcggtccggggtag

SEQ ID NO: 3055 - DNA, 1884 bp, Myxococcus xanthus
atgatggcaccagcagcgcggttcacggtggtgggcggcggcctcgccgggctgatgacgacgatcaagctcgcggaggcgggccaccaggtggatgtgctctcgctcgtcccggtgaagcgttcccactccgtttgtgcccagggcggcatcaacggcgcggtgaacaccaagggcgaaggcgaccacccggatatccacgtgaaggacacgctgcgcggcggcgacttcctcgcggagcaggtttcggtgaagggcatgtgtcatgccgcgcccggcatcatctacctgttggaccgcatgggcgtgacgttcaaccgcacgccggaaggtctgttggacttccgccgcttcggcggcacgctgcaccaccgcacggccttcgccggcgccaccaccggccagcagctgctctacgcgctggacgagcaggtccgccgctatgaggccgagggcaaggtcaccaagtacgagtactgggagtggctcggcacggtgaaggacgacagcgggcgctgcatcggcagcgtggccgtcgacctgcgcaccatggagatccgcaccttcccggccgaggccgtctgcctggccacgggtggtccgggcatcgtcttcggacgctccaccaactccatcatcaacaccggcaccgccgcgggccgcgcctacatggagggcgcgcactacgccaacggtgagttcatccaggtgcacccgacgtcgattccgggcgaggacaagctccgcctgatgagcgagtcggtgcgtggcgagggcggccgcgtctgggtgccccgcaagaagggcgacacgcgggcgcctcagcagatcccggaggcggagcgctggtacttcctggaagagaagtaccccaagtacaagaacctggtgccgcgcgacgtggccacccgcgagatcttcatggtctgccgcgagctgggcatgggcatcaacggccgggacggcgtgtacctggacgtcacgcacatccccgcgccggtgctggacgccaagatcaagggcgtcatggagatctacgagaagttcgtcggtgacgacccgcgcaaggtgcccatggtcatcttcccgggcatgcactactccatgggcggcctgtacgtgaacttcgaggccgacccgaagacgcagacgccggccgagggcagcccgaagaaccagtccaccaccatccccggcctctacgccgcgggcgaggcggactacgccttccacggcgcgaaccgcctgggcgccaactcgctgctgtcgtgcatctactccggcatgatcggcggcccggccatggtctccttcgccaagagccagggcaccagcgccgcggcgatgccggagaagcacttccaggccgcccggcagtactggcaggaccgtttcgccaccatgctcaagatgagtggcacggagaacccgtacgggctcgccaaggagctgggcgacaccatgacggagaactgcaccgtcgtgcgctacaacgaccgtctgaagaagacgatcgagaagatccgcgagctcaaggagcgctggaagaacgtcaacgtgctggacacgggcaatgtggccaaccgcgcgctgtcgtacaccaaccagctgtggaacatgttcgagctgggcgaggtcatcgcgaccagcgcgctgctccgcgacgagagccgcggcgcccactacaagccggacttctcgctgcccgaaccgaagacgaaggacccgacgcaggacccggagtggatgagcctgtggcgtgcgcgccacgagaagtgggcgaagacgaccgtcgcgacgtacagcgaggccggcccgaagatccactacgaggacatccctacgcccgtgctggaccccgagccgcgctggtacgcctgagac

SEQ ID NO: 3056 - DNA, 312 bp, Myxococcus xanthus
acgctctacacggcccaccgtgtgcgcttcccggtggagaaggtgcgcgcctcgctcgtgtacctcaacgagggcaaggagcaggacgtcgcggtggacccggaggccatggcctccttccaccggcacttcgagcagagcgtggcgaagatgcgctcgctgctgaaggacgcggccaccaacacgccgctggacgcgtccgcgtttccgcccacggagtcgctgacgtcctgcgcacggtgcgtcttccgccgtccctgcggacgcgagggcgccgcgcccgaagcgccccaaccgcagcaggtggtctga

SEQ ID NO: 3057 - DNA, 1455 bp, Myxococcus xanthus
atggccgccgaggcctcgagcgacgtgtcgccagaaattgtctccgcgatgcgtcgggaccttgggctcaccgagcagcaggtgcatcagcgcctgtccttcgaggcgaaggcgcccgggctggagcagacgatgcgtgaacaacttggcgacgccttcggtggcgcctggctcgacgcggagggcggccagctcatcgttggtgtcaccgacgaggcccgcctcgccaagacccgggtcgccggcgtgcggaccgtgcacgtggcgcggagcctggcgcggctggagcaggtgaaggcggaactggaccagaacgtccaggccctctcgcccgccatccactcctggtacgtcgacctgccgacgaacagcgtcgtcgtctacgtggacgcctccagccagacgaagctgcgcgcggatgccttcatcgcgcagagctcgggcctgaaagacggcagcctccgcgtggtggcctccacccacgcgcccgagcccgcctatgacctgcgcggcggtgacccctactacttcagcaactaccgctgttcggtgggcttccccgtcaacgggggcttcgtcaccgccggccactgcggcggcgccggcacgcccaccacggggcacaacggcgtggccctgggcaccatccgtggctccgtctggcccggctccgactacggctgggtggccacccatggctcgtggaccccgcagccgtgggtcaacaactacagcggcggcaacgtcaccgtcgcgggctcccaggaggctccggtgaatgcctccatctgccgctccggctacaccaccggctggcggtgcggcgtgctccaggcgaagaacatcaccgtcaactactccgtcgggcccgtgtacggcctgcacaagacgaacgcgtgcgcggacggcggcgactccggcggctccgtcatctccggcaaccaggcccagggcgtgacgtccggcgtggcgggcacgtgcgccaacggaaatccgccgcagacgttctaccaacccgtcaaccccatcctgggcgcctacggcctgacgctccgcacgacgggcggtggcggcagtggacggtccttcgtgtcgcgcctcaacggcaagtgcatcgacgtacccaactccaacttctccgacggagtgcagctccagatgtgggactgcaatggcacgaacgcgcagcggtggaccttcatcaacggcaccgttcaggcgggcggcaagtgcatggacgtggcctgggcctccacggccaacggcgcggccatccagttggccaactgcagcggcaacccggcacagcagttcgtgctgagcggcgcgggtgacctcgtcagcgtgctcgccaacaagtgcgtggacatcgtgaaccacaacacgtccagcggcgcccggctcatcatctacgagtgcacgggcaacccgaaccagaagtgggactaccgctga

SEQ ID NO: 3058 - DNA, 1494 bp, Myxococcus xanthus
atgaccaagcgtgtcgttatcagcgcgctgtgtggcgtgctgctggtgctgtcgacggggtgcggtgacgagtgtgtcgatgtattcgactgccgcagcgacaaagggccccctccggcggggaaggattggacgtgccgctcgggcaactgtgagctgcgcgatgtccagcggccgcccgagggggacgctgggacggaagaggacgctggcaccgagggagacgcgggcaccgaacaggacgcgggcactgaagaggatgccggcacggacgcgggcacggccgacggcggtggcgtggtcgtcatcggcacgggggccaagggtgatgcttgcacgtcgtccgccgactgtgccgcgggcctgcgctgtgagggcacgaccgaggccatgacgtgtcaggcgctgcacgtggccttcacggccatggacgacaccgacgaaatggctgcggtggtgacgcgcttcgatgcgccggagcccacgcggctgtcagacgccgaggagaacagcctctacccgcgctggaacccggccggcaaccggattgccttcgtccagggcgccaccgagacgggcacctcgacggggaacctggccggtgagctggtggcgcgcgacgtgccgctggtggcgggtgcgcccacgatgctcgccaacggcaccacgggcagcaccgagggcttcctctacctggagtgggagccgggggattctctcctgtacgtgcgccgcgcgggcgacagcatctccggcatctcccgcgtcccggccgagggcggcacggtggagcaggtcaccgcgttgggctcctccccggcctggcgcaatggcaacacgttcgcgttcagcaccgccaccgtcggcatctccacggccaccgtgggcggcgcgcccacgccgctggccatcgcgggcaccacggcggagcagccgcactacaaccgcgtcaatgaccagctcctgttcctccgtccggatgacacgcggccggtggggctgaacgccgcgctctacatcgtccccgtgcgcggcgccgccgtgcaaacgattgccgagttcaccacggcggccgtcgagggtggctcggtggattcctacatcgccaaccccacctgggcgccggatggcagctgggtggcgtacgtgcgcgcctacttcttcaaccccaccacgggggagccggagctctgcggcgccggtgactcgccctgtgccggcgacccgggcaacatcattttcctgcgccgcatcaacccggcggatggcaccccggtgggggatgaggtcagcttcgccgagggcgccacgctcccgtcgttctctccggatggccactacgtggcctacatccagacggggcagctctacgtccagcagattgatccggcggcgggcgcgaaggtaggtgaccccatcgtccacccgctggggggctacactctccagacgtcgcgcggcgatgaccaccgtccgcgctggcagccccggtag

SEQ ID NO: 3059 - DNA, 252 bp, Myxococcus xanthus
atgaggcgctctcttgttcctggcttcctgctcttcaccgcctgcgccaccgcgccggctcaccgcctggacgagggcagtggtggcaccgcggccgaggagccacagtcgctggccgcgcctgtgcgcctggagacacgctccggcagcttcctggtacacccgaacaacgcggcagacttcgagaagctgctcgcgggagagcccacgcggcagcgctactccgccggcatcctgatggcgggagactga

SEQ ID NO: 3060 - DNA, 387 bp, Myxococcus xanthus
acgctgacgcccgaggcgctcttttcccagtgggagggcttccaggtgctcgacgtgcgcgagcgctctgagttcgagcgtggccacatcctgagcgcacgacatgcgtatgtgacagagctggaggagtgcctctccgagctgggactgcgcgaagaccatccggtcgcggtggtgtgcagcacgggccatcgctccggacttgccacgagcatcctgctccgcaacggcttccagcaggtctcgaacgtgctgggcggcatgtcggcatggcggcggctggaacttccggtgcggacaggcccgccgtcggaggtcgagttcgaacaagcaacgcgctccatggggacagaggagcaggacgcttctccaccgtcgccttcgtga

SEQ ID NO: 3061 - DNA, 754 bp, Myxococcus xanthus
atggtcacgatgggcacgggatgtggcgacgaatgcgttgaccagtttgactgccgcacggacaagggcacgccggccgctggcaagcagtggacctgtaactctggaacgtgcgagcagcgcgacatcacccagggcccggatgcgggcaccgaggaagacgcgggcaccgagccggatgccggcgaaggcgacgcgggcaccgacccggagggctgcaccagcaacgcgacctgcggtctgaccgagacctgcaacaccacgacgagcacgtgcgaggactcgggctttgtcacgccggtggcgacgaccagcacgcagatccaggcggtccgggatgcggcggatggcgcgctcgaccccgcgctggccatcgagggtgcgttcgtcacgttcatcaagcccgcggtgacgggcagcagcgagctccccggcttcttcgtccaggccgaggcccagggccccgccctgttcgtgtccgacgcgacggcgctggccgcggtcgccgtgggtgaccgggtcagcttctccgtgtcgtcgaaggcgaccgacggcggtctgcgctccgcgtccgccgtcaccggaaccacggtcatcagccaaggccacccggttcagacccagtcgacggccacgccggccggcctcgccgtgaaccgctccgcggacacgtcggacacgctggtgaccggtctggactccgtggagtccgagctcacctacctgacgggcacgattgcggcggccggcagtt

SEQ ID NO: 3062 - DNA, 720 bp, Myxococcus xanthus
atgaatgacatcgccgtcctcgtcaacctgcgtgcacgccggggctccgaaggcatgggagggctggtccagcgcttcctgccccgggcacgcgtggcgctcacccgttcgctcgacgaggcccgtgcctggatttcggacacgctccggcccaatccgccctccctcctcctggcgggcggtggtgacgggacgattacggggctgctcaacgagctgcgcaccgcgggggtggccctgccggccattggcgtgctcccgatgggcaccggcaacgcctgggcccgcgtcaccggcgcgccccggcccgcggaggccttgaagcagatcgccgccgtgggcgagcgcctgccgcccctgcgccccttcgccctggttcgcgtggagggcaaggtggcccccttcgccggcacgggctgggacgcggagatgattcaggacttcaagaaccagctcgccgcctccggtccgctgcgcagcacccaggccggcctgcgcggctacctgggcgccatgttcacccggacggtgcctcgccacctcttcggcgagggcaacccctcagtgtccgtctacaacctgggcgaccccgccctcacggtggacgcgcggggctccgtgcagcccgtgccgcatggggacaagggcgcgctcctgtaccgggggcccacaggagtttccggggcggcccccacgccccagtgggggtttggcttcaaa

SEQ ID NO: 3063 - DNA, 276 bp, Myxococcus xanthus
atgcacggcctgctgccccgcaccttcgagcgcaccatgaacggcgtcaccgaggcccatcactttgagaaggagcgccagggccacacctctgggacgctcttccgtccgatggcggagggaacggggacctcggggggccaccacgcggcgggcaagcaatggctgcgccggctgttggtcgccgggggcgtggccgcggcggcgttctccctcggaaagaagcgggaggcacgggggctgaaggcccgtttcgcccatgcactgggagtatga

SEQ ID NO: 3064 - DNA, 744 bp, Myxococcus xanthus
atgaagtccgcgaagtgggcggccctgccgctgttgctgctggccgcctgtgccaccacggggcgccagggcgctgctgacgactcgccgccgcgcctcatgtcctggtcggagcagatctccgagcgcgaagcctggctggagaagcgccacggcatgctgctggacatgatgcgccgccatggcgtgggcatgtgggtggtcgtcaacgaggagttccacgacgacccgctcacccagttcatcgcgccgccgcggccctacgcaggtaaccgggacatcttcgtgttcgtcgacgccgggcccgaggggctcaagcgcgtcgcgctctccggctactcggaggccacgctcgcgcgcttcttcgagctgcccgaagaagggcgcaagccgcaggaggtcctggcggacctgaacacgcgctatcagccccggacgattgccctgggcattggcggcaagcgcggggtgacgcgcagcctgacgaaggacagctacgccttcctggtggattccctgggcgcggaggcggaggcccgcttcgtgagcgccgcgccgctcatcgaggagtacctggacacgcgcatccccgaggagtggctgcactaccagcgactggtgatgctgacggaggccgtggtgaaggaggctttctctccggaggtggtggtgccggggaagacgaccgtcggtgacgtgcgccgcttcctctatgacaggctctgggcgctgggcgtggacacc

SEQ ID NO: 3065 - DNA, 2871 bp, Myxococcus xanthus
atgcagttggagctgctgggcttccatgtgatgggggacccgcgggtgttggcgcacgagcaggaggacgcgcccgaaacctggatggcgtccgatgcgcccacgacacgtgacacggccgaagtgccgcggcgcccttattggcgctgggccccgttcgcggtgggcgcggtggcggcggccatcgtcctggtgctcgtcgtcaagagcgccggtgtgcggggttcccagcaggaggtctggctcgcgcagacgtcgtcgcgcctcatcgaggcgagggttgcctatgcacgcgccgacggacaccggccctatgagcccctacgtgcgggtgtcagtggccctccgggcggggctggctcggcattgccgctccgggcgttggcggatctggaggaccagggggacctgcatggcattgccgccgcgtacctggtccgcaaggacctgcggcaagcctccgacttcctccatcggatgtcgccgtcaccggaccgggacagcgacctggccatcgtcgcgttggagcaggggcatccggaacaggcgctggcgctgctggacggggtattacgacaagcgcccgagcacgcccaggcgcagtggaaccgggcgctggtgctgcgggagatggggctgacgctgctggccgcggaggcgttcgacgcggtggtgaagcgcggggagccgggctggagcgaggaggcgcggatccgcgcgcgagcgctccggcagcagacgcaggcgcgtgggcgggcctggaagggggctcgcgcggcggtgcgggacctgatggtggacgcgcaggcgaggctcccgctggaggaggcgaagcgctttcctggcatcgtccggctggcgttctacgacgcggtgagggccgcgccgtcgcgggagtggaccctgcgcctgcttccgttggcggacgtgttggacggcgtccagggcggcgaggtgcttcgcggctacgtgctgcgtgtggcggagcgggacttcagccgccgtgcacccctggcggcggactacgcgaagctcgtgcggggcgagctgtcctcgccagcgcgcttcctggagacgctgcggcgttcgggcgaggacgacctgtacctgggcgggctcatcaatcagacggcaggcgcgcgccacctggaggatttcacgcggctggcccgtgcggccgaggacccctggttgtcgctgctggccgagcgggagttggcgggcgccgaggagcgcgcgggcgaatggtggaaggcggaggcgcggcttcgcgcggccgtgggggcctgtcagggcaaggggctgtcctaccgctgcgccacgctgaagaagcggctgtcggacctctatctcgcgctcaaccgcccggcggaggctttcgagcaggcctggagtggctggctggcgtcccgggagcaggaggaatgggagctggagcaacagttcctccaggaactggcgcacatcgcgcgctaccgcttggacgtcaccagcgcgcgcgcctacctgcgcgagtccctggcgcgaacgcccgatgcctgtgagcagcgcacctacgtgcaccgcaacctggcctacctgtcgtggctggagttcgacgcgcacgaggcgcggaacgagctggagctggcgcaggagtgtggccggccactggggttgcccggcgcgctgttgttgtcatacctggcgcgcttcggcgcggacagccaggacgcggacctgttgcgccgcaccctggccgagctgcaccgggggcagccctccccgggcaagctcgcgcagatgcgcttcgccgaggggcagttcgtgctggagcgcgaccgcgtggctgggctggagctgcttcgcggcgccatccaactggcggagtcccttcccaacgatgtggacgcgcgcaagacgcgcatgggggcctacaacgtcctggcgcacgaggcaggccgcacggacgccccaggtgaggccctggcgctcatgggcgccgcgcttcaggtcgaggtccctgcgcgatgtgtgctgggcgtcgccgtggactacgagcgctcggtggtcgcgctgcggggcgctacgggtgaactgcagggacacttcgacgccagccgcgcggagcccctggggcgggacgcctccgggctggttccgccgtcgctccaggccgccttgaagggctgcgagcgggtggacgtgctcgcgctgccgccggtgcatggcctgcgggggctgctgcccgcggagctcgcctggagctaccgcgtggggcggcccggaggcgcgtctcccgtgccggctcgtggcagcgggccgcacctggtcgtcaatggggttgaggctcccgcggcgctgggcctcccgcggttgcttccactggagccaccgctcgcaccggacccgcagcgaatcgagctgtcgggcatgcaagccacgccaacccgggtgctggcggccatggcgcaggccagtgaggtggaaatccacgcgcacggcgccttcagccccgagatgtcagacgcctcgctggtggtgctggcgcctgaacccgatggccgatacgcgctgtccgcccctcaggtccgcgcgctgaagctggagcgcgcgccgctcgtgcttctggccacgtgcagtgcggcccgagccacgcctttccttcatgagtccttcagcctgccggtggccttcatcgaagcaggcgcggccacggtgctggcctccacggtggaaatccccgactcggcggggcgcttcttcgaagcggtgcgtgagcgcatccggagcggcgcgccggcggccctcgcgctccgcgacgcgcggcgcacgtggctggcggcccatccctcctcggactgggttcacggcatcctcctcttcgaatga

SEQ ID NO: 3066 - DNA, 351 bp, Myxococcus xanthus
atgaccaatcatttcctcgaccagtgccgcaagcggcgctcggagttgctggagcaggaccgtccggagctgcggctggtgcgcgagggagtggcggcccccgagccggaggccatggaggtctgggagcacatctcggcgaaggacttcaaggcggccatcgcccagttgtcgaatcccagggtgcgtgaggcgtattcgctgcatgcctcggggctgcgctaccgcgccatcgccctgcgcatgggcgtccccgaaggcaccgtggggagctggctctatcaggcccgcaaggagttgaaggcgcttctgctgccgctcaccgggagcgacggaggaggcagcgcgtga

SEQ ID NO: 3067 - DNA, 1176 bp, Myxococcus xanthus
gcgccctgggtggcggcggtgctcatgtgcgcggtgctgatatccgcggcgctgttcatccggaacaccgcgctggagtcgtccgccctggtcacccggggcatggccaacgtcatcatggtcgccggcttcgaggccttccgcgacacggaggggctcccggacccgtccgcgctgaacgccttcctggcagcccaccgggagggcggcctgcgctacgtggccgtcgtggatgacgaccaggtgctggcgtcagccggggaggtgaagctggggcggcttctcttgcatgagggatcgccgctggtggtcgaaggcgcgcgcgcgcgcctggtcagccgcctccgccggccccgtcccgccttcggtcccctgacacaggaggaggtccgcgccatgtcggcgcagggcgattccctggagccgcgcaagcacctgcgcattgtctacgagttcgagccgctcaccgccctggcgttggagtcgcgctcgcagcgtctgctgggcgtggcggtggcctcgtgcgtgggcatcctggtgttggccttcgccttctcgcgctcgttggcgcagcgggaggcgctgtcggaggaactggagcgcggccggcggcttgcggccctgggcaccatgtccgcggtgctggcgcatgagcttcgcaatcccctggcctcgctcaaggggcatgcgcaactgctcgccgagcgcgtggagcgtgacgccgtcctggcgcccaaggcggaccgggtggtgtcggaggccgtccggctggagcagttgatgaatgacctgctgggcttcgtggccagcggtgagcttcgccgcgtggaggcggaccccaacgacgtgctccgcgcggcggtggagagcacgggcgcggcgcgtgtggaggctcgctatctgccggaccgcacgccctggcctctggacgcgggccggttgcagcaggcgctggaaaacgtgctgcgcaatgccgtccaggccagccccgaaggccagcgcgtggaggcgaccgtggagcggcaggactcgtccctggtgttcacggtcaaggaccacgggcccggtatcgccgcgggggaggaggagcgcatcttcgagcccttcatcacgggccgcatgcgcggcgtgggcctggggctggccatcacccgccgcatccttagagcacgggaa

SEQ ID NO: 3068 - DNA, 606 bp, Myxococcus xanthus
atgggtgaaatcatccgggtcgcattcgatgcggtcctcgccaacaagctgcggtcgctgctgaccatgttgggcatcgtcatcggcatcgcggccgtcatcaccatggtcgcgctgggcgaaggggcgcagcgctcggtggcccagcggctccagggactgggcaccaacgtcctcacggtacgcccgggtcaggcgttcacgggcggcatgattcgcgcccaggcgtcgatgaccatcgacgacgcggaggcgctgcgggagaacgcgcgccacatccaggccgtggcgccggaaatcgagtcgcgcttccaggtggagtacggcgcgaagaacgcgaacctgtccgtcgtgggcacctggccggactacttccacgtcaaccaggggcagatcacgaacggccggctcttcacggacgcggaggacaagggccgccgccgggtggtggtgctgggcgccctggccggtgcgcagctgggcctgacggacaccgcatccctggtgggcgagtccatccgcatccggggcattccgttcgaggtcatcggggtgctggccgaaaagggcgcgcagggcttcaacaacccggatgagagctgtaga

SEQ ID NO: 3069 - DNA, 1311 bp, Myxococcus xanthus
  unsure (1)..(1311): unsure at all n locations
atggaagtggtggccgaatccgcgggcctggtggagccgctgcgcgtcgtggaggtgaagtcccaggcctccggtgaagtgctgaaggtccactacgacacgggcgacaccgttgccgagggcacgctgctggcggaaatcgagccgcgcgacgtgcagaacgcgctggcgcaggcccaggccgacctggagtccgcgcgggtgcggctgaacacgacggaggcccagcgccagcgcatggaggcgctgcgcaaggacggctacgtcacgcagcaggaatacgagacggccgtggacgcgtccgcgacggcacgggccaccaaggtgcgggcggagacgaacctccagttggcgcgtgagcgcagccgggacgtcaccatcctcgcacgcagccccggcaccatcctggagcggaccatccagccgggcgtcatcatcgcctccgccaccaacaacgtgtccggtggcaccgcgctgttcaagatggcggacctgtcggtgatgcaggtgcgcgccaaggtggacgagacggacgtcgggcagatcaagcccggccagaaggcgcgcgtcaccatggaggcctacccgggccgcaccttcatcggcgaggtggtgaagattgaaccgcaggccctggtggagcagaacgtcaccctcttcccggtgctggtgcggatggacaacccggacggcctgctgcggccgggcatgaacgcggaagtggccattgaaatctcccgccgccgcaatgccctcaccgtgcccaacaccncggtggtgggcgtgcgggatgcccggagctccgccgccgcggtgggtgtttccgaggaagcactgcgcgcggtaatgcgtccgccgggagccccgaaccgcccgggcgcgccgtccggaccgacgacggtgtcggccgtgggagaagccggcgtgggcgccaccgccgcggtggccaatggcgccgggccgggcgcggtgcccgcgaggggccagggcggcatgggtgaaggccagggcggcggaggccagggccgcgcgggccgccgggcgcgcgaggatgtccagggcgcgacggatacgcggcagggcgtcgtcttcgtgcagagccccaccggtccgcagccccggcgcgtcaccctgggcctgagtgactgggagagcacggaagtggtgagtggcctggaggatggcgaaaaggtggtgctcatcacggtggcgaagctccagaagcagcagcagcagaacaccgagcggatgcgccagatgtcaggcggcgtgattcccggcgcgggtggtggcccgcgcgggccgcgctaa

SEQ ID NO: 3070 - DNA, 681 bp, Myxococcus xanthus
gtcatccgcgtggagggcctgcgcaaggactacacgatgggctccgaggtggtgcgcgcgctgcgcggcgtggacctcaccatccgccgcaacgaatacgtggccgtcatgggcccgtccggctccggcaagtctaccttcatgaacctcatcggctgcctggacgtccccagtgaaggccagtactggctcaatggccagccggtggcgggcatgtcggagaacgcgctggcccgcatccgcaaccgggaactgggcttcgtgttccagagcttcaacctgctgccccgcgcctccgcgctggacaacgtcgccctgcccctcatctacgcgcgcatccccaagaaggagcggcgcgagcgcgcggcggcgatgctggacaaggtgggcctgggcgcgcggatggaccaccggcccaatgagctgtccggcggtcagcgccagcgcgtggccattgcccgcgcgctcgtgacgcagcccgccctgctgctggcggacgagcccacgggcgcgttggacagccgcacgggtgaggagatcatggccctcttcggcgagctgcatggccagggccagacgctgatgctcgtcacccacgaatcggacatcgcggcgcatgcgcagcgggtgctgttcctgaaggacggcgtcatcgagcgggacgagcggaatcgggactga

SEQ ID NO: 3071 - DNA, 570 bp, Myxococcus xanthus
ctccggattgcccagcgagtcccccgcacggaagcggagggccccggtgtgcgctacgccctctgggtccagggctgccccctgcgctgcccggggtgctgcaacccggagatgttcgcgaccgaacgcggcaccgtggagacggtggaggcactggcccaggcaatcctggccacgcccggtatcgagggactcaccctgctgggcggcgagcccttctcccagcccggtcccgccgcggcgctgtgcgagcgcgtccgcgccgccgggctgagcatcatggtcttcaccggccacacgctcgcggagctgcgggcccaggcgcgggacgacgtggaccggctcctcgcgacggtggacctgctggtggacggccgattcgaaaaggaccagccggagacggcgcggcggtggattggctcgcgcaaccaggtgatgcacttcctcaccggccgctacgctcaggacgacgcgtgcttcaccgccccgaacacggcggaggtgcacttcgtcggcggcaagctcgtcatcaacggctggcccgcgctcgccgaccggctccgtccatga

SEQ ID NO: 3072 - DNA, 1386 bp, Myxococcus xanthus
atgcccacgctcacgccgctgaagagtcccgccgatgccctctgctgggtggcgccgcccgcggagaatcccgagctgacctccgaagacccgctcgcgctcgactatgtctcgcagcaggtggggctctgggggttgcccacgctgacgacccgctccagcagggcccaggcctacgcgatggtgctctatggattgcagctcgtggagcgggccatcgagcaccattcctaccccgcgacggacgaggttcggcgagaactcttcgagcgttgggagcgcttctgggccctggccacgctggagttccgtgagggccagcttcctcggggcgattgggattccatgcggggcgtgcgaggtgcgcgaaatgcgtggcgctcaggtgcgtcgagcctgccgctcgacttccagctcatctcgcgtcagcaggagctgggaaacctgggggcctacctggcaccgctgcggcgctctgggctcgtcatcgagggttccctgcggccgggcccgggcgcgctggcgctcatcgatgcgttctgggacgagccctcggagaacaaacaccgggggcgatacgaggagtacgcgctggtggcgctggacaggaagtcgacgagcatcgcgcgggttcacgggcggctgacgttggctcaggtggggcggttcagccgtctgagctccctggtcgagcgcggacgcaccgcccagcagcaccggttgttcgaggccctcttcgtgcacgcacgggacccgcactcgttcgcgatgagccagttggtcgagtcggcagcgaaggccggggtcgctgctccgcgagacatcctcgacgctgcgctggcgggccggctgggacggctctcggatgagctgctggcgctcctgctgacggcgcgccgcttcggtgaggtgatgcagggactcgtcggggccttcgaccgggtctattcctgtctggatggcgccggttgggtcgctccccgcgagcgcatcggacgcgaggccctcgatgcggagacacttggggcgctgaagggcgcatgcgcggcgctgctgtcctcgccgagggtcggtgcgatccggcgactgcccatgcatggcgccgcttttcttcgattggtcgaggcgctggtggacgcggattcactcgcggcgctagacctgttgctgctctatcactccaatgtacagcgcgagcggcgacgcggcgaaggctggattcgcaacgaggccggcaagctcgtgctcatcgtcacgtcctacaccgcacggccagagtcggcacgcttcccctcgttcaagctggatgtggtccgcacgttgctgacggacctgggacggctgcccatgagccgggagctggatgttctggaaggtgccgcatga

SEQ ID NO: 3073 - DNA, 1296 bp, Myxococcus xanthus
atgacggccctggccctgggcttcctcgggctggtgacggcgcccggcgtgggtctggcccaggcaacgacgacgatgacgacggtctccctggaggaagccatcgcccgggcgctgaagacgagcccccaggtggcgcaagccgccggcaccgtcaccacgacgggggccgccgagcgcagcgcgtttggagcctacctccccaacctgtccgcgagcgcgaacacctcgctggccagcagccagcgcctggaccccaccacgggggcggtgttcaacgcccccagcgacacgtacagcgccggcttgtcggcctcgtggaacgtcttcaccggtggccagcgcggcgccaccagcaagcaggcccaggcgcgctctagcgccgcgcgggccggactgatcgcgcagcgcgcgtccgcggtgctcgacgtggagcgttcctattacgaagtcctccgcgccgggggcctggaagaggtcgccgtgtcccgcatcgagcgcgcgaagcagaacgcggaggccgcggatcggcgactggcggtgggctcggcgacgcgctccgacgtgctgcgggcgaagtacgacctcaccgccgcgcaggaggccctgctctccgcgcagacccagcacgccgccgcggccctctcgctgggccggctcatcggcgaggacggaccggtggacgcacagccgttggagctccaggacgtgtccaccttcgcgctcaccgacgaggcgctgacggacgaaatcaccgcccaggcgccgtccatccaggccgcggaggcggaccttcgggcggccgaagccagcgtgaaggtggccaggtcgtcctacctgcccacggtgcgtctgtccggcggttatgactggttcaatgacgagcccgcgctcaacggaggccgcacgagctggtcggtccggatgggcctgtcctaccccatcttcgacggcttcgttcgcgaggagcgcgtggtgagtgcgcggacgcaggcgtcggtggcccaggccacgctgtcggatacccggcgcgcgctgcgctcgagcgtgggaacgtccctgaaccagctcaagctggcgtcgaaccgcatcgccctggccacggagtccgtcgcggtggcccaggaggacctgaaagtgcagcaggagcgctacaagctgggagccacgaccatcatcgagctgctgacgtcccaggagaacctggtgacggcggagatcaacctggtggcctcccgcttcgactaccggattgcgcgcgcggagctggaagcgctcgcggggaggccgctgtga

SEQ ID NO: 3074 - DNA, 647 bp, Myxococcus xanthus
cagcagcgcgtgctggaggacctggtgacggccttcctcgcgcgcggccacgtactgctggagggcgtgcccggtgtggccaagacgctcaccgcgcgcagcatggccggcgcgctggggctgctcttcacgcgcatccagttcactccggacctgatgccggcggacatcctgggaaccaacgtcttccagccccaggaccacgccttccgcctcgtgaagggccccatcttcacggaggtggtggtcgcggacgaaatcaaccgcaccccgcccaagacgcaggccgcgctcctggaggccatggaggagcggcaggtcaccatcgacggcgtgtcccacgcactgccgccccacttcttcgtggtggccacgcagaaccccctggagttggagggcacctacccactgccggaggcccagttggaccgcttcctcatgcgcgtgcgcgtgggctacccggaggcctcggcggagacgacgatgctccgcgcctttcaccagcgcgaaggcaagccggccaccacccgccaggtgctggatgcgcccacgctgctggagttgcagtcgcgcgccgcccgcgtgtcgtgtgacgactccatcatccagtacgtggtggccatcgtccgggagacgcgcaccaaccc

SEQ ID NO: 3075 - DNA, 888 bp, Myxococcus xanthus
atgcaggcatccaccgagcagtcgtccaactccggctccctggcgatgtacctctcggagatcaaccactactccctcctcaaggtggaggaggagcaggagctcgcgcgccgcttcctcaagggcgacctggcggccgggcaccggatggtgaccgccaacctgcgcttcgtggtgaaggtcgcctatgagtaccgctcatacggcatcaagatgtcggacctcatccaggaggggaacatcggcctgatgaaggccgtgcagaagttcgatccggacaagggcatccgcctcatctcctacgcggtgtggtggattcgcgcgtacatccagaactacatcctcaagagctggtcgctcgtgaagctggggaccacccaggcgcagcggaagctgttcttcagtctggcccgcacgcgccgcgagctggagaagtttggcagcggtgacgccgcggtgaacgtggatgacatcgcccgccggctccacgtgaagccgggcgaggtgcgggagatggagcagcgcatggggggccgggacctgtcgctggacgcgcccatgggcgaggacggcggcaacagccacgtggacttcgtggtgagcgccgcggccccgcaggacgacgagttcgcggacaaggaggaggcgggcctcatcaacgcccgcgtccgtaccgcgctgatgcgcctggatccgcgtgagcgcttcatcatcgagcaacgcgtcatgaacgagcgccccatgacgctcaaggaactgggtgagcacttcggcttctcgcgcgagcgcgcccgccagttggagattcgcgccaaggacaagctcaagtcggagctggccgcgctcatggccgaggtggaccccgaggccgtcgccgcccagcagtga

SEQ ID NO: 3076 - DNA, 2392 bp, Myxococcus xanthus
  unsure (1)..(2392): unsure at all n locations
ccgtacgtcccccccgacaagtctccggcggagatgacgatgcgagccctggtgctcggctcggtgttgggcatcgtgttcgccgcctcgtccgtgtacctggccatcaaggtgggcctcacggtctccgcgtccattcccgtcgcggtgctctccatcgccatcttccgggccctgggcaactccagcatcctggagaacaccatcgtccagacgacgggctcggccggtgagtcgctcgccttcggtgtggccgccgcgctccccgccctgctgctcctgggctacgacatcagcctcacccacgccttcctcacggnggcgctgggcggcgtactcggcgtgctgatgatgattccgctgcgccagggcctcatcgtccaggagcacggcagcgtgccctacccggagggcaccgccagccagcacgtgctcatagtcggccagcaggggggcacccacgcgcgcgctgtcatcagtgtcttgattgtgggcggtgtctggtagctcgcctactccggcatgaagctgttccgcgaggtcctgagcacgccgctgcaggggctcaagagcgcgaccgtctcccaccgaggtgagcccggagctgctgggcgtgggctacatcatcggcccccgcgtggcggccatcaccttcgccggtggtgtgctgagctacctcatcctcatcccggccatctcgttcttcggcagcgggctggagacgccgctgctgatgcacaacggccagctcatccgggacatgtcgccggaccagattcgcaatgcgtacgtgctctacatcggcgcgggcgccgtggcgacgggcggtctcatcagcctcatccgctcgctgcccaccatcgtcggggccttcaagcgcagcctggagacgctgaaggcgtcgcggggccagggcgccatgccgcagctgctgcgcacggagcaggacctgcccatcaccgtggtgctgggaggcagcgcgctgctggtgctggccatctggctggcgccgccgctggaggtgaacctcatctccgccatcctcatcgtcatcttcggcttcttcttcgtcacggtgagcgcgcgcatcaccggtgagattggcagttcgtccaaccccatctccggcatggtggtggccacgctgctcatcacctgcctcgtgtacctgctcatgggctggacgtcgtccgaggaccgcttcatggccctcaccacggcggccatcgtcggcatcgccgcgtccaacggcggcaccaccgcgcaggacctcaagacggccttcctggtgggcggtacgccccggcgccagcagttggcgctgttcgtcggtgtgctcaccagcgcgatgttcatcggcctggtgctggtgacgctcaaccgcggcgccaccgtcaccatccccgagccccacccgggcgtgaaggtgacggagttctccaacgagacgcgcgtccagcacaccttctcctgggccgtctccgccgacgcgctggcggcccgcggcctggacgaggcggcgctgcgcaaggccgtctgggcgcagggctacgagctgaacacgcagagcggcgcgatggagctgcgcagctggcgcgacgtgtcctcgcaggacctgggcgcggtgacgctcaacgtctccagcggcgcccccatcaaggtggcggacctgggcgccgtcacggacggcccgaagcgcacctacaaggaaggctacgtgcgcggcgcggacacgccggtgcccgcgggcaagtacctgctcgatgagtccgacaccatccagtacgtggtggacccgggcatcggcggccgcatcagcgtctatgaaggccagcaactgacgcgctacgcggcgcccaaggcgcagctgttctctctcatcatcgacggcatcctcacccagaagctgccgtgggacctggtgctcctgggcgtgttcatcgcgctgatgctggagctgtgcggcgtgtcctccctgcccttcgcggtgggcgtgtacctgcccatcagcagcagcgcgccgttcttcgtgggcggcatggtgcgctacttcgtggaccgcatccgcggcggcgagtccgacttctcgccgggcacgctgctctcctccggtttcatcgccggtggctccatcgcgggcgtgctcatcgccttcctggaaatcgccaccgacggagcaggcacccgcgcgctgaacctgcctgccctgctgggcaaccagggcggcctgggcggcttcctcaacatggtgggcgagagcgagcacgcccacccgctgtggtccaacctctggggcctgctcttcttcgccggcctgacgctgttcctgctgcgctccgccctcaagggccagagcgccgccatgtcaccgccgccgcagaaggaggcgtag

SEQ ID NO: 3077 - DNA, 1545 bp, Myxococcus xanthus
atgaaggtggagcaacagaacttcctgctcctcggcgagtcgctgttctccgaggacaccccgctgccctacaagttcttccgcgacggcatccggcagctcatcttccgcccgggtctcacggtggaggagatgaccaccttcacgctcatcgccctgtccgagccggagcgcggcgcggaggacgtgctggcgcagctgtggcgcgcgagcatggagcacgtggagtacgtggtggtggaaggcttctccatggagaacgccagcgaggaggaagtgcaggtcgaggtggacaaggtggtgggctacctctactcgcgcctgcagacgaattcggatgactacctgcgcttcgcgcgcgtgtccgcggaggacctggacgccaagctggacggcgtggagcagattcgcggactcgtggtgggtggacggcatgcctcagacgagctgaaggcgaagctgcagcgcgaagtctccgaggaggagaacgcccggctgttccccaagctggtgagcgccgtgttccaggtggtggaaggcggcgtggatgacgcgtccctgctcgaggaaatcttcgtgcagttgctggacatgctcctcctccaggacgacttcggcaccatcaaccagatcgtcctcaagctgcgcgcgctgtcccagcgcgaaggcagcgaggacctggcgaagatgttggagaacttcctccacaagatgggcgaggagcagcgactgatgcggttgggcgagtcgctcaagtcgacgcggccgaagaaccccgcggacgtgtcgcgctacctccaggtgttgggccgggactccatcatccccctgctgtcggtgctggagagcatcgaggtcgccgacaaccgcaccctgctctgtgacgccctcgcgggtttcgcgcgcgagctgcccgaccccttcgtcgcgcggctgatgtcagagcggccgcagacagtacgcgacatggtctacatcctggagaagagcaaccacccggaccgggtgaagatgttcggccaggtgctcaagagccccaacctggtggtgaagttggaggtgctcaacatcatcggccgcggccgcacgggcgaggcccggcgcatcatcgcggacgcactcacggactccatctcccaggtgcgcatgctggcggcgaagctgctgccggagttcgaccgcgacaagggctacgcggacctgatgcgcctggtgcgggagtccggcttcgacaagaagacgcccgacgagcgcgccgcggtgtacgcggccatcggctccacgggcaccccgggcgccctgtcgatgatgcagcagatgctcgcgacgaagccctcgctgctcaacaagaagcgcgtgctggaggacaagctgctggccatccacggcctgggcggcgcgtgctccatccagggctacaagctgttgcaggcggtggtggaggacaagaaccagccgttggaggtcctcacctcggctcgcaaggcgatgtaccagacgaagaaggcgctcttcggagactcggcgctgtcggaggaggcatag

SEQ ID NO: 3078 - DNA, 1260 bp, Myxococcus xanthus
atggccgacaacctgaaaatcacccaggcgcaggacgagaacaccaacgagttcggccgcgagcacaacgagaagctccagggcctggcgcgctcgctggtggccggcctgtacatgctggtgcgctcggtgaagatgtatgacccggagaacgcggtcttccagaagccgctgcaccagctccaggacatcatcaatcaaatcatcagcaaggaaggccgcctggagctcacgggcgtcaaggagtcgttctacctgaacggcatgctggtgaaggtggacctcaactccatcgagaaccagcgatacctgctgacggagctgcgctcgaaggacgtgggtggcttcacgctcaccaagcccgtcaccgttccggagctgaagaacttcatctggatcttcagcaaggagcagacgaccgcgtccgaagaggacggcctgtccaaccgcaagctgctcaacatgcgggtggccaagttctccaagctgaaggagaagctgaacaaggacctggacaacccgggcgaccagaaggtggaccgcaagaagtacgcgatgaccatctacgcgcgcgccgtgttcttcctcacgaagtacctggagtcggtgcgcgccgggaagcccatcaacgcctccaaggcgctgcgcctggtgcaggacttcgtcgacatctcctacgagcagcggacgcacttcctgggcatgacgaccatgcggcgcgaggacgactacctcgtgtaccaccaggtcaacgtgtgcctcatgagcgtcgtcttcggcgcggagctggggctgacgaagccgcaactgcgcgacctgggctacatcgccctcttccacgacgccggcatggccacgctgtcggaggagctgtcgacgaagcgaggcgcgctgacgcccgaggagaagcagacggtgcagcgcgcgccgctcatctccgtgcgcaacatcctgatggagaagggcttcagccgctccacgctgctgcgcgtggtgacgacgttcgagcacaagacggacttcggtaccgccgtgcgcgactcccgcggcaacatccagatgatcatcccgaagacgaacctcggggtgtacgcgaagatcatcgccatctgcgacgcgtacgacgccctcacctccaagcgcccgtaccgggatgcctacggcccggaggtggcgctgatgctgatgtggtcggagatgcggaacaagttcgacccggagctgctgtccgtcttcatgcgggtgatggccatcctttag

SEQ ID NO: 3079 - DNA, 279 bp, Myxococcus xanthus
atgagcctccgttccggagcgccgcgcggaggagcgcccgacgagcagaccggagtgagcctggtcgccggactgacgacctcgaacgtggtggcgccggagtgccagcacggcttctcccgcgtggatgtgtattggccgtggtggagccccgtcgtctacgcggcgaccttcggcatcgtcgcgccgttgcgcacggagtacgtgtgcgcggaggccgcggcggccgctggctccgtgcggcccgagcccgtgccgtcctcccactcgccgctctga

SEQ ID NO: 3080 - DNA, 613 bp, Myxococcus xanthus
aagcgtcacgccccggccacggaacgcaatcgcgagcccctgctcgctgtcctccgcgaagtccttcccgcctccggcagggtgcttgaggtggccagcggcaccggccaacacgcggcctggttcgcccgagccctcccccacctcgtctggcagcccaccgacgtggacgcggagtcgctggagagcatcgaggcgtggcgcaccgcggaagggcccgcccaacctgctgccgccgcgccagctcgacgcgagcgcggcgtcctggccggagacggccgcggacgtcatcctcaacgtgaacatgattcacatcgccccctggacggcctgccagggcttgatgcggggcgcgggccgggtgctgcctcccggcgggctgctcgtcctgtatggcccctacttcgtcgagggccgcgagacggcccccagcaacctggagttcgacgcctccctccgcgccagaaacccggcgtggggcgtgaggtcgctggaggccgtcaccgccgaggccgccctgcatggcctggagcgcgagcgcgtggtggacatgcccagcaacaacctcaccgtggtcttccgcaaaccccgtcctcaggtgtccccgcactga

SEQ ID NO: 3081 - DNA, 795 bp, Myxococcus xanthus
atgccagaggatgttctgttcgcctcggccttccgtggccacgagacagaggcctggagccgccaacgcacgctgatgctggtcctggccgtcatcggtctgcacgccgcggcgctcaccggcgcggcctcgttctggcacggcacaccgcgacggctcgaaggcgaaaccacccggggagaagtcctcgtgctccgcctgaccgccatgtcaccttcggccccggtgggggacgtcaccgggccagctcccgcgccccttcggccccggaccgcgcgcaggcctcgcccctcgcgcgccccctcaccgccgcgcaccgccgcggcgccgcgcgcctccgaactcgcggagccgctgtccgtcgggcgccccgccagcatcccagcccatgaccgtgacagcctggcgggccgcgccgtggcaggcatcacccagcgcgccctggggcccggcttcccggggttgctcgtggagccgccgcccgccacggcccccgacaaccgcgaggacatggcccggcgctacttcgaacagatgttccgcgaccgcttcgaggacgttccctacccccacgaggcgcggatggcgggcatcgaagggtccttggtgctgcgcatctccgtgggcgtgcagggccagttggtggccctgggggtgctgggcccctgcccccaccccctcctgtgcgaagccgcgcaggaggcggtgcggcatgccgcgccctttccgccgcctccgccggcgctcggcgaccgggtcaccgtcgagctgcccttcaactaccacctggaatga

SEQ ID NO: 3082 - DNA, 2196 bp, Myxococcus xanthus
atgatgatcgaatcccggaggctcatcgagcaggtcctcgtctccgagcaaccctgcctgggagccgtcttttgctcctatacattcgacccttcctatttcgaggaccgcatcctgcgtgcattgctgcgcctgcagggggacccggaggaggaggctgtccgctaccatgaggaggcccgcgcggcgctgcgcgagacaccggtggcttgcttcgtcgacgcgcgtgtccgccggggaggccgtcgcctgccgtatgacctccagctcatccgggagcggacgttccacccgaaggtcatcctggtgctgtacgacggggaggcgcgcgtcgccgtgggctcgggcaatgccaccaggccgggccacgagcagaacgccgaactcttcttcacgcgcacgttgcgctacgacgtccccgccgacgcggcgttcctacggaacgtagacaggttcctcagaagctgcgcggcgctcgcgacccacccgggcacccagttgacgctggtccgctccgcgctcgcggcaagaatctccgacacgccgtttcccagcggccaggcgccgacggatgcgctcttcgtggacaccttcagcgcgtccatgctcgatcatctgagagaggcgctcccggaggacgcgcgagtcactcgtgtgggcatcctgtccccgttcttcgaactggatgacctcgacatcgcgaatgacacgacggggctcgcgtcggtgctctccgagttgctcgcgcttcgccccgggagtccgccgccgctggaccttggcgtgccatgggaggacgcaccactcgcccctccctatggcgggggaacgcccgtgctcgcggagggcgaagggcggctgtgggcctcgcgttatcgcgagtcagtcgacggcgaggacatcgagcgcctggagtactttggggtcaaccgcgtcacggcgaagcgtgtcgagatccagctcggctccgggcggcctggacggtacgagagagacgcattcgagcatgaagtcgcggaggggcggatgtggcccgtggagccgccgacggtccatgcgccgaggcgaatcctcgagcgcatcgtccgcgagcacgagatccaactctggctccatccaacggcgacgctgacacctgccgggcgcgcgagccgacgccccctgcatgccaagctcttcctgctgacggtgacgaccgcaggcaggacgctgacctatgcgctcatcgggtccgccaacgcctccgccgccgcgctttcgtgtggggtggagcagggtggcaacgtcgaggcgggcgttctgctctgcctggacggagaggtgcgcttgtcggaaatgctgccctcgctggtgtgcgcgcccttcgagtcagcgcgcttcgaggagcgagatgcgcccggggccgaggtcgacttctcggcgtggctcgaggacgtcgtccatgacgcggccgctcgcacattgaccgtcacctggagtcagcaggggccagggggactggggggctgggcctggtggtacctggacagggaactggcgaagggcgtggggccgcgctcgggtccggtggtactctccgacttcgatctggccgcggcgggagccgagctggagttccgcgcggcgggacggtcgtggcttgttcccatccgcgtcgcggacctcgcgatgctgcccacgagtgctcatctcgcgggcctgggagtccgggagttgctggcgctgttggcgcggcgtgtgggcgcggagcggttgtcgacccttcgcgagcagcgcggcgtggcgggggtcgactccgtcctggactccgtatttggcgagggctttggccccacggacgtcttcaaggcctggtgggggctgaaggaggatttgctcgccgcatcgacggtctccgcgtttcgttatcggttgttggggccgacgggggcccggacgctctgggagcggctgcgcgacttgcctcgggattccgtgtccgatgacgaaatctgggtctacggctgcgagctgcttcgagagctggagcagctcgtgttgcccgagagcgcggatctggaggcgaagcaggcgctgctcgcggagctgcggaccctgctgcgcgcggacttgacgcggctgcgaccgcgaggtgccgggtggctggacggtgtcgttcgtttctacgggcttgagggcacccatggaaagacgtga

SEQ ID NO: 3083 - DNA, 759 bp, Myxococcus xanthus
atgcccgcgggccgttacgcctgcaccttccaggcgcggggcaccggcgaagttcgaaacgccttcttcgacgacgactactccagctactcgtcctacacggccgtcgacagcgcgacgtggacgcaggtggcgtacagcttcaacctcgccaatgaggtcttcgacaccttcgagctcatcttcagcatccgcaacaccagcggcgagcacctgagcatcgatgacgtgcgctgcacgcgggccgccgagccgtgtgacgcggtcagctgcgagtcctgggagcgctgcgtgaatgccaccgcgacctgcgagccgctcgccggccggtgcaacgctgccgaggactgcagcgagtggcaggcctgcgacgagacgaacacgtgcgtggtcgccgccgaccgctgcacccgccacgcggattgcgcggggacgccggagacgccggtctgtgatacggccagccacctctgcgtcgaaggcgacccttgcgccggcgtcgtgtgcaaccacccggcgacgagctgcaaccccacgagcggcgtgtgcgagctgtccgcgggagcctgcttcaccacgtacgactgcgtgggtgagctgccggcctgcgacacggcgaccggacgctgcgtgtccgccgaccaccccgcgaacatcatcctcaatggtggattcgaaagctggagcaccacctacatcccctaccacggcaaccatctcatcccggactactggtacgggctcgacaacggcatctga

SEQ ID NO: 3084 - DNA, 711 bp, Myxococcus xanthus
atcattcgcgaacagagaagcagccgcggcgggagccgcgaccagagaaccaaccgtcgcatccgtgcccgtgaggtccgcgtcgtcgggtctgacggtagccagctcggggtcatgcctctcgaggcggccctggaccgtgcccggaccgaggggctggacctcgttgaaatcagccccatggccagtcctccggtctgcaagatcatggactacggcaagttcaagtacgaggagaagaagaaggcctcggaagcgaagcgtgcccaggtcacggtcctgctcaaggaagtgaagctccgtccgaagacggaagagcacgactacgagttcaaggtccgcaatacccgccggttcatcgaggacgggaacaaggcgaaggtcgtcatccagttccgcgggcgtgaaatcacgcacagggagcagggaacggccatcctcgacgacgtggccaaggacctgaaggacgtggccgtcgtggagcagatgccccgcatggaagggcgtctgatgttcatgatcctcgcgcccacgccgaaggtggcgcagaaggcccgcgagctggttcgtcaggccgccaccgccgccaagcggcccccgccgccgggagccccgggcgcgggcaagtcggccgccggtgccagcagtggcgccgaggagaaggccgaggagacggccgaggaaaagaaggaagcgcaggcctttagagca

SEQ ID NO: 3085 - DNA, 731 bp, Myxococcus xanthus
ctgagcgatgtcgagtggagccgcatcgagcccctgctgggctccaggacgggccctcgctcgaagcgaggggaccgtgacttcatcaacgccgtggtgtggcgggtgaagaccggggtgcaatggcgggatttgcccgagcggttcggtcactggaagacggtctacaatcggttccatcgctggacgaagactgggcgctgggaagccatcttcaaggcgctgcggctcgatgtggatgagcttggctcccttgctgacgcatcggtcgtccgggcgcatcaggacgccgcgggcggaaaagggggatccgaagcaatgctttggggcgttctcgaggaggtttttcaacgaaagttcacgccgtcactacgacgggaggtaagccgctccacgtcgcgctgacgcccggccagcagcacgagtccacaatggccgaagaacttatggtgcacgccgagggcgccgctttcattgcggataccggctatgacgccgaccgcatccgcgccaacgttcgaaagctcgggatgaagcctgtcatccattcaaacccgagccgtaagcgggcgttgccgttagaccgcaccctgtaccggatgcgctaccgggtggagtgcttcttccacgatctcaagcgctttcgggccgtcgccacccgctatgacaagacggcgacgagctacctcgccgtcctgcacgtcgcatccatgcttctttggctgcgctaa

SEQ ID NO: 3086 - DNA, 1740 bp, Myxococcus xanthus
atgaacgccgcgctcatcgtcgcgctcgcgctggccagcgcacccgtgcctggcggcagcacctcgcttcagcagctcgtggagcgcatccccgaggtcgtcgatgacggcggcggaatcggcacggacgcgcaagaactcgcgagccgcatccaggcgcatggcgcggcggcgattccgtacctcctcccgctgttcagggaggaatcggagcccattcgtgacttcgcgggctacatcctgcgcgacctcgaagggctgaccgaggaacacctcaatgccctcatccaggcccggcttcatggggacggatggattcctcccgccatcgctcgcattggaaccccccgcgccatcgcattcctcgtcgaagacctcaaggatgagccccagacgcaatcgcaactgactcatgccctggtcatcgcgggccgcaaggcagccgccttgctcgccgaaccctttggcgcggcggcgcccgtgcacgaactctacgccagcgcggtgtgcgaagtgttccatgagatggggtccaactcggggcccgccgttgcgcccctcttgagggtggcgaccgggggcgagtccctccttgaaaatcaggcccatgccattcaggtgctgggctgcatcggtccctccgctgcggcggcggtgcccgcgctgcaggcgctgcgcaagaatgccgccctgcgaaagacggttgatggcgcgctgatgcgcatggggcctgctgccgccactcccgtcttcgtcgagcacctgcgcacgaagcccacggtgtacctgcttcgcgacctggcggaactccgcgagcgggggaagggggcgggcagtgcggttgtcgcgcttctgaagaacgaggaccctcagttgcgcttcgccgctgcgcgaacgcttggctacatccagttcacagccgcgaccgacgcgctcatcacgatgctgggcgatgtcagggactggaggatggcctttgccgcggccgaatcgctcggaaggctccgggccacgcgggccttggcaccgctcaaggccgtcgcgacgaagcactgggcgccacctgtccgcgacgctgctcgcaaggccacgaaggtcatcaatggcaaagagacatacccggcgggcaacccgaacttcgcgtttgagtacttcgctggcgaccgcatgcgcttcgaccagcaagcatccctcgaaccggcactggttgcggcgccggatgaactccctgaagcttcattcgggccattgacgtacgagagcgaggtccgctcggtgggggtggatggggagcgtcgcactcccatcaaacaggcaccgcagttcggattgcgcgtttcgaatgggcatctggtgggggcaagtcggggtgagtggggtggagaactcatgcacatcccgactgacgccgccgcgaagaagattctggacgccaacgccactggcatccacaaggtcggcgaacacatcgtcgcggtgacgggcctgtcccatatcgtcaccaacgacgggatgctgtaccggattgttccccgtgacggggcctacgtggcggagccgtggcgggtactcccgggtgcaccgcgacgctcagggctgctatccgatgggcgcctcttcgtctcctgcctgggcgcggatgtagtcatcacgcccgagggagacatgcggctcgccaccccagagaatatctctggcacgcaggagcaggcgccacccgctccgccccggcgcaagtga

SEQ ID NO: 3087 - DNA, 2598 bp, Myxococcus xanthus
atgatgtacctgggcagccaggtggggtggcagggcctgtccacgctgctgcgcgcggtggaggtggcggcccgggaggaagaggtgcgtctgtcggtggtgggcgcgcgccacgcggactgccagccgcacctggatgacctggtgaaggagctgggcctgagcgaccgggtggagttccaacccccggtgcaccacgacgacctggccaaggtgctcgcgctcgcggacgtgggcgtgctgcccatggatgacgtggagcgcaatcgcgttcagggcgggccgctgtcgaaggtgtcggagtactgtgccacgggccgccccatcatcgcggcggacctgcccgtgacgcgggagctcatcccggctggcgcgggcgtcttcttccctccgggcgacagccaggccttggccgaccgcatcatcgagctggcgcgcgacgtgaagcgtcggatggagctgggccaggtggctcgggcacacgcggaggcggcgctcgacgcggggctcatccgcggcaagctcctggacctgtatgactcgctgctggagaagcggtcggagcccgtctccaccacgagcgaggacaacctgcccgcgctcaccacggtgacgggaacgcccacgaaccgactggcggcgctgctacctcccgagcccgcccccacggcggcaccggtctccaagaaggcgccggagcctcggaaggacaaggacgcgcctgccgcggggcgtgcgcgtgaagacctgccgctggtcatggggcaggtgctcgatgaggggctcgacacgcgcctcatcaagacggaactcgagacgaatcccatcgagccgcccgtagtgatgggcgcgccgctgcgagagcgctccgcagcggccgccgatgccgcgaccaccacggtccgcgagagcgaggcctccgcatccagcgtggccggcaacgacgcgacgccggaaggttccgcgcacgacgcgagcgacgacgacgattccgaaaacgcgcttcccatcgttcaggcaacggaggtcgaagacgcggacgaacccccgtcgccgacgcccatcgtcaaggcgccgattccgtcagcgcaggcctcttcgacggtgagcggcgatacgagtgagcacgcggcgacgacgcccgtcgtgaaagcgccctcctcctcgggccggttctcctccgtgcagagtgacgacggcagcgaagcctcggggacaacgcccatcgtcaaggcgccatcgtcgtcaggccggctgccgtcggtgctgaacgaggacggcagtgaagcctcggggacaacgcccatcgtcaaggcgccatcatcgtcaggccggctgccgtcggtgctgaacgaggacggcagcggagcctcggcgacgacgcccgtcgtcaaggtccccccacctccgggccggtctccttcgcccgtgggcgcggattccagcgaaacgtcatcagtgacgcccatcatcaaggcgcccgccgcgctgaaccgaacggacgtgggcaccagcgaagcttccggggacgctgatgaagcccccgcgccgaccccggtcgtccgcagccccgtcatcgaagcgcgctacgagccaccctcgcacacgccggtggtgcgctcgccctacgaccgccagcgggacgaaccacccgcgccgacgcccatcatccgcgtgcccaccgagctgcaccaggagctcatccccacgcgcgcatccagcagcggcggaacagactcctcaagccggccggaagagtaccccacccccacacccatcgtccccgcgccctcctcgctgtcgagccggagcatctcggcgcgaatggagacgcccgtcggacggatgacggcactgacgccccagcagcggtccacgaacacggaacggccgccgcccatctcccgcccgggtgcctccgaagcagagcgcttgccgcccatccgaggaggcgcgtccgcgaacacaccggagcgcccgcctccgatcctccacccgagcacctcgacgccggaagccgaccagccccccgccctgcctccgcgcgcggcggcgcccccgcccgttcccccgcagcgtccgcctcggctccagtccgtggacggccccccccggctcgaacccgtcagcccgcaggcgttcaaggcctcggtctcggtccccggcggcgaggacgaagagcccgaggaaatctccgaggacgaagcccagtccatcgacgagggggacgacgacagccactcccgcgcgcggccccaacccgaggagccggacgaaatcagcagcgatgaggtggaggaagcggagatttccgccaccagtgcagcgcagctcatcgaatcggacgacgacctggaggaagccgacgccgacgtcgcccccgagccacacgatgacggccccgctccggagcccgtcccctcgacgctgaacccgtggttcgcccagctcgcgcacgggtactgcccccccgacggaatccgcttcgaccgacacacgccccccacgacgttccccggtcgcgacgagcccacgaaccccgcccacccgaccccctcagtccgttcggaagtcgtcgtccgcggcaagggctcgtga

SEQ ID NO: 3088 - DNA, 1713 bp, Myxococcus xanthus
cagctcaccctgcgggcggtgctgctcggaagtggcattggtgccatcacctgcgcgaccaacctctacgcgggcctgaagatggccgtggcctttcccgtggccatcaccgccgcgttgctcgcgcacacggcacacggagcgatgcggcgcgtggcgccgggcgtcgcgggtgctccgctttcgccgctggagacgtgctctgcgcaggccgtggcttcgtccgcgggctatgcgacgggcggcgccctggtatccgttcagggcgcgtggttgctcacgacgggcagtcatccccccgcgtgggcgttgctcgcgtggaccttcctcctgtccgcgctgggcgtgctcttcgcggtgcccctcaagcgcaagctggtggaccatgagcagcttccgttcgccacgggcacggccgcggcggcgaccatccgtgctcttcacaccacgggcgcgtcgtcccgtccgcggctgtcgatgctgggcctgggcggaggtatcgccgcgctcgtcaccctggtgcgggatgggctgggccgccttccctacgtgtttcctttccccggaacgctgagcgggatgtcgctggagcgcctgggctttggcttcgagatgagtctgcttccgctgggcgcgggcgcgctgctgggactgcggctcacggcgtcctggttcctgggcgcgctgctcattcacggagtcgtggcaccgcgcgtgttcgcttcggggctgctgcttccagatggagacttcctcgcctggagtctctggcccggaacggcggcgctcaccaccgcgtcgttgttgcacttcgcgctggagggccgcgtcctggggcgcgcattgaagggactcttcaaacgtccctccgtggcgccccatccggtggacgcacttcaggtgccgggacgctggctgttggcgggcctggtcgtgttgacgcccgccacgctcgccgtggccaaggtgggctttggcgttccgctgccacacgccgcgctcgcggtggcgttgtcattcgtgctgtgtctcatcgcctgccgcgtcacgggggagacggatgtcacgcccgtgggcccgctggggcaggtgacgcagatgacctatggcgtgctgctgccgcgcaacgtggaggcgaacctcgccaccgcgggcatcaccgtcaacgcggcgtcgtccgcggcggacctcctcagtgacgcgaagacgggacacctgttgggggcccatccccgccgcgtgttcctggcgcagctcgtgggttgcgcggtgggggccgccgcggtggtgccgctgttcttcctgttggtgccggaccgttcggcgctggggggcgagcgcttccccgcacccgccgccacggtcaccgccagcatcgcccaggtgctggcttcgggcttctcggggttggagccgggcacgcgcgcggcgctcggttgggccgcgctcgccgccgctgtcctcacgctgacggagcgactgcttcccgaacgggtgcgacactgggtgccctcgcctctgggcatgggcctggcctgtctgttgccggcgtccacggcgctggggttcttcctgggcggggtggcggcggccttggcccgcagggcgaatccaggggtgcaggaggggcgggtggtgacgctggccgccggcctcattgcaggcgaagggttgatgggggttgtcatcgtcctgagccaggcgctctggtaa

SEQ ID NO: 3089 - DNA, 3492 bp, Myxococcus xanthus
atggagcggctgcatggccagacgctcgcagcgtggatggaggcgttgccgggctcgggcgcggcgtccgtgccccgcgtgcgcgaattgctcaggggtctctgcgccgccttggagcgcgtccatgccgcgggcgtggcccatcgcgacctcaagccggagaacatcttcctgcgtgagggtggggcgctcagcctgctggacctcgggctcgcgcgcttcctggacgcacctgaagacggagagagcccggagcccgagggcttgacgctcgtggggcagcggctgggcacgccgtattacatggcacctgagcagtgcctggacgcgcgcgaggccggcgccgccgcggatgtctacgcgctgggcgttctcctgtacgagttgctcactggcgcgccgccgttcatcggcggcgccgaggagattcgccacgggcacgtcagccttcgccccgcccgggtgtcggagcgcgcacccgtgccgacggcgctcgacgcggtgctgtcgcggtgtctggcgaaggcgccctccgaacgtttctcgcgggcttcggatgtgctcgccgctttcgatgccgcgtgtacccagtccctgtccatggctccgccagagggcgcgcccgccgcggtgcccacgtcgtccgggcctggggccggcgagcgctgggtcgcgttgctgggcgtccgcgcggacattccggtcgatgtgcttcggctgaccttcgagcctcagggcggcacgctcgcgcgcgtccacgcacggggctatctggtcgcgttctccgagtccctgtccgccgaggccaaccttcgcgcaggcgcactggtggcgcgcaagctgatggaggagggcaaggccgccaccgtcctacacctgtcgcggctgcacgttcttccgggcgccacgaccacgcgggtcgcagggcctgccttggaatccgcaggagactggtggccggaagacctctccctgggagaagcgcgcgtcactgcctccgccgcggccaggttggggccgggcgccatggagcactcgcccgatggcgcacgcctgcgattgcacgacgggggcgcggccacgtcctccgcggatgcaccgcccctgtcgggccgcgatgccgtcctggcggcgctggaggccgaggcgtcacgctgcatcgaggagggtgtcccagggctgtgcgtcctcacgggggacgtggggcacggcacgtcccgcgtcctggaggcactgtccacccggctggaggccgcggggcggtgtcttgtggtgcggctccgcgcgtccgctccggacgccgcgtcctcggagtcgctgctggacgcgctgcgagccaccgccgagccggcccgtgttgtccaggccccaacgcttccactcgcggatgcgcgacacgcagccgcgcgctgcctcgcagagggactccagcggcaggcccaggcggcccctcgagtgttgctcgtcgacgacgcgcacctggcggaccccaccagcctggatgcactggaggtcgccaccttggcgggtgtgcgtgcgccactttgggtctgtgtcgccgcgaggcccgcgttgctcgggttgagaccgcacctgggcgagcgcagcgcccgcgtcgcgcgaatcgcactgccgccgttgacgcccgaggcgagccgttccctgttgctgcatctgctgcgccccgccgagcacgtccccgagccggtgctcgcgcggttggaacagctggcgcagggcgtccccttgtcgttggtggaactcgcgggtgcgctgcgggccgcgggggccctgcgggcgtctccaggaggcgggtggtacatcgcgccggacgcgttgctggacgtctccgtgacgccgctcttcgaacgactcgccgcgcgggcgttggccgggctccccgcggcacaccgagtcctggcgcggctttgcgcggtgctgggcacggaagtggaggtgtcccgcgtggatgccgccctgcgacacctggagccgagcgatgagatggcgcgcgtgacgtcgctcgacgcgggggctggactccagcggctggcgcgctcggggctgttgcggcccacggctccgggccacttcgccttccgtcaccccttgctgcgcgaggcgctggaggcgttgctgccggcgccctcacggcgcgtcctccacgccgcggcgctgcgtgccacgccccgggacgggatggccgagcgccgtcgctgggcccaccatgccgcggcctgtggtgctcatgcggaggccatcaccgcgttcctctcgctcgcggagtccgcgcgccgtgcgcacctgtccgtcgaggcggagcagcactacacgcgcgcgctcgcgttgttgccggagggagacgtggagcgccgtgccctggcgttgtcggggcgtgggcgcgtccgtcaccggcttcagcgcttccgggaggggctggcggacctgggcgcggcgcgggcactggccgtggcccgcggtgaccaggcccagcaggtggagttactgctggaggaagccaccgcccgcgactggatggaggacgtggagggctcgtcggcctgtacacgtgaggctctggaacgcatcgagcggctggatgatcctcgcctggccctgcgctgctcgctggcccgaggccggctccacgtccggctgggggagtggggcgccgccgtgcgcgttcttaccggggtggtggaaggcgcggagcgggtgcatgaccacgagacgctcgtggtgtcgctggcgctgctgggctcggcgctcacgttcctggaccggaccgacgaagccgcgacccgcttcgacatggcactgctgcgctgtgagcaggccggggacgcgctgcaccgggccgctacgctcatcaaccgtgtgctgctgtggttgcgcctggggaatgtggctcggatggaagaggacctgcgccgcgcgatggtgctgggccgggagctgggccatgcgcaagtggagcgctggtccaccttcaacctcgccgaggtgctctacatgcaaggccgactggaggaggcgctgccgctggcccggcgtgttcacgaactgggcgtgcgtttcttccgtgagcaccctgtcccggtggatgcgttgctgctcgcgcgcatggccgccgcgctgggcgacctggaggaggcgacgcggcagctccggtggattgacgcccactgtccgcccgaatcgctgccgcccaccgccgtcatgcggaggctggtggagctacaggtccaggacgcacggggcggcggctcggcgcgggaggcgtggctggccctggcggacgacgcggacaccctggcttcggcggatgagaaggcggagattctcctccaggccgcccggggcgcgctccaggcgggacgtaccgacgaggcgcgcacctgggtggtccgggccgagcgcgcggtggaggagggcgctcccctgtggcgagcccgcctggagtccctgcgggttgcccttttcgacgtgtag

SEQ ID NO: 3090 - DNA, 525 bp, Myxococcus xanthus
atggagtacgtggtgggctgcgcgctgacggtcgaccaggagattgcctattacgacccgcgggagcccagtcccggcgtccggaaatggcttggacaggcggggctctgcccggattgggacgactccccgccgagccggagctgcctggagcgtgtctccgcctgtgtactggcgcgcaacaacgcggagggacggcgcgtggagctgtccatgcgcggcgagcaccagttctacgcgtcgggccccaacatctacacgctggatgcgaagacgcgcccggccgcgcacgtccccatcacgggcaatgcgctggccagcttcggggactgtggcctgggcgaatcaggcgagcagcgtgactgcggttggacgccggatggcattggccgctgcacgccttccacgaccgtcgtggtgggagcggggggggccgctgtcctgcgcggggctgtctcccatcgtgggctccagtgtgaatgggcccaccgtcctgcgggtgtgcgagggcatcgcggggtgtga

SEQ ID NO: 3091 - DNA, 624 bp, Myxococcus xanthus
atgaccgcgccggcttcaagcacgaccgtggaatggctggcgaacgtcgaggcgtatccggactccgcgtccacctatggcctgtccgagcagcaggtctattccgtgcgcgagggcgcattctacggaaacatcttcctgccgaacgagctgggggcggaggtggacgtcgtggcactcggggatggggacaagaagcggtacgtggtggtgggtgccgacgtcatcgtgcgcggctccatctaccggaagatgttctcctgctacgacccggcctggtcgagcggggcggcgtacgcggtgaaccgcgtctgcgcgctgccctcgtcgggctccaactgtgccgcgcgcgtgacggggccctgcttcacatccctcagtccgcccgtggccggtaagtgcgagatcctggatgggcccctcacgccgagggatggcgactacgaggcgtgccacgacgatgacgacgtgctgtggaatcagtcggtgaccacctacctccatgccccgtgcgacacagtggcgaaggagatgcgcacccagtcctgcgggcgttcatcggggcccgtcaagccgctgcctacgggggaggagctgccctttcccttccctcggaagaagtag

SEQ ID NO: 3092 - DNA, 951 bp, Myxococcus xanthus
atgtatctggtggaggtgcaggggcccactggcaagctcggcggcccgccggtgcgcttcctcctgtgtgctttgaatccggacgcgggcgcctcgctggagcatgacccttaccggcccagggcctgggaggcggagcccgctgtcacgctgaccgcggacgaccatggcgtgctgcgcggattgttggcggaggcttctgcgcgcgccatcgtcgtgtgggaagggcgctacggacagaacaccctgtcgctgcggcgcatcgagccttctcccgtgtcgaagcggctccaagccgtgctggatgaagcgcccatgcgcccgctggcggcgttgcatgagcgcagcccgacgctggcggccgtcgttcccctgtccgacccgggcctggagttgctgcccatccaccgcgcgctcaagggcgtggagaccttcaaggaggagacgttcctcacgctggtgacggcgtatgcgcgcgtctacgagctggatgagcccctgaataacccgcgcggtctggcggtggcgcgagagcgactggccacgctcatcaccgggcaccacgcggtgctgctggtgttgccgggaggacgaggccgcattctccggttccgtcaggggttggacctggcgcacctgaagggggcgccgcgcaatcccacgctgcggagcttggacctggcgttgctcaacgcgctggtgctgcggaccgtgctgggcatcaaggacccggaggcgccggggcactcgcaggtgtacccagtgcagggcctggagtcgctggtgcagggcgtcgagtcggggatgtttcaggcgggcttcgccctcaatccgccgccgctgtgggaggtgcgcgcggtgatggaggcgcaggcgacgctgccacccagcacgcttcgggtcgaaccgttgccgccggcggggctgctctatctggaccgggaggcctga

SEQ ID NO: 3093 - DNA, 929 bp, Myxococcus xanthus
  unsure (1)..(929): unsure at all n locations
atggcgtcgggtgacgaagaggccctctatggcgaggagctgggcgtcggcgccctggtatcggactggctggtggagcaggtccattaccgggggcctgtctccacgctctaccgtgcccgacatgtccgcacgggtgcgctcgcggcgctgaaggtcctgctcccgcagccctcggacgtcgccctgcggcgcttccgtcgggaggcggagacgctccagcggttgagacatccgcacatcgtcgacgtgcttggctacggcacgctcgcggacgggcggcccttcatcgcgatggagtggttggaggggagggacctcgcggcggagctggcttcgcgcgggccgctgtcgccaggagaggcgctggaggtgctggagcaggtgggcggcgcgctgcgcaccgcgcaccaggccggtgtcgtgcaccgggacttgaaggcgcagaacgtggtgcgcttgagcacgggcagtggagcgccgcgcgtgaagctggtggacttcggcgtggcgaaggggctgacgccggatgcgccgggcgcgtccacgctcacgctgacgggcgtctccctgggcacgccgttgtccatggcgcccgagcagattcgcggcgagccgcccgacgcccgcacggacctgtacgcgatgggcgtgctgctcttccaactcgtcaccgggcagccgcccttccagggggccacccggcatgaggtggaggacctgcacctgaatgcgccgcctcctcggcccagtgagcgcgccccggtgcctgccgcactggatgccgtggtgctgcgcancatggggaagcggcgcgaggaccgatacccggacatcgatgcctggctcgacgcgctccggcgcgcggtgaagggcagtcccacggaggaccagcccacgctcgccgtggcgctgtacgcggaagcccg

SEQ ID NO: 3094 - DNA, 489 bp, Myxococcus xanthus
atgaacgtttccatcgtctcccgagatgaaatcaagctggtgggcatcaaggtggtcggccggcgcagcgaactgagccaccgcgtcccgctggcgtggctggagcacctctctcgtctggacgaactgcccggagtggtcgaccgcgacgtgttccatggctgcgtgccgggcagcgaccacgagcaaccgggcgatgaccccgtctaccagtactgggccaccaccgaggtccgagtcctcgacggggtcccagaaggcctgaaggccctcacgattcccgcgcgcgactacgccatgacaccggtgcagggcacggcggacgccatcaacgcggcctacggccggctggcgaattggcttcagtcggaaggcaggcgctcagcccctgccgcctacgtgctggagcgatacggccagcgtcgacagcctgtgaccccgccgtacgagcgcttcgattacgaactgctcacgcccctggcgccctga

SEQ ID NO: 3095 - DNA, 149 bp, Myxococcus xanthus
  unsure (1)..(149): unsure at all n locations
atgcgggaagtggatggggcggaggcggcccaggccacacaagcgttgggcgtcctcgcgcgcacccgcggngcggcggtggttgcccatgtgcccctggcgccagcggaggcgctgctcgcgggcgagcggccggtggaggcgcgtca

SEQ ID NO: 3096 - DNA, 1062 bp, Myxococcus xanthus
cgcgcacgtggcggaggacatccgcacgcgggacgtgcgcttcaccagcatgcccggggcggaccgtcacgcggtggtggcctgggcgcgcgccgccgcgcaggcgctgcgccgactggacctgcgctgcctggacgcggcgctgcgccgcatcgaaccgatgctgccagagggggagtcatgaacgccgaagccgtgcaacccgagtggagacgcgacgaggtgagcgcgtactacgaggcgaagacggagcggctgctccaacgctatgggcccggcccacgcgtgcactatcactccgggctggtggacgtggtgccgccgcccggcgcgtcctcggaggtgctgcgcgacacggtccattccgcgcaggaagcgctgctgatggagctggcgcgcgccgtgggccgcttcccggacggcggcgaggtggtggacgtcggctgtggcctgggcggcggcgcgctctactgggccaccgagcatcaggcgcacgtgacggccgtgacgaacgtgccctcgcatgtcgcgctggtgcgcggcttcgcggaggccgcgggcgtgagcgcgcgcgtgcgccccatcctctgtgacgccctctccgtgccgggccgcgcggccttcgacgcggtggtggcggtggagagcgcctgctacctgccgcgcgccgagtggttccgccgcacgcggacgctgctgaagccaggcggcgtgctggccatcgccgactgcttcctctgccgtccggagctggcccctggctttgaccggtattggcgcacgcgcatcggctcgctcgatgagtacctgtccgccgcgcacgccgcggggttggagctggaggtccgcgacgacgtgtcctcacgcgtggtgggcttctggtcgctgacactggaattgatggtgcatgagcgcgcttcggcacaccccacccagcatcccctgcgtgcgctcgctcaggccggccgcggcgaatccagccgcgagcacctgcgcctgcagcaggcgttgatggacggcggtctggagtacgggctgctcgtgctccggcgggtggactga

SEQ ID NO: 3097 - DNA, 138 bp, Myxococcus xanthus
atgcaaggctacgacgccggcacgggcggctccggccacgagatgcaaggctacgacgccggcatgggcggctccgggatgatgaacgaccacaacaccaaggacaccgggacgcacagccccgaaggtcagcagtag

SEQ ID NO: 3098 - DNA, 1254 bp, Myxococcus xanthus
atgcccttcaagttcgttcatgccgccgacctgcacctggacacgcctttccggggcgtcgcgacccaggggccgctcctgggacgcttccaggattcgacgttccgagcgctcacgcgcatcacggaggtgtgcctgcgagaacgggtggccttcctgctgctcgccggagacctcttcgatgtgaaggaccgctcggtgcgcgcgcggctggcgctgcggcgcgagttgggccggctggacgctgcgggcatctccaccttcatcgtccacggcaaccatgacccgctgagcggagacaccggcgcgctggggcttccgccgtcggtgaaggtgttcggcccggactgggaagaagtggaggtgaagcgcgagggccggagactgtgccgcgtgcagggcatctcctatccggacgtggaggtgcgcgacgacctctccgcgcgcttccgccgcaccggggatggcttcagcgtgggactgctgcacgccaacctgggccgcgcggagggccacgccaactacgcgccctgcaccaccgcgggtctgggctcgcgcgggctggattactgggcgctgggccacgtccacacgcgcgccgagcacatgctccccggcggcggcgtggcggtgtaccccggcaacccgcagggccggcacgcgaacgaaaccggcccgcgcggttgcatgttggtggaggtggaggacggcggcatgcggcggcgcttcatccccgtggacggggtgcgctggcacaagctggaggttccgctgtccggcgtcagcacgctggacggactgctggccacggtgatggagggcgtggaggctcgctgcgcgcccgagctggacggccacgcggtgcgactcaccctcaccggaagaggtccgctgcaccgcgagctggcccgtcccggcgcgctggcacagttggaggtggacctgcgcgaacagctcgcgaggagtcacccaccagtgctgttggagtcgctgcgggacagcagccggccggaggtggacctggaggcggtgtgcgcggcgggcggcttcgcgcgcacgctgctggacgaggtgggcttcctcgcggaggacccggcggcgctggcgcggttgtgggaagaggaggccatgggcgcgctgagccagcggctgaagcggctgggcgtggacgcgctggaggcgcctcgcgcggagtgggtggtgcaggccgggctgcacggcgtggagtcgctgcatgaggaggagacgtcatga

SEQ ID NO: 3099 - DNA, 3225 bp, Myxococcus xanthus
atgaagccggggctgcgcatcgacgcgctgcgcgtgctcggcttcggccgcttctccggcctcacgcgcgacctggggccgggactgcacctgctgtacggccccaacgaggcggggaagagcacgctgctggccttcctgcgcagcatgctgttcggcttcgagaagcgcgggcaaccggagcgctacgagccggcccacggcggcgcgttcggcggcgagctgacgttgaccacccacgcgggaccgctgctggtgcgccgcatcgcgagccggcgctcgtcggagggcgagctgtcggtgcgcgacgcggaggggaaggagctctcgaaggagtcgctggagagcgcgctggcccacgtgtcgcgcgagctgttcttcgacgtgttcgccttccgcctggatgagctggccggcttcgagcggctcaccgaacagcgaggcgcctccgaggccctggtggccgccagcatgcgcggcgcgcgccgactgccggaggtcatggaccaactccgcaagcgcatcgagaaaatctacaagccgaacggcgtgactccctcgctgaacgtgacgctgaaggccctggaggacgtccaggtccggctgcgacaggagggagaccggcccgcgcgctacttcgcggagaaggagcggctgggcgcgctggtggaggagcaacggacgctcgaagcggcgctgctggagacggggaccggactggagcggctgacgcgactggaggcggcgctcggggacgtggcggcgctggcacaggcgcgcgccgagctggcgacgctgcccgcgctggagaccttccccgaggcaggtgagtcgcggctcgaggacggcctgcaccggcgtcggagctatcgcgcggaaggcgctcggctggcggagcggctggccacggtggaagccgggctggagcggctgtccgcgccgtcgggcgtccggggtcgcgaagaggcgctgagccaggcccttgcggcatacaccgagggcgccgcgctgctgcgcgccctgccctcccgccgggccgccctggcggagaagcagcggcaggtggagctggccttgcgcgagctgggcctgcccgtggatgggcccggcctgctcgcgctggacttgagcgtaagcgtccgcgtgacgctggaggaactggcgctccggctgggagcggccgaggtcgcgcatcgcgaggcggagggcgcatgggcccgcgccgtctcggagcgtgagcggctggatggcgcgctggcgcgggtggacgccgagctgtcgacgctgccggaggaacgggcgtcgcgaattcgccagcaacaggcggggctgggacggctgcgcaccgtacgcgcggaggtggagcgcctgtcggagcagcgggccgagctgcaccggcaattcgagagcgtccgcacccagggcgagccgcaggcgacggcggcggtgcttcccacatggtgggtgccggcggtcgccgcggtggtggtggcgctcgcggtgacggcgtggctgctggcgggcaatgtggtgggcgcgctgtgcctcgtgggcggcttgctgctgacgggcgtgctggagctggcccggcgccgtgtggagacggcgcgcgacgcggacgtggaggcacaacgcgcgcgccagcgctggcggcagcaggaagaggagcggctgcgcgcggccttgatgggtctgtccgcgcgagaggaactgctgcaccgtgagctactgtccgcggcgtccgaggccggactcaacctggtcgcgacggcggcggacatggcggcgcgggaagccgtgctggcggatgcgctggagcgagcgggacggcgggagcagctcgagcgggagcgggagacgctgcacgccgagcacaccgccgcgcgacgcgaggagcaccgcgcgagtgaggcggtgggcgaggcggagtcgcggcaggaacagttgggcacagagctgacggccctgctgtccgagcggcacttccctcccacgttggccgcgtccgcggcactgacgctgtggcgtgacgcggcggcgctccgtcagcgactcctggacgtaggcgcggaggaagccgcgctcacggtggacgcgcaagtctgcgccctggtgacgtcgcggctgtgggcggaggccgtggtggcggaactcatcccgggcgcgacggaggcccgtgaattggacgccggtgtcatggagcccctggcgtcgcgggtggcggcggcgctggaagcggagcgcgcgcagagcctggagcgcaggacgctggaagagcggcggcacgaactgcgagcggagaaagcgcgactggacgggctgtgccacgacgaagaagcggcgttggcgacgctgctggccgaaggtggcagccccgacgaggagaccttccgccgccgcgccgcgcaggcacgccgctacgtggaactgacgggccggacgcgggagctgtcacaccgcatcgaggcgcgcacgggcctgtcggagacgctcgcgcggcaggcgctcatcgacgtgggcggcgagcagggcctgcgcgtggagctggaatccctgcgcgaccgacaggcggaggcccaggaccggctgaaggcggtgctcacggagcgcggcgcactcagccaccagttggagcagtgggagaacgacgacgcgctggcgaaactccgcatcgtcgaggagtccctgcgcgcacgggccgccgagctggcgaagcagtacgcggcggaccggctgaccctggcactgctggcgcgggcgcgccgccgcttcgaagaggagcagcagccgcgggtggtgcagctcgcctcggagcacttcgccacgctcacccagggccgctaccagcgcgtcttcatccccacgggagaggagcgcgagctgcgcgtgggtgatggtcagcgtgactggagcgcggcgcaactctcccgagggacgcgtgagcagctctacctcgcgttccggctggcggtggtgcgtgacttcggcgagacgcgcggggcgctgccgctcatcgtcgacgacgtgttggtgaacttcgacccggagcgggcgcgaggcgccatccacctgctggcgaagctctccgagcaccagcaggtcatcgccttcacctgccatccctggctgcgagacgccttcgccgccgagggcgcgcgggtgcaagcgctggacgcttccacgagcgaaccgcccgcgcccgtgtccgtgctgaagacgggctag

SEQ ID NO: 3100 - DNA, 336 bp, Myxococcus xanthus
agcttcgcgcacgtgctgtgcaatccgccgtatcggacgcgagcatccggacgcagcagcatgttcatggagaaggcgattgcccggcacgagctgacatgtgagctccaggacgtggtgcgcgccgcggaccacctgctggtgccgcgcggcgcgctgttcatggtgtatccggcgtcacggttcggggagttgacgtccgtgctcaggcttcaccggatggagccgcgcaccgtgcggtgcgtgcatcccttggcggaccggcccgcgaagctggtgctgcatggggatgacgagcacgcgttcacggatgaggtgaacgcgatgttgatgtga

SEQ ID NO: 3101 - DNA, 732 bp, Myxococcus xanthus
ctcttctccatcgtcttctgggcgttcctgatgctctccagcgccgtgctcttcgtgggcgccgtgctggtctggctcgtcacgttgccgttcgaccgcgacgggcgcgtcctgcacctgtattcgtgcttctgggcgcagctctacttctacgtcaacccgctctggcacctggaggtcgacggccgcgaacacctgccctggcggggcccggccgtgctcgtgtccaaccacgagtcgctcggcgacatcctggtcctcttcggcctctaccgccccttcaagtgggtctccaaggcgtcgaacttcaagctgccgctcatcggctggaacatgcggctcaaccgctatgtccccctggtgcgcggtgacagggcgagcatcacgaagatgctggccgactgcgaatactggctgtctcgcggcgtgcccatcctcatgttccccgaaggcacgcgctcctccgacggcgtcgtgaagcccttcaaggacggcgccttcgcgttggccttgaagcagcgctgccccgtcatccccgtggtcctcaccggcaccgcgcgcaccctgcccaagcacggcctggtgctggagaccaccgcccgctgccacgtccaggtcatgccccccgtcgaccccagcgccttcaccgacgtggcctccctgcgtgagcacgtccggaatctcatcgtctcggaaaaggcgcgcatcgaggcgctgacgcccggcgcctga

SEQ ID NO: 3102 - DNA, 3180 bp, Myxococcus xanthus
atgcgcaaacagccggtggtgatggtcgcgctcggtggactcgcactggcgctggccgtggcgctcgtccatgcccaggacgactcgagtgctcgaccaccgccacccaccgcgcagcacggtccatcgcttcgaaagctcgacgcccccacacccccgccgaaaggcaaccactcgctccgtggccgcgtgctcgacccgtggcgccgccccgtcgcgggcatccaggtctccgccacgcgcgagatgcccggcgagtccctgtccgcacttccctgtgacacacgcgcgccggacctgtcgctgtcctccggcgactgcattggagtgcccgaggagcaggtgcggggcctcgtcgaggtgggccacggcggcgcgcccgtggtggcccaggccgtcacgtcggcggaaggaacgttccgtctcgaaggcctgcccgagggcacggtggcgctctggggcatcggcgagcatcacgccacgctggcgctcgacgtcagcaccggcgcgcaggacgtgacgctcgtcctcgccccgggcctcttccttcccggccgcgtcatcgtcgaatccggcgcatcgctgcccggagcccgcgtgacgctcttccaccaggagcactcccgcttcttcgatgccaggactggcgcggatggccgcttcgccttcggtccgcttccaccgggcgactacaccgtcgtcgccaccagcgacggcctgctgacagactcccttcaaaacgtggagatggaggacctgaatcccatcgtcctccacctcccccggcggctgtccgggcgcgtgcttgcccaggacacgcccgtagccggcgcggaagtccacgtggcgtacacgtcgtccgtcacagtgacggacgaccagggccgcttctccttcgagccactctctccaggtgattacgaggtgcgcgcggagcaccagggcgcgtacggcttcgccatggtgacgctcaccgaggaagacggggacgcggacaccaccgtgcacctgggcacgctcatctatctggaaggcaccgttcgcgacgagtccgggcgccccatccctgaagcccaggtgggcgctggcgcggccagggggcgggcccctcccgtggactacgccaccacgatggcggacggccggttccggctgggcccgctgcggcgggagccctacatcttcaacgtcctcgcctccggctatctgggcacgctgcgcgacgaagtcgccgcgcctggactgcgtctggacttcaccctcgcgcgcgcccacctcatccgaggcaccgtcatcgacgcccagggaaccccggtgcccgatgtggacatcgacctggacagggagtcgctacccgacaccgagacagacctccagcgcgtggacgccaccacgtcggacgagcacggccgcttcgagctcgcggtcccccatccaaggcgctacgaaatcgtcttcatcagccagggccatctggaggcgcgggtgacagcggacgcgccgggccccgagctccgcgtggtgatggaggcgaccgcccgcgtggagggcaccgtcacgagcgcccagggcctccccgtccaccacatggcgattcacctcgaggatgacagcgacaccgggaactcccacaccgttgagagtgacgaggaggggcgcttctccatcaccggcgtgctcccgggcacgtaccgcctgcatgcggggacgaacacccacccggccacccgagcggcgtcgcgtaccgtcaccgtgcacggttcggaggtcgtgaatgcctcgctgcggctggagaccggagcgccggtgtccggcatcgtcgtggacgagcgcgggcgcccggtggcgaacgccacggtagaggggcaatccctgtcgggccggcgcagcgacctcccccccagcgtcaccaccagcgacgacgagggccacttcaccctgcaccacctggcggaaggtgagtgctcgctgcgcgcggcgaagggccggtatgtgctcgaggccaccgagcctcgtgctcccggcgcctcacatcccgcggtcctcgcgcagtcgggagctcgcaacgtgcggctggtgctgcgaagccagggaaacgtccatggccgcgtggtgcgcgcgaatggcacccccatcacccgcttcaccatcaaccaggagcccttccgggaccccgaggggagcttcaggttcgacgcccccgtcgtggggacacagcggctgaccttcgaggcccccgggctgacgcgcgccgtgcgcgaggtgcaggttcccgcggccgaggacctggacctggggcaggtgcggctggaggctgggcgcaacgtccgcggccgagtggtggacgcggcgacgtcgaagcccatcgaggacgccatcgtcgaggtccatctgccgggtgaaggcggcgcgttcgaggaagtcaccgcgctggccgtggacgtctcccaacgggatggcactttcgccttcccactgctggaagcgcgcccgctggacgtgctggtccagacgaaccaggggcaccccatcctgcgccatcggattggcacgggtgacgaaaccctggagttgcaggtgtatccgggcgcacaggtggaaggcaccctgaatgaccgcgacggaaagcccgcggaagccatcgtgcagctcgtcgccgaagacagggactactccgcctcggtggatgaggggctgggggcattccaggcccggaacgtcccggcgggcacctacacgctgtcggcttccatgggacagaacgcggaaggccgcagcgtggccttccttccgcagcgcgtgaaggttccgcccatgggaaaggtgacgttcgccttcacggaagccaccggtggcggcacgatgcgactcggcatccggatgcctccggtcaagccggacgtggggatctacaaggcgttgctgtcgggcacgctgccaccgaccgtatccggccgggagctgcgcacgcgggcccgcttcggagacatccgagcgtccacgaagagcctggagggcgtgttggtgtacgagcagctcccggctggggcgtacacgttcatcgtcctgctggaagaggggaagcccgcccgattcaccgtccaccgggaggagctcttcctcgcggagggggagacgctggagcgggacgtccaggtgacgccacggcccctgccctga

SEQ ID NO: 3103 - DNA, 855 bp, Myxococcus xanthus
atgagcgacaagcgccccctggcggacacgaccgagttggagctggactggcgtggccgcgccccccgcaagccggaggcgccctccagcgcggccttggaaccgctttccgaggtcgaggtgccgtccggcgcgggcaaggggctcccgggcgacccgcgccacatgagcatcgagttgcgccagtcggtgcaggggatgatggagacgcccgcgctgcgcatgcggcagatgcgcgaggggctggagattttcttcggcgcccagacgcgcaaccgctacgaggtgtgcgacgacacggggcgcgtcgcgctctacgtggaggaggaggcccgtggcttcggcgccatgctccggcggaccttctcgcccttctacaaggcccggatggagtgcatgacgctgggcggcatcgtggcgctcgtggtggagcgtccctggagcatcctcctcacgaaggcggacatcctggcctgggacggccggctgatggcgcgcatccagcagcgcttcaccctgttgggacgccacctggacatcgtcacgcccggcggcgccgtcatcgccaccgtgaagggcccgctcttcagaccctggaccttccgtatcttccagaatgacgtggaaatagccgtggtccgcaagcgctggagtggcttcctccaggagagcttctccgccgcggacaccttcaccctcgacttccagccccagtgcaccgacttccggctgcggcagttggtgctggccgtcgccctgctcgtcgacctgacgtacttcgagaacaacagcccccgcgccgccctgggcccggggctggacctgttcgacgcgttgatgttctggaagaagtag

SEQ ID NO: 3104 - DNA, 2733 bp, Myxococcus xanthus
atgtccacgtccacgagcgatgcgctgagcgcggcagacctggagcggctggtccgcgccgagtcccctgacctggccgatgccgtcctcgccctgctcgagcagcccgagcagacgccggagaagccgctgccgaaggatgccttcaccttcgacgcactcctccggacgctcacccaggcccgggcgcactacgagtcggacgggcggcgtcaggcctcctccgaggcgtggcagcgctacctggcgcagcaggacgtgccccgccctccccgcctggccctggccgacctgctggtggcgctctaccagcgcggcacccaggcctcgcgcgcggcgctgatggacatcgcccgccgcgcggacctgcgcttcggcctctggggcggactcaagcgcatctacaagctggcggaggccaaccacgacgcggagctgttcggcgtgctcgcctggcgcttcgacgtggagcgccaccgccccagcgccagccgggaagtctccggcggcaccctcacctacctgcgccgccgcgcctggcgctacctgcgccacctgggcgccgccgtgccggagctctacccgcagttcgcggtggaggtgctgcgccactacgcgacgaacacctcctggtacggcgtctgggtggcccaccacatctgggcgcacggcagcggcaagtacacgcaggactccttcgccatgccgccgccgggcgacatggtgaagcaccgcgccttcccggacgcgtggaagcgctcgccggacgcgctgatgcgcctgctggacgtgtgtgagtcggaccccgccgccagcttcgccatccagggcctgcgcaaggacttcccggaggcgctgcgcaaggtgacgcccgcgtggctggaccggctcgcccgccgtccgctgggcagcgcgcacgacttcctggtggagacgctgcagggctcgcccgagttccaccagggccggctgcgcgagctcggcctgcacgaggcggtgctggcgctgctgctgtcccccagcgccaaggcccgcgcctacgccatcgagtacgcccgcgcccacgcgcaggacctgccggcggagcgcctggaggagctggtggcccagggcgccccggacgtgaagtccttcgccgcggccacgttggagaagcgcaacccgcgcgagctgggtgtggcgctgctggggcggctcctgcagcacaaggccacctcgaccttcgcggcgagcgcgctggcgcagtcgttcgaccgggcggagctgcccgcggacttcctgcgcgacatgtacctgggcaccggtgagcagctcaactgggtgaagggcttcatcagttccaagtacggcgccaccgagctgcccgcggacttctggaaggcgctgctggacgacccgcggctgcagaagaagccccaccccgtggaaggtctggcgatgcgggcgctgtcggcctacccggccgcggccatcggtccggagtggctgctggagaaggccgcccatccccgcatcagccacatggcgacccaggcgctcatgcgcgcggacagcctgcccgggctggacgtggagcaggtgaaggcgcgcgtcttcagcgcgaagtaccggggcgtggccctgggcctgctgggcaaccgcaagctgttcaccgcgcgccagctcaccgtgccctggctgctggcgctggcccgccgcgccgacccggagctgcacggcttcgcgcaccgctacctgctggagaacgtggcccccgcggacttcagcgacgcgggcgacgcggccgcgggcctggagcgcctcttcgagctggccctgggcgcgaagcagccggcgcccgtgcgcgccttcgcgcagacgtacctgcgctgccaccaccccgtcatcgggccggagcagccggagtcgaagtcctacaacctcaagccccgcgcgccgcgcaaggcgtacacgccggagctgctgtggcccgcgctcaccgattcacgggacgacgtgcgccgcttcgccctggccattgcccgcgcggagctgcgcgcctggggctggcacacgcgcgtgtacgagctggcggacgccgaggcgaaggagattcgcaacctggcctatgacgctctgctgcgcgcgggcgaggaaggcgcggacgcccggcacacgctccagccagaggagctggaccccgtgaaggtgttctccctcacggagagcaccaagcgcagcacgcgcgaggtcgcggtggagctcatccgccgacactacgcgcggctgggcggcgccgagcggctcgcgtggctgatgcagagcgcggaccgcgaggtgggcctgttcgcggtgcgcctcctctgggagaagcaccggcccacgcacctgccggaggggtggaagcccgcgggcgccaaggaggccccggccgccagtggcacggagcgcttcgccaacgtggacgcgctgcgcaccttcctgcggaagatgctcttcggcctgccgccgggccgcgccaaggaggcccgtgagggtgaggtgcagaagcgcctgtccgccagcgtggccaagcgccgcgtcatcgagctggtgcgcgacctgggcctggacgacgcggccttcgcccgcgtggtggcgccggtgctggaggagttcaccggctcgctggccaagggggaatggcagagctgcctcgcctcgctggtgcagctccgggccgcgcacccggatgcgcaactcggaagcgcctga

SEQ ID NO: 3105 - DNA, 888 bp, Myxococcus xanthus
atgctgctcgatgaactgctgaatggctttccgcgggagcgcttcctccaggagcactacctgcggcgtcccttcaccggcgcttccgccgcggagcgcctccagcgcctggggacgtgggagaccatcgacttcctcgtcgaggagacggcctgcgacgtgctgctcgcgcgccagggcgtaccctacccgggagacaggcccacgacggcgaaggcggcgcgggagctgttcgcgcagggctacacgctcgcgctgcggcagccggacctgcaccacccggacctggcccaactggcgcgcgccttcagcgcggagctgcacggccgcatcaacctgcacatctactgcacgcccgcggggcaccacggcttcggctggcactgcgacccggaggaggtgttcatcctccagacggcgggccgcaaggactacctgctgcgggagaacacgctccaccccgtacccctgccggagtccgtacccagcggctccctggcggcgcaggagaagacgcccgtcgagacgcactcgctgagcgccggggacttcatctacatcccgggcgggcactggcacatggcgcaggcaaccgaggaggcgctgtccatctccatcggcctgatgccgcccacgctcctggacctcctcgacggggtgagggccgcgctggccagcagcccggtgtggcggcggcggatgccctcgctggggcgtgcctcctcactggacgacccgagcaaactggcgctgctgcggacgctgttgtcggagctgggcggtgaagtccagcgccagctcgccgaccccggctaccccctgcgcttcctcgcgcagacggcccggttctatctgcgctccacgggaatccggggcaacgggcgctga

SEQ ID NO: 3106 - DNA, 487 bp, Myxococcus xanthus
atgcccgtactcgccatcggcaacatcgagaaggtccgcgcactcgcggccaatgcgcgcctgctgctggtgggcggtgctcgcgcatccaccgccagccgcctcaccgcgttcgagccgggcaccaacaaggtgctgtggagcacggagctgccctccgcggtgaacgcgctcgccctgtccggtggacagtgggccgcggccggcgcggatggcacggtgcgcatcggcacgctgtccgacggacaggtgcagttccaactcaatgacgtgcaccccggcggcgtcacggcgctggcctccagcgcggatggcacgctcctcttcagcgcgggcgcggacggcgtcgtgcgcgcctgggactgggagtccacgcgcaagatgcacgagtggaaggcgtccacccagcccctgcgcgcggtggccgtggacccctccggcacctacgcggcgggcgcgggtgacgacggcgtggtgcgggtcttta

SEQ ID NO: 3107 - DNA, 171 bp, Myxococcus xanthus
atggctccggaagagaccctgtccgcagcgcccgcccactccgagcccgccacttccgaggcggcgcacagcgaggtctccgccgcgcccgagaagctggatgagatcgaggagatcgacttcctgctcgaggagatcgagagcaagattgctccgctcgcgctggcttga

SEQ ID NO: 3108 - DNA, 384 bp, Myxococcus xanthus
atgccgccccgggtggatcgcaccacgctcacctacgacgtgacgctgcccttcgccgcgaagctggccttcaagcccacgctcttctacgtccacaccgtctacgccatcgcctctccgctctccgaggagaagatgcggtgcttctacttcgcctcgtaccacccccggctgcgcaaccacttcccggacatgttcgtgaagagtgagctggccatcctggagcaggaccggcgcacgctggagggcgtgcgtccccgggcccagcccctggacttcgccagcgaggtccacacacccgcggaccgcctgcccatcgaataccgccggggtgtcatcgccctgcggctgggcaagcccgtggacggacccgccccggaatga

SEQ ID NO: 3109 - DNA, 975 bp, Myxococcus xanthus
atgcgctcccatctcctgttcctgctgctggcgctgagcgcctgtcagcgcaacgaatcgccgccgccacccgcgaaggctccggccgcatccgcgccgtcgcctcgtgctcccgccgtcccggccgtcaccgcgtccgcggacgcggcgaagctggagcggggccggtacctcgtggagaacgtgctcgcctgtggctcctgccacacgccgcgcgactgggctcggtatggaggccccgcctccgggcccgcgctctccggcgcctgctgggatgacgcggcctgggagctgcccggtcgcgtctgcgcgcccaacatcacctccgatcccgagcacggcatcggccgctggacggatgaggagctgatgcgcgcgctgcgcgacggcaccgggcgcgatgggaagacgctcttcccactcatgccgttcctcctctaccgcgagctgtcggacgcggacgcccatgccgtgattgcctggctgcgtcaggccccggccaccccgcgcgcttcggcccgctcggtcatcccggacgaggtgtacgcgcagtacaaggacatggccgcgcccatgaagacggccgtgccggagcccgccgcagatgacgtctctcgcggtcgctacctggccaccatggcgcagtgcgccgcgtgtcacgcgggcatggacgaggcgggcacgcccttcgtgggaggacgtccgctgcccacgccgcacggcccggaagtcgtatccaatctcacgccgcatgcacacggactgggcgccgtggacgaagcagccttcgtcgcccgcttcaccgccttcaaggacctggcacccgcgcccgcgcgggcgggccaggtgaacaagctcaccatgccctggggtttcttcgccggactggcggaggcggacctcaaggccctctaccgttacctgcgcacggtgcccgccgtggcccccgccgcgccgtccgcgtctggcaaatga

SEQ ID NO: 3110 - DNA, 1485 bp, Myxococcus xanthus
atgcgcaaggagtcgcgcttcaaggacctggactggtcgggcgtgacggtgggccgggacgagtggacgaacgacttcgactccacctttcagcgcgagacgtactacgagaacgccgcgtggatgcgctcgctggacgacaccttcctcatcgaggtgctcgacgcggacggcgccgtgcgcacctccatcacctacagccgccgtgacttcatgggtgagggcgccaccacgggccgcacgcgcgccagctggctggtggcggacctggcgcggcctcgcttcccgggagacccggaggtgagcctgctgccggacggcaccgagcccacctacaagacgatggtgaaggcgtccttctccggcgccaccaacccgttcaagacgctgaccatgccgcagctctccggcgagggactcatccgcgtcacttggagccagctgcccctcaagcccttcctcttccccatcgtcttcgcgcccgaggcggagcgcccggccacctgctaccggctggatgaaagcgggctggccaccgatgaacaggtgccttgtggcttcggcctgacgcaggcggtgcgcgtcaaccgcccgaccaacggcagctacttcatgcccggtgactcggtggacttcatggtgtcgctgcgcgacggggacggcaacggcctgcatccgcgcaaccggatgcccagctacaacgagtacatgggcgagtcctccaacggcctcgcgtacttcaacgaggagatgctgctgacctaccgcgaggccagctcctcggagtccggcttcaaggtggtgggcccgctgcaggacctgcaggtgtcgcgcggttcctacacgctgccgtacttctccttcccgctgttcagcgagccgcacttctacctgccgcccggctccaaccagctcgcgggcggcggtgatgcccagccgcccacgcactactcggtgacgctgccgccgaacgcgaaggcgggcacctacgccatcatcctcaaggggcaccgcaccttcatgggcgagcgcctcaaccggctggaccccttcttcttccaggtgggccaggcccagcccaccacctacccgggccgcgtgggcaactgccaggtgtgccacaacggggtgaactcgctctccaacgtgcaccacggcatgtccgtggaccacgtggaggcgtgcaagacgtgccacatcgaggagggctacgggtacctgccggacatcatccaccgcatccacaacagctcgcgcaagtacaaccagaacaagggtgactgcaccatgtgtcacctgacgcgggagagcacgctgtggcccagcctgatgagctgcaatggctgccacgtggcatcgcacggcacggagtacttcgaccttcgcttcgagcccatgcagaacacgcccaacggctacggcaactgcgccgaatcgtgccacgtcaccacgccggcgggcgagcacatcctcccgccccgctga

SEQ ID NO: 3111 - DNA, 210 bp, Myxococcus xanthus
atggtcaaccatcgcgccgagcagaaccacgcgctggatgccgccatcggtctgggcaaccacctgggcctgcccgtcgtcgtctaccaggccatccgtccggactaccctcatgcctgcgacaggctccacgcctgggccctggaggggatgatggacatggccaccggctgcgccgcgcgcgggctgacctactggctggagctgccc

SEQ ID NO: 3112 - DNA, 1098 bp, Myxococcus xanthus
atgaaggttcgctctctcattgcctcgaccctgtccgccgccgtgctgagcgcgtgcgctgatagcagtgcaccgcctccacccaagctggacgccgaggcgccctacaccgacctgcccgaccggcgggtgcccgtctccggcgtcatcttcgatccggaggcgatgttctataccttcgtcatgtggccgcccgacccggaggacccggaggccgggccgccgctgccggcgctgctgtatggcatgcccacggtgatgcgcgcgtccgtgtggggcgcgcaggtcagcatggtggggcccaccggcgaggtggtcgacaccagcggccccgcgatgccgccctggggcaacttccagacggaaggcattccctccgacccgacggtgccgtacctcatgcgcgccgagcccgcgcccgggctctccgtgggggccgccgacatgttcccggaggaggagggccacgcgcccatccccgcggtgccgtactacgccaccaccagcctgcggcccatcgcggccaccgggacgcagtgcctcatccagtcgccggccatcgtgggcgaggcgggcgcgctcggcgcgctggcgcaggtgatttccgaggagacggggacgtccgtctccccggccagcctggcggatgcctcgtcgggccgctcggtggcgctgctgtgggtctactcgcccagcccggtgctggacgcgttcctgttccccagcggtgacatcgcggcggagacgacggcgggcacgctgtacgccatcgactgggcgccgccgggctcgttcccgggccagacggagatgggctacttcgccatccccggcggcatgagcagcctgggctactacgccctggtggtgcagccgggcgccccgagcgcgctgacggtgagcttcgtggacaccctggaggacgaggaggagggccggccctgggaggtgcctcccttcttcgtcgagggcctgccgccgggagtgtccttcacgcgcctgttcgccatggaggcctcgccgcccgtggaggagaacccctacgaggagcccgcgccgccgccggacttcggctttctctgctacccggaggggtga

SEQ ID NO: 3113 - DNA, 1383 bp, Myxococcus xanthus
atgcggggcggttccggttccgaggaggacagcggggtggcggcatacgcgggccttcagcctcgcgaatggctgacgtccgctggcgaagcgctggagggcttcacgcggcaccacgcaccctcgcaggccgagctgttcctcgccgcggagcgcaggctgtcgttcgaatacgacgccgggacggggcgctccatcgtcaaccagggggagaccatggatgccatggcgcgcgtgagctgggacgcgcggcagggcatgttgaccgcgccggtgggtgagacaggcgcgctgccgctgctcctggagcgcaccgcgcgacaggccacttcaggacgtgcgagtccgctgccagagcttccagctcagagcgattccccgagtgtctcgagtcctcctccgctccagccggagcgcgcggcgcgccggatgaaacacttcatcgagaccgccgtgccccctggcagcgtcgtgcaggccgcgctgctcacccaggtgtccacgtggcgcgccctggtgcgcgcaagtggcgcgcgccgtgctcgcacggaatggcgcgaggaactgttcgtgcgctgtgagacgccgcgaggcgccgtggtggatgcggtggcgtttcccgaaacagcggcggacgacacggtcatcattccgctgcgccatcgactcgcggaggctgtagctgccctcacgggccccgcggagtcgctggaccgcgacctccccctggtgctgcggccggcggtggccgcgcctctcgcggcggggctcatctggttgctacggggcgacgtggccgcggccacacccgccctggcccgggccgtggggcgcaagttgttcccctcggtcctgagcgtggtggacgacccgaaccaccccacgggcacgcggcgcgtatccatggatgatgaaggactctccacagacacgctgtcgctggtcgacgcgggcgtgctgcgaggcttccttcacgcctccgacaccgcatcgcggctcggcgcgccgctcaacgggcgtggcttccgcaccagcatgtcaccacccacgcccgaagccgtgaatcccttcctcgtgcccggtgagaccgccgtgctccccgcgcactacacggaactcgtcgcgcgcgtggagaccttcaccaccatgccgcgtcccggcaccgtcacgttggtggcgggcggctgggaggtacgcgacggccgtcgtgtgcgccgcatcgctccggtggaactggagctccccgtgctggagaccttccgcgcgctgcgcggcgtggggacggacctgacctttttccccaccgccgagggctgtggcacgccgacgctcgtcttcccgcccctgctgtcgggtgcccagggagggcaggcggccaggtga

SEQ ID NO: 3114 - DNA, 645 bp, Myxococcus xanthus
atgtcgggtcagtcgctggcggcgaagatgctggaaggggcgcgggagtgggcgaagcgattgccgaatgcgctctccaacgacatggcggtggacgtgagccgcaggcgggtgcgcctgtcgcatgcacgcgtggagaccgtggtgagccagcttctggcccggctgaagaacttcgagctgcgcgagtggtcctcgcgggagaacgtctatgacatccgcttctccgtgcacggctggaagctgcgcgtggagacggcgctggagcgcgtggagctggcctccgggcgctaccggctgtggttgaagacgccgggcgtggtggcgctggaggagtcccgcacggcttcgtcgctgatgatgggcgtgcttcgcgccggggcgggccgggccgcgatgcgggtgttggcggagcggctgctgcctcccggcattcgttgggacggtcaggtgttacaagtggaagggccgttgcccgaagagggcgtgctgcctgcccggctgttcgattcggcctccctggccatgaccgccgagcatcagtccgagggcctgtggctggccgccgacgcctggcccgggctcatggacctgctccaggtggtgtttggcacggaacttccgcggacgccccccggcgcctag

SEQ ID NO: 3115 - DNA, 7404 bp, Myxococcus xanthus
gccgccgcgaagcgcgagcaattgcgcaagttgctggagcagcgcaagaaccccggcacggggagcgccgcgccctcctcgccacagcggaacgtggtgggcccctcgcgccgcccggcggggacgaccgacgtgctgtcgcccgcgcaggagcgcatgtggttcctgcaccagctccgccccgacaccgcgacctacgtggtgccgtgggccgcgatgctggagtcccccgtggacgcgagcgcgctcgacgcggcgctgcgagccctgctgtcgcgccatcccctgctgcgagcccgcttccccgccgagggcggccgtccccaggtgcgctacctggacctgcccgagcgcgtcctcgacgtggaggatgcgacgggcgcgagcgaggcctggctttcgcgcaggctgcgcgaagaagcctctcggccgttcgacctggagcaggggccgctgtaccgcttccggctgctgaacctctccagccagcggcaggtgctggtcctggtgttccaccacctcgtcaccgacggcgcgtccatcaacgtgttgatgcgcgaactgggtgtgcttcatgccgcgcacgcccgcggtgaagtccccgcgctgacggcgctcccgctggagtacgcggatgccgccgcgtggcagcacacgcccgacgccgccgcgaatgaaccggagctgatggccttctggaagcggcagctcgaaggcgccgtgcaggggctggagctgcccatcgacaagcctcggcccgcccggcggtcggaccggggggcgctgacggaacccatcgccctcccctcctcgctcacgggcgcgctgcgcgccttcagccgcgaacggcaggtgtcgccgttcatgacgctgtacgcggccttcgcggcgctgctgtaccggtactcgcggcaggacgacttctgagtcggcacgcccgtctccgggcgcacgcacccgtccatggaggggctggtcggcctgttcgtcaacacggtggtgctgcgcacgcgcgtcaccgcggcggatgccttcaccgcgctcctcgaccaggttcgcgccaccacgctggatgcgctgggccaccaggcccttcccttcgagcggttggtgcaggccctgggcgtggagcggagcctcagccactccccgctgttccaggtgatgttcgacctataccgcgtggagcattccctggcgggcgccttccccgaggcccgcgacctccccatggacacgggcgcgtgcgagttcgacctgcacgtcacgctcttcgagagcgcgtccggcttcgagctgttcgcccgctacagcaccgacctcttcgaggccaccacggtgcggcggatgctgggccactatctccagctcctcacgcatgcgctgcgcgcgccggacacgcgcgtggatgcgctgtcgctgctgcctgatgcggagcgcgcccgcgtgctggcggattcgaacccgccgcgccggcccttcccactggaagccgccttccccgagcacttctccgcccaggccgcgcgcacgccggaccaggtggccctgtcgtcctccagtgctcggtggacttatgcggagctggaagcccacaccaaccgcgccgcgcgacggttggtggcccagggtgtcggcctggagtccgtggtggccgtgctcgggcgccgcagcgaagccaccgtgcgcgcgctgatgtccattcacaaggcggggggcgcataccttccgctggacgcgcagctccccgcggctcggctggcccgactcctggaggagagccgcgcgccgttcgtgcttccgctcgacacggacgaggccttgctgtcagaggtgctcgcgggcgttcccgaagcccggcggcctcgggtgctgtcgctggagggactcgagtcacagagcgcggagcggctgccgccgcgtgccacgccggactcgctggcctacgtcctcttcacctccggctccaccggcacacccaagggcgtcatggtggaccaccgcggcatgctcaaccacctgctgggcatgcgcgaggcgctgggcctggacgggtatgacgtcgtggcccagattgccgcgctcagcttcgacatctccatctggcagatgttgggcgcgctgcccggtggcggcaccacgtacctcatcgaagacgacgtgatgagggatccgccccggctcgccgacgcgctggagcagggccgcgccaccgtcatggagatggtgccctccgtcctccaggccatcctggagggcgctcgcccagagcaggacttcccggacatgcgctgggtggtgctcggcggcgagcccgtcccgcccgcgctgtgccggacctggctggagcgctgcccaggctgccggatggcggacgcctacggcccgacggagagctcggacgtcgccagcctccacttcatcaacgagccccccgaaggcagcttcacccccattggcacgcccaaggccaacatggaggtgtacgtgctggacgacgccctccagcccgttccggtcggcatcgtgggcgagttgtacctgggcggcctgggcgtggcccgtgggtacgtgggacgcgcggacctcaccgccgagcgcttcgttccgcaccctttcagcgccacgccgggcgcgcgcctctaccgctcgggagacctggggcgctggttgccggacggcgtgctccagttcgtctctcgcgccgacctccaggtgaaggtgcgcggcatgcgcatcgagttgggcgaggtcgaagccgccctcgcgtcgctccccggcgtccgctccgccgctgtcaccgttcagcgacgcgggccctctgactcctggctcgccgcctgggtcgtccccgcttctcccgacgccgacgtccactccctccaggccgccctcgctcgtctcctcccggccttcatgcttccctctcgctgggtccttcgggcccagcttcctctcacctccaccggcaagctcgaccgcaaggccctcgccgcgattcctctcgacgaagccccttccctctccgagggtgggcctcctcgcgggcccctggaggagctgcttgctcaactcttctgccaggtcctcggcctcgagcgcatcgagcgggaggccagcttcttccacctcggtggccactcgctctccgccacccggctggtggcccgcgcccgtcacgccctgggtgttcagcttcccctctcctccctcttcacctccccttccgtcgcgggcctcgcgttggaagtcgcttcgcttcagcgcgacgcctcctcgcttcctcctccgacgccttctgactcggcgccttcgctctcccaggctcaggagcgcctctggttcatccatcagctccagccgggctcgggcgcctaccacatcccccaggccgtcgagcttcgcggcacggtgagcgccgacgcgctggatgcggcggtgcggtggctgctggaacgccatcccgtgcttcgcaccaccgtggtgtcacagcagggacaggcgcgcgtcgaggtgtcctccgttcccgtgcgtgtgcttcaaatggaagcgctgcgcgcggcccccgaggcactgcagcttcggcttcagcaggagtcgtggcggcccttctcgctggagcaaggaccgctgtaccgctttctgctgctcgacgtaggggaggaccggcacgtgctgctggccgtgttccatcacctggtggtggacggcctctcgctggacatcctgctgcgcgaactgggtgaagtgtatgccgccttccagcagggtcatgcgcccacgctggccccggtggcgctgcactacgcggacgtggccagttggcagcgctccgagcctgtccatgcgcgcgacacggcccagctcgactactggaagcagcggctctccggcacgccggggcttctccagcttcccaccgacaagccgcgccccgccgtcctcacgcaccagggcgcctccacggggacccaggcactgcctgccgcgctgacggacaccgtgcagcgcgcttgccgtgaacacgaagccacgccgttcatggtgctgtacgccgcgttcgccgcgctgctgtaccgctactctcaacaggacgacttctgcgtcggcacgcccgtctccggccgcacccacccttcactcgaaggtgtcgtgggactgctcgccaacaccgtgcctctgcgcacgcaggtggatgcgtccacctccttcgcttcgctccttgcccaggtccgcgccaccacgctggatgcgctctctcatcaggacgtgcccttcgagcaactggtccatgcgctcggcgtggagcgcagcctcagtcatgcgcccctgtaccaggtgatgttcgacctgcaccgggtgcagggttcgctcgcggatgcattcacggggctggatgcgcgcccggttcccgtcgacattcgcgccagcccgttcgacctcgcgttgagcgtcatcgagcaggcagggagcttcgagctcttcctccgctacagcggcgagctgttcgaaccggagaccgctcgacggatgatggagcactatcagcgtctgctcacccaggcgctggccgaaccgcatctgccgctgtcgcggctatccttgctgtcgtccgacgagcaggcgctggtgcttcgccacgcccgtcccgcgccgctggctttcgacctggacacctgcctgcctgagcgcatcagcgcccatgcgcgcaacacgcccgaacggctggcgcttgcctccgccgacgcgcagtggacctacgcgcaactggaggccctgagtcttcgcgccgcgcgcacgctgcgcgcccagggcgttgggcacgagtccgtggtggccgtcctcggccgccgctccgaggccaccgttcgcgcgctgctgtcgctgcacaaggccggtgccgcctacctcccgctggacgcgcaactgcccgcggcgcgcctcgcacggctgctgatggagagccgcgcgcccttcgtccttcccctgggccctatcgaggcgctgctcaccgaggtgctcgcggagattccgctcgagcatcggccgcgcgtgctgtcgctccagaacctggaggccgagtctgacgcgccgttgcctcccttcacgacgccggactcgctggcctacgtcctcttcacctccggctccaccggcacgcccaagggcgtcatggtggaccaccgcggcatgctcaaccacctgctgggcatgcagcactcgctgcaacttggcgcgtccgacgtgctcgcgcagacggcgccgctctcctttgacatctccatctggcagatgctgggagcgctggccgccggagggacgacctacgtcgtggatgacgacgtggtgcgtgagcccgcccggctcatcgcggccttgcagcaagcgggggccaccaccgtggagctggtgccctcgctgctccaggccctgctcgaagagcctggagaagcgccgctgcccgcccttcgccagatgctcaccattggcgaagccctgccgccttcgacctgtcgtgcgtggttcgagcgccaccccggcctgccactggtcaacgcctacggccccgccgagtgcgcggacaccgccacactctggcgcatgcacgcaccgcccgcgagcgccagcacgcccatcggcacgcccaaggccaacttggaggtgtacgtcctggatgacgcgctccagccgctgcctccgggtgtcccgggtgagctctacatcggcggtacgggcgtcggtcgcggctacgtgggacgcgcggacctcaccgccgagcgcttcatcccgcatcccttcagcaccatgccgggcgcccgcctctaccggacgggagatcgggaccgctggaatgccgacggaacactgggcttcctgggccgcgtcgacttccaggtgaaggtgcgcggcatgcgcatcgagttgggcgaagtcgaggccgccctcgcctcgctccccggcgtccgctccgccgccgtcaccgtccaacgacgcgggccctccgactcctggctcgccgcctgggtcgtccccgcttctcccgacaccgacgtccactccctccaggccgccctcgctcgtctcctcccggccttcatgcttccctctcgctgggtccttcgcgcccagcttccgctcacctccaccggcaagctcgaccgcaaggccctcgccgcgattcctctcgacgaggccccttcccgctccgagggtgggcctcctcgcgggccccaagaggagctgcttgctcagctcttctgccaggtcctcggcctcgagcgcatcgagcgggaggccagcttcttccacctcggtggccattcgctctccgccacccggctggtggctcgcgtccgccactccctgggcattcagcttcccctctcctccctcttcacctccccttccgtcgcgggccttgcgctggaagtcgcttcgcttcagcgcgacgtctcctcgcttcctcctccgacgccttctgactcggcgccttcgctctcccaggctcaggagcgcctctggttcatccatcagctccagccggactccggagcgcatgtcgtcggacaggccgcggagtggacgggctcggtggacgtggccgcgctggatgcggcagcgaagtggctgctggagcgccatccggtgctgcgcaccaccgtgtcctcacgacagggtcagccgcaggcgagcgtgtccccggtccccgccagcgtgctccaggtggagcccctggcgccgggtgcggacgcccaggcccgtcaggctcggcgcctgacggaagaaggcaatcggccgttcgatgtggagcacggtccgctgtatcgattcctgctgctcgaagccgagcaagcgcggcatgtgctggtcgtcgtgttccaccatctggtgagcgacgcactgtccgcgggcctgctcatgcgcgaactgggcgaggcgtattccgccttccagcagggccatgcgcccacgctggccccggtcgcgctgcactacgtggatgtggccagttggcagcgctccgagcctgtccgcgctcgcgacacggctcagctcgactactggaagcagcggctctccgatgcgccggagctgctccagctccccaccgacaagccgcgccccgccgtcctcacgcaccggggcgacaacaccggctaccacccgctgccgccgtctctctccgagagcctgcgagcgttgtgccggcaacagcaggtcacgccgttcacggtgctgtacgccgcgttcgccgcgctgctgtaccgctactcccagcaggacgacttctgcgtcggcacgcccgtctccggccgcacccatccttcgctcgaaggcgtcgtgggtctgctcgccaacaccgtgcctctgcgcacgcaagtggacgcgtccacaacccgtaga

SEQ ID NO: 3116 - DNA, 1950 bp, Myxococcus xanthus
atgccccccttgcccgttcgagccctggccgcggccatcctgctctggagtcttaccgtgtccgccgagccctggaacggcacggagccgggcacgacgacgctccagcaggtcctgctctcctttggcccgcccacccggcaggtccacgaggacggcgcggtggtgctgacgtaccagcgcaaggccgcgccgggaggcacccggagcacgcgcttccacttcgacgcccggcagggcgtgctgcgccgcgtcgaggtggtgcccacgaagccgccgacgcaggcggggctcgtcgcgctgtacggccccgcgtgtggcgcggcgaaggcctcggagggaggcccggactgtcacgaggaggaagccgcgcccgcgcgccagcgctggtggcactaccgcgcgcgcgggctgagcgtgctcctcgacaagcagcggcgcgtgaagtcgatgcgctacagcgagcccctggcctccgcgagcccggccccggcacgaggatccatggcttcggccgggagtgaaggcgccaccgtgccggccgcggcggcgttcgacgtcccgagggcgacgcccgccacggggacgctgccgcccgacacggactccgcctccgggctcgccaccgccgccgtggacccgagcggggccggtgcgcccgacggtttcgaggacctgctggacgctcccgctcccgctcccgcgcctcggccggccggtccatcgggcgccatcgtggagggctggcagggcccggaaggcgaggccgcggacccctggcatgagacggcgcaggagcgtcagcaggacgtgctcgcggtgggcggcatctacttccagcgcgcggagctgacggggctgcgctcccaggggaagacgtcgtaccagcccgtcctgcccgcactcgcggacatctacctggacgcgacgccgtcgaagcacgtgcgcggcttcatgatgggccggctggcgtatgacccgctgtccacggaggcgaacggacccgccgccgtgctggggcagatgtggctgaagttcgacgtcgcccaacggctgttcgtcaccgccgggcgccaggagattcgctggggcagctcgcaaatctggaacccgaccgacttcctgcaggcgcccaacccggatccgctcaacatcttcgacctgcgcacgggcgtcgacatggtccgcctcacggtgccgtgggaggccatggccgccaacctgtcgctcctgggtaccgccaacgtggaggacgtcagcgaggacctccggcgggtgcgctacggcggtggcgtgcgcgcggagatggcggtgggcacgggcgaaatcgccgcgacggcggtgttcgaccagtcgcgccggccccggtacggcctggacgcgacgatggcgctgggcctgctggacttcaacgccgaggtggcctgggtgggcgacggcaacacgcggctctgggcccgtgatggcgacagcttcgtggagcgcacgctggagggacgcaagctgctggtcagcgcgggcgtttcggccacgttcaacttcgccgagctctaccgcgccgtcatccgggtggagggcttccacaacccgctgggctacgacgaccgcgccttcctgccctggctgagttcgcagggagacttccggccgctcttccatggccgctactacgcactggggcaggtcaatatcggccggcgcggcgtgtcccagctgtcgctcatcttcaccaccatcgccaacgtgcaggatgcgtcgtacctgtcacggctggccttcaactcatcgcccttcgacatccgggacatcttcgtccagaccttcgtcgaggtgccctacggtgaacgtggcagcgagttccgcttcgagagcctccccgcggaccccaccatttccggttcggggctgggcgtcttccgcgcgggcgtgagcctctacgttcgcatctag

SEQ ID NO: 3117 - DNA, 1107 bp, Myxococcus xanthus
atgccggaggcgctggcataccaggcccgtcccctgctcgacgccgagccccggctcgcgagcgacacggaggccatggtgtcgctcgtccgccaactggaggcgacagcgcgggccgcgggcgcccagcacctggacgtgctgctgcgcgaagtggagcggcgcacgctgtccgccagcgacgcgcaccagagagaagaccaccagcgccatgccctgctcgaagtgaaggccttccacgacaccggcgcgggcatggcagaactgtggcgctgcgccgcctggccggacgtcaccggggcacgcaccgcgctgccctcgttggaagcgctcgtggagagcatggcgcgggagctgcgggacacaacacccatggtgccctgcccccgcgacgtgctgcccatcgtctttccaccaggcgccgcctccggctgcttcttccacgaggtgtgcggacatcccctggagggagacgtcgtcgcgcgcggcggctcatacctggcgcggcggctggggcagcaggtggctggtgcgcacctcagcgtctcggacgacccgacggacggccacggcgcgctcggcttcgcctgggacgatgaaggccacgccgcgctcccggtgacactcatccgcgagggccgggtggacgcgcccctgctggatgctcgcagcgccgccgcgctgggccgcgcgcccaacggacacgggcggcgcgtcagctaccggcacccgcccctgcctcgcatggcccacacgcgcgtggacgcgcaccagggacacctggaggcgctgatggcggacattccgcacgggctgctggtgcagcacctcacgccccggcagatggacctgctgtcaggcgacttcagcttctacatcgtggaggcgcgggaaattcgaaacggccggcctgggcgccgcgtgggccccggcatcctccggggcaacgggctggaggcgctggccgccatcgacgcggtgggcgcggacacgaagaacctcttcgccacgcgcggctgccggaagctggaccatggcccgcttccggtgtccttcgggcagcccacggtgcgcttccgcgggctcacggtggagccctcgcggtga

SEQ ID NO: 3118 - DNA, 909 bp, Myxococcus xanthus
gctgtaaaggcggcggagatgatgctggccgcgctgcgtcccctgctccaggccatgcccgcgggcgcgccgctgcggcccgcgctgctgctgggcgtggccctgggcgccaacgtcggcggcatcgccacgcccgtgggcagcggtcccaatgcgctcgccgtatccgccgcgtccgagtatgcgcaagtcaccttcgcgaagtggatgtccttcgccctgccgctcacgatgctcctgctgctggccggcttcggactggtgctgctgcgcttccgcgtgggcggcaggctgacgctgccccccgaagcacccgtgtccctggcgcgctcgggacggcgcgtgctctgggtgagcgcggcgtgcgtggtggcctggctggcagagccgctccacggtgtgcccgcgcccgtggtggcgctggccgccaccgcgctgctcttcggcagcggcctgttgaagcgcgaggacctgggccggttggactgggccacgctgctgctcatcgccggcggcatcgccctgggccggctgctggagcactccgggctcatcgctcgcgcacttgccggcgcggaccttgcgggctggccggtgccggtgcagttgggggtattggtggccgtcgcggcggtgctgtccgcgctgatgagcaacacggggacggcggcgctcctcatccccctggccacacaactgcatcccgccgtttcgacgccggtcctcgtggccctggggtgctcgctgggcatgcccttcgtcatcagcaccccgcccaatgcgatgacggtgggcgaggggctggcctcctccgagctgatgaagttgggggttcccctgatgttgggcggatgtctgctggtgagcgtctcgggccctgccgtgctgcgcctctttgggttgccatga

SEQ ID NO: 3119 - DNA, 1422 bp, Myxococcus xanthus
tcccccatgtccccacagcgaatcctggtcgtcgacgatgaggacaatgcccgccgggcgattgccaccatcctgaatgaggaaggctacgaagtggccgaggccgccaatggcgccgaggccctggctcgcatcggcgagttctcccccgcggtggtgctcaccgacgtgcgcatgccgcagatggacggcctcacgctgctgaagacggcccgcgagcagggcagcgacgccaccttcgtgatgatgacggcgttcgccagcgtggagacggccgtggaggccatgaagtccggcgcggacaacttcctgctcaagccgttggacgcggaccaggtgctcgtcaccctgggcaaggtgctggagaagcgcagcctgcgccaggaggccgaggcgctgcgggaccaggtgcgctcgcgcgtccgccgcttccacgacatcatcggcgaatcgccccagctccaaggcatctacgacgtcatccggagggcggcgggcacgcgtgccacggtgctcatcctgggcgaatcgggcacgggcaaggagttgattgcccaggccctgcaccaggagtcgccacgcaaggacaagcccttcatccgtgtgcactgcgcggccctgtccgagaacctgctggagagcgagctgttcggccacgagaagggctcattcacgggagcgctggcccggaaggaaggccgcttcgagctggcggacggtggcacgctgttcctggacgagattggagaaatctctcccgccgtgcaggtgaagctgctgcgcgtcctccagcagcgtgagttcgagcgcgtgggtggcacccagacgctgaaggtggacgtgcgcatcgtcgcggccacgcaccgggacctggtggccgaggtgaaggcggggcggttccgcgaggacctctactaccggctcaacgtggtgagcgtgacgctgccgccgctgagggaccgcaagagcgacgtccccgcgctggtgaaccacttcctggagaagtacagcgattcatacggcaagcaggtgcgaggcctggcacccgggacgctccaggcgctgctgtcccatgactggccgggcaacatccgcgagttggagaacgccatcgagcgcgcggtggtgctggcgcaggggcaggagctgtccacggatgacctgccgcccgtgctgcgtgggccccggccgcacgggacgtccacgggcgcgctcatcccgggcgccacgctggcggcgattgaacgcgaggccatcctgcgcacgctggagatggtgcagggctccacatcccgggccgccgaggtgctgggcatcagcgtgcggaagattcagtaccggctcaaggaatacagcacgccggatggcgcgccgctcaaggtcgtggccgatgaggcggaggacctggccgcggagtcgtag

SEQ ID NO: 3120 - DNA, 810 bp, Myxococcus xanthus
atggaggactggataacgtcggacctggacctctccagcctggacttcggctggatgcgccagatgcatgcgttcgaccactggaatgccattccccgtgcgtccatcgcaccgggcaagcctttcgacctgatgtccgcgtcctttccggagttctcgctcctggtgctctggtcgaagttgcggctccggcatgcgattgaacaggggacgccgctggaagccgtgcgcgacgtgaggcagctcgcgtggctggcctaccgcacggacacgctgttgggcggcatggtcgccctctcattgctcaccgtcgaacacaggatccacgccaccttggagaatcccccgcctgactggcggcccatgagccttgaacaacagaggcgcttcaaggccgtgctgtggtccgcctctgccttttcgagcatcgcttctcccgtggaggtcagcgagaaggcacgcacgtgtgagccggcgattggccgctgtattggcctggtggaagccgcccttcgcggccgttacctggaaccctatgcgaaaggcacgcaccagcaggcgtacctggaactcaagacagccagcgcggcgggccactgccccacgcaactgctggcgtccatctgggagcaagggctcacggtgacggatgacgatacagggccgggtgcaggggacgagcgtcccctggcggcgcggctgattcccacgagcgccctcaggggccccttcgcactccaaatcctggcatcctcgctgaccaccctcgacccgctccgcgagctcaaagccctggcccccgccccttag

SEQ ID NO: 3121 - DNA, 2004 bp, Myxococcus xanthus
tctccagacaaactgctcacggacccgtactccaaggccctgcaccgcgaccacgactggagcaagggcagcacggccagcggtccggcccgcacgcaggtgacttacgcggcctccgccaagagcgtgctcgtcaagagcggcgactaccagtggggcgaggtggagcagcagtggcgcgccaaccgccaggacgagaactggcaggggcacggctggcaggacctcatcgtctacgaggttcacgccaagggcttcacggcggaccccgcaagcggtgtgcgcttcccgggtacctaccgcggcttcggtgagaaggcggcctacctggccgagctgggcatcaccgcggtggagctgctgcccatccacgagaagccgctggacggtggctactggggctaccagaccatcaacttcttcgcgcccgagctgtcctatgcggccttcaaggagccgcaccaggtcatcaacgagttcaagtggatggtggagcaactccacaagcacggcatcgaggtgattatcgacgtcgtctacaaccacaccggcgagggtggcctctggcgcgagaagctggagacggatgacgtcatgcccggcgagccgctggagtccctggaccccgcggagacggctggcctctattcgttccgcggcatcgacaaccaagcgtactacgcgctcaacccggacctccgcacgtattggaacaacactggcgtcggtaaccagacgcgccccaaccaccggcccacgcgcaagctcatcatcgacagcctgcgcttctacgtggaagagctccacgtggatggtttccgcttcgacctggcgcccatcctgggtgagcgggacggcgactacaaccgctgggatgacccgcgcaacaccgtgctccaggacgtcatcgacgacccggtgctccagaagtacaacacccgcatcatggccgagccgtggagcgcgggcggctggtactgcatgccgctgggcgagttccccaacgccaagacgcagccgggcaatggctggtacgagtggaacggccgcttccgcgactggtggcgcgcgttcatgaaccaggatggttggaagctcaactccaacgagggttcgctgtgcggccggcctggcaccgtggacggcggcttcctgatgtacggcagccaggagtggttcgagcgcaatggccgccgcccgtatcactccatgaacttcatcaccgtgcacgacggcttcaccatgtacgacctgttcgcgtacgacgagaagcagaaccgctgcggtccgctgaacccggtgtgctgtgacacaccgaacagtcccttctgcgacaaggtcagcggcgaggagcacaaccgttcccgcaactgggggccgattggcgacgagcgcgcggagagcatgcggcggcagatgattcgcaatgccttcatgtcgatgatgatcagccacggcacgccgatgatcctgggcggcgacgagtggatgcgcacgcagttggggaacaacaacgcctactccacgctgtccgacaaccccttcaactggtaccagtggggtacgtacctggcgcgcgacgaacgtcaccgcatgttcgagttcgtgaaggctgccatccgcctgcgcaaggagcatgcctatgccttcgctccgaaggactacggcaagggcgcgccgctggcctggaagagcgcgcagaacacggaggcggcgtgggacagcaagcagttgatgattcactatcacgacgcgtcctacgggccggagttgctggtgctcatcaacatggagccccgcgcggtgacgttcacgctgcccgaaggccgcaagtggacgcggctcatcgacacgcaggcgtacttcgacagctccgcctatctcacgacggcgggcctggatagccggtccacgggtaactcgtggcttgatgcaccgtcaccagtgaacggtccgacgtacgggatgccggaaagaaccatcgtcgtcctgcgtgcggagtag

SEQ ID NO: 3122 - DNA, 396 bp, Myxococcus xanthus
atgaccacccacgccctcccgcagccgacgcgggccgagctggccatcctccgtgtactctggaagcagggccccagcaccgtccgacaggtgcatgagctgatgcggggcacccaggacaaggacaccggctacaccacggtcctcaagctcctgcagaacatgacggagaagggcatcgtccagcgtgacgagagcgagcggacccatgtctatgaagccgccatcagcgagacgcgcacccagcgcgacctcctgcgcgacttgatggaccgggccttcggggggtccgccacgtcggtcgtggcccaggcgttgtctatgaagcgcgcgtccgccgaggagctggcggagattcgcaggctgctcgacgcacacgaaaagcgggggaagtga

SEQ ID NO: 3123 - DNA, 1914 bp, Myxococcus xanthus
atggacgcgcgttatctccacgccctggagcaggcgctgctcggcttcctgtggcagggcgcggtagtagccctggcggtcgcgggtatcctgtccctgacgtcgcagcgcgccgcgcggacgcgttacgccaccgcatgcctggggatggtggccatggccgtgctgcccgtggtgacgttcctgaccgcgctggcggaggcctcgcacgccgtgacgttcggcgccttcgggtccctgacccagtccagcatgctgaccgtggccacgacggagaccgcgtccctggcggctcctcactggacggaggtgctccgcccctggcttctgccggcgtggtgctgcggcgtgctcctcctgtcggcccggaccgtgggcgcatggatcatcacccaccggatggcccgacaggagacggaggccccctcggcccactggcgtgaggcactgactcgtgcgttgcaccacgtccgcctgtcccggcccgtgcgcctgctggcctccacccgcgtcgacgtgcccatggtcattggcctgtggcgccccctcatcctggtgccggcgggtgccatcaccgggctgtccgccgcgcagttggaagccatcctcgcgcacgaactgggccacatccggcgccacgactacgtggtcaacctcctccagtccttcgtggagaccctcctgttctaccacccggccgtctggtggctgtcccactgcatccgcgaggagcgtgagcactgcgcggatgacctggccgtccagtgctgcggggatgcgctgctctacgcccgcgccctggcccacatcgaggagctgcgcctggcgccatcaccccaccccgccctgggcgtcagcgatggctcgctgctgatgcgcgtgcgacggctgctgtccgcgtccgagggcatgacgccgcgcaggtcctggcggctcgccagcggactgggcagcgccgtgctcgccgtggccctggggtcgtcgcaactgccggagacggcccacgccacggagccggtgagcacgccgcccctccacgcggaggcaacccccggcaccgtgcagcgactgtccagcgccacgcccatgcaccatctgctcgtggccccggcgaccttctccgcccagaccccgcaggcccccgcgcccatcgagcgcccgaaggcggcggcgaaggcggagcgagcacccgcggcgaagccccgtcccacgcggcccgcccccctcctcatcccagacatggggacgattgcccgcacggagctgtcgcgcgtgccctactcgctcgacggtgagcccgccgcgcccgtcctgctcgaggacacctccctggagtcgcccgacgccaccctggccgaggccgcctccgcgcacgccgacgagcacgccgccgagctgccccgagtggtcgtctccgcgccggcaccctcgcgcgcttccgcgttcgacgccgtctacaaggccatgaaggcgccggctcccgtcaagacgctccggcccggaatcaccccgccccggttcctctcgggcgagcgcatccaccttcccagtatcgtctacgggattcagtcccacttcggaggcttccccaagggcgcggtggtggcccgctgcatcatcaccacgcagggctccgtcaccgactgccagcccatccagggcctgcggggcctggaggaaggcgtcatccgcacgctctccacctggcgctacgagcccgccacgctcaacgggaagcccgtggccgtgcgctacgtattcgacgtctggttcacgaaggagccgggcggcggaacgcacgaatcccggcacttcgcgggcctcgacctctccgatgtggtgggcgccgcggccccagggacgtgcgacgactgcgacaccttcgagttccacagcccgacggcgcgccggtag

SEQ ID NO: 3124 - DNA, 681 bp, Myxococcus xanthus
atgcgagagcccgaattccaggaccgctatgagggaggccgcgtgctcgcggaccacctgcggcgccatgcgcggcaacccggcaccctggtactggcgctgccacgtggcggcgtgcccgtgggcgccgaagtcgcacggaagctcggagtgccgctcgatgtcttcctggtccgcaagctgggcacgcccggccacgaggagctggccatgggcgccatcgcctccgggggcgtgcgggtgctcaaccgcgaggtcgtgaacgagctgaacatcggccgcgaacagattgaagccgcggcccgccgcgaggccgtggagctccagcggcgtgaagagagctaccgggaaggccggccgccccccaacgtgcgtgggcgcaccgtcctcctggtggatgacgggctggccactggaacgacgatgcgggcggccgtggcggcgctgcggctcctggagcccgcggccatcatcgtggccgtgcccgtggccgcggccgagtcctgcgaaagcctggcccaggtggcggacgaggtcatctgcgtccgcatgcccgagcccttctattccgtgggcctgtggtaccgcgatttcgcgcagacggaggacgacgaggtgcgcgccctgctcgccgaggcaacccgggaaggggctgccagcgaagcacagccctccgcctga

SEQ ID NO: 3125 - DNA, 1424 bp, Myxococcus xanthus
atggacgtgacgcccgtgggcttcgccttcttcgaccgcgagctgcgctacgttcacatcaacacggccctggcggcgatgcatggcctgcccacggagcggcacctgggccggcacgtcaccgaggtgatgcccgacctgggcaagctcatcgctccgcgcctccaactggcgctcagcacgggggcctccatccaggacaccctgctccaggtggagacgcccgccgcgccgggcgaaagccgcttctggttcggcagctatctgcgcgtgtgcggcgcgaacggcgaggtgctgggcgtcatcgccgcgatgtccgagctcaccgagcgcatgcgcgcggaggagagcctccaggagcacgagggccggctggacgtgctgacgcgctcgctgccggactacctgtggggcggcaagctgcgcggcgggaggctgcgcgatttctactgcacgcccgtcatcgagcgcaccaccggctatgccgcctccgcgttcgtccagcccgcaccggatggcggaccgccgccgctgtgggcggagatgatccaccccgaggaccgcgcccgctaccgggccagcatcgagggcctggcccccggcgccgaggcggagctggagcaccggctcatctgcgccgacggccgcgtgcgttgggtgcgcagccgcgccgccgcttccgcgttggatgcgcaggcggagctgcatgtcggctgtgtcgtcaccgacatcaccgaccggcggctcgcggatgacctgcgccagcgcctgcatgacagcttccgccgctccgcccaggaatggcgccgcaccttcgacgcggtggcctcgccgctgatggtgttgggggcggatggcaccgtccagcgtctcaacgccgccgccatcgcgctcttcggaggcatggacccgtccggccagccgctgttcaccgcggccagtgccccaccctggtcgcacgcactgccgttggtggaggaactgcgccgcacccgcgccagcgccacccgcgagctgggcgacccggtgtcgcgccgcacgtgggaggtgtccgccacctgggtggaggaagccggcggcgaggactcgcgcatcatcctggtggccacggaggtgacacgtctcctggagctccaggccagcctgcggcgcagtgagacgatggccgccatgggcgccatcgtcgcgggcgtggcccacgaggtccgcaaccccctcttctccatctccgcggtggtcgacgcggtggaggccaccttcggcgcgcgcgcggagctcaagccctacgtcgacgtgctgcgcggcgaggtgaagcgcctcaaccacctcacgcaggagctcttagagtactggcgccccacccgcggagaatgggtggaaggtcccgtgctcccggtgatgatggatgcactctccgcatgtgc

SEQ ID NO: 3126 - DNA, 786 bp, Myxococcus xanthus
atgaagccttgcgcgccgcaggagctgctgctgacgctggagcaagcgatgcggcaggtgcgcctgcacgcggagaagcgcgagctggcgcggcgcgcccaggtgacggagaagctggcggcggtggggacgatgacggcgggcctgtcccacgaaatccgcaatccactgaacgcggcggcgctccagctctccgtcctcgagcggcgtctacggcgtcttccggatggacagcaggcgcccttgctggagccgctgctgttggtgcgcgatgagattcgccgcctggatcacatcctggaggacttcctccagttcgcgaggccacgcgagttccgtcccgcctccgtggacgtgaacgagatgctgcggcgggtggtggatctgctgagcgggcaggccgcgtcccgcaaggtgtcgctggaagtcacgccacgcgaggcgccggtgccgtcggtggcgggcgaggaggagcggctgcgtcaggtgctcatcaacctgtgcctcaacgcgctggaggccacgccagcgggaggcaccgtgacgctgtctgcggggcacgagggcgggcgcgtgtggctcaccgtggacgacagcggcccgggtgttccccaggaggcccgggaccgcatcttcgagcccttcttcaccacgaaggctcagggctcggggctggggctgtccatcgtccatgccatcgtcacgcagcatggtggttcgctggaggtggacaccgcgcccggtgggggcgctcgtttcatcctccggatgccgctggcggggtag

SEQ ID NO: 3127 - DNA, 714 bp, Myxococcus xanthus
atgcgccagtacctcctgttggatgacaacgtggcgttcgcggagaacctcgcggagattctgcgcgacggcggggacgcggccactgtcgtcacgagcggtgacgaggccgtgcggttggcgcgcaccacgcgcttcgacgtcctgctgaccgacatgcgcatgcccggcatgagcggcgcggatgccgtgcaccacctccgccgcgtggacccgggcctggccgcggtggtcatcaccgcgcacccacgccaggatgacttggagacggcccggcgcgaaggtctgctcgcggtgctgcccaagcccgtgcccatccccacgttggtggagctgctgtccggtgctcgccgggatgggttggtggtgctggtggaggacgacccggcgctgagcgacaacatcgccgagctgctgcgcgggcgcggcttctcctgtgtgacggcggcctcggtgctggacgcggaccgaatcctctgcgtgcagcccttcgccgcgctggtggacctgcgcgttcccggtgggccggatggtgaggccctgcgacggctgcgcgcgcgctatcctcacctgcccacgttcgtcatgacggcctatacagatgcggccccgcttgacggtaccacgggagtcttctccaaaccattcaacccaggcgcgctgatggaggtgctggaaacggcgcacgcggcacgtcccacccacgccttatga

SEQ ID NO: 3128 - DNA, 1191 bp, Myxococcus xanthus
atggcggaaaccttgttcgaggaattgaagcggtacgtggggttcagctcggcggacgagcaggctctcgtgaccttgcatgccaccgcgaagccccacttcgcgcgcttcgctcgcgtcttctacgaccgcatcctggagcacgaaggggctcggcaggcgcttgaagggggcgagagccaggtgggccacctgcgcggcaccctgcaggtgtggatggaccagctcctccgcggcccctgggacgaggtctactacgcgctgcgctgccgcattggccgcatgcacgtgcgcatcgccctgccgcagcactacatgttcggcgcgatgaacatcctgcggcaggagttcaacagccacatcgacgccacctacctggaagagcccgcggcgctccgcgcggcccgctccgcggtggggaagattctcgacctggagctggccatcatgctccacacgtaccgggaagatctgctggcgcagcaggcgcgcagtgagcggctgtccacctttggccaactggtgggttccatcggccacgagctgcgcaatccgctgggcgtcatcgagacgtcgctctacatcctccgggggcgcccgggggccatggacgagcgcacgacgaagcacctggaccgcattggcgaccaggtgggcatcgccaaccgcatcgtctccgacctgctggacatgattcgggaccggcccctgcaccggcaggaggtctggttggacgaggtctggcaggaagcgctcaaggccgtgcagcggcccgacgctgtcgtcgtgagcgcggagggactgacctcattgcccgcggttcaaggagacgcggggcagctgcgccaggtgttcgtgaacctgctcgacaacgccgtccaggccctggaggagacgggcgggacggtgtcactgtccgctgccacgcgcgagccggagatggtggagctggtgctggaggattccgggccgggcgtcagcgacgtcatccgccgccgcctcttcgagccgctgatgacgacgaaggcgcgcggcatcgggctcgggctcgcgctggtcaagcgcatcgtggagcggcatggggggagcatcgcgtatgtcccccgtcccggcgcgggagcgcgcttcgtgattcggctttccctcgtcgcttcggaggagacgcatgcgccagtacctcctgttggatga

SEQ ID NO: 3129 - DNA, 891 bp, Myxococcus xanthus
atgcgactcgacctcgcggatcttcgcttgttcctctgcatcgtggatgcggggagcatcacgcaaggtgcccaacgcgcgaacctgacgctggcatccgcgagcgagcgcctgcgaagcatcgaggatgcggtgggcgtcaagctgctcgagaggcggcctcggggcgtggtgacgaccgaggccggtgacgcactcgtgcaccacgctcggttgatcctgcatcaacaggagctgttgaaggatgagttgaatgcgtttgtttcaggccggcgcggcaccattcgcctctatgccaacaccgcggcgctgaccgagtacctgcccgagaagctggcgccatggcttgccaggcacccgaggctgaacatcgacctgagagagcgaaccagcgcggatatcgtcaaggcggtcgaggcaggcctggcggaggccggactgatttcggacgccgtggagacgggcacgcttcaagtccgcccgttggagcccgcccccctggtgctcatcatccccgccgggcacccgctggctgcatccaagagcctcgcgctccgcgatgtgtatcgggagcccttcgtcggcctcgcggccgagagcgccttgcaggagcacattgatgggcacgcacgtcgcgcgggattcgacgtgtccttccgcgtccggatgaagggcttccgggggctgtgcgagatggtgtctcacggcgtgggcctgggcatcgtcccggagcgcgtcgccaatcggcatcagcgggagggcacctatcggaaggtgcccctttcggaggcctgggcccagcgtcggctctgtgtctgtttccaggactgggacggcctgtcatctcctgttcgtgcgttgctggagtacctgctcggtggaggggaatga

SEQ ID NO: 3130 - DNA, 579 bp, Myxococcus xanthus
atgctgggcacgcgggccttcacgaacctggggctgcggcggctcacggggatgggcgcgggacggcgggccatcacccttcacaaggacatcaacgtgaacgcgccggtggaggaggtgttcgccttctggagggagatgcagaacttcccccggttcatgacacacgtggatgaagtgattccgggcgtcgagggccgctcgcactggaaggtgcgcgggcccgcggggctgcacttcgaatgggaggccgtcgtcacgaagttcgtgcccaacaaggtgctggcctggaagagcgtggagggcacggcggtggagaacctgggcgtcatccacttcgagtccacgccgcgaggcggcactcgggtggacatccggctgtcctacaacccgccagcgggggccattggccatgccttcgcgaagctgctgggcgcggacccgaagaagcagatggatgacgacctgctgcgcttcaagtcgctgctggagcggggaagggccaccggccgtgagacggtgacgcgcgagcagatcgcgccccgacgtatgtcgtcccggggccccctcactcactag

SEQ ID NO: 3131 - DNA, 915 bp, Myxococcus xanthus
atgccctacggcaccttcctggtccagcgctgcttcgtggagctgccccgcctcatcgaggccctggagcacaaggcgcgcgagtccctgttcgactgctacgcctgggagtccggcgaggtggggttcacccctggcctgccgccctcagcccgggcgattgggctcaagctgtcgctgtccaccctgcaccgtgacgcggtgtcgcggcagcgcgagtggagcatgttccgcgacatcttccctcggatggacacgacgttccgcgtcttccgcgagttcgccgtggagacgtattcggaggaagaggacgtcctgctggacctggcggcgagcggcgccacgctgggagagctgctggcgagcgcccgggaggccccgctcttcgccgcgcgctgggtgcttcacctgtaccggcggggggccctggccccgcgcaaggccctcggcccccgattgggtgaagccgccgagttggaggagctgctcacactggtgaagcgcttcctggaagccggccagtatgaccatgccgtcgccctggccgcgcaaatcctggagcaaggccccgtccccgaagcccacgccctgtaccgcgaggcggagatccgcctgacgctggccctcagtgacgagctcttcgcgctcgacgggcgcctggtgttcgagccgattccgcgccccaccccgcccgacctgacggcggatgacctgtacctgtactcgaagctgcgcggcagccgaagcatccggcaggccctgcgcacagcggccatgggcgagctcgccgcgtcccgctccgtgcaccgactgatggcgtccgggctgattcgcgtagccccgctgccagggagcggaccccgacgggcccacacggacccgttcggcctccccatccacggcgtggggagctga

SEQ ID NO: 3132 - DNA, 1497 bp, Myxococcus xanthus
atgcgagtcctgcctgcgcgcctcggcgccatcctgttgacgttcctgccactcattgccctggccgatgcgcctcgcgatcgcttcggggccgcgggttacttccgcatcatgacccgcccggacttcgcgggcggctcgggccaactgggctattactggctctacggtcggctcctcaacgaaagcccttacggtgagctcaacctccgtctggacgcgttgcaggccacgccggggaccgacgaggtgtgggccgaggtccactcccgtatctctggcaggtcgtttcgttcggcggaccccggtaatggctcactggtgaacttcagcgctgactacctcttcgtccgcgccggcaacatcctgctggaccgggtgacgtggcagctcggcacgctcgaggaccgctggaacgacctgcacatctatgaccagcgtcccggcacgctgctctgggacacggtgggcctgtccggcacgtaccagggcgaccgctacgacgtcctgctggcggtgggggacagcggctacacgctgcgcccgaacaactacaacacggtgctgacgggcgccgcgtcgttccgctaccggttgattcccggccacctggaggtgggtatccgcggccaggtgggctacgagcccgcggtgcgcggcaaccggaacgcgctctacgcgtcgcccgggaccagctacgagaacttcgcgcggcgcgaggtggtgcggcgctacttcgaggccaacccgggcgcggaggacctggtcccggacctcaaggcgcgcagcgcgctgtcgtaccgggccatgggctacgtgggcttcggcggggtggggccgctggtgtggagcaacctgtacctgacgttcgagaagcgccatccgcagcccttctacacggagaacttccggggccgggactggaccgtgtacgtcacggaccagaccgacgagcgctacgacggcaacctcggcaacgaggcctacctgcgcatcatccccgacaagctggaggcgctctggggcgtgtgggctggctactcgttcaacaaggacaacaagatcgccgcgggtgaggacaaccgcgtcatcgcctccacggtgctccgtctccagtacttcctcaccgacaaggttcacctcctggtggagagcaccgtcgcgcgcgagaagagcctgaacggcaatctctaccgcaaccatgtggactcggtgttcaccagcaccgacggcatggcggacgcgcgcggcctggagttcggtgacagcgacacgcgcgacacctggcagttcaaggccggtgtggtgctcaaccccacgggccgcagcatctacgcgcgccccagtctgcggctgctgtacgggctccagcgctccacccaacatgcggcgttcggcaactccttcgtggacagcctggaccagtacaacgtttacgtcggccccgagcgtcactggcactcggtggtcgcgatcgaggccgaaggatggttctga

SEQ ID NO: 3133 - DNA, 729 bp, Myxococcus xanthus
tggctccgggtgttggccccgatgctcgtctcaatgggggggcttgtcgcactccggctgctcgggccggacttcgtcgaccagcagcgcctcgccagttggttggagcccttcgggaagtgggcgcctattgcatacatcggcttccttgccatccggcccgtgacactgcttccgggtcagctgctgacggccgtgggcgggatgatgtttggcacgctcgcagcgaccctctattcactaacgggcggcttgctgtcgggcctgctgcttttcgcggcggcgcgcaagttgggcaccgggctcatgaagcgcctggctggcagcaagtaccccgcactggtgcgggcggcgaggcggcatgacttcctcttcgccttcaccgcctgcatcaatccgctgtgccccaccgacgtgatgctggcggcggcggcggcgagcggagcgcggctgacgcccacgctggccggcgccttgattggcacccttcctggcaccttcctcacggcgcagctcggcagtggtctggcccagggccgcacgacgatgacggcggtcgccgccgcgggcctggtggtgtcgctggtgctcggcgcctacatcgggcggcgcttctacaaggagctcaacgaagacgcgccggagccacagccacgcgcggagccgccgccgcccgcgcgacgccccatccgtcattccgaagagacggccaagcccgcggcggtctag

SEQ ID NO: 3134 - DNA, 423 bp, Myxococcus xanthus
atgaacaacgacgtgcgcgtggggaaggaatccatccgcgcgtactacgatgagatgatgcgcgggccgaatcgcgtcgtggaccgcatccaggcgaagttcgaggtggatgacctgacccgcctgtacggcgacaccggcatcgcgcgcggctcgtcgcgggaccactacgtcctcacggacggcacggacatcgtcatcgacggccggtggacctgcaccctggtccgggagggcgaccgctggcggatcgccgcgttccactactccaccaacgtcttcgacaatcccctcctcacgcgggtgaagcacctcgcgctcgcgggagcgacggtcatcggacttggcgcgctcgtggcgggcgcggccatcggccggaggctgcggcgccgaagccccgggcccacccctcacgcgccctga

SEQ ID NO: 3135 - DNA, 870 bp, Myxococcus xanthus
tggatgccggacctgggcatcgacttcgcgctgcggctggacggcctgtccctgctgatggcgctgctcatcaccggactgggcacgctcgtggtcatctacgcggggcgctacctggtccaccatgaggtgttgggccgcttctacggatggctcctgctcttcatgggcgggatgctgggcatcgtcctcgccgacaacacgctcctgctcttcgtctgctgggaggtgacgaccttcagctcgttcatcctcatcggcttcgagcacaaggaagacgccgcccgagaatccgcgcagcgggccctgctcatcaccgcgctgggcggacagtccctgctggtgggcctgctcctgatgggcgacgtggtgggcacgctgtccatctccggcaccatcgccgcctcggacaccgtgcgcgacagcccccgctacctggccatcctcctgctggtgctgggcggcgccttcaccaaatcagcgcagatgccgttccacacctggctgccgggcgcgatgacagcgcccacgcccgtgagcgcgtacctccactccgccaccatggtgaaggctggcgtcttcctgctggcgcggctgtcgcctgtcctgggaggcacacccccgtgggaaaccatcctcaccatcgtgggcacgatgacgatggtgctgggcgccctgctggcgctggggcacacggacctcaaactggtgctcgcgtacgcgacggtgagtgtcctgggggccttggtgatgttgctggggcagggcaccgcggtctccatccaggccatggtgacgttcctcaccgcgcatgcgctctacaagggcacgttgttcctggtggcggggtcggtggaccactagacgggc

SEQ ID NO: 3136 - DNA, 492 bp, Myxococcus xanthus
ctgtccacggaccgcatccgcaccgtcatcgagagcgtgctcttcgtggcggagcggccgctgtcggtggacgagctgtacatggccaccggcatcgagcgggagctcatcgccgaggccctcaaccaactctccggcattcaccgcgacggcatcagcggcatcgtgctgtatgaggtggcgggcgggtggcagttccggacggacccgcattcgggtgaatatgtccggcgttacctgcgggtgaagccacagcggctgacccgggcggcggtggagacgctggccatcatcgcgtaccggcagccggtgacccggccagaaatcgaggacatccccggcgtggactgcggcgcggtcatcaaggcgttgatggaccgcaagctggtgaagatcctgggcaagcgtgaagaagtagggcggcccatcctctatgggacgtcgcgcgagttcctggagttcttcgcactgaaggacctgtcggccctgccc

SEQ ID NO: 3137 - DNA, 789 bp, Myxococcus xanthus
atcgcgttgcccaatttcgaaggtccgctggacctgctgctccatctcatcaaggagcatcgggtcgacatcttcgacattccgctggcgctgattacggagaagtacctcgagcacctggagcggatgcgggagatcaacctcgacatcgccggggagttcctggtgatggcctccaccctggcgcacctcaagagccgcatgctgctgccccggcaggacgtcgcctcggcgcaggagggggcggaggtgctcgcggtcgccgaggagaccgaggacccacgcgcggaactggtgcggcgcctgctggagtaccagaagtacaaggacgccgctgaacagctcgccacgcaggacctgctcggccgcgacgtcttcgcccgcaacgtcccggtggaggcggtgcccatccccgaggaggaggtgggcctccaggagttcagcgtcctcaagctggtggaggcgctcgaccgggtgctggagcggttgcagcccaaactgcagcacgaggtggtccgggagcgcgtgacgctgtccgaggccatcctccgcgtagtagagcgcctgcgcccgcatggacaggttctgttcgagagcttgttcacggaagaggaaaccccgtcgcgacaggaggtggtcatcaccttcctggccatcctggagatggtgaagcggcggctcatccgggtggtgcaggacgagccgctggggcccatcttgctgctgcccaacggggacgcgctggagaagctggctcccacggaggtcgacgacagtgactaccggtag

SEQ ID NO: 3138 - DNA, 1044 bp, Myxococcus xanthus
atgcgaattctttcaggagtgcagtcgtccggcaggctgcacatcggcaactactacggcgcgctccgccagttcgtgcagctccaggatgaaggcgaggggtactacttcatcgccaacctgcacgcgctcaccaccgtgagggatcccaaggccgcgctggcgctgacgcgcgaggccgccatggcctacctgtcgctggggttggatccgaagaaggccgtgctcttccggcagagcgacgtgcgtgaggtgctggagctgtactggattctgggcaccgtgacgccgcacgcgcacctggagcgggcccacagctacaaggacaaggtggccaagggcatcagcccggacttcggcctcttcgcctacccggtactgatggccgccgacatcctgctctacagcgcggacttcgtcccggtgggcaaggaccagattcagcacatcgagttcgcgcgcgactgggcggtgaagttcaacacccagtacgtgcccggctacgacccggccgatccggaaggcaaggagcggggccatgcgcccggcatcctcaagctgcccgcggcgcgcatccaggagaccacccagacggtgcccggcgtcgacggacagaagatgtccaagtcctacgggaacaccatcgagctcttcggggacgagaaggaaatcaagaagcggatcatgtccatcaagacggactcgacgccggtggacgcgcccaagccgctgcccacgcagtcgccgccgcccgggctcgtcagcgatgcgccgctctacgacttgctgaagctgatgcttcccgagtccgagttcgccgaggtggacgccacctggagggcgggcgggaagggctacggcgactacaagaagaagctcctggaggcctaccatgcggcctttggcccggcccgtcagcggtacgccgaactggcggccgacccgggcgaggtggagcgcatcctccaggacggcgccagccgggccagggccgaggcgagccgcctcatggaccgggtccgcaaggccgtgggagtcccatga

SEQ ID NO: 3139 - DNA, 903 bp, Myxococcus xanthus
ttcatccgcgcggagcgcggactgtccggcaagacggtggacgcctacgccgcggacatcaacgtgtacttcgaggacctgcgctcccgcggcgtctcagacgtgacgcaggcgcggcaggaggacgtgtccgcgcacctgtccgcgctgggcaagcggggcttgggcaagcgcagccaggcccgtcacctggcggccctgcgcggcttccaccggttcctcgtcgccgagcgcatggcggacaaggatccgacggaggacctggacacgccccgctcagcccggaagctgccgtcgttcctcaccctggaagaggtggagcagctcttggcggccccggacgagcgcacgtccacgggcgtgcgtgacaaggccatgctggaggtgctgtacgccaccggcctccgcgtgagtgagctgtgtgggctgggcatcaacgacgtgcagctcacggcgggctatctggtggcgaagggcaagggcgccaaggagcggctcgtcccgctggggagcgtggccatcgagaaggtccaggcatacctggcggagtcccggccggcggtgctggggcggcgcaagtcccaggcgttgttcgtcacgccacgaggctctggcttcacgcggcagggcttctggaagctgctcaagcggtacgcgctgaaggcgggcatcttgaagccgctgtctccccacaagctgcggcattcgttcgccacgcacctggtggagcgtggcgcggacctgcgcgccgtccagcagatgctggggcacgcggacctcgccacgacgcaaatctatacccacgtgaacgccgcccggctgcggtccgtgtacgacgagttccacccgcgcagcgatgtcttcgtccccaaggcgaagaaggcgcgggccgccgcgcgatag

SEQ ID NO: 3140 - DNA, 771 bp, Myxococcus xanthus
atgctgctggtgctgctcgtcggcgcgccggtggtgacgcaggtgctgggcctggcgctcatgacggcgggcctgccgctggagcgcggctgggtgttgtcggcgctgttctgctcggcggtgggactgctggtggcgcaggtgttggggctggccgcgggcgtcctgctgggctcgctgtccagtctggccacgctggtgggactgcacgccacggccgcggatgccttcgggccggagctgggtggagtggcgggcatggtggtgggcgtgtgcctggggagcgtggccgggttggcgtgtgggagcatcagcggcatcgccattggccggggcccctccgtggtgagggtccagatggcggccatcctcgccagcctgacgccgatgctgctctggagtgggacgacgaatgcgtcctacgccggcgcggtggccgccagtgcgttggtggccttcctggtgagtgcgttccggctgccgctctatgcgctggaggtgctggcgtccgcggtggcgtatgccgtggagcgctggacggggcggcccacgctgggctgggtgccggtgcgtcaccacaacctcagctatctgccgcatcccttcctggggcggcatctggcgctggcggtgcgctcgcggccggcggaggtgctggcggtggcggatgcctgcctgcgctcgccggggaacatcgtggtgggctggccgtgggtggtgcaggcgctggagtcggcgtcaccggagggggcgagggagccccgggcctga

SEQ ID NO: 3141 - DNA, 612 bp, Myxococcus xanthus
atggccgcacccatcctcgaggtggacacggagcacccatcaccccgccacatccagcgagcggtggaggtgctggagcgcggcggcctgctggcctacccgacggacacgtacttcgggctcggctgcgacttgagctccaagaagggcatcgagcggctgtaccagctcaagggacgcgacaagaagaagcccctgtcctttctctgccccgacctgtcggacgtggcgcgctacgcgcacgtgagcaacttcgcgtaccggaccatgaagagcctcactccgggtgcgttcaccttcatcctggaagcgacgcgtctggtgccggacctgatgatgtccaagcagaagcaggtgggcatccgggtgccggactccgcgctcgttcgcgagctgacccgagccctgggccgccctctggtgacgacctccgcgaccaatacggagggtgagcccctcacggacgcaaaggatatcaaggccgatctgggacacggcctggacctcatccttgacgggggcgtgacgctcaatgaaccgtcgaccgtgatttcactcatcggcgattcacttgaaatcctccggcaggggaagggtaggctggaggactag

SEQ ID NO: 3142 - DNA, 1299 bp, Myxococcus xanthus
atgacgggcgcggtcatccggctgctgctgttgatggtgctcctggccatcatcagccgggcacaggtgctccgggcggactcgggaacaccggtgatgctggcggcgggcgcgctgctgttgtgcggcctgttcgcgggaaaggtggccaagggcctgggcctgcctcgcctcaccggttacctgctggtgggcgtggcggtggggccctatgcactgggcttcatcccgaacgcgggcgtgaaggggctggagctggtgaaggggctggcggtgagcctcatcgcgctggtggccggcacggagctccggttggggctcatccgccgcgtgggcgcgcgcgtggccttgctgtgcgcggccgtgtgcggcgtcaccttcctggtgtgcttcggggccaccttcgcgctcaagcccctgctgcccttcctggcggacatgacggtgccccaggcgctggcggtcagcgcgctgctgtccacggtggtggtgtcattctcgcccaccgtcaccatcgccatcgtccaggagacgagcgcgcgcggcgccttcacggagttcctgatggcgctggtcatcatcggcgacttgctggtgatggtggccttcgcgctggccgcgggcctgacgaaggcgagcttcggcggcgggctggacgtgacggagctgctgggcggggtggggtgggagctgttcggctcggtggtggtggggctggtgctggccgtgggcatgctcgtctacatgcgcggcgtgaagcaggagctgccgctgttcctggtgggcctgtgcttcgccgcggcggaagggggcacgcgcctgcacctgtccccgctgttggtgtcgctggcggcgggggcgctcatcgcgaacctggatgagcacgcgggcgagcgcatccacaacgccatccaacaggcggggctgccagtgttcgcgctcttcttcgccgcggcgggcgcggggctgaagctggactccctgctgacggtggggccggcggcgatgttgctggtcgcgctgcgcggcgtggccatctggctctcctgccgccgcttcgccccagcggacgacccgcggctcaagcgctacctgtggatgggactcatctcccaggcgggcgtgacgtttggcctggcggccctggtgtccaggacatttccgacctttggcccccaggtggaggtgctcatcgtcgccatgattaccgcccacgagctggtggggccggtcctcacccggcgcgccttggcggcctccggggagatccgcgcggacgacgcgcagggaacggcatag

SEQ ID NO: 3143 - DNA, 1933 bp, Myxococcus xanthus
atggcgcccaccgtcgtcacccaggactacggcgcggcgcttcagttcgaccagcagcgcgaggacgatgcacagttggaggtggccacgcagatcgccgggcaggcgggcgcgctgttcgactccttccttgcctcgcccttcctggtgccggacacggacggtggtccgggcacggtgccgggtctcgacgcgccggccggaccgggcatcgagccgggcacgggcacgccggccgtgcccgagccctaccggggttcgtgggagccgccggcgggagacgcggtctacttcgtgatggtggaccgcttctccaatggagacccgaagaacgacggtgcagtggacctggaggacgcgcaggcctttcacggcggagacctgcaaggcgtcattgaccgactggacgggctgcagcagctcggtgtccgcacggtgtggctttcacccgtcttccagatgcgcaccgacaagttccatgggtacggcgccttccacggtaactgggtggagggtttcggccgggtatagccgcgcttcgtacagtaggccctgttgaagactctgccgtggcagttgtgctgctgggacatgcgggtggttctgtacgtggtgctcaactcacgtggggccatggacgagcctgtcgcgtgagctgcctgattggttctacgccgtgggtcccatcaaggactggggcgattcacgccagttggtcatgggatatgtgcacggccttccggacctctctagtggagaaggaagatgtgtacgcgcacctgctggcgcattcgcgccggtgggtggacgtgctccagcccgcgggcttccggctggacgcggtgaagcacatgcccacctccttctgggctcgctacaacgcgacttgcgccagcacgcggggccggacttcctgctgttgggggagatgctggacggcgacccggtgctgctgtcgaacacgatgaaggaaggccgcttcgggacgatgttcgacttcccgctggccttcgcgctggtggacgtcttttgcagggaccgctccccgtcgcacctgggcgccatcctcttcaacgaccggctatacccggcgccgggctcgctcgtgacgatggtggacaaccacgacctgccccgggtgatgagcgagtgcggtggtgacgtggagcgggtgaagcgggcgctggcggtgcagctcaccgcgcgcggcgtgccggcgctcacctacggcaccgaggagggcctgacgggcgcgaaggagccggagaaccggggggatatgcgcttcacgaaccacccgctgcggtcgtggattggcgggttgctggcgttgcgtcgaggcagtgcggccctccagcgtggcgagacgatgattctcgccgcccgggaggacctctttgcctacgcccgcgtcaccgccgacgaggttgtcgtcatcgccgtgaatacccgtgacagcgccgtggacgtgccgctgcccgacgggctggccggcgcgaagctggagccgctggccctggcgccgccgctggccgccgggggcgcgggcttcatgcgcgtgcccgccggcgaggtggccctggcgcggctgacgcctccggcggcgggcggcttcgccacggcggcgaagctcgcgggtctgcggtggcgggggctgggcacgcggcgccaggtggagctggccgtgggggacccgtcggtgcggttggtgggcagcgggccggagatgggcgggtggaagcccgagcgctcgcttcgtccagggcccgagggcttcgcgctgtcgctgccagtgggcgccgtcttcgagtacaagctcttgcgcggcggctcccagggctcttttgactgggaggacggcgccaatcgtctgctgttcgtggacgaaggcaccgggccgctgcgccagacgctggcgtggagccagcgctga

SEQ ID NO: 3144 - DNA, 1035 bp, Myxococcus xanthus
atgcgcccggtgatggcgctggggttgggcaccgcgggcgtgctgctgggcctgaacctggagccccggctgctgcgcctgttgccgcggtccgtctacctgtcggggctggcgcactccggaacagccttcttcttcgtcgcgctgccattgctggtgccgctcgtcttcacgtccgcccgggggctgctcggcgcggtgggcgcggcggcgatgttgggggcggcggccagtctttcttcggggcactcggccgtgctcgcatggcgcgcggggcgcctggaccgggcgcgcggcctgggcgtggcgctgctcaccatgctggatgacgcggtgggtctgggcgtgctggcgctggcgttgatgatcggcgccgccagcaacgtgggcgaaggcctggggctggtgtgtctggccttgctgctgggcgtcatgtgtggggcgctgctggccttcctcacgcattcgttgaaggacctggcggagctgaccacggtgacgctgggcggcgtggtgttggtgagcggcgcggcggcgtacctgcgggtgtcgcccttgctggcgggcgtggcgtgtggggcgacgctggcggtggtgggaggccgcacctcggagcgcgtggcgcgcgcgttgggccgggtggagcggcccgtgttcctggtgctcgtgttcctcgtgggctgcgcggtgcatgcgcgggactactgggcctgggtgctgatgcccgccttcgtgggcctgcgcttcctggggaagatgctgggcggccggttcgcgcggcggctggtgcagcagacgctcgtgttgccaccccggctgggctacgcgctgatcgcccagggcggtctggcgctgtgcctggtggcggagtacgggatgctcgtgccgggagggctgtcgcggcgcgtgctggacgtggtggtgatgggcgcggtggtgaacgagctgctggcgggccaggccttccagtacgtggtggacccgccccgcagcatttccgagaacccggctgacagcgacaaggtggcggcatga

SEQ ID NO: 3145 - DNA, 111 bp, Myxococcus xanthus
atggaacggttggtgcagcgcgtccaactggaaatggacgcggacgagccgcccatgggacggctggtcgccatgccagtgatttccgcgcccacgcatcgccggtcgtga

SEQ ID NO: 3146 - DNA, 462 bp, Myxococcus xanthus
atgtcggacaaggacaacaagggcagcatgacggtggccgaagcgggccggaagggtggcgagacggtccggaacgaacgcggtcgcgagttctacgagacgatcggccgcaagggcggcgccacggtgaaggccgagcgcggtcgctccttctacgaggagattggccgcaagggcggcgagacggtgaaggccgagcgcggcgccaagttctacgaggagatcggcaagaagggtggcgacagggtgaaggccacccgggggccgaacttctacgaggagattggccgcaagggtgggcagaaggtgaagaagctcatcgaagagggcaagcgggccgcgcgggccgccatggcggcgcaggagggcgcggcaggtgctccgccccaggagggtgcggcgccggcgccatccacccccccttcttccggagagccggcggggccggtccagaacgagtag

SEQ ID NO: 3147 - DNA, 795 bp, Myxococcus xanthus
atggcccagcactcctaccgggcgctgaatgacatctgggtgaacatccgcgaggcggacctctaccggaagctgccgtggccgctcatcgacctgctcgtgggcctgttccgcaaactggggctgtacgacaacacgcccatgcgggagctgatccagcggcacctcgtccgacaccgctttcgggtgcccgcccacgtggggcgcgtgtccctggtctctggcaactacgagctggtgcccagcgactcgagggacttcctggacgccgtctggcagagctcgacgttgcccatcctctgggagccggtgggcgcgacggccctggtcgacggcggactgcgcaacgccacgcccctgggggatgcgctggagttcggcccgacggaaatcgtcgtcatcgtctgctcaccatcccaggtcgaacgggcgaagccgccggccaatctcctggaggtggccacgcgcagcctcgccgacatcaccctcaacgaaatcttgctcaatgacgtggatgccttcgtgcgcatcaacgacatcgtccgtcaggcctacgacgcggggctcaccgtgcggcgtccggatggggtgccctaccggtactgtcgcatcaccgtcatcgagcccgcacggcccatgggggacatgttggacttcgcgccggaggtgatccggatgcggctgcgacacggtgaggagatggcccgggccgtctcactgcccacgggcgtgggcccaggggagcgcgtgcagcgccgcgtggagctcttcccggagccccccatgcatgcctag

SEQ ID NO: 3148 - DNA, 1437 bp, Myxococcus xanthus
atggccacgggcttcgccctgttcttcgtggcggtctacggcggcgcgagctggctcacgggcttctacaccgggggcctccgggtggagctgtccttcgagcgccacatcccgttcatgccgccctgggcgctggtctacgtcagcatggacgtgctgctcctgctgtccctcttcgtcttccggacgtggcgggacatggtgcccttcgcgctggcgctgtgtgtggagacagcgctcgcggccgtgtgcttcctcctcttcccggtggaggtggcctggccgccgcgcgccgtggagggggcctgggcgggcgtcttccaactggcggacacgctgaacctggagcggaactacctgccgtccctccacgtggccttcgcgtgcacggcggccctggcctacgcggagcgggccggcgtgctggggcgtatcctcttcggcctgtgggcgctggccatcgcggcgtcgacgttgctcatccacgagcaccacgtggtggacgtggtcgcgggggcgttgctggcctggggcacctggcggtgggtggctccctgggcgcgccgcacggcgttcctcgaggccctgcgagtcgaagccttgtgcgcccgggagtcctatcgcttcgcgcggcgtcacctgcgttacgggctgattgccctggtgctctaccgctacgcggtgagccggtggtggcgcgaggctcggggggcgcgggtgggcttctgtttcctccaactggtggacgacgtgctggatggggaccgcgcggtggacggagagccgctcgactgggtggacgcgctcctctgggagctggagtccgggcgaggggaggaccgggggacggcggccacgctggggcgcgtgctgctcgagcagttgggagacgacacggcccgcgcccaggtcttcgcgctggtgcggacgatgcgcaaggaccgggagcgggtgaaggccggacagtggtggagcgcggaggcgcttcgcgcgcagcaacgcgacacgttctgcttgtcggtggatttgatgctgcacgtcgccggggcgggcgtccgggccgaggacgcgcccgcgctgatggaggccttcggctggtgctcggtgatgcgggacctgcgagaggacctggcccaggggctctacaacgttccggaagaggtcgcggcggctgtccgtggcgacggcgcggatccgacggacatcgacgcgctgctgggaacggaggcgggccgcgcatggatgacggcggagcacgtccgggccagggcgttgctggatggcacagccggccagttggcggcgctggagggccgtccggggctggcgttgctgcgcctcttccaccgctccatcgagtcgttctggcgcaagcgccttccccggcgccatcccttcctggccgaggtgacggcccgccggcttcagggcgcgtga

SEQ ID NO: 3149 - DNA, 924 bp, Myxococcus xanthus
atgacgacagagggtgagggcgtgggaactccgattccagccgcgctcaacgccgtgctcctggtctgcgccatggcggcctgtgccggatgcttgtggctggcgtcacacgcggagcggctcgcgatccaggcactggccgcggtggtcttctcgttcgtcaacaacaccgtgttctcgctgctgcatgaggccacgcacggcgtgctgcaccccgtgcggtgggtgaacgacacgctgggccggttcgccgcggcgttcttccccacgtccttcacgatgcagcgcgccttccacctgaatcaccaccgccacaaccggacgcacctggagcagttcgactacttccggcccggagacaaccgcttcctgaagcgggcgcagtggtactccatcctcaccgggctctactggctgttcgtcccggtgggggcggtggtcttcgcgctcgttcccggattgctgcaccggcttcgcggcacgggcacccggtacggcgagcagacgggcgcggacgcgtacctcggacgcctggaagccgcttccggaggtgccatccgcgcggaggtgctgctggcggcctgtgtgcaggccgggctcgtggtggcgctggatgtgtccgcgatggggtgggggctctgctacgcggccttcgccgtcaactggagcgcgctccagtacgcggaccatgcgtggtcaccgctgcatgtccgtgacggcgcgtgggacctgcgcgtggccgctccggtgcggtggctgttcctcaactaccactatcaccgggcccatcaccggcacccgcacgtgccctggctctacctggggcgctacgtggacccggaggtggcgcgaccgtccttcctgcgcatctggctgtccatgtggcgaggccctcggccactgcccgccgcgatggaggagtga

SEQ ID NO: 3150 - DNA, 900 bp, Myxococcus xanthus
cgcgcgtggcacctcgtgtgcccctccgaagcgcttcggcccgggcaggtgatgcgttggagcacgggcacacgggagctggttctcttccggggacggagcggcgcggtccacgcgctcgccgcccattgtccccacatgggcgcgcacctgggtggtggcaccgtggtgggggattcgctgcggtgtccactccaccactggcagttcgacggcagtggcgcctgcccagggaagacggcacagcgggccttccccgtggtggagcggtacggcgccatcctggtcttcaatggcccggtggtgctcttccctccgccggaggtgggcagcggcgcgttgcgctggggcacgtcggctcgcttcgcggtgcattgtgactggctgcccgtggtggccaatgccttcgacttggagcacctgcgcacggtgcaccatcgtgagctgcgggacgcgccagtggtggagcgcccggacccgttcaccttgcgcgtgcggtacacgtcccgcgtcacgggcagcgggctcagtgaccgggtgatgaagttcctgtccggcgatcgcatcggtgtcacgctcacgttgcatggcggaacgctcctgtccgtggagagcgacctgggacgcacgcgcagcgcgttgctcgcgggccttcatcagagcgaggaggggttgttcgtgcggctcgccttcgccgcgcgccgcagccggcttccgggcgtggactggttggcgctccaggtgtcgcggtggctgttcacgtcgttcctgcggcgcgacctgtccgtgctcgacgggatgcgcttcaaccgggcgggggcggcggcggacccggtgctgcgccaggtgctcgacttcaccgacagcctgccggaggcgcccgatgacgacagagggtga

SEQ ID NO: 3151 - DNA, 1795 bp, Myxococcus xanthus
atgagcaccaccgtctccgattacctgctccaccgcctgtcccagtggggcgtccgccgcatctatggctatcccggtgacggcatcaacggcatcctcggcgcgctcgggcgcacgttggagttccgcttcgagcacacgcgccatgaatatatgtccgcgttcatggcctgtgcgcacgcaaagttcaccggcgaaccgggcgtgtgtctggccatcgtcggggcccggggccatccatctgctcaatggcctctatgacgccaagctggaccaccagccggtggtggccatcgtcggacagcagacgcgctcagcgctgggcggccacttccagcaggaggtggatctgatgtccctcttcaaggacgtgcccagcgaatacctcacgatggtgaccagcccctccgccatccgccacgcggtggaccgggcgatgcgcgtcgccatctacgagcgcaccgtgacgtgcgtcatcatccccaacgacgtccaggaagaggcctaccacaagcctccgcacgcgcacggcacggtccattcaagcgtgggctacagcgtgccgcgagtgctgcctcgcgagcgggacttgcggcgggcggcggacgtgctcaacgccgggaagaaggtggccatgctggtgggcgccggagcgcaggccgcggcggacgaggtgatgcacgtggcggagttgctaggcgcgggtgtggcgaaggccctgctgggcaaggccgtgctgccggatgacgttccctatgtcaccggctccatcgggctgctgggcaccaaggcgagctgggacctgatgtcggactgcgacacgttgctgatggtgggcaccagctttccgtactcggagttcctcccgaaggagggacaggcccggggcgttcaaatcgacctcgatggccggatgctggccatccgctaccccatggaggtggcgctggtgggggacagtcaggagacattgaaggcgctgattcccatgctcgagcacaagaaggaccggagctggcgcgacagcgtggtgaagaacgtgcggcagtgggagaagacggcggaggcgctcgcgatggaccgcgcgaatcccgtcaacccccggcgcgtgttcttcgaactgtcgtcacggctgccggatggcgtcatcctgacggcggattcggggtcgggcacgagctggtacgcgcagcacctgaagatgcgcaaggggatgatggcctcgctgtccgggaacctggccagcatgggctgcggcgtgccctatgccatcggcgccaagttcgccttcccgcaccggcccgtcatcgcgctggtgggcgacggtgccatgcagatgaatggcaacgcggagctcatcaccgtggccaagtactggaaggagtggaaggacccgcgcttcatcgtcatggtcctcaacaaccgggacctcaacatggtgacgtgggagcagcgcgtgctggccggcgacccgaagctgcccgcgtcccaggacctgccggacttcccgtacgcggcctatgcggagtccctgggcttcctgggcattcgcgtggaccggccggagtcgctgggtcgcgcgtgggatgaggcactgagcgcaacccggcccgtcgtcttcaaggcctacgtggacccggacgtcccgctgctaccgccccacatcaccttcgagcaggcgaagcactatgcccaggcgctggcgaagggcgacgtggacacgggcggcatcctgaagcagtcgctcaaaggcatggtggagacactgctgccccggggcggtggcaagtcctga

SEQ ID NO: 3152 - DNA, 402 bp, Myxococcus xanthus
atgcccgttctgcgttacgccttcaccctgaatgccgtgcgtgagctcggccgtctggctccggacatcgcccgggcacgggcggaggcggccctggacacgagcctcctgcacattcgcgaagcctgcacggccgcgctgggcatggagttcgacacactgatgtgcttcgacgcgcgctccgtggtccgcctgttctcacacgcggagcaggcccgcatcctggcccggctggtggacgagcgggcacgcacgctggcgcggctgggccgcttccaggaggcgctcgaggacaccgtctacgcggggcagttgctggcgtgctcgcgccagcgcttcggcctgcccaaggatgcacgcgcggcggagacgctggagcgcgaggtgcccgagcttcgttga

SEQ ID NO: 3153 - DNA, 2115 bp, Myxococcus xanthus
atgctggagaatggcgcgaaggtcattctgacggacaaccagaaggtggcgcagttcgtcaccggtctgtcgattgctctgccggatattcctgccgcgggtcccaaggcgctcaacgcgtccgcgctggcctcggtcgtcgacgccgtggcgccgacgttccgcctggagccgggcaacctggtcttcaagaaggcgcacacggacaagcagggtgacagccactaccgctattccgtgaagcacaacgacatcccggtgctgggcggcgagctgatcctgcacgcgcgcaacggcaaggtcttcgcggcgaacaccaacgtccgcagcgacctgcgcgccgagctgaaggcgaccatcgcgggtgagattgccacgtccgcggtggactccgaccgcgagacgctcaagggctgggtcaccgacaagaacccggagctggtgtactggcgcgtcgatgacgagctgcgcctgatgtacaaggtcgtccagcacggcaacaaggcggacggcacgcccgttcgcgactgggtcctggtggacgcgcgcaacgcggatgtgatgctgcgcatcccgcagatcaaggagtccctcgaccgccgcctccacaacggcaacaacaccagcaccctgccgggcgcggtcgtgcgcatcgagggcgcggcgccggtggcggaccccgtggtcaacaccaactacgaccacctgggcaccgtctacgactgctacaacaccctgttcggtcgtgactccatcgacaacgcgggcggcacgctcatcagcaccgtgcaccaccgcgtcaactacgtgaacgccttctgggacggtacccagatggtgtacggcgatggcgacggcgtgacggccaccaacctagccaactcgctggacgtgacggcgcacgagctgacccacgccgtgacggacaacgagtcggacctcatctactcgggtgagtccggcggcctgaacgagtcgatgtccgacgtgttcggcgcggtgtgcgagtggtacggcgacggcgcggacgaggtctccccgcgtcactggctgattggcgacgacgtgtggaccccgtccatcccgaacgacgccctgcgctacatgaacgacccggcgctggatggcgactcgctcgaccactaccacaactacgtgcccggtaccggcgtgcactacagctccggtatctccaacctggcgttctacctcctgtcgcagggcggcacgcacccgcgcggcaagagcaccatcgtggtggcgggcatcggcatcgagaaggccgcgcagatcttctacaaggccaacacgttgatggtgccgacgtccaacttcgaggccgcgaagaccatctcggagcaggccgcggcgcagctcggctacgacgccgccaccatcgagtcggtgtcgaacgcgtggaaggccgttggcgtcagcgtcccggttccgcctccgccgacggaccccatcgtcaaggacacgccggtcgtcgtgtcgggtggcgccaacgagaagaagtacttcgaggtcacggtgccggaaggtgcctacaacctgcgcttcaccctgtcgggtggcacgggtgacgccgacctgtacgtccgctacaacaacgcgcccaccaccgcgctgtatgattgccgcccgtacgccggtggcaacaacgaggtctgcaccttcgcggctccgcagcacggcaagtggtacgcgatggtgaacggctaccgtgcgtactccgacgccacgctgaccgtgacctgggagggtggcttcgtccccatcgagagcggcatcgccgtggagaacctctcgggcgcggcgggctcctcgcaggtgttcatcctcgacgttccggagcgtcgcccgggccaggggaagaacaacatctacatccagacgggcgagggcaagggcaaccccgacctctacgtcaagcgcggtggcgccccgacgcacgcggactacgattgccgcagcgtgaaggaccaccagtcggagaagtgcaacctcatcaacgctccggccggccgctactacatcgaggtctacggcgcgaaggatggcttcgagggcatcgtcctcatcggctccttcctcgagccgctgcccaagtag

SEQ ID NO: 3154 - DNA, 81 bp, Myxococcus xanthus
atgcgccgggccaagcaactggaccggacgtccatccggatcctcagcgtgctcgcggcgcagttcaagccgcgcggctga

SEQ ID NO: 3155 - DNA, 450 bp, Myxococcus xanthus
atgcgtttcatctcgctcgttcccatgctgtgtggcctggcggtcgtggctcaggctggtctcaaccgtcgcttcgggggccagtggggcctgatgagcgccgtgctcctgaacatggtggtggcgacggtggccaccttcgcggtgtacttcgtcgtgcgcacggtgccggggctctggccggaggccgcggcgggccagggtcgcttgagcggcttcacgccctggcacctgttgccggggctgtgcggcgtcgtcatcgtcctgggcatgcccttggccatgagccgcctgggggcggtgcagtccgtcctgctgctgatggcggcgcagctcctcaccagcctcgtgtgggatgcgatggtggaaggccgccccgtgacgttcccccgggtgctgggctccgggctcgccttcatcggggccaccatcgccgtctggaagggctag

SEQ ID NO: 3156 - DNA, 408 bp, Myxococcus xanthus
atgcgccgggtcctcatcgtcagtcctcatgcgccttcgcgcgagctgttgcgccgtatcctcgaggcgccagacctggccatctccgtcaccggggatgcggacgacgccttcgcctcgctgacgtcccggccccccgcgctggtggtggtggacgtgcgccgcccggatgaggaccacccgctcttcctgggcttgctccgcaaacgtcacccgacgcttcccgtcatcgcactcgtcccgggcaggttgcgcatcttcgacgggcggcacgagcgtgtggtcgaagcccacggtgacaccgccgagtcacttcatcagatgctcgtctcgcttcaacaggccatgcacgagctgctcgcccaggacctgctccggctgtggcgcccacctgtcgggcgcgcctga

SEQ ID NO: 3157 - DNA, 603 bp, Myxococcus xanthus
atgggggtggtatccgcgctggcggcggtaggggtgctgctgacggcacaggcagcgccagcttcggggctccagcggcggacccaggacccggagcggctggctcccttcggattgatgctggacgccagcgcacccgagggcgcgggcctgtcactctccttccggcccacgcgaatgctccggctccacgtgggcggcacgcacaatggtgtccgccccggagcgcgcgtggggctcacgttgctgcccttgaaggggcgcctgacgcccgcgctgacgctggaggccggccatgcgcggcccgcgaatggtgaaggcctggagcggcgcatcgtggaccgcacgcagatgcccatccattcgttggagcgcgtgggctactcctacgcgagcgccctgctgggcttcgaatggcaggccccgaagcggctgaccttcttcgtgcgcggcggcttcagcatcatgcggctctacagcccgggcatcgtcggcgtggacgagcagttccgcgacgcgctggagcccgcgaacttccacggctggagcctgagcaacatcgagcccaccgcgaagctcggcatcctgttgtcctttggttga

SEQ ID NO: 3158 - DNA, 96 bp, Myxococcus xanthus
atgaagcgggactgccccatggacgtgtccggcgcgcaggcgcgcgcggaggacatcccggagggcgtggccctcatcatcgtcacgccggaaggc

SEQ ID NO: 3159 - DNA, 585 bp, Myxococcus xanthus
atgacggtgggcgtggtgctgctggccgcgggcggctcctcgcgactgggccaccccaagcaactggtgcgataccagggctcgacgctggtgcggcgcgccgccgaggccgcggcctccttgcggtgcggccccgtggtggtggtgctgggcgcgtcgagggatgcggtcgcggcggagctcacaggcctccccgtgcgcaccgtggaccatgcggactgggccgcaggccctggaggctcactgcgcgcggggctcggtgcgctgcgggagacggagccccccgcgctgaacgccgtgctcgtgttgctgtgcgaccagcttcgcgtggatgccgcacacttgcggacgctgctggatacctttgaacggactcgcgcgtccgtggtggcctccgcctacgaggacactcgaggcgtacccgccctcttcgcgcgtgacgtcttcccggagctggatgcgctcagcccgggccagggcgcgcgtggtgtgattgcgcgcgtggcctcgcgcgtggtggacgtcccgctgcccgggggtggcgacgacgtggacacgcccgaggatgtctcgcggctgacgtga

SEQ ID NO: 3160 - DNA, 1113 bp, Myxococcus xanthus
atgaaggacctggacgccatcctccgcgcgcgggcgcaagctcgcggccccctggtcctggccacggtggtcgaggtatcgggctccgcctaccggcggccgggtgcgcggatgttgatgagcgaggacggatggctcgcgggcggcatcagcggcggctgcctggaggccgacatcgtccgcaaggccttcttctggaccaccaccgggccccgcctgctgcgctacgactccaccagcaacaccgcggaggacgaaggtgccttctccttcgcgctgggctgcaacggcgtggtggacgtgctgctggagcgctgggaggcgggcgcgggcgaggccctctccttcgccgccgaggcgcgggaagcggggcgccgggcggtggtggcgacggtgtaccggggccccgcgaacgccgtgggttcccggttgaagctccgcgatgacggcaccgaagcgggccaactgtccggcgcactgggcgacgccgtgcgcgaagccgcacgcgaggcgctggaagcgggccggacgtggagcggcccctgcggcggcgcggacgtgctggtggaagtcgtggagccgccccatcccctggtgctctttggcagcggattcgacgtggccccggtggtgaaccaggccgcggccctgggctggcatgtcacggtggtggcggaccggcccgcgcaggccctgcggcgccgctttccccaggcccatgcggtggtgtcggcgaaggccccggacgcgcccagtgcggtgcccctatcgccccgtgcgctggccgtgctgatgacacacagcctgccgcaggaccgcgagctgctggcgcggctcctcccacggcccctgcgctatctgggcgtgttgggacctcgctcgcgcacagaccgattgctcgcggagctgccctccccgcccaccgacgcacacctggagaagctgcacgcgcccgtgggcctggacctgggcgcggaaggcgcggaggaaatcgccctgtccatcatcgccgagcttcaagcggtggtcgccggacgcgagggcggcaagcttcgcgagcggcgcgcgcccatccacaccgccgcgcccctgccggcgcagaggctcgcatga

SEQ ID NO: 3161 - DNA, 978 bp, Myxococcus xanthus
atgcgcgcattgcagctacagcggctggacggccctgacgggctccaactggtggacgtgcccgagcccgaggcgggggactcggtgctcatcgacgtggtggcggccggggtgagctttccggacctgctgctcacccgggggcagtaccaactcaagcccgccctgcccttcattccgggcgtggaggtggccggcgtggtgcggcaagcccccgcgggcgcgggggtgaagcccgggcagcgggtgatggccttcagcttcggactgggcggcttcgccgaggtggccgcgattcagccggagatggtgttccccatccccgcggactggagcttcgaggcggccgcgggcgtggtgatgaactaccacacggcgcacttcgcgctgcaccggcgaggccggctcaaggcggaggagagcgtcgtggtccatggcgccgcgggaggcgtgggcacggcggcggtgcaggtggcgcgcggcgcgaaggcacgcgtcatcgccgtggtgagcgacgagcgcaaggcggacgtcgcccggcgggccggcgcgcacgaggtgctgctgtcgaccggagattgggtcgcgcaggtgcgggagaagacgggcggcctgggtgccaacgtggtggtggacccggtgggcggcgacatcttcgacaagagcctcaagtgcctggcgcccgaaggccggctgctggtggtgggcttcgcgagcgggcgcatccccgaggtccaggtgaaccggctcctgctgcgcaacatcgacgtggtcggcgtggcctggggcggcttcctcctgcacgagccatccctgacgcccaccatcgccaaggacctggaggccatggcggaccgtggtgtgctcacgcccgtcgtgggcccggtgttcccgctggagcagggcgcgcaggccctgcgtgagctcgacgcccggcgcgccacgggcaaggtggtgctgcgcatgcgcgaaggctga

SEQ ID NO: 3162 - DNA, 873 bp, Myxococcus xanthus
atgaagctctacgccatcagcgacctgcacttgcgccacaacgacaaccgcctggcgctccaggcgcttccggcccatccggaggactggctcatcgtcgcgggggacgtgggcgagacgctggcggagatggagctcatgctgagcaccctcacccagcgcttccgccaggtcatctgggtgcccggcaaccatgagctgtggaccatgccgtcggagcagccgcaactgaagggtgaggcgcgctaccagcggctggtgagcctgtgccgcagctacggcgccctcacgccggaggacccctacccccgctggcccggccctggccccgagcgcgtcatcgtccccatgttcctgggctacgactacacgttccgcccggaccatgtgcccgcggacaaggcgctggagtgggcctgggaggatgacctgctgtgcaccgacgaggtgctgctgcaccccgagccccacgccagccgcgccgcctggtgcgccgcgcgcgtcgaagccacgcgggcccggctggacgccctccccccgggctgcgccaccgtcctcgtcaaccactacccgctgcgctacgagcacgtgcggctgccgcgcatcccccgcttctccatctggtgcgggacgaagcagacggaggactggcacacccgctaccgcgcggaggtcgtcgtctccggccacctccacatgcccgcgacgctgtggcgtgacggcgtgcgcttcgaagaggtgtcgctgggctaccccgtgcagtggaagtaccggggcgtgcacgcgtgggagagctgcctgcgcgtcatcctccccggccccacgccgtagaaagcacgaagccccgggcgccgcgtgaagcggagcacccgg

SEQ ID NO: 3163 - DNA, 360 bp, Myxococcus xanthus
atgctgaccttcttgttcgtggacgaagacccacgttcactcgccgcgctgcggcgtctcgtgagggatttacccggcggcaagcgcttcgcccgctgcgtggaggaggccctcgcgctcgtgaaggaagaagcgccgtccgtggtggtgacgggcgatctgctcccggacggagacgggctggggctgctggagcaggtgcgtgcgagccacccccgcaccgcctgcgcgctgcatgcggtgatgccgcccctggcgcgggacatcacgtggatggaccgcgccgcgccaccctcggaggtgcatgccctgctgcggatgctgggcatcggtgcagcatcgatgggaagcccgcgttaa

SEQ ID NO: 3164 - DNA, 1083 bp, Myxococcus xanthus
gccccgcctggcgcggggcccactccgaggttcgaagtgaacgaccgactcctccgcgcggcgcgccgccagcccacagacacgacgccggtatggctgatgcgccaggcgggccgctacctgcccgagtaccgggccatccgcggcaacatcgccttcctggacttgtgcaagcacccggacctggcggcggaagtcaccgtccagccggtgacgcgcctgggtgtggacgcggccatcatcttctcggacatcctcatccccgtggaggccatgggcatcaccctggagctgggggacaaggggccgcacttccccgaccccgtgcgctccgcggcggacatcgacaagctgggcgtgccggacccggtggagggcaccggcttcgtggccgaggccatccgccgcacgcgcaaggcactcaatgactccgtgcccgtcatcggcttcgcgggcgcgcccttcaccctggccgcgtacatggtggaggggggcggctccaagagctacatcctcatcaagcggctgatgttcgagcagcccgagttggcgcaccgcctcttcggcaagctcaccgacacgctcatcccctacctgaagatgcaggtggaggcgggcgcgagcatcgtccagattttcgactcgtggggcggcgcgctgtcgccatgggactacgagcgcttctgcattccctacctcaagcgcatggtgtccgagctgaaggccaccggcgtgcccgtcatcgtgttcggcgtgggcatgtcctcgcacctgtcgctgctcaagagcaccggcgcggacgtggtgggcctggactggacgctgcccatggacgagggccggaaggtgctggggccggacgtggcggtgcagggcaacctggacccgctgcacctgttcctcccccgcgaggagctggacggccgcgtgaaggacatcctccgccgcgcgggccccgaagggcacatcttcaacctgggccacggcatcctcccgcccacggaccccgacgccgcgaagttcctggtggaggccgtccaccgccacggcgtggccctgcgccagggcacgctgggtgcctag

SEQ ID NO: 3165 - DNA, 1206 bp, Myxococcus xanthus
atgctgacacgcgagctgctcaacttccgcgtgcgccagggcgtcctgcgccccgtcttcgtgaagcgcgatgacacggagctgctgaccttcgcccaggacctgctcgcggaggtagcggcgtcgcgcggcggccagcgcgacgacatcgaggagtcgctgggcttgaaggccggcgccttcaccaagcccaaggtggcgcgcggcctggtgaagctggtgttggaccggctcctcttcgacgagcccgcgcccggcgtcacggaagcccgttgggagcgaatcaaggcggcgggacaggtcctgcgtgcgctgcctcccgacgccacggtggagggcttcgaggcacggctggcccagacgctccccgtccccctttccgaggcccgagaggcgctgtactcggacctgcccggccaccgccggctggtggggtgggacggcgaggcactgaacgcccaggacctgctggaccgctacaacctggcgctggcgcagggccccctgctgtccgcacggcgcctccgcctgcgagcccaggcgccggacctgctgcgcgtgcgcaaggtgctccggtggctcaagttctgccgcctggtggccgaggtgtggcgtgacgacgacaactgggcgctcgacgtggagggccctggggccatgctggcgctccagaagaagtacggcctgcaactggcgaccttcctgtccgtggtgccggtgctggagcgctgggagctgaccgccaccgtggaactttcacggcggcaggccacgttgatgctcagccacaaggacccgctgcgttcgcccctacccgccgcactgggtcacattcctccggaagtggcctccctcgcggagggcttcgcggatgacgcctgggagctggacctgacgccccttccccggcacgtgggcgcctccggactgtgcgtgccggacctcaccttccgccaccgtgcgtccaagagagaagtcgcgctggagctcttccacgcatggcatgcggcgcccctggcccggaggctgacggagctgcgctcgcggccggacgcgggcctgctgctgggcgtggaccgggcgctggccaaggaggccgtggagcgagaggcgctggaggcccacccgcaggtggtgctcttcaacggcttcccctccgcgcgcaagctgcgggagcgcctggcgaaactggagcccgggcggtga

SEQ ID NO: 3166 - DNA, 1380 bp, Myxococcus xanthus
atgccgtcgcccaccgagctccacttcgactgcggcaccctggtcgcgcccacactgccggaagatgctcgcctgcgagccctcttccagaaggacgggcgcaccggcgtctaccgcgcgcccgcgtggcattaccgcgaggcggtgctgcggctgcgggaactgggcatcccctacgaggacaaggcgaagcgcttcgagccgctggagctgccgctcacctcgcccatccaaccctttccgcatcagcagcaggcgctggaggcgtggacacgcgcgggcggacgtggcctggtggagctgcccacgggcgcgggcaagacgctgctggcggtgctcgccatcgcccacgtgaagcggcccacgctggtggtggtgcccacgctggacctgatgacgcagtggcagggcgtgctggcgcgccacttctccgcgccagtgggcctgctgggcggcggcgtgaatgaccggcagccgctgacggtgacgacgtacgactccgcggcgatgcagacggaattccacggcaaccgcttcggcctgctggtgtgcgacgagtgccaccacctgcccgcgcccagctaccgcttcatcgcggagggctcgctggcgccgtaccggctgggcctcaccgcgacgctggagcgcgccgatggcggcgagcgcgtctgcgaggagctgttgggcccccgcgtgcaccgctcggacatccgggagctgcagggtgaatacctggcgccctatgaagtgaagcgagtggaagtcccgctgacgcccgacgaaaaggcgcgctacgacacggcgcgcgcgctgtacctgggcttcgtgcgcaggctgagcgtgccgctctccgcgccggacgggtgggcgcgcttcctggcgcagagccagcgcagtgacgagggccgcgcggcgtaccgcgcctaccgcgagcaacggcggattgcgctcacgtccagcggcaagcaggaggtgctgtggcgcatcctcctggagcaccgggacgaccgtgtcctcgtgttcaccgacgacaacgagacggtgtacacgctggcgcgccgcttcctgctccccgcgctgacgcaccacacgcccgtgcccgagcgcaaggcgttgctggccgccttcgcctccggggaactgccggtgctgctgacctcgcgcgtgctgaacgaaggcgtggacgttcccgaggcgcgcgtgggcgtggtgctcagcggcagcgcgagcgtgcgcgagcacgtgcagcggctggggcgcatcctgcgcaaacggccggggaagcgcgcgctgctgtacgaggtgtgctccgcgcagacggcggagagcagcatcagcgagcggcgacgccagcacggcgcctatcaggagggcggctga

SEQ ID NO: 3167 - DNA, 990 bp, Myxococcus xanthus
gccgtgcgattccagcccacccatcccttcgtgcccgcgcccggcctggccaacgagcatgcgcagaccatctacgcctcgctcgtgcgccccacccgcacgcccgcgctgcgacgcgagcgcatggagttgccagacggcgacttcgtcgacctggacaccttcgacggcgcggcgggcgcgccgcatgtcgtggcgctgcacggcctggagggttcgtcccgcgcgggctacgtcaccgccatcctgcgcggtgcgcggacgcgcggctggggcgccaccgcgctcaacttccgctcatgcagcggcgagcccaaccggctggcgcgctcgtaccactcgggcgacatcgacgacgcgctccgggtgctgaacgagacgcgcgcccgcgtcaccggcccgctattcgcagtgggcttctccctgggcgccaacgtgctgtgccggctgctggagacgctgggcgacgacgcgcccgtggaggccgccgcgtccgtcagcgcgccgtatgatttgagcgcctgctgtcgcaagctcgacgcgggaggccccttccaccggctgtaccgcgagcgcttcctgcggacgctgaagcagaaggcccgcgaaaagctgcgccactttccggaggccttcgacggccaggccatggaggcggcgcgcaccatccgcgccttcgacgacgcggtcacctccgagctgcacggcttccgcgacgccgcccactattacgcggagtcctccgccggcccccggctgcacgccatccgccggcccacgctgctgctgagcgccgcggacgacccgatgctggagacgcccgtcatcccgcccgccgccgccgcgaatccccacctgagcgtcgtggtgacggagcacggtggacacgtcggcttcgtcggcggccaggtacaccggccccacttctgggcggaggcgcaggcgctggccttcttcgacgcggtgttgtcccagccgcgcgtggactga

SEQ ID NO: 3168 - DNA, 348 bp, Myxococcus xanthus
atgagtgccccccactccaagcccgtggagtgcacgcgctgcggcgcctgctgcgtggcgccggacatcgccgcgctggacaagccgctgggcctgcgctgcccacatttgcaagaggacaacctctgcggagtctacgaggagcggcccgccatctgccgcgactaccaggcggatgaagtctgcaccctcatcgaggcccccacgctggaggagcgcgtggagaagtacctgagcctcttcgggctccaggcggaggcccgcgccttgcgcgagcagggctgtgcgtccatgcgcatggcccgccgcctggacaccctgcgccgccctgacggcgccaaggactag

SEQ ID NO: 3169 - DNA, 558 bp, Myxococcus xanthus
atgcccgtcaacggcaccggcgaggtggcgggcgtggccgacatccgcgcctgcgtgtccgtccagcgaggcacccgccgcgtccccgacggcacggagcgggtgtgccggacgaagtcgcgcaaggtggcctgcggcacggaggagaagtgccgccgcaaggacatgggcaacggcttcatggaggaggtgtgcgaggacgtgacgaagtactgccgcgagtcctatgaggactgccagaacgagacgcgctaccgccgggagcccgtgtatgcggaccagtgcacctacgacacccatgagtggaagccgctgacgcgcagggaggcgtccggcaccgacgatgcgccgcgctggcccgagctggccgtgggcgccgcggaccggctgcgccgcgaggagacgtacacggtgcggctgcgctacgaggatgacggcgcccatgagcacgtgctggagccggaggacgaacggacgttcctcgtctggaagaagggccagggcgcgcgcctcaccgtgacgaacctgggcacggtggagaaggtcgtgccccgatga

SEQ ID NO: 3170 - DNA, 510 bp, Myxococcus xanthus
gctctcagtgattcgcaggtggacgcgctgctggaagacgcggacgtgccctcggcgctcgagcggatgcggcggccggaggtgcccttctacctgtggccgggcgcctcacaggtggactggcacctggagcgcgagcgcatctacgcggagctgctgcgccgcccccggccccgggcctgcggcgcggtggtgggcgcgtccactgcgctgtgggcgatgatggcccgccagggagagctggtggtgctgatgctggacgcgcgctccgaggacgacgccgccgcgctgctggaggccgcgggggcccaggcccacaaggccggactgtccaaggtggtgctgtgggaggagccgggcaccatgccgtgggtgggcccggcttcccgaagccaccccgagaggcccgggatggctcgctgcccatggtgcggcccctgcgcgagggcctgtccaccagcgaagacatcccctttggttgcgccctttgggcgtgaacgtgcggcttag

SEQ ID NO: 3171 - DNA, 273 bp, Myxococcus xanthus
atggacgactcgaagaagggttctcgtcgtacgattcgcgcactcgcctcaccggctgccctgacggtgctcttcggagccttcgccagcaacgccgcgaccctgaagcccgtggtgaatgacaccattggcgtcagcaacgtcagcttcccgacgaccgaggtccagcagcaacagcagcagcaacagcaacaggtcgtgaagcctggcaccatggccagcggcaagccggtgatgctccagtcgctcgtcgcggacctgggcctcgcatag

SEQ ID NO: 3172 - DNA, 2054 bp, Myxococcus xanthus
atggaaacgcccttgacgcagcggcccggtgacaccccccaggaggcccgcgacagctcgcgaccggaccttcatctcgtcttccctccgcagtggtctccgctccagcccttcctgagcaccccgtcgctcaaggcctacctggagcagaagggccaccgcgttcaccaggacgactggaacgtcgtcttctatcgctggttcatcagccgggcgcgcctgcccctggcgcgggcgcggctggagcgcttcatcgcggcgctgacggatgagcaccgcctctaccgcgcccggtgcctgcaggcgctggcgacgctggaggagtatgagcagctcatcgtccaggtggaggggctgcgcaccggcgatacctacggcacgatggagagcttcaaggacagcgtggacgcgctcaaggcgctgctcgcggcgttttccgcggcggagcccgtcatcgaggtggggacgacgtcactccaggatggcgacgtcctgggctccattccgtcactgctcgccttcatcgacaaccgcaacgccaaccccttcatcgcgttcttcgaggagcaggtcgcgggcgtcaagcaactgcctcgctacttcggcgtgtccatcatcggcaccgagcagattgtcgcgggactcacgctctgccgtgtgctgaagcagcgccatccggacgtcccggtgctggtggggggcagcgtgttctcccgcctggtggagaaggaaagcacgtgggtcacccagttgttcggcaggtgcttcgacttcatctgccggtagagggcgagcgcccgttggaccgctttctgtccgtggaagacccacggggagaccgcccgcccaacttcgccttcatggagggtgaggacctggtgctgacgccgctgggggactcactgccgatgagcgaggtccccacgccggatttcggggggctgccgctggacgagtacctgtcccccgagattgtcctgccgctgttgacgacgcgcggctgctactgggggaagtgcgcgttctgctaccacggcatgatttacggcgaccgttaccgcatgcgcgcgcccgagatgattgccaaggatttggaggtgctcaacgcgcgccatggcgtccggcacttcgcgttcaacgacgaggcgctgccgcccaagctcttccgcatgttgccgcccgccgtccccaaggggcgctacttcttcaccgcgctctacaagttcgagaagtacttcacgcgggaggacttccagaacatgcacgacatcggcttccgctcgctctacatcgggctggagacggcgtccgagcgcgtgcagcgccacatgcgcaagaacaacacgcagaaggtgatggtggacaacctccagttcgcgcacgacgcgggcatctggagccataccttcaacttcttcggcttcccgacggagacagaggacgaggcggaggagaccgtccagttcctgctggggcattcggacatcctgcactcggagggaacggggaccttcgtcttcgaacacaacgcgcccattcacctgtcacccgagcagttcggcgtgaaggccttcaagccgcgcacggacaccgtgctggacctcttctatgaatacgagcccgccacgggactggacgcggctggcgcgcaggccgtgctggagcgctacaaccgcctcaagcgcgagcggaaggtctaccagcacgggcactgggtggaccgggagcacctgctgctgctgctcagccgctacgggcgggacgcactgaagaaggccttcgccgaggtcgaggattcggaccggggctattccgcggcggagctgctgcggggctatgcgttcgacacgcccgagggcaagcgtcacttcgtggtgaaccggcggttgcgccgggtgtgcatcaccaacgaggacgcggtgcgcatcgtcgggtggctccagttcggcgccaaggtggaggacctgctcaccgcctatcccgcgctgtcggccgcactggacccggtgcccgaggacgtggaggagctgacagcgctgcgcgaagcgtcatga

SEQ ID NO: 3173 - DNA, 966 bp, Myxococcus xanthus
caaggagcagcgcgcatgaacctggacccttccacgcagaagttcgtctcggacctggcggcctcgaacagcccgccgctgtacaccctgacgccagagcaggcacgggaagtcctcctcgaggcgcagtcgattccagtgcccatgccagacgcggacgtggaggagcgcaagctgcccgtggggcccaggggctccgtccggacgctgctcttccggccgaaggggagcaaggagcgcctgccggtgctgatgttcgtccacggcgcgggctgggtgatgggagatgccaggacgcacgagcggctggtgcgggagctggtcaagggggcgaatgtcgcagcggtgttcgtggactatggccgctcgcctgagaacaagttccccgtggccatcgaagaggcctatgccgcgacgaagtacgtggcggagcacccggacgaattcaacgtggatgcccgccgcatggcgctggtgggagacagcgtcggagggaacatggcgaccgtcgtcagtatgctcgcgaaggagcgcggggggccgtccatccgcttccaggtgctcttctatcccgtcaccgacgccaacttcgacaacggctcctaccaggagttcgcggaggggccgtggctgacgcgcaaggcgatgaagtggttctgggatgcctatcttccggaggccggcaagcgcgtggacccacatgtttccccgctgcgggcgtcactggaccagctcaacggcttgccccccgcgctggtcatcaccgacgagaacgacgtgctgcgtgacgagggcgaggcctacgcggcgaagctctccgaggcgggtgtcaacgtcactcaggtccgcttcctggggacgcatcacgacttcgtcatgctcaacgcgctggcgcagacgccggcggcgcgaggcgccatcgcgctgaccaccaccaagctgcgcgagtggctgcacgcgaactga

SEQ ID NO: 3174 - DNA, 1272 bp, Myxococcus xanthus
agggtggccatcgtccgcggcctgcggaccccgttcgtcaaggcgggctccgtcttctcagggctgacggcgctggatttgggccgcctggtggtccaggagttggtccagaagacggacctggacccgaacgtcatcgaccaggtggtgttcggccaggtcatccccacgttgacggccccgtccattgcccgcgaggtcgtcatcgcggcggggctgccgaagaagattgatgccttcacggtgtcgcgcgcgtgcgccacgtccatccaggcgctgacgacggcggccaacgcgattgccacgggcgaggcggacgtcatcatcgccggtggcaccgagtccatgtcggacgcgcccatcttcaccagccggccgctggcccacgcgctggtggcggcgtccaaggggcgctcgctgccggacaagctcaagcccttccagcgcctcaaggccaaggatttgctgccggtgcccccggccatcgccgagtactccaccggcatgacgatgggggagagcgcggagaagatggccaaggagaacggcatctcccgcgaggagcaggaccgcatcgccttcaactcgcaccgcaacgcggccaaggcgtggaaggacggtctgttcgacaacgaggtcatgcacgtcgtcgtgccgccgaagttcgacaagacggcggagcgcgacaacatcgtccgtgaagactccagcatggaggcgctggggcagctcaagccggcgttcgaccgcaagtacggcacgattacggcgggcaacgcgtcgccgctgacggacggcgccgcggcgctgctgctgatgagcgaggagaaggcgcgcgcgctgggctacgagccgttgggcttcctccgcagccacgcctacgcggccacggacccgggcgaccagttgctccagggcccagcctacgcggtgcccacggcgctcaagcgcgcgggcatgacgctggcggacatcgacctggtggagatgcacgaggccttcgccgcacaggtggccagcaacatccaggcgctggcgtcccaggccttcgcgaagaaggcgggctggagcgcgccggtgggcgaaatcgaccgggagcggctgaacgtgacgggtggctccatcgccatcggtcatccctttggggccacgggggcgcgcatcgtcacccaggccatcaatgagctgaagcgtcggaacaagaacacggcgatgtgcaccgtctgcgcggcgggcggcctgggcgcagtcgtcatcctggagcgtgcgtga

SEQ ID NO: 3175 - DNA, 264 bp, Myxococcus xanthus
atggcgagcgtgcccacccagaacaccgtgacctggaatgacggctcgcagagcgtcatcgagttcatcgatggggtggatgtgcggccggtggggatgacgatggtgacgctgctgggccgggtctccagcggccggtatgagaacgcgctcgccatcaagacgctggacgtgtcgtccgtgcccggggtgacccagtgcgtcctcggcggcgtgcgctccgccacgaagaacgtctcgctgtccctgctgcggctgttctaa

SEQ ID NO: 3176 - DNA, 320 bp, Myxococcus xanthus
atgtggctgggggtgacggcggcggccttcgcgcggagctacggagagacggcgggctccgtcggcgggcagctcgcggtcatcttcgtcgtgtcgttgggcgcgcccgcggtgggcgtggatgccgcgctggcccgcgccttctggctgctcttcggcggcctgtgggccatgacgctgtccctggtgctgtggcccttgcggccctaccgcccggcgcggagggccatcgcgcgcgtgtacggggagctgaaaaaggaaagctggtatttgggccgcctgtcgcgcgagggcgccagctcccaggggtgggtggaggc

SEQ ID NO: 3177 - DNA, 2448 bp, Myxococcus xanthus
atggcccgtatcgccgacggagtgggggacatcgcgagcgacttcaagttcgcggtgcggatgctccggaaggacccggtcttcacgctggtggccgtgctgtgtctggcatttgggattggcgccaacgcggccatcttcagcgtggtggatgcggtgctgctccgcccgctgccctaccacgagccagggcagctcgttcgcctcttcgagacgacaccagcgcgggacccgacgtggctgggctcggtgtcatggcccaattaccaggactggtccacccagctcccctcgctggaaggcgtggccgcctacgagttccagggccgcaacctgatgacgcccgagggcgcggagcgggtgagcgtggtagcggccacggccaacctcttccagctcctgggcacttcgcccaagctgggccccggcttcgcgcccggagatgaccagcccggggccgcgcccgtcgtcgtcatcggagagggcctgtggcaacgccgcttcggagccgacccgggcctcgtcggacgcacgctgacgctggacggacagccgcacaccgtggtgggcatcctgcccacggcggtgggctttcccgcgggggcccggatggaggtcttcatccccttcgtcccctccgctgaccgggtggacaaccggggctcgcacttcctgagtgtcctcggtcggctgcgcccgggggtcccgccccagacgctcgccgcggagctgaaggaagtggcgcgccgcatcgaggaagcgcaccccgcgcagcaagccgggcggagcgccgcggcggtgtccctggcggagacggtgacgggcaacgtgcggcccacgctgctgctcctgcagggcgcggtgctgctggtgctgctcatcgcatgcgccaacgtggccaacctgctgctcgcccggaccgccacgcggcagcaggagattgccgtccgcttcgcactgggcgcgagccggggccacatcgtgaggcagctcctggtggagagcctgctgctgtcgctgctgggcgcgctgctgggcgtgctcctgggcgcctggggtgtgaacaccatgggcaacctggtccgggcgtccttcccactcaccggggaccttcccctcaatgggcgggtcctcggcttcctcctgctgatatccgtgggaagcgcgctcaccttcggcctgacaccggcgctccaggccacgcgcacgccgctgcgcgccagcctcgccgagccaggggccaagcagtctccgtcgcgcgcgcaccactactttcgcggcgcgctcgtcgtgacggaggtggccctgtcgttggtgctgctcgtcggagcggggctgctgctgcgaggcttcgtgacgttgctgggcaccgagcccgggctggagccgcgccacgtcctcaccgcccacctgcccatcaccccgaaccagtacccccgggaggaggtcgtcgagcgcctcttccagcccatcctggagaaggcccggacgctcccgggcgtggagtccgcggcgctcatctccctcctacccatccagacggcgtggaccagcggggactacgccgtggagggagagctgccggcggagccaggcaagacgctgttcgcggagttcaggacgaccagcccggacctgttcaagtcgctggggataccgttgctggccggccgcgacttcaccgaggacgacggccggagcgccgagcaggtcgtcatcgtcaaccaggccctcgcccgccggcacttcgcgggaagcgaggccgtgggacgccggctgctcatcgggggccagcccgtggaaatcatcggcgtggtgggagacgtgcggcaggcgggcctggaccagcagcccctccccgaggtccacctcccctacaaccatccgcgctccacgctctggtacttccaagcggtgacgctggtgctcaagacacgcacggcgcccgctagcgtggcggccacgctgcgcggcgcggtgcgcgccgtggactccgagcagccgctctacaacatcatgaccatggaggagatcatccagcagtccgtggcggggcggcgcctcagcctcacgctcctgggcgcgttcgcgctcatcgccctggtgctggccaccgcgggcctctacggcgtcatctcctacctcgtctcgcaacgcacccaggagattggcatccgcatggcgcttggggcgcctccgggccgggtggtgcggctggtcatggaccagggcatgaagatggcgggattgggaatcggcgtggggctcgtcgccgccttcggactgtcccgctacatggaaagcctgctgtacggcgtcagcgggacggacccactgaccttcggcgtgttcgccgtgttgctgggcggcgtggcgctgctggccacctggctgcccgcgcgccgcgcctcccgcgtggaccccatcatcgccatccagaagcgatga

SEQ ID NO: 3178 - DNA, 1044 bp, Myxococcus xanthus
atgccgacgaagggcaagcacgccacccggtccgttcccaccaacgcgccgggcaacaagttccggcccaccacccgcattggcctgggcggcgtggccattggcaatggcttcgcgtccaccagcgacgcgcaggcgcaggccaccctggaggccgcctgggccgccggcgtgcgctacttcgacacgtcgccctggtacggcctgggcctgagtgaacgccgcttcggccgcttcctgcacacccgcgacgcgaacgagtacgtgctgtccacgaaggtgggccgcatcctcaccgccgcggacgcgccgccgccgaagctgctgtggagcgacgcctcccccttcaactaccaatacgactattcggccgccggggtgcgccgctccgtcgaggacagcctgcagcggctcggcgtgtcgcgcatcgacatcgtgttcatccacgacctgtcgccggacaaccaggacatgggcgacaagtggacggagtacttcgaccaggccatcaagggcgccatccccgagctgacgaagatgcgcgaggaaggcctcatcaaggcctggggcttcggcgtcaaccgagcggagcccgcgctgcgcgccctcgaggtcagcgacccggacatcttcctgctggccacgcagtactcgctgacgaaccacgaggaggccctgagcaagacgttccccgcgctggagaagcgcggcatctccgtggtggtgggctcgccgctcgacgccggctacctcgccggacgcaaccgctacctctacgacggcaccattccgcccggcgtgcaggagaagcgcgcccgcatgagcgcgattgccgcgaagcacggcatcgacctgcgcacggccgcgctccagttcgccgccgcgccttccgtcgtctcctccgtcattcctggagcgcgcacgcccgaacaggtgaaggcgaacgtgcagtccatgacggtcgcgattccagacgccttctgggaggcactgaagaaggaagggttgattgcgcgggacgcgcccatcccctccaaggcctga

SEQ ID NO: 3179 - DNA, 390 bp, Myxococcus xanthus
atgttcaaggtcaagcagaaccacacgttccagaatccgatgcggcagcagatcgaccagaccacgcagggcaagcagagcgactacgcccacgcggtcggcggcgtgaaccagattctcgaccggcacaacatcggcatctcttcgcgctcccaggccagcgtcatcgacaacgtgaagaaggtggagacgggggaacgcagcgaggtcaacgcccaccagcgcgaggccctgaacttcggccgggacgccttcgaaagcgccaagaagggcaactacaaacaggcgggcgtggaggctttcggctccaccgtcaatgggctggcctcgatgttcaagtccatctacacggagacgcccagcgagaagcagggcatcgctccccactga

SEQ ID NO: 3180 - DNA, 924 bp, Myxococcus xanthus
atgaaccgcttcgcgctgcgcgacctcacggaccgcctcgacgcccagacccaacacgaagacatcgtccgcatcctcgccacccgggagttcccctgggacgtcgaacaggcgctcagcttcgcgctgttccgcacctacgcggtgcccagcatcggcgtcctcctgcacgacacggacgagttcacccagcgcacccagaagcgctacgacgacaccgtgctcatcctggacaccatcctggagcacggcatggccagccaggaaggccggagcgccttccggcgcatgaatcagatgcacggcgcctatgacatctccaacgatgacatgcgctacgtgctctccaccttcgtggtgatgccggtgcgctggattgcggacttcggctggcggcccttcacgccgcatgaagtgacgggctggacgaactactaccgcgccgtcggccgccacatgggcatccaggacatcccggagacctacgaggccttcacctcgctcatggatggctacgaagccacgcacttcgccttcgacgcgcgcagcaaggccgtcgcggacgccaccctggagctgctcaccaccttcccgccgacgaacctcgcgcccaagcggctggtcaccctcttcgcgcgcacgctgatggaggacgccctgctggacgcgttccactacccccacccgtccagcctcagccgcaaggtgttccgtctggcgctcaaggcgcgcggcacgttcgtccgctacgccctgtctccaaagaaggagcccgcctacgcccggcagcgcgcgaacatccgcagctacccggatggctacgccgtcgaatccttgggaaccttccccaggacatgtcccgtgaagcatggcgccgcggcggagggctcacctcagcgcgcgccatccaagggcggcccctga

SEQ ID NO: 3181 - DNA, 1386 bp, Myxococcus xanthus
atggtggggcggcggcgatgggcaatcggggtgctggcgttcgggcttctcctcgtggggtgcggggagagggcgcacgcggcagcccgcgccccgggcttggaggtggcggggtcggctgcaggtgagggcgagggggtcctggcgtggacgcgtccgctggtgctgggggacagcgaagcgccacatgccgtggtggctcccgacggggacgtcctcgtcgcggcgacctaccgtgagcctctggaccttggggcagcccccctgcctttcaaccacgtatcaagagcgcctcacctgctggtggcgcgcttctcttcggaaggcaccctgcgctgggcgcatgggctgacaccggaggcagacaccgcgcgcgcgcacgtgggcgggctcaccgtggatggcgaaggcaacgcgtggctgggcggcctgtccgcaggcttcgcgcagggcgcggtgaaaatcccgcccggagccttcctggcccggctgtcgcctcagggcgcgctggagcgcgtgcggaacttcggcggcacgggtgcgctcaccgtcaatgcgctcgcgccggacggcactggcggcgtggtgctggtgggagacttccagggccaacgcgacttcggcgacggcgtgagggaatccccacagggccagcgctccgccttcgcggtgagcctggacgccagcggccagacgcgctggagccgcacctgggccgcggggagcgaaggcctggtgacggcccgggccgtagcggtggatgtctttggcggcgtgcacatcgcgggggcctatgcgggttccgtctgctttggcgggccggcgctcgtcacggtgcggcagcgcacgcctttcgtgctgaagctgtcttcaggcggcgaacacgcctggagccgggacttgcgtggcaccgagggcaccgccaatgccctggcggtgggccccgaccgcgtcttcgtcggtgggaacttctccgggcgcttctacttccaggggaagcctcatacctccagcggctatcagggattcgtgactgtctttgatacccatggcaaggaacgctgggcgcgctccttcgcggccaccgccaccgcgctggccacggatgatgccgagcagctcaccctggcgggctcgcatgatggcgggctggatttgggcgacggcgacgtgcccgcgggcctctacgtggcccggctccatccggaggacggcgcttcgctctgggtgcgcagcttcaccagtccaagccccaccctggcgcgcacggtggcggtggattcgagcggctacacggtcgcggcgggcgcgttggcgcgctcgcttccagaaggcacgccctaccctcgccctcgggatggattcctcctacgactgaggccctga

SEQ ID NO: 3182 - DNA, 501 bp, Myxococcus xanthus
atggcgaagatgctgacgcggggcctgctgtgcgcggtgctgggtatgtcgccggtggccatggcgcaggacgcggagcccgccgccgcgcaggtgaaggcgccggacgcggacgcggtgcgtgacacctggaactacttctacaagggccagggccagggccccgtgctggtggaggccaaggtctgcaccgaggtcgccaaggaaggccccaacaagtacgagtgcaccgcggaagtcggcccggaaggcatcaaggccggcaccagcgtgatgctgtggcaggcctatctggtgccgcagggcgactccgtcgaggacatcatggtgcagtcgaagcagggcgccgtcgtccgtgagacgaaggacgtgaagatcaagggcgagggctggcgcgcgcggcagtggacgggcctgcggctgaacaagcctggcacctggacggtgtcggtgctgcgcggggaccaggtgctgaaggagattcaggtcaaggtgctctga

SEQ ID NO: 3183 - DNA, 1308 bp, Myxococcus xanthus
cgcttctcttcgcgcttcgtccccagcgcgttcgccatcgccgtcctgctcacgctgctcaccatggcgctggccaccggctgggccggcgccgcgccgcccgccgtgctggacgcctggggcggcggcttctgggagctgctcggcttctccatgcagatggcgctggtgatgttcaccggctacctgctggccctcaccggccccgtgcgcgcgttgctggagcgcgccgcgcgggtgccacgcacgccccggggcgcggcggcgtggatggccttcgtctccatggccctggcctacgtcaactggggtctgtccctggtggccagcgccatgctggtgcgcttcatggtgaagcgccggccggacgtggactaccggctgctggtggcgtgcgcgtacttcggcctgggcgccacctggcactcgggcctgtccgcctccgcgccgctgctggtggccacgccgggccacttcctggagaagagcctgggcgtgctgcccatcgacaggacgctcttctcgcccttcaacatcggcctcacgctggccgtggtggcggggctgacgctgctggcgtggctgctgcacccgaagccggagaacaccgtccgcgtggaccccgcggtgctggagtccctgggcgacttcaccccgcccccgcgtccctccgagcgtggcttcgccgcgtggctggaccactcacggctgctcaacaccgtcatcggcgtcctggggctcgtgtggctggcgcggcacctgtggatgaatggaggctggcgcgcgctcaacctcaacgtggtgaacttcaccttcctggtgctggcggtgctgctgcacggcacccccgcgcggctgctcaaggccagcgaggaggccggcaccgtgctgcacggcatcgtcctccagttcccgctgtacgcgggcatctacggcatcttcaaggccaccggcctgacggagcgcatcggcgagctgttcgtgtcgttgtccacgcgcgagacgttccccgccatcgtctacctgtacagcggcgtggtgaactacttcgtcccctccggcggctcgaagtgggccattgaagcgccctacctcctggacgccgcgacgcggctgggcgtggcgccggagaaggtggtgctggcgtatgcgtggggcgacatggccaccgacctcatccaacccttctgggcgctgccgctgctggccgtggcgcgcttggagttcaaagagctcctgggattcctgctggtggccttcctcgtgtacctgccgctggtgacgctggccttcttcctcttcggctga

SEQ ID NO: 3184 - DNA, 489 bp, Myxococcus xanthus
gtcaccctccgtcccgccaagccctcggatgagccctccctggggcgcatgggcgcggcgctcgcccggaaacaccacgccttcgacgccgcgcgcttcatgctcccagaggacgtggagtcgggcttccgcaagtggctgggcagcgaggccgggaagcccgacgcggtcgtcctggtggcggagctggacggcgaggtcgtgggctatgcctacggccgcgtggaaggcatggactggaatgccctgctggaccgcagcggcggcttccatgacatctgggtggacgagaaggcccgtggcgcgggcgtaggcgtcctgctcgcggaggagatgatgaagcgcctgacggccctgggcgtgccgcgcgtcgtcctccacaccgccgcgcagaacgcgaccgcacagcgcctgttcgcgaagctggggtggcgccccaccatggtggagatgacgcgcgaggcgccccctcgtgacgctactgaatga

SEQ ID NO: 3185 - DNA, 1395 bp, Myxococcus xanthus
atgtccaccgccgtgttgccaacgtcctccgtgaattctccccgcaccgagctccgggcgctggcccggcttgcggttcccatcgccatcgcccagggcgggcaggcgctcatggggttggtggatacgctggtggtgggccgcgcggggacatccgcgctggcggcggtgggcctgggcaacggcctctacttcgcggtcagctccttcggcatgggcttgatgatggggttcgaccccatgatttcccaggccattggcgcacggcagttcacccgggcgcgggcgctgttgtggcagggcgcgtggatggcgttctgcgcgggggtgatgctggccacgctgatggcgctggcgccgcggctgctgccgctggcgggcatcagtgagacggaggccgcgggagccagccagtacctgatgtggcgcgcacccggcatgccgatgatgctgatgttcctcaccatgcgctcctatctccaggccaccgccttcacgcggccgctggtgatcgcgacggtggtggccaacatcttcaacctgctgggcaacctggtgctcgtcttcggtggcgccaatctgccggcctggttcggcccgctgcggtcggtgccggcgctgggtgtggcgggctccgcgatggcgacgtcggcgagcatcggcatcgagctcctcatcgcggtgctgttcattcgcagccggaaggtggaaggggcgcgtgccagtcgtctgccggtgtgggcggacctctcgcgcgccatccggctgggcctccccattggtctgcacatctgcgcggaggtcggcgtgttcgcgctggcgggcgtgctggcggcggggctggggccggcgagcgtgggcgcgcaccagattgccatctccttcgcgagcgtctccttcaccgtggccatgggcattggcaacgcgggcagcgtgcgggtgggctgggcggtgggcgcgcacaacacgccgcaggcgcggctcagcggcttcatggccctggcgggcggcgcgggcttcatggcgctgagcggcctggtgttcgcgctgttccctcacacgctggcgaagctggcgggggcgcccgcggacgtgctgccgctcctgattccgctgctgatggtgagcgccatcttccaggtgttcgacggggcgcagggcgtgggcgcgggcgtgctgcgcggcgcgggcgacacgcgcttcaccttcctggcgaacatggtggggcactacgccattggtctgccggtgacgctgctgctggccttcaagctgggcctgggcgtggtgggcatctggtggggcctgtgcgcgggcctcatcagcgtggcggtggcgctggtgtggcgcttcaaccggatgagcgcgggcacgctgcgtccggtcgaagcgtag

SEQ ID NO: 3186 - DNA, 1987 bp, Myxococcus xanthus
atggccaccaaggcggaagagctcgaggtgaagcagggcttctcgtaccaggtggagggcggcgtcgccgtcatcaccttcgacctgccggactcgccggtgaacacgctgtcgccggagacgggcgaggccttcctgcgcgtcatgatgcgcgcggagcgcgagcccgaggtgaaggccgtcgtcttcacgtccggcaagaaggactcgttcgtcgccggggcgaaaatcgacttcctgcagaccatcaagacggcggaggaggccaccgccatcagccgcaacgggcaggagggcttcgacaagctggccgacttccccaagcccgtcgtcgcggccatccacggcgcatgtctgggaggcggcctggagtgggcgctggcgtgtgactaccgcatcgccaccgacagcccgaagacgtcgctggggctgccggaggtgcagttgggcctgattccgggcgcgggcggcacgcagcggctgccggcgctgattggcgtgcaggcggcgctggacctcatcctcaccggcaagagcctcaagcccgcgaaggcgaagaagctgggcgtggtggatgaggtggtgccgacgcccatcctccgcgccatcgcggtgctgcgcgcgaaggagctggccgacgggaagctgaaggtggaccgccgtcatggccagggcttcaagggcgtggccgcgaacggcaaggccaaggggcttgcgggcttcatccagggcctggccaacaaggagctgtgggcggaggtggcgctggaggacaacccgctgggccgcaaggtcctcttcgaccaggcgcgcaagcagctcctgaagaagacgcgcggcaagttccccgcgccggagaaggcgctccaggtcgtgcgcgtgggcctggagtccgggcacaaggcgggccaggaggcggaagcgaaggcctttggcgagctggtggtgtcggacgtctccaagaggctggtggagatcttcttcgccaccacggcgctgaagaaggagaacggcacctccaaccccgacgcgaagccgcgcgaggtgaagaaggtggcggtgctgggcggcgggctgatgggcggcggcatcgcctatgtcaccagcgtgctccagggcgtgcccgtgcgcgtgaaggacaaggatgacgcgggcgtgggccgggccatgaagcaggtgcagtccatcttggacgagcgtgtgaagcggcgctcgctcacgcgccgcgaggccacggcgaagtcggccctggtgacggcgggcacggactacagcggcttcaagtccgcggacctggtcatcgaggcggtgttcgaggacctcaagctcaagcaccgcatcatcgcggaggtggaggccgtcaccggcgaccagaccatcttcgcgtccaacacctccagcatcccgattacggagctggccaagggcagccgccggccggcgcaagtcattggcatgcattacttcagcccggtccacaagatgccgctgctggagatcatcacccacgcgggcaccgcggactgggtgacggccacctgcgtggaggtggggcgcaagcagggcaagacggtcatcgtcgtcaacgacgggccgggcttctacacctcgcgcatcctcgccccgtacatgaacgaggcggcttacctgctggcagaaggcgcggacatcgcggagctggacagggcgctggtcgagttcggcttccccgtgggcccgattaccctcctggacgaggtgggcatcgacgtggcgcagaaggtgggccccatcatggaggccgccttcggcaagcgcatggcggcgcccaaggccctggagaaggtggtggccgacggccgcctgggccgcaagacgcagaagggcttctacctgtacgaggacgggaaaaagcaggaggtggacagctccatctacgccctgctgccgcacggcacggagcgccgctccttcgaccgcgcggagatggcggaacgcgtggtgctgc

SEQ ID NO: 3187 - DNA, 1461 bp, Myxococcus xanthus
atgagatggctgagcacgcgcctcacgggcgtactggtggcatgggtgctggtggcaccgctggcggaggcggcgaaccggaagcaggaggtagaccggtacatccatgggttccaccagaagggcatgttcaacggaacggcgctcgtagccacggaggggggcatcctcctcaagaagggctacggctccgcgaacctcgagtggaaggtgcccaacgcgccggacacgaagttccgcatcggctccatcaccaagtccttcacggcaaccgtcatcctgcagctcgtcgccgagggaaagctccagctcgatgaccccatcacgaagcacctgccggactaccggggcgacaccggtgggcgcgtcaccatcacccacctgttgaaccacacctccggcatccccagctacacgtcagccccccatttccgggccgactcggtcaacccctatggcgtcgcggagttcgtgaagaagtcctgcagtggcgacctggagttcgagcccggcacgaagtacgcgtacaacaactgcggctactacctgctgggcgccctcatcgagaagctcaccggccagacgtatgcgcaggccgtgcaggcgcgcatcttcgggccactgggcatgaaggactccggctatgacgtcaccgccacggtgctgcccaagcgcgccagcggctacacgcccaggccgggcgggtacgtcaacgcgccctacatcgacatgggccagccctatgccgccggctcgctgtactcgacggtggaggacctgtaccgctgggaccgggccttctacggcgacacgctgatgcccgcggagctcaagcagaagatgctcaccccgggccttcagcactacggcttcggctgggccattgcccccgtgcaactgcatgacggcaagacgaagcttccaggtatcttccacagcggcggcatcaacggcttctcatccctcctggtccgcctgcccgagcgcaaggaggtcgtcatcctcctcgacaacgcgacccacggcgacctccaggagattgcgggcggcgtgctgagcatcctccatggcatcgccccccggcaggcccggatgcccatcggcaccgtgatgatggagtctctcggcaagggctccaccgccgaggccatcgccaactaccgcgcgctgaagaagacgaaagaagcccagtacgacttcagcgaatcgcagttgaacacggtgggctaccacctcttgcgcgacgggcgcgtggtggatgccatcgaggtgttcaagctcaacgtggagacgttccccaagggggccaactgctacgacagcctcggcgaggcctacgccgcccacggcgacaaggaacaggccatcgcgaactaccgcaagtccctggagctggaccccaagaacgagaacgcggtgaagatgctcaaggagctcgagcagcccgccgcgacgcggtag

SEQ ID NO: 3188 - DNA, 897 bp, Myxococcus xanthus
atggcgctggcgcccctctgcgtgttgctcgccgcggcgggatatctcgtggtgaacggtcatcgcattggccagggcctgctgcatccgtcgcccattccggtgacacgtcccccggcggagccggcgttgtcgccgctggaggacgtggccttcaccacgtccgacggggtgccgctcaagggctggtacgtgccttcccgcaaccgcgccgcggtggtgctggtacacggcttcgcggacaaccgcgcgcagttgctcttcgaggcccggacgctcgcgggcgcgggctacggtgtgttgctctttgatttacgcgcgcatggcgagagcggcggcgacacggtgacgtggggagaccgggagcggcgcgacgtgacggcggcgctggatttcatctcacggcgcccggacgtggacccgggacggttgggcctcttcggcttctccatgggcggcaccacgtcgctcctggtcgccagcgaggacgcgcgggtgaaggcggtggccgccgcgggggcctatcccgcgctggaggcggacatctacgcgggctatggccgctggggtgcgatgagcgcggagccggtgctgtggaccctgcgccgcgcgggtgtgacggtggacgcggtgcgccccattgacgggatgtgccgactgggcggcaggccgctgctgctggtcaacggcgacgtggacccggacgcgcccgcgaagctccaggccagcctcttccaggccgcgtgcgaacccaagtcactctgggtcgtcgagggcgcgggccatggccagtacgcgcgtgtggcgccggaggaatacgcgcgccggctgctccagcacttcggcgcggcgctccaggccctgcctcaagcctcctcgggcggcgccacccactga

SEQ ID NO: 3189 - DNA, 852 bp, Myxococcus xanthus
atgtccgtcattgacgtctcggtggtgatgcccacccacaagcgggagaaggaagtggtggaggccatccgctcggtcctccgccaggaaggggtgaacgtcgaggtcctcgtcctggacgacacgcccgagggcacggcgcgcgaggcggtggaagggctgaaggacgagcgggtccgctacctggtgaacgatccaccgtcgaagggccgcccggccgtggtgcgcaaccacggcgccacgctggcccgcgggcgctacctgcacttcctggatgacgacgacatgctcgccgagggcgcgctgcacgccatggtgagcgcgctggacgctcggccggacgcgggcgtggcggtgggctgggtggtgcccttcggcgacgacgcggactggctcaaggacaagagcgagtacttcgagtgggccgcccaggtgggcgccagcacccccaacagcgcgtggacggtggcccacatcctcttccgcggcacgctgtatgtgaactccgcgtgcatggtgcgccgcgagcacttcgccccgctgggcggcttcgacgccaccatccccgtctacgaggacgtggacttctacctgcgcggcatccgcgcgttcggccacgtctacgtcaaccggcccatcctgcactaccgcaccggccggccgtcgctgatgcacaacctgggcaaggacggcacgctggtggtgcagtccaacgagatgattcacggcaagtaccgcaagacgaacggcatgctggagtaccgcctcatgcaggccgccctgcgggtgctgcccttcgaggtcgcccgccgtctgccgctgcgcctgcgcaaccagggccgcgcgtcatga

SEQ ID NO: 3190 - DNA, 1443 bp, Myxococcus xanthus
atgagcctcaagagccggcttctcgggacggccagacgccaggtgaagcagacgctgcgcccggtgctccagcgggccatggccccggcgcgcaaccacatccccgcctcgcactggggcctgcgggacgtgcccggccagggcctgagcctggagggtgtcccgctggcgcagttggtggagcgctggggctcgccgctgcacgtggtgcacatggcggcactgcggcgcaacgcggagcgcttcctcgcggtgcctccggggcgcacgggcggctgtgaagtctattactcgtacaaaacgaacccggtgcccggcgtgctgtccttcctgcacggcctgggcgtgggcgcggaggtcatctccgcctacgagatgtggctggcgctgaagctgggcgtgcccccggagcgcatcgtctacaacggcccggtgaagtcggaggcctccgtgcgcgaggccatctcccggggcatccagttgctggccgccaaccacgcggaggagatagccgtcttcgcccggctggccgcggagctggaccgccgcccgcgcgtcgccgtgcgggtgacgacgaacagcggctggtccgcgcagttcggcacgcccatcgcgggaggcgccgcgctgcgggcctaccagcaggcgcgcggctcgaagcacctggacgtggtgggcctgcacgcgcaccgtggagaaaccatccgcacggagggcgacttcacggccttcgtggagtcggtgctcgacttcacggacacgctgcaccaggagctgggactggacttggaggtgctcgatttgggcggcagcctcaacacgcccaccgtcgagcacatcgccgagcgcgactggcgcctcaacctcaccttcttccgcgacgtgcccgcgcccgacccggcggcgtcgctgtccatcgaccgctacgtggcgctggcggtggagatggtggagacgcactacgcgcggcgcggccggcagcgtccccgcatcttcctggagccgggccgcgccatgacgggcgacacgcagctcttgctgggccgcgtgcacgcgctcaaggcgggggaagacaggacgtgggcggtgctggacgccggcatcaaccatgccgagtgcgtgcgcaacgaataccaccagctcttccacgtgaaccggccggacgcgccggccgacaaggtttacacggtggtgggccccatctgcacgccgggcgacacgctctaccacgcgaagcggctacccgacctgcgcgtgggggacacgctggccatcatggatgcgggcgcctacttcgtgcccttcgccacgtccttctcctatccccagccggccatcgtcgcgctggaggacgggaaggagcggctgctgcggcgcgcggagacgttcgatgacctggtgacgttcgacgcgctggacagccgcgccgcgctcaccggttga

SEQ ID NO: 3191 - DNA, 624 bp, Myxococcus xanthus
atgccgttccatgagctgggccacgccatgacggcctggttctgcggccggtccgcgttccccacgctgtggaagacggccatcttcggccgctcctatgtcctcgcgctgatgctcgccgcggtgctgggcgcgtgggcgtggtgggggtggaggcgccgtcagtggctgtgggtggcctgcggcgcgagcctgctggcgctccaagccgtgggcacgctgctgctgtcgccgcagacagtggacatgctcatcaccttcaacggcgatggcgggatgatggtgctgggcacggtgatgatgctgaccatctatgccccggcgggcagctacctccacaagcaggccctgcgctggggcttcctggggctcggtgcgctgtcgctcatggacggcctcctcacgtggtggaagtcgaagaaggacttcaacgccatccccttcggcagaatggaaggcgtgggcctgagcgacgccagcaagctggtggggatgccccacaactggggcgagcaccagctcatcggcaggtacctgacggtggccaccgtgtgcttcgcggtggtcgccggggtgtacgtggtgcagttcgtgcgaggccgggcccggctcgccgcgcgctga

SEQ ID NO: 3192 - DNA, 1395 bp, Myxococcus xanthus
gtgggccaggaagacgcgaactgcttcgcctggcagcagttcatcgcgttgaactggcccgagtccggcatggacggggggatggctggctttggcacccccggggacctggagcccgtgcaatggcagacgtacatgagcaccggccagctcttcctgccggacgggggcgcgcctcccgcctggggcacgcaggcacgcatcacggatgcgtgtctggcggaagcggggctctccgtggcgcaggcccgggagcgcctgccgttgatggtcgcgtcgaagttcgcggagaacttcttcccggggagcgcgaaccaggcgttccccttcgacggctcgcccgcgtggctgggggcgcccggagacaccaacgtctggtacgacgtgaaggtcaaccagcccgaatacgactacatcgtcgacgcgggtctctacaacgcggcgaaccagctggccctggtggattcaggcgtgcccgtggtcctgccacaaggcgcgtaccagccagcccccggctcggtgggcgccatcgagctgaagtcggcgtggatggaagtgcccaatccctccgacgcgcgctggaacacctacaagctgtcgcccgccgtggtggtggacccgtcgacgcagcggtgccggacggcgaccgtggcgctggtggggctgcacatcatccatgccacccagtcccaaccgtccatcatctgggccacgttcgaacacgaggcgaatgcaccggaccagggcaccgacgcggggacgggcgcgtggaacttcttcgatgccgcctgctcgccgcgcacgctgacggtgcccgccaactgcgcggcggatgggaagtccacggaggtgacggtggggtgcgagcccaacgtgccgccgccgtaccacattggcggcggctgcccggggcccgtgcccatccaggtgacgcgactgacgcccatcgacccgatggcgcagcgggtgaatcaactggtccagcagaacatcgcgatgcacttcccggactcggtgtggaagcactacgtgctggtgaacgtgctctggtccaccaatcccagccccagcccgacgaagcccgtgaaggcgccgctgcccttcgccgcgcccacgccctccgggtcagtggccatcgccaacacgaccatggagacctatatccagcggaccgcggacttcggccaggggccccaggcgagcaactgcatcgtctgtcaccggaacgcgacgctcgctggcaagacgggcatcgcgtcggatttcagcttcgtcttcggactggcgcagggcctgccaccgtcccaggcaccgtcgctgaagtccatgcgcctgacgccgagccagaaggccgcggtggcccatcccccgacgatgcggcgaatcattcagtag

SEQ ID NO: 3193 - DNA, 975 bp, Myxococcus xanthus
atgcacctgacgagcacgcccaacacgctccagacggaaatcgggctcgcgtcggccgcgacggtgccgcgtcccgtgggcaactccaatccgcagacgctcatctgctgcgcgcagtatggccagcccgcccgcaacagcgacccgcacatcgggctgtccgtgaatcagctcgtcgcgccgcccaatccgcagcggccgtcaaacaaggccaccctggccaatccgcccgggctctacatccagatgccagacttctctggctaccagacgccggaccagacgaacgcggcggagttctggaccatcgtccgaggcacctcgtcgctgacggacccggatggcaggcccatgccgggcaactacatcctgcacgccaccttccgggtaccgccgaacaagcgctacaccgtctccgacatcaccatcaacggccagaagattcgctgggccgggcaggtggcgcagaccttcctcatgcaaatcaccggcatggggctggcgcagccatcccgcgcgccggtacaggactgcgtgggcgtgccgtccacggagctggcgcagccgctccagctcttccattccagcgtgttcagcgccctggccggtaccaacgtgcccaatttcatgggcgtgcccatgaacctggccagcaacagcaccttgattgccccgacggtgagggccggtgacacgaatgtccccatgttgctgaccgcgctgctgcccgacatctccgcgctgccgaccgtggccgtcgacgggggcggcatcaccgtccaggtgcaggacatgaagtcggtggactacgcggtgcccgggaacacctatcccgggccggtggcggccatccgcatcctggtctccgtgcaggcggacgcggcgccgggcccccggggtgtcttcgtcaccggtgcggggcagacgaagacaccgacgccgttcccctcggcgctgcacgtcgcctcccggtag

SEQ ID NO: 3194 - DNA, 1689 bp, Myxococcus xanthus
atgacgacgacgaacgaaacgcagggcctgaacttcctccaggaaatcatcgaggaagaccagcggacgggaaagtacgcgggccgcgtgcacacccgcttcccgcccgagcccaacggctacctccacatcggccacgccaagtccatctgcctcaacttcgggctggcgcagcaatacggaggcaagtgcaacctgcgcttcgacgacaccaaccccgtcaccgaggacaccgactacgtcgaggccatccagcgtgacgtgaagtggctgggcttcgagtgggaggaccggaagttcttcgcgtccgactacttcccgaagctctacgacttcgccgtgcagctcatcaagcagggcaaggcgtacgtgtgcagcctgtcccctgaggagattcgcgagtaccgcggcgacttcaccacgccggggcgcaacagtccgtaccgcgagcgctccgtggaggagaacctggacctgttccaccgcatgcgcgcgggcgagttctccgacggccagcacaccctgcgggcgaagatcgacatggcgtcgcccaaccccgtgctgcgcgacccgcccatctaccgcatccgtcacgcgcaccatcaccgcaccggcgacgcgtggcccatctacccgctctacgacttcgcgcactgcctgtcggacgcgattgagggcatcacccactccatctgcacgctggagttcgagaaccggcgcgtgctgtacgactggattgtcgacaacctcgtcagcggggaccggccgtaccagtacgagttcaaccggctaaacctcaactacacggtgatgagcaagcgcaagctgctcaagctggtgacggagggcttcgtggccgggtgggatgacccccggatgatgacgattaccggcctgcgccgccgtggcttcacgccggcgtccatccgggacttcgccacgcgcgtgggcgtgggcaaggcgcagcagctcatcgacatgagcctgttggagctgtgcatccgcgaggacctcaacgagacggctccgcgcgccatggcggtgatgcgcccgttgaaggtggtcctggagaactacccggaggggcagacggagctgctggaggtgcagaaccatccgcagaagccggagatggggacgcgccaggtgcctttcatgcgcgagctgtacatcgaggcggacgacttcatggaggacccgccgaaggggttcttccggttggcgcccggcaaggaggtgcggctgcgctcggcgtacttcatcaagtgcgagcaggtcatcaaggacgccgcgggtaacgtggtggagttgcgttgctcgtatgacccggccacgcgcggcggcaacgcgccggatggccgcaaggtgaagggcacgctgcactgggtacccggcaacgcgcccgtcgcggaggtccgcctctatgaccggctcttctccgtggaggcgccggacgcggacgactccaaggacttcaccacgttcctcaacccgaccagcctccagacgctgcgcgacgcccgcgtcgagccgatgctggtggatgccgccgtggagtcgcgctaccagttcgagcgcaccgggtacttctacgtggacccgaaggactcgaagccgggcaagcccgtcttcaaccgtacggtgacgctgaaggactcatggacgaaggagcaggccaaggggaagtag

SEQ ID NO: 3195 - DNA, 1011 bp, Myxococcus xanthus
atgttcttccaccaccggccccatccgaagagccagagtgaccggattccacagcgcaccgaggtggtgtggggcaccgacgccttcgagtaccggcggggcatgctgccgcgtttcttctggcggctggtgcgcgaggcgcgcgacgtggacgtcatcgtggcggggcaggagggccgggcggcgctgctggcgtgcctggcggggcggctgctgcgcaagcccgtggtgggcatgattcacttcgactggggcgccttccacctggagcagccccggcggcagctctggggcctgcggtggctctaccctcgcatgagccgcatcgtcgcgtgcggccacgattcagcgaaggccttccgggacctggtgccggtgcggcccgagcagctccacgtcatccccaacttcgtggacggcgaccgggtgcgcgccgccggtgagcacccgctgcccgcctgggcggagcccatcttccgcaagcccgtggtcatcgccgtgggccggctggagcaccagaaggccttcgacgtgctcatccggagccacgcgctgatgcgtcaggccggggtggaccagcacctgctcatcctgggggaaggctcgctggaggcggagctgaaggcgctggtgaagtccctgggcgtggaggactccgtcttcctgccgggcttcgcgcccaacccccatgcgctgatgcggcgggcggcggccttcgccctgtcctcgcgcttcgaggggctgcccatggtgctgttggaggcgctggccctgggctgccccgtggtcagtaccgactgcccctccggccccgcggaggtgctggagcacggcaagcacggcgtcctggtgcccatggagcagccccaggcgctggcggacgccctggcgcgcatcgtccaggacgacgtgcaccgggccgacctgtccgcccgggcccggcgccgctccgaggagctgtccgccgaccgcgccctcaaggcctgggagtccctgctctcgtcgctctga

SEQ ID NO: 3196 - DNA, 750 bp, Myxococcus xanthus
atggcgttcctcctggcacacgaagtcgagtcgccccgggcctgcagctacctgccggagcgggaggcctcgctcgaaaacctcgtgctggaggacgtcacgccggaggagtacgagcacctgctggtgcgaggctggcgccgcttcggcctggtgtacttccggccggcctgcgtgggctgcaatgcctgcgtgtcattgcgcatccccgtggagggcttccggcccaaccgcagccagcgccgggcgcgtgccgcgtgcgcgcacctgcgcgtggaggtggggccgccgcgtgtggatgacgcgcggctggcgctgtatcgccagtggcattcggagcgcgaggccgtgcgcgaatgggagccgtcacccatcaccgcgcgcgagtactcgctccagttctcctatccgcacccgtccgcgcgcgaggtggcgtggtacgacgacggcgcggagggcgggcccaggctggtgggcgtgggcatctgcgacgagacgccgcgcgcctggagcgccgtgtatttcttctacgaccccgcctacgcgcacctgtcgctgggcacggccaacgtgctgcaccaggtggagctggcgaaggcgcggggcattccccacgtctacctgggctaccgcgtcctggcgtgcgcgtccctgcgctacaagggcgccttccgcccgcacgagttgctggaggagcggcccgcgctggacgcggcgcctcagtgggtggcgccgcccgaggaggcttga

SEQ ID NO: 3197 - DNA, 1575 bp, Myxococcus xanthus
atgccccatcgcgtgacgttcgccgtcgatgccgtgaagcccgccgtcctgcccttggaagaggtcggactcaccgaagccctgagtgggcggttggacgccaaggtgctcggggcctcccatcgcgaggcgcggttcgttcgtcccgaggcgacccatccactgctctccgcggtgcatctcgccttcagcgggcaccgcccattggtgctgtctccggacatcctctggatcaccatcgcccaggggctggccctgcacatcacccgcaacgcggaggcgctgcgattcgatctggtacgtcaccaggggcgcaagcagttggtggtgacacgcgacgcgtcccagacggacctcgcatcggatgatttctggcccggcgtcgtggacgacttctccgggatgattcaagggcactcgcccgcactgcacgacctgatggtgtgcgatttctccacgacggggccggtggagcgcgtggtcagtcaaatcgtgctgatggatgcgatgcgggagtacttcgactacgtggtgatgtgcatctgcggcattcccaccatcacgctcgagggctcaccggaggactggcgcaagctgcgggacaaggtcggacagcttcctcggtacggcatggaaacctgggcccggcacctgctgccgctgtgtgaccagttcatccgagcttccgagggacgggaggatcgcaaattctggcaatccatctacaagctgcaccacgcctatggcagcgataccttcaatggctggattggcaagctgttccccttccttcgcaatcaattgacgggcgaatatgactttcccaatccgatgctggaggcccaggcgctgggcaagcccgacgccacggagaagggcgaaaccctgtccagtgacagattgcccaccgggctgtcccgggtgtcgctcctgctcgcagtggccaccgattcagggatggtgaaggcacggatggccctgacggcgggcttcatggggacgctccagtccgcggagacgctggcgctgcggccggtgccaggctgggtggtccacgaggacctggggctggatgcgatgctccggcgcatcaaggatgagcaccgcatggccgatgccctctcggaggcacgtcacagcaagtggcgcgacctgtggggggaatgtggaatcccggcggacatcagccagttctacgccgcatgcgacggcgcgtcgctcttcggccagggggatgcggccgtgtaccgcatccgggcgtcgggggcgctggagttccacgacgggacgcgctggaacaagacccgtctggcagatccgcaatccagcggctacccgcacggctggacgcgcttctgtgacgtgggcgaacacggcttcctggcctaccgtttcaactcacagcagcatgggaagctcccgctctactgggtggaaagcgctcagtcgcggaccggcgtgtgcgtcgccgcctcgctgacggagttccttcacaaggcgctcaattcacaggggcgcgtctacttccaggagccgggcttcacgccgggagaggtcgaggagttgtggttctga

SEQ ID NO: 3198 - DNA, 1272 bp, Myxococcus xanthus
atggagggccgtccgtccgtgctgctcttctccgcgggcttctacggcacgctcgcggccgcgcgttgcttcggacgcaatggcattgacgtcacggtggcggaccccggcaagctggggcccgcgagctggtctcgcttcgtgggccgccgcgtgcagtgtcctccggagtcccaggccgaggccttcgtcgagtggctgatggacctgggccgccgcgagccgatgcggcacgtgctctatccgacgagcgatgagctggcgtggctggtgtccgtccaccgcgaggcgctgtcggagtacttccacctctacgacccgggcatcgacgccgtctacggcctgctcaacaagcgcaagctcttcgaggcgggccaggcggcgggcctgaagctgccgcgcacctggttccccgaatcggaagcggacctgaacgtggtgtcccgcgaggcgcgcttccccgtcctcatcaagcccactacgcagattctctactccacccaccgcaaggggcagccggtgcaggcgcccgagcagctcgcggaggagtaccgcgccttctcgcgagacgggtacgcgcccatgctggtgcgcttcgaccccgcggtgtcgcgccccatggtgcaggagttccacccggaggcggcggagggcatctacagcctctctggtttcgtggacgagacgggcgagctgttcgaggtgcgcggcgccatgaaggtgctccagcgtccgcggcggctgggcgtgggcgtgtgcttcgaatccgccccggtgcgcgaggagctggccgcggggctccagcgtctgtgcaagcgcctgggctaccacggcgtcttcgaggtggagttcatccagacgaaggacgacttcctcctcatcgacttcaacccccgttactacgggcagatgggcttcgacatcgcccggggcctgccgctgccgctcctggcctaccacgccgcgctgggggaccgggatgccctgcgccgcgagctgcgggccgcgcgtgactggcgtggcaacggcgaggtgttctgcaaccgcatcgcgctggagatgctgctcaacctccagcggctgtccggtgcgctgccggaggacgaggcccgccagtggcggagctggctggcgtcacaccgggacgtggcggtggacccgctcatcgactcggatgacctgatgcccaccgcggtggaggtggcgcagattctctacggctccgcgcgccacccccgggccttcatccggatgatggtgctcaaccggtga

SEQ ID NO: 3199 - DNA, 813 bp, Myxococcus xanthus
ccgctggacacgaaaacacggggacggacgtcgcgcgggcgcctgcgcgcgctggacgcgttcctgtgccgcttcgagcgcccgttgctcgaacgccgtgacgggccctgggcccacgcggtcttcgtcgacgtggggttcggcgagcacccgtggacgacgctggagagtgcccaggcctttcgcgcgctcaacccggagctcgccgtggtgggcgtggagctggacgcggagcgcgctcgggcggcgcaggcggacgcggatgcccgcacgtccttccgcgagggcggcttcgcgctgccccttcgtcccgacgagcccgcccggctggtgcgggccatgaacctgctccgccagggcgcccccgagcgtgtccccgaggtgcaccgcaccctgacccgctacctgctgccgtcgggcctgctggtggaggggagcgcggacgcgacgggcgcggtgatggccgcgcacctgctgcgccgcggcgttggggagggcgcggagctgccgctgcgcgaagcgctcctgttccacaccgacttcagcctgggctttgcgcccatgctcttccgggactggctgccccgggatttgcgccgccgggtacgtccgggggagcccatccatgacttcttctccgcatggagcgccgcctggcagcaggcgcggaccctgggccatacgcacccacccgatgcgtttcgcgaagccgcgctggggctctccgcacgcatggagggagtggcgaccgacccgtggctcttgtcccagggctacgttgtttggaggcccaaggggggcgtctgtttttga

SEQ ID NO: 3200 - DNA, 345 bp, Myxococcus xanthus
cggctcatggccgggcccgaggaggcgctgcgctatggcgccttgctgggcgcgcgctacgtggtgccctgcgcggatggcggggcgccctggtactggcgcgagggcatggggcctcgctacgcgggctaccccggcgagcccgtgagcggcgccagtcacctggatgagaacccggacgcggacccctatccggagcggctcgccgaggtccggcggacgatgaaggacgttcccagtcccctggtgctgcggccgggagagtcgctgcgctggaagggcgcgaggacaccggaggtggtgcgccaccctggcttcgtgtggcctttcggcgacgcggcgtga

SEQ ID NO: 3201 - DNA, 1104 bp, Myxococcus xanthus
atggccgtgcaggctggtcccagagtgcaggtgccccacagccatccaggccggaggcctgacggtagtagtttcctcccgaggcccactggagggggcagcgcgctgcccatgagcccatccccgctgcgaatcgtcacctacaacgtccgctacttcgggcacatgctccgcggcctggcgagcaccgtgggccccaagcggcgcgtcgctgcggcgttggcgtcgctggacccgctgccggatgtcgtctgcctgcaagaggtggagacgtcctcgctgcgcagcaacatcgccgaccggcccaagcaaccgggcgagacgcagctcaccgccttcatgggccggatggtggagacgttcgacaggctgggccgggagatgccctacgaagccttctacttccgcgcccaccactacaagctccgcgaggtgtccctctacaccactgggctcgcggtgctggtgaacacgcgcaagctggaggtggccacgcacaacgtgggcgccccccaggccatcacccaccaccacgtccaacggctcaaggaccggaagcagagccgcatctgcgcgcacatgcgcctgctgcgccgcgaggacaggcaccccttccacatcttcaacacccacctcagcctgcccacgcccttcgcccgtgagttctgggccacgcgcgacaagatgggcggcggcgtcaaccagctccacgaggcgcgcaaactgacggagttcatgcaagggctgaccggtgacgagccctacatcgtgtgcggagacttcaactcaccgcccgcgtcgcccgtataccgctacctcaccaccgatggccggctcacctgcgcacaggccgccgtgggacagattgacccgaacgtgtcgcgcggcttccccaccgccggcttcttgcacatgcggatgcacctggaccatgtgttctccggcgcgggcgtgcgctggctcgacacgcaggagacgtctcctttcggggacctccgcagccgcttccacgggttgtccgaccacatgcccatcgtcgcgcgcttcgccttggacagcggcaagacgctcatcacgcctccgccgacgtcgttgctgctgtag

SEQ ID NO: 3202 - DNA, 2595 bp, Myxococcus xanthus
cgtcccttctcccttcctggcgccaccgagcactacgccgccgagcggccggtccgcgccgagcacgtccgcatcgaggtcgacctcgatttcgacacccaccgcatcaccggcctgtgcaccacgcgcgtctccgccgtccgtccagtccacaccctcaccttcgacgcggtggacctcgacgtgtccgacgtccaggtagacggccgcgccgcgcgcttctccaactccggcgcccacgtccgcgtggagctgtccgcgccgctcgccgccgggcaggcctgtgaggtggccatccgctacacggcccggcctcgccgcggcctctacttctgggcgcccgacgccgcctatccgcaccgtccccaccaggcctggacacaaggccaggacatcgacgcgcgtgcctggttcccctgcctggacacgcccgcccagaaggccacgtccgaggtcatcgccaccttccccgaggcgatgacgtccctgtccaacggcacactggaaagcgaccgcgtccacgatggccgccgcacccagcactaccggatggcgcagccgcacgccccgtacctcgtcacgctcgtggtgggtgaattcgaggaggccaccgacacggctggcacggtgcccctgcgctacctcttccccaagggccgcaaagaggacgcgctgcgctgcgtgcgccgcacgccggagatggtgcgcgtcttccaggaagtcaccggcgagccctacccctggagcagctacgcccaggtcttcgtcaccgagttcatcctgggcggcatggagaacacctccgccaccagcctcacggacaccgtcctccacgacgcgcgcgcccaaccggactacaacgccgagccgctcatctcgcacgagctggcccaccagtggttcggggacttgctcacctgccgtgactggccccatggctggctcaacgagggcttcgccacctggctcgagatgctctggaaggagcgcgccgacgggcaagacgaggccgaccagcaccggctcgtggacctggaggcctacctgggcgaggcgcgtgagcgctatgcccgccccattgtcgcgcggcgcttccacgcgcccatggatgtcttcgaccggcacctctacgagaagggcggcctggtcctccacgagctgcgccgccggctgggcgatgacctgttcttcaagggcctgcgccactacgtcgcgcgacaccgccacggctccgtggagacggtggacctggcccgcgcgttcgaggacgccacgggccacaacctggacgccttcttcgaccagtacatcttcgcgcccggccaccccgagctgaaggtcgacgtccgctacgacgccgaggaagcgcggctgcgcctccaggtgcgccagacgcagtccacggcggacggcgtgcccctcttccggctgccgctggatgtggcgctcaccgtggacggccgcgacaccgtccaccggctggaggtgacggacgcggagcacgcgttccacctgccctgccccagcgcgccctcgcaggtgcgggtggaccctcggcgcggagtgctcggcacgctgacggtggacaagtccgcgggcctttggatggacgagctgcgtgccgcgccggagatgcgcgcgcgcaccgaagccgccgtggccctgggacgcgacggcagcccccgcgccgtggacgcgctgggcacggcgctggcggacgcgcgtttgttctggggcactcgcgccgcgtgcgcgaagtccctgggccgcatccgcacccccgattcccgcgcgcgccttctggacgcgctgtccaccgagcatccccgcgtgcgccgcgccgtggtggcttcgctgggcgagttccgccgcgatgcggaggtgacagcccgcctgcgcgccctggtgaacggcggtgacaccagctacttcgtggaggcggaggccgcccgcagctatggccgcgtgcgcgcgccggacgcgttgggcgtcctggaggccgcgagcacccggccctcgtaccaggacgtcatcgccgtgggcgcggtggatgggctcgccgagtctcaggaccccgccgccttctcggtggtgctggcgcgcaccgcctatggccacgcggctccgctgcgccgcgccgccacgctcgcggtggcgaagctggcggaggtcgcgggtcgcaagcgcgaggccgtggacctgctggcggagctgctccgcgacccgctcttccgcgtgcgcatgggcgtcttcgaggcggcgcgcacgctgggggattcacgcctggtgcccgcgctggagcagacgccactgttggatgccgtcgcccggcgcgcggcgcgcgagacggtgcgcttcctgcgcgaaggtgaaccgcaagtccgcgaggtggcatcgctgcgcgaagaggtggaccgcctcaaggaggagacacgggccttgcgcgagcggttggaagggctctcgctgaagccccccgaaccgccgcgtccaccgcgcgggggcgcgaagccggcgcgaaagcaggtcactgcgcgcacgaagacagccgcacgcaaggcgggtggccggaaacgcaaggccacgcgccgctag

SEQ ID NO: 3203 - DNA, 1263 bp, Myxococcus xanthus
atggtggagctgacggtgggcgcctccggcaaaggccgggatgagcgcatcgtcctcaacttccgccgcctgcacgaggtcgtcgacaccctggccgagcccgtggagcgcacgctgcacggactcgagtcggagagcgttcctggcgacgcgctcttccggaccgtcgtggagcacgcgcccatgggaatcatctacttcgaccggagtgccatcgtcatcgcgtgcaacgagctgttcgtgagcatcatcggctcacccaagcgcttgttggtgggcctcaacctcctgtcgctccgggatgagggcatcctccactgcgtccgggagacgctggcgggacatacctgtgagtacgaaggcgagtaccgcgccatcacctcaggcaggaagacgccggtccacgtgcgcttcgccccctgcttcaacgcggccggacaggtggagggcggcattggcatcgtcgaggacatctccgagcgccgccgcgcggagcgcgagcgcgagcgcctgtaccgtgaagcccaggaggccatccgcgtgcgcgacgacttcctgtccatcgcctcgcacgagctgaagacacccctcaccccgctgagcctccggctggccacgctggagcgccggctggcgcgtggcgagctcgtggagtcctccaccttgcgtcaggcgcgcctgtacctcttgcgcatcaccagcctcatcaacgacttgctggactcctcacgcatcgaggcgggacgactggcccttcaccgggaggccacccggctggaaggactggtggagcacgtcctccacgagctcgagccccagcgcggcaaccacaccgtgcggttcgacgcgcccgagcagcccgtgcaggtgaacgtggaccccttccggatggagcaggtgctcgccaatctggtggagaacgcgttcaagtacagcccgaatggcggcaccgtgcgcgtgagcttgcgccagcgcggcgggctggcgctcctgtctgtctccgacgaaggcatcggcatccctccggaccagcagaagctgctcttcgaccggtacttccgggcgcgcaacgcctccgcccattccttcggtggactggggctggggctctacatcagccgggacatcgtcgagcgccacggcgggcgcatctgggtggagagcgagccaggccatggctccaccttccacgtcgccctgcccttgatggcgggcgctcccgcgcagccgaacgtcgaggaacccggacagctcatccactga

SEQ ID NO: 3204 - DNA, 558 bp, Myxococcus xanthus
ctcatggcgagcgcagaggaaatcctgagcttctggttcgggcagccacgtgagcggtggttcctgcgggacgaagccttcgatgatgaatgccggcgccgcttcctgcccgccgtcgagcgcgccgccgagggcgagttggacgactggcgggacgagcctcgcagctgcgtggccctgctcctgctgttggaccagttcccgcgcaatctcttccgcggcacgccccaggccttcgcctcggacgcgcgggcgcgcgaggtggcccggcacggattggcgcgaggcctggacatggccctgccgccgctgtggcggtggttcatgtacctgcccttcgagcacagcgagtccgtcaacgaccagcggctgtcagtggccctcttcgaggtgctcgcgctgtatcactcggacagccgggcagcgctcgactacgcccggcaacaccgggacgtcatccagcgcttcggccgcttcccgcatcgcaacgtgacgctgggacgtccgacgactccggaggaaaccgtcttcctccaggagccgggctcgtcgttttga

SEQ ID NO: 3205 - DNA, 2298 bp, Myxococcus xanthus
atgctgggcgtggcggtgctggccaccacgctggccgccgtctgccttcacttcgacgcgaagctgggcggcctgctggaggaagcggagcgcaccgcgtacgacaccgtcgtcacgcgattcaccgcgcgacgcgaggtgtcatcccaggtggtgctggtcaccatcgaccagccaagcctggagcgcatccgcgccaacgaacagtacgcgctcaacttcggaagctggccctacagccgcaacctctgggcgcgcgtggtggaacagttggaagccgagggtgctcgggccatcgtgttcgacgccgtcatggacgagcgcggcacggacgagtccatggacctggccttcgcgcaggtgctccaggagacgtccatccccttctacctgggggtctccacccacgcgaacgcgccgctgctgccccccgctgacttcggcgcggcggtggcggtggaccgccccactcaggaggaggacaccttcccggaggaagccggcgcggaaacgttcgaggacggcgccctggaggcggtccttccctccgcttctccggagcagcttgcccgggccatcgcgtttccggtgcgcgcgaacggccggacgctgcccgcgctggattacgcgacgtcctcgggggagcggctccccagccacccggtaccgcccattcccgtgctggtgggcgcggtggatggcttcgggctggtggagccggagtcggacgccgacggtttcatgcgccgcacgcgcttcgtttattcggatggtcccaatgccttcgcgacgctgccggtgcgcgtggccgcgggcctgttgggcgccagcgccattgagttctccgggcgcacgctgcgcctgggctcgcgcacctacgccgtggatgcggatggcagcgctggcatcgacttcggcgggcagttgcatgaccgcttcacgagcgttccgcttatctccgtgctcgacgcatgggtgcaccggggacagggccaacccacggggctgccgccggacgtcttccgcggcaaggtggtcatcattggcggcaacgcggtgggcctcaacgacgtcaaggccacgtccttctcgtcgcatgagcccggcgtggtgaaacaggcggcggtgctggacacactcctgggcaacggccgcttcatcacccgcgcaccgctgggggtgagtctggcgctcgtcttcgcggtggccttcgtgtcggtggtactgctgatgacgacgcgctggacgccgctggagattgcgtggccgctggggctctacgccggcatgagctgggtgacgggccccgcccttggactgacgaacacctacgtgctcaccgccctgcccgcgctggcgggcgtgctggccagcgtcagtgcggtggccttcaaccacctggtggccaacgaggaggcggctttcatccggcaggccttcagccgcttcatggagcccaagctggtggagcagatgattgcccagcgcgagctgcctcggctggatggggagaatgtcgaaatcaccgccttcttcagcgacatccgaggcttctccaccttcagcgagcgcttcaaggacgacccgcgcaacctggtgcgcctgctcaatacgtatctgacgcgggtgagcgcggcgctgctgaaggaaggtgggtgcctggacaagtacatcggtgacgccgtggtgtgtctcttcggcgcgccgatgcgacaggcggaccacgcactgcgcggctgcaagggcgcgctcgcggcgaaggcggcggtggaccggctgcgcgacgagttccgcgcccaggggctgccggacatgtacacacgcatcggcgtcaacaccgcggtcaacttcgtgggcaacttcggcagcgagcagctcttcagctacaccgcgattggcgacgggatgaacctggccgcgcggctggagggcgcgaacaaggcctatggctccgtcatcatgattggcccgcgcacgtacgagctggcgcgcgagcacatcgaggtgcgggaactggaccgggtgcgcgtggcgggcaagacggaggccgtcaccgtgtacgaattgctcgcgctcaagggcgggctggacgcgcgcaagcggaagacggtggagcgataccacgcggcgctggcgctctaccgcgcggcgcggttcgaggaagcagcagcggtgctgaatgcgcgccgcgcggaggacccggaggacgggcccacgcaggcgttgctggagcgctgtcaacgatatgtgaaggcgccgccgcaggacttcgacggcgtggcgaacctggacaagtga

SEQ ID NO: 3206 - DNA, 573 bp, Myxococcus xanthus
atgaagacgcgggtggcgtggaccaccgccctgctggcgctggcgattccggcgggagcgtcggccgtgaaggtcggcgagccgctgtacgtgaaggcgaagaacacgcgcgtacaggtgagcccgtccggctcggacaacgccgtggcggtgctccagcccggagagcgggtgacgtggggcggcgcggatgcgaagcacaagcagtggcaccgggtgaccacggccaccgggaagaagggtttcgtgttccagacgaacctgtccaccacgccgcccaacatggagctggtgacgcaagggaatggcacccagcaggtggatccgaagaagttcgtcgccagtggcgccgcggtgaaggcgctcagtcccggcgcggagcagtacggcaaggacaagggcggcgaccacggcaaggccgtgcaggacatcaaggcgctggaggcgctggcgaagtccgtgtccacggcggacatcgccgcgcacgtgacggcggcggggctcttcccggtggtgggcgccagcgacacggtcgcgaaggccgggacgaacaagcggagcggcaaccgatga

SEQ ID NO: 3207 - DNA, 987 bp, Myxococcus xanthus
atgatgcgaacgggctggaaggtgctcgcgttggtgggtctgggcgcgctgacggcgtcctgcaagggcttcaatgcgtcctcactcacccggggtgagaacatcctggggaagctgagcgccgcgtccgcggaagccaagacgtgcaagaagctgcgcgccgcccccagcgtgcaggaggagtacgccctgggcggcgcgctggccatcaacttcgtgcggcggggtggcgggctgctactggacggccccaacgacgcgctccaccgctacgtcaacgtcgtggggaagaacctggcggcgcaatccgcgcggcccacgctcgagtggaccttcggcgtgctccaggacacgtcccagttcaacgcgatgtccgcgcccggcggctacgtcttcgtcacccggaagctgctccagggactggagaacgaaggacaactggccggcgtgctggcgcacgaaatcgcccacgtcacgctcaagcacgccatccaccagtacggcgacgcgaaggtgaagacgtgcgagctggtcacctacggcgaggccgtgctctcccccaccgcggtgaaggtgctctccgcgggccgcaacggcgacgggacgctggatttggaccaggacccgggcctgctgggccacctgagcgagaagaccatcgacctcatcgacaaggggaacgccaaggagcaggagctggaggcggaccggatcgccgtcgagctgatgctctccgcgggctacacgccggacgactacctcgccctgctggccaagacgaaggacgggggcagcaccttcgccaaccacccggggaaggacgagcgccggcgcaacatcctcgcgcacgtccaggcactgaaacagccggctggcgccttcagtggactggccaccgaagggctccgctcgccgccgctcagccccgccttcgccgccgtgcgcggtggaaacaacccacgcggcgtggcgaaggacgggaagtag

SEQ ID NO: 3208 - DNA, 1638 bp, Myxococcus xanthus
atgcatgagaacggcgtcagcgagaaggtccgccgcacggtgatggtctacgcgaacggccgcgtgacgcaggtgctgcactacaatggcgccggcgaacgcgtggtgccctccaccggagagccgtaccccacgcggcccgcgaacctccccgagaaggctgagtaccgcgaggaccaggaccagtgggcgtccgtgtcgctcaacgcgaaggccgagcggcacgggctgtgccgattctgggaccgggaggggcagctcctctgggagtgcgaattccacgaaggcagccggcatggccgctatcactcccgcgccgtggacgagtacgcggaccctcgggtgcggttcgacgaaggggagatggaggacgacttcgcgtgcggcacgtggaagttgctggatgcggagggcaacgctgtcgtcacccgggacctgggcgttgtccaggaccacgagacgttggatgcctcggaggtgttctcgaaccttccgaggagcgccgctgaatggcgtgcgttcgccgagcaggctcgggcggaccggcgataccgggaggcgctgctggccatggcgcgggcaagcgccgtgtcgctggatgcgggcccgctgaaggcatggctcgagtcgctcaccctgcctcgaacggaggcgagtgctcgcgagaatgccgaaggcgtgatgaacagcgcgggggatgagcgggcggcgttggcggatgcgatgatgcgtggcgcggaggccgcgatgttgcttcggggcttcgcggtgctccacgaccagcaggaccggccccgggcggcgttggacttcatcctggccgcgatgctgctcgcgccggagcgctcggcgtacctgttcactcggagcctcatcctggcgaacctggggctgggcgagcagatgcagaaggacgcggaggcgctggcgccggcggagccggattcgtggaagttcctctcggcttaccggcgggtgctgtttccgcgcttcgagttctggccgggacgtgagcccgcgcactgcacgttcgatgaggtccccgacgggcccacgaaggagctggacgcggtgcaggccgtggtccgcaagtacgccactcgactccagttgctgcgcgcggagattctctcccgcttcaagcccggcacgaacgtgccctggctgccgcccgatgtgtcgtccttgctgccggacgggcccgtcgaactggagcagacggaggtcgaggacgcggatggtgactcggtggatgtcgacgagacgctgtccacgaaggggatggggattccggccttgtcccgtgcggcccgtggagactggagcgcgctgacctggctcttgtgggcgtgcggggtggattcgattcggatgccggatgcgctgacgcctccggccgacttcggtcaggccgcgggacaggccacgcagcggctgtggcagtgccgcaaccggcggtcccgtggtcgcatcgacccggacctgccaacgttcgatttcgaaggggttgccctccaggagctgcatcccaatctggcggggattgccgaagagcagtacgcggagacgcaggcgatgttcttctggctgaccgacgcgaaccacgtgtctccgtggcaggccaatctgagggggtag

SEQ ID NO: 3209 - DNA, 153 bp, Myxococcus xanthus
atggcgggcgtggaaggcgcgcccacgctggcggaggatccgccggaataccgcgagcgcccggaagtccgccggctgctgcgcacggtgcgcaagctggacgcaccgcgtcttcgcctgttggggcaggtggcgaacgcgctcgagacgtag

SEQ ID NO: 3210 - DNA, 771 bp, Myxococcus xanthus
atgtgcctgctgggctgggccatctgcttctggaactacgccgtcctgcacaaccacatgcacgtgtccatcgcacggcctccgctggcgcactgggtggtgtcccgttcgctgggcatggcgtgtgggttcccctaccggggctacttcatccaccacttcaaccaccaccggtacgatgacggcccgggcgactggggccgccgccgtcccggagagcgcgtcttccgctactgcctgcgctcggcgctgacgccgtggctgtggccctacgagacgctgggccaggtctggcagtgggcgaagaagaagaaccagcggctggagctggcggtggatttcctggtggtggacggcgcgctgctggcgctcatcgtgtggaagcccgcgctgggcctggccttgtggggggtgctgctggtgacgcagttctgcatccactggctcaacctggcagcccacttcgaaacggactccgaacagaaggacgccctggggaccacgtcttattccgccttctacaaccggtggttcttcaacgccggctaccatcaggcccatcacctgaagccgcaggtgccctggtacgagctcccggccctcaccgaggagctcgctcggacgtccaggctccgtccagagctgacgaccgggctctcccccatcaatccgttgtgggtggcacgggtggtgaagcgctattctgccaagccgtgcgatcggcagacggagtcgaagattaccgccgggacccccacggccgttacctag

SEQ ID NO: 3211 - DNA, 678 bp, Myxococcus xanthus
atggcctttgccgccctggtcaaatacatgcagccccgcgagaaggacttcagtacctccgtgctgaagcaggcgctggtgcggccggaaggcgtggtgggcgcggtggtgggcggcttctacacgctgctgtccggggcctatcccagccgggcattcaccgctcccgacaccgcccttcagtggttggggcagccggaggccgaggccgcggcgctgctggcggagctcaacggactggtcgcggaggccaccggccagtctcccctgctgcgcgagctgcaccaggtgatgcgaggccggctgccggaggtgaatctgtcggacgtggcccgggagatgggcatgtccgaacggacgctgcaacgccggctgaaggaggccagcacgtccttccaggcggagctcaacgcggtgcaggtgcgcatggcgcagtcgctgcttcgcgagtcgaacatgaagctcaccgcagtggcggtggaggtgggctgcgcctcgctccagcacttcagcagcctcttccgcaagctggtgggcgagtcccccagcgcgtggcgggaccggcagaagcagccgcagggcgacggcacgccaccacccgccgaggccctgatggaggaagtggctggagcgcccggtaagggccccgtcgcggccacgtccgaagtccccgagtag

SEQ ID NO: 3212 - DNA, 681 bp, Myxococcus xanthus
atgcgtcctccggaggtccgtgagcccttcgccacgctggagcggctccacggcgacgtgttgtcacaggtgctggtggccgatgagggcacctcggatggcatgtggagagacccgctgggggacctgggcgaccggctccaccccggcagccgggatgacgcctacgcggcgtccacgggctacctgctgctgcgggacggccggcccgcggcggtggtgcgcaagcagggcactccgttcgaggacctctggttcctgcaagaagccctgagcaggctcacccctcgcgtgcccccgccggacccggcccagcggccaggacgtcgccgcgcggagcccgcgccccgctcacccccacggcccgcgagcggtggcacgaacgcccgcgccacgggcacgcgggagcggaccggctgggacgatgaggccacgccgccccggggtacgcgcgtgccgccgcccgagccgccgaggaaggacccgtggacggtgctgggcatcgcgcccgggacgcccctggatgtggcgcgcaaggccttcagggcgctggtggtgcagtaccacccggacaaggtggcgcacctggcgccggagttccacgcgctcgccgagctgcgcacgcgggagattctggacgcgtgggaagaggtggagcgagcgctgtccggaggggcgtga

SEQ ID NO: 3213 - DNA, 513 bp, Myxococcus xanthus
atgcctgacccggtgcggcgcacggcgctcaaccccacgctgcgcaaggagtccgtggtggcgctgggcgtcttcggcgctctgacgttgggcgcggcggccctgggcgctcgcgtcagctcggcggacacgcgctggtaccggcgtctgcacaagccctcgttccagccgccaccgaaggtcttcggtccggtatggacggtgctgtatggcctcatcgccctttctggttggcgtgtatggacggcgcccgcgggcgcggcccgctcccaggccctggcctggtggggcatccagatgggatgcaacgccgcctggtcctggctcttcttcggcagacaccagccgcgccgcgccctggcggacaacctggcgctgctggccagcgtgacggcgtatgtcgccgtcaccaaggatgtggaccgccctgcggcctggatggtggtgccgtacctgggctgggtgggcttcgccaacgtgctcaacgccgaaatcgtccgcctcaacccctga

SEQ ID NO: 3214 - DNA, 1002 bp, Myxococcus xanthus
atggacgccgccctgcgcgagccggacgacgcgcccgtctacgaggagccgccgccggagcccgaagcggtcgccgacgtgcccgtgacgtacggggctccgccggaggcggaggcgttgctcgacaccgagccgcacgccgggcccgtcaccttcgccgcgccgcctcctgcgctgcacttcgacgccgtcagtcctcctccggaggcgcaccccatgacgcaggcctcggctcccgtgtccatgccgcacgtcaccgccaccgtcgcggagccggtggcccgtgtcgaagcgccgcccaccgaggtggaggtgcagcggccggccccgccgcgcgaggacgggcaggactcctcggcccgccgtgagcgactgaaggcccggctcaaggcggtgcgggagaatccgcgcccggagccgctgcccgccaccgtggcggaggcgggtcagcgcgccgtggagcgcatcacccacctccaggcggagctggtgaaggtgaaggcgctcaacctctccctcacgcaggacctggaggtgtcgcgccgtcaggcggagaaggccacggaagaggcccgcctgcgcatggacgaggcgcgccgcctgtcctcggagatggagggccgggtgaagctgctggccgacctggagcgcgagctgtccgcgctggagggcgagcgcgacgaggcgctgctgtcgctccaggagacgcggcaggcgcttcaggccgctgccaaggagcgcgaggccctggaagaagaggtcgcccgcggcaagcagtccctggtggacagcctggccgaggaggagcggctcgccggtgagctggagtccgccaaggacgagtccacgtcgctgcaccgcgcggtggaagcactccagggagagcgcgacgtgctggctcagcaggtggcctcgctcaccgccgagcgcgccgagttgctcgaggcgcgcaaggccctggagtcggtgcaccgggccctgagtcaggccacggtgcgctga

SEQ ID NO: 3215 - DNA, 960 bp, Myxococcus xanthus
atggaagcgccgacgtacagctccaagcaggtcgccgagatgctcggcgtgtccccgaagcagattccggaggaatcgcggaaggacgcctacacgccggacgacatctgggagctgcgcaccacgctcgaccgtttcccggcgcggctgggccaccgccgccagctcttcctgaacttcaagggtggcaccggcaagacgtcgctgtccacgtcctacgcctggcgcctggcggagctgggctacgcggtgctgctcatcgacctcgacagccagggccacgccaccaagtgcctgggctacgagggcgaggacttcgagaagacgctcctggacgtcctcgtccgcaagacacccctggccaaggtcatccagaagtcctcgctgcccaacctggacttcgtcccgtccaacctgaccatgtccacggtggacctcgcgctgatgcccatggccggccgcgaattcaagctgcgcaacgccctcaaggacgtggaggcccagtacgacgtcgtcgtcttcgacgcgccgccgtccttcggcctgctcaacctcaacgcgctgatggcggcgaacgacttgttcgtccccgtgctcgcggacttcctgtccttccacggcctcaagctgctgttcgaaacggtgcagagcctggaggaggacctgaaccacgtgctcgaccacgtcttcatcgtggtcaactccttcaacgccaccttcaagctggcgaaggaggcgctggaggcgctccagacgcactatccggagttcctgctgcccaccatcatccggcagtgcaccaagttcgcgcaggcctccagcgaggggcggccggtgttcgtcgcggacccctcgtccaagggggccaacgacatccaggccatgattgacaacatcctgccccggctggtggccgcggcagccgtcgcccagacgaagggcacccagcaggccggctga

SEQ ID NO: 3216 - DNA, 1938 bp, Myxococcus xanthus
atggagcacctcaagcgcgaggtcgcggagacgcaccagcgcgagctgggcctgcgccgtgaggtcgcggagctggaggtccgcgtgggtcggctccaggccgaacgcgaggaactggcccggctcaaccaggccctgcgcggcgagcggaaccagatgatggacaagctgctggacgtggggcgcatccgcgccaccgcccaggagcgcgacgacgaggacgacgacctggggctcgacctggcgtcgttcatctcccagcttcgcagcgaggtgctgctgcgcggtgaggcgggtccggtggcccgcgggctggtggtccccacgcggcgctcgccggtgccgctgcgtgagacggcggccagtgtccccgtgacgccggcgccggtgagcgagccgcccgtggccgctgtcgtcgggggcgacggcctgtctccggtggcgcgtgaggcgcagcgcttcctgcaggcgggacggttgggcgtgagcgcggcgcagcacgcggagctgtcctcgcacgcgggtttcggtgggccgacggatgagacgttgttcgggttctccatccgcgagctgtccgcgcaggatggcgcggcccgagtgcgtgccgcggagcgattgaaggcgctgtcacagccggccgccgcgcccgcgctggcgtcggcgctgcatgcggagacggatccgacggcgcaggtggcgctgctccaggccttcgcgtcgctgtgccaggaagagggcgcgtcggtggtgtcgccgctgctcgcgtccccggtgccggaggtgcgcatcgcggcgctcaaggcgctcctgacgctggcgccgaaggacgcggcgccgcatctggcgcaggcgatgaaggacccggaccgctcggtgcgccgccgcgcgtcgctgctggcgctgggcctggaaggggagacggcgcggcggctgggcgaggaagccatccacgacgcggatccggaggcgcgcgcgctggccgcgctggcgctcggagctggcgctggggagaacgcgcgcacgctgctgctgggcgccttgggtgaccgtgagcagcgcgttcgcaaggcggccgcgcagagtctgtcgcgcatcctggggcaggacgtgtcctcggtcgtggacctggacgagacccaccgccgccgggagattcgccgactggcgacgttgcctgtgaagcctgtgcgggcgcggctggagcagcctcgtccggtggtggcttcggtgcaggcggtcgcgccggcagtggctgtcgccgcggtggttcaggcgccggtggcggcggtcgagcagcccgctcatgcggtcgccgccgtgggggctgcgaatcggcaggccgtcaccgtgggcctcgcgcagggcgctggtccggtggggcctgtgcaggggcgagcaggccccgtgggagcgccggtggctccgacgcccgcgccaacgccacaggccgttgctcccgtgcagcgtccgcctgcgccaactcctcaggccgccactccggtgcagcgttcgcccgcgccgccgccacaggccgccgctcccgtgcagcgtccgcctgcgccagctccgcaggtcaccccaagccattccagtcccgcgcaggctccgcgcgctccggctgctcgcctgtcccccgtccaagcggccttggtggccatgggcgcggtgcccgggcaggccgcccccgcgccgcgtgttcccgctgccgccgcagggccgtcccgtccggcggccccctcgcgccccagtgcgtcaccggtggaatccctctgctcgcagatgctggccgaggtccgcgtcgccgtccgaggccgctcgctcgtcgagctggcggtcgcgctctcggcgccctcggagctcgcccaggaggcgctcactctgttgtccgcacggggagcggtgattcgaagggggcacaaatacttcgccgcttga

SEQ ID NO: 3217 - DNA, 2244 bp, Myxococcus xanthus
atggacatccggacacagagcgcgctgctggcatccatcatcgggctcgccctgggcgtgtccatgttgctgcggcccggcaggcccagggtactgacgctgtactccgtcttcgcgctgacggtggccggctactacctttcgctcttctttcacagcgtcttcccggccggcgactacccgtggacatcccgcatcttcgtgggcgccaccatcctggtgggttccctggtgccgggcgcggccgtagccttcttcctggagttcctgggggtcagcaaggggacgaacctggtgggccgccggctcgccctgctgtccgccgtcctggggctgaccgtggctgtcacccccctggccgacaagctctgggcccgggtgggcatgggcgtgtgggtgctgggcacgctgctgacctacggttcattgctgctccaccgggtccgcaccacggagtcgcgcatcgagaagttccggctggcgtatctggccagtggcgcgggcgcggccatcctcttctccgcgctggatttcctggtcagcttcggcatccccttccccacgctggggtcggtcttctccacgctgtacctgttcttcctggcccacacgctgctgcgcctgcggctgatggacctgcacgagctgctgggcaagattgcctcgcagacggtgctggccagcatcctggccgccgtcttcacggtgctgacggcgtggggcaaggagaacaccggcctcttcctcttcaacacggtggtggctgcgttcgtcatcctcatcctgctggagccgctgaaggtgaaggtggaggagatggtggtgcgcatcttcttccgcgagcgcttcgccctcctggactcgctgggcgcgctgcgcgtgcgcatcgcgaatgtcatcgagatttccgagctggcccggctggtgctggacacgctccacgagacgggccgcgtcacgcacgcctccgtgtacctgctggcggaggaccggcccgggtaccggctgctggactcacgcggcccgctgccggtggccttcctggacacggcggtggcacgcggcctcctcttcgcggcggccagcggacagaaggcggtgctgcgagagaacgtggagcgccgcatggccaccatgcggctgcaggcggtggagggcaagcgctaccgggacgagctcaagcggctcaacgacacgcgcacggcgctggtgcaggtgaaggctggcatcgccgtgccgctgatgggcaatgaccgcgtcatcgggttcctcaacctgtgggacgaacgggtgccggaggccttcgcgtccgacgaaatcgccatcatcctggaggtggcggagcggctggcgacggtgctggagaactccaagctctacgagaagattcgcgagcgggaccgcctggccgcgctgggtgagatggcggcgggtctcgcgcatgagattcgcaatccgctgggcgccatcaagggcgcggcgcagtgcctggacccggtgcactaccagggcgaagacgccgagttcctcgaagtcatcgtcgaggaggtcaaccggctcaacggcgtggtgacggcgttcctcgactacgcgcgcccgctgaagcagagctttggcaccaccgacctcaacgaggtggtcacgcgcaccatgcggctcatccagaacgacgtgccatccaacctccacctggccgtggagttggacttgatgctgccgcgcgtggacggcgacgcggagcagctcaagcaggtgctcatcaacctggtgcagaacgccgtgcaggcgctcgagacgcgcgagggccgcatcagcgtgcgcacggagaagccggagcgcttcggtgagctgcgcagcgccggcgccgagttcgtagaggtgcgggtgtccgacaacgggcccggcattccttcggaccagcacccgcacatcttcgtgccgttctacacgacgaagcagaaaggcaccggcctggggctggccatctgccaacgcatcgtgaagaaccacggcggcagcatctccgtgcaaagcaagatgggcgagggcaccacgttcgtcatccgcctccccgccctccccaccgagcagccacccgcggaggccagctccgtggacggcctgcccgccgggaagcggccgtcgcagtcattgcccgtgtccgacgaactgcgtgatgcgggcaagccatcgcatgtggacggccgcgccaagcgggagcgccgcaagcggctccgcgcgtag

SEQ ID NO: 3218 - DNA, 363 bp, Myxococcus xanthus
atggaggtgtgctcgggctgcgcgggcgtggccctggatgagggcgagctccagcaactgcaagacgccgtggagacgtaccgcgatgagccgctggatgcccgcgccacggtgcggctcgaagggcccccctgctgtaccgcgtgccggcgcaagctccggctggagcacggcttcgtcgcggaggagcgcctctactgcgggagctgcgcgcccagtggcgccaccccctacagggaaacgttcagcagccatgacatcccgatgttcgtccccacccggcgcggaggccagaccttcaacctggccgggtacgcctccgagggcttgatgtggctgctccaccggatgctcacccgatga

SEQ ID NO: 3219 - DNA, 936 bp, Myxococcus xanthus
atgcaggagattctcgcggaggtcgaggcatccgtgctgccgtcggaggggctggccgcgcaatcagacgacgccgacgatgatggatccgacgactccgatgatgaggagtctgacgacgccgacgatgatgaatccgacgactccgatgacgaggagtctgacgacgccgacgatgatgaatccgacgactccgatgacgaggagtctgacgacgccgatgatgaggattccgaggagtcgtcggacgaggactcggaagacgatgcgtccgatgaggatgccgaggagtcgtcggatgaggactcggaagacgatgcgtccgatgaggatgccgaggaggaggattcggaggacgactcggagtccgaagaagctgcgtcggacgatgaggcggaggtaccggcgggcagcggtgtgaagggggatgtgtccagtgacgacattgccgcggagcttgcggcactgggtatcgaggatgagcccgcggaggctgccaaggtggaggcacccgtcgcgacgccgattacggcacgtccactggtggcgcgtcctgtgccgaagatccggccacctgacgaagccgcgacgattctggaggaccagtcggcggagacgaccaacatcgtgaaggctcccgcgccactggaggtcttcgtccagtgggcgcaaggcgcgccggtggccgtctccacggagcgtttcacgattggccggggccctcgctgcagcctcgtcgtgaagtcggagcgtgtctcgcgcgagcacgcggtcgtgacgcgggtgggggacgaggttttcatcgaggacctcaactcctcgaacggaacttggttcaacaacgagcgaatcacacggcagcaggtctcggacggtgacgagtacatgctcggcacggaggccgtgtccttcacgatgcgtcccgcgggcggttga

SEQ ID NO: 3220 - DNA, 1599 bp, Myxococcus xanthus
cgttataaaatcgaaagcgtcctgggccagggcggcatgggcatggtgttccgcgccacccagacgtccgtgcaacgcccggtggcggtgaagacgctcaacccgtcgctggccgccgccccccagttcttcgagcgctttcgccgggaggcggagctcgccagccgactgcggcaccccaacgtcatcaccatcttcgacttcggccggtcgccggacggcacctgctactacgtgatggagctcctggaaggcgaaagcctgaaggagacggtgaagcgccagggccccatgtccctgcgacgggccttgagcctcgtggagcaggcgtcccagggcctggcgcacgcgcacgcggagggttgtgtccaccgcgacctgaagccacacaacatcatggtgcagcagctcagcggccaggacttcgtcaaggtgctggacttcgggctggtgaaggccatggagtccgaggaggaggagcagctcacctcgaccggacaggtgctgggcacgccccagtacatgccgcccgagcaggccggcggcgagtccgtggaccagcgctccgacctctactccatggccggcgtgctctacttctgcctcaccggcagctcgcccttcggcgcgaacacggtgcgcaaggcgctgacggcgtcgctcacccaggcggtgcccgccgtcaacaccaagcgccagggcgcccccgtgccagccgcgctggatgccttcttcaagaaggcgctcgccccggagaaggaggaccggtaccagaacgcgcaggagttcatcgacgcgatgctggacaccgtggcggacctcacctccgaggagctcgacgccatgccgagcggcggcgtccccagcgccagcgagcgcggcagcaacagccgcagccgttccagccgtcaggggagccagagcggcatccgctcctcgcgggtgggcgccgcgccgagcctgggccgaggagccacgcccttcaacgtcgtcgtcgccaggccccagggcggcgcgagcggctcgtcgtccttttccagccgggtccgctcgcagacgtcccggtccgcgccgcctcctccgcccccgcctcccgagccggagggcatgtccaccggcaagaaggtggccctggtcgccgtgccgctggtcctgctgggcattggcgcggccgtggtcctgggcaaaccgggcggcagcgcccccgcgacgccggtggtggtgaacgtcccccgcgacgctccaccagcgacgacgcagaccgcgaccggcacgacgggaacgcccgaggaggcgtccgtcctcacggtgagcctcgattcgacgccgtccggcgcatccatctacgaaggcgaggagatggtgggcaccacgcccacgaagctccagctccgccgcgacaaggtgcactcgttcagcttccgcttgccggggcaccaggacaaggagctcacgctcaacctgcgccgggtggccggggatacgcagtcggcgaacgtggtgctggagcccgtgcgagccgcggcccccgggcgttcgccgcgccccccgccgaagccggcgagcccgtccgggcctgacatctccgtcttcgaatag

SEQ ID NO: 3221 - DNA, 486 bp, Myxococcus xanthus
atggcggaagtcaccctggatctgcgcggcatgcccaaggccgaagcctacgccgagctgaagcagcatgtccgcgcggtgctcgagggcatcgacgacgacatcaccggcatggccaccatgagctgcctgctgcaccacgccttcgggcacctgtggacgggattctaccgcgtcgtcacgccgggccggctgctgcgggtgggcccttaccaaggcacgctcgggtgcctggaaatcccgttcggcaagggcgtgtgcggtgcctccgcggcgaagggcgagtcggtggtggtggcggacgtccacgccttcccgggccacatcacctgtgacgggcgctcggcatcggaaatcgtcgtccccgtgttcggccgcaaccgcgagctgctggccgtgctcgacatcgactccgagcacaagaacgccttcgacgaagtggaccgccgcgagctggaagagctggtgcgctggttccagcggtag

SEQ ID NO: 3222 - DNA, 753 bp, Myxococcus xanthus
gaagctcgcggcgagcgcgtcgaccaatacctcgcgcgcgcgttcccggacctcacgcgctctcgcatccatggcctcatcgaggccgggcatgtgctcgcggacggccagccggccaaaccggcccggcgtctgcgcggcggtgagctgctcgtcctccacattccggcgcccgttcccgccgtcccgttagcggaggagctcccgctcgcgctgctgcacgaggaccgcgacctggtcgtcgtcgacaaggcggcgggcatggtcgtccaccccggcgcgggccacgcttccggcaccctggtcaacgcgctgctgcaccgggtgaaggacctggccggtgttggcggcgagctgcggcccggcatcgtccaccggctcgacaaggacaccaccggctgtctcgtcgtggcgaagaacgagcaggcgctggtggcgctccagaaggccttcaagactcgcgcggtggagaagacgtacctggcgctggtccacggcgtcccgccggcggaagggcgcatcgagacgctctacggccgtcaccccatccaccgccagcgcttcacgggcaaggtgaaggagggcaagaacgccatcaccgagtaccgcgtcctcgagacctttgatggcgccgcgctggtggaggtggacctgctcaccggccgcacgcatcagattcgcgtgcacctctccgaagccggccaccccctgctctgcgacgcgctctatggcgccggacgcaaggctttagag

SEQ ID NO: 3223 - DNA, 264 bp, Myxococcus xanthus
atgacggacgaggaaaaggtcaaggcgatgcggctcgcccgtgcgattgcctcggatatctcgctctacaacgagcagaagatcatcaagggaatcgaacaggacaacctcttcgaggtcctcaaggaggaactggaagagggccgcgagctctacaagagccgcgtcagccaggagatcttcacgaagatgaacttcttcgagcgggcgatcaacgacatcgtcctgcgctcgaaggcgcatgtgaagtcgaagatctggtaa

SEQ ID NO: 3224 - DNA, 162 bp, Myxococcus xanthus
atgcacctggagaacgtcgaggcggaccgctacaacctgctcccgccctcggtctacctgcgaggtatcctgatgagcctcgcccgcgagctggggttggatccactccgcgtctccaagagctacctggccctgtcttctgagaagtcaggccggaagtag

SEQ ID NO: 3225 - DNA, 867 bp, Myxococcus xanthus
tccatggtgtccgccaacctgggcgtggccctggcccaatccggggccaacgtgctgctcgtggacgtggacctgggcggggccaacctccacacgtgcctgggggtcggacagcccaacgcgacgctgtccgacttcctgcgtcggaacaaggcgcagttggaagaggtcatcgttccgacgggcgtgccccggctgtcgctgatcgccggcgcgcaggatgcgctggacgcggccaacctcaagtacgcgcagaagcagaagctgctgcggacgttgatgggcacgtcggcggactacctcatcctggacctgggcgcggggacgagcttcaacaccatcgacttcttcatcctcgccgaccacggcgtgctggtgatgttgcccgagcccacgtcggtggagaacgcctaccgcttcgcgaaggcggccttcttccgcaagctccagcaggtggagtcgcagtacggcatcgaggacctggtggacgacgcgctcaccacccgtgagggggcgctgcgcacgctgcatgacgtgctggcgcaggcccggcgcaaggacccggccatcgcggaccgcttggagcgcgagctctccgcgttccgcatccggctgatcgtgaaccaggcgcgcacggatgcggacctgtcggtgggcacctcggtggccgccgcatggaagaagttctttggcatcgaaatggatgtcctcggagccattcgctacgacgacgaggcatggcgcgcggtgcgcaagcgcaagcccgtcctcatcgagcgaccggattccgcggcggccactgccattctgggcatcgcaacgcgtatcctcacactcgacggctccccccagcgttccacaccatga

SEQ ID NO: 3226 - DNA, 594 bp, Myxococcus xanthus
atgatcaacagcgccgtgcttgtcctcaaccggtactaccagccggtgcatgtcacctcggtgaagcgggcgttctcgctcctgtacctgggggtggccaaggccatcgactcgcagtaccggctctacgagttcgcggattgggcagagctgagcgcgacacaggactgcatcaccaccatcgagcgcaccatccgcgttccccgtgtcctggtgctcagcgcgtatgaccatctgccccgagggcgggtgcgcttctcccggctcaacatctacgcgcgtgacaacgacacctgccagtactgcggcaagaacctgccgcgcagcgagctgaacctggaccacgtcatgccgcgcacgcagggcggcaagacgacgtgggagaacgtggtgtgctcctgcgtgccttgcaacctgaggaagggtgggcgcacgccggagcaggcccacatgaagctgctcaagaagcccgtgcgcccgcgctggacgccgctgttccgcggcgccacccgcaaggtgacgtatcaggagtggctaccgttcctgcacctggcggatgcgtcgtactggaacgtcgagctgctcgacgagtag

SEQ ID NO: 3227 - DNA, 1398 bp, Myxococcus xanthus
atgggcgccccgtcgaacagtggagacggtgggaagaatgcgctcttgcgcgcgctcccctccgtcgagcagctcctgcggcgcccgtcgctggaacccctgttgagcggagtccccagggcccgcgccgtggccgcgctccggctggcggtggaccgggcccggggccggttggtggcgtcgggcgggccgggcttcgaggatgcggacgtccagcacgccctggacacgctggccacaccggggctgcggcccgtgctcaacgccaccggggtggtgctgcacaccaacctgggacgcgcacccctggcggcctcgaccgtggcgcgcgtggcggaggtggctcgggggtactccaacctcgagtacgacctggatgagggagagcggggcagtcgctacgcgccgttggtggggctgctgcgctcgctgacgggcgcggaggacgcggtcgtcgtcaacaactgcgcgggcgcggtgctgctggtgctggcggcgttggcgtccggccgcgagtgcgtggtgtcgcgcggtgagctggtggagattggcggcggcttccgcgtcccggaggtgatgcgacagtcgggcgcgaagctggtggaggtgggcaccaccaaccggacgcggctgtcggattactcggcggcgctgggcccggagtcggcgctgctggtgaaggtgcaccgctccaacttcgcgttggtgggcttcacggaagaggtggaggtcgcggagctctcggcgttgggccgcgcgcgcggcgtgccggtgttccaggacctgggcgcgggcgcgctggtgccgctgaagggcgagggcctgagccgggagctcacggtggcccaggccgtggcggcgggcgcggacgtggtcgccttttcgggagacaagctgttgggaggaccccaggcgggagtcgtggtgggccggtctgtgctgctggcacgcatcaaggctcatccgctcatgcgggccctgcgggtggacaagctgacggtcgccgcgcttgaagccaccctggcgctgtaccgggatggccgggcggaagaggttccggtgcatcgcctgcttgcccagtcgccggaagacctgcgcgcccgagcggtacggctgcaaggcctgctggcggggcagggtgtgcgtgcgcgggtggccagcgtggaggggcaggtgggtgggggtgccatgccgctggccaggttgccgtcctccgcgtgcatcctcaccctagggacgccggaagaattcctggagcgcctgcgcggaggcatgtcgccggttattgggaggatcgcggatggcgaggtgctcctcgacgtccggtgtctcgaggaggaggagctccaggccgtcgcggatgccgtcgcggccgccattccagggaacccgccatga

SEQ ID NO: 3228 - DNA, 150 bp, Myxococcus xanthus
atgcaggacggcggcggcgaggacctcttctgccaccacactgcgattcagacccagggcttccgcacgctgcaggaaggccagaaggtcgagttcgacgtggcccgtggccccaagggcctgcaggctcagaacgttcgcccggtctga

SEQ ID NO: 3229 - DNA, 1674 bp, Myxococcus xanthus
atggccatcgccgacatcgccgcggagaagaaggacaaggccgccgagcgcgccgcgctgtggcgcctgtgggccgcgcacccgctgtccgccttgtcgaagcaggccgagaagcgcctcaaggggcagacgccgcccgtcgatgcgagggtggggcgtggcgaggcgctggtggagctgcaccggaacaaggccggcctggagcagttggagccgctgctgccgaagctggcgcttccggacccgctggcctgccgcgcgcacttcgccttcggcaagggcatgcgcaaggagcgccagcacacgcgcgccatccaggtgctgacgcccgtggcggagaagtgccaggaccgcgacctgctggcgcgcgtgctgtacgtgctcggctcgtcgcgctccatcgtcgaccaggcgcggggcacggagacctacgagcggctggcgcgcgagttcccggaccactcgttcgcggatgacggcctcttctacgcggccgacctctacctgaagacgggccgtccgaaggaggccatggcccgcctggacacgctggcccggctgtacccgcagggggacttcctgggcgaggcgctcttcaaggcgttctggattgctcgcaccacgggcgtggaggactccggcctgtcgttcctggaccgcatcgaggcgcagttcgccaaggcggacgagagctacgacgtggagcgcgcgcgctactggcgggcgcggacgatgcaagagaagggcaacatccagggcgcggcggagctgttcgagaagctctccgtggaccacccggcgacctactacgggctgatggcgcgctcgcagctggcgaaggtggacccgccacggctggagaaggtgtccgccgaaatcttcgccgtgcccgaggccgccagcccctggccgctgttcgccggccccatgggcgaggacccgcacttccgcgcgggcgtggagctgtaccgcctgggcttcaaggaagccgtgtcgtccgagatgctggccgtcaaccggaccaatctgcccgcggagtccgtgcgcctgctggtgctggtgctgcacgaggccggggacgagcgctccgcccacgcggtggcgcggctcgccctgcgcaaggacttgagcgggcgcatcactccggagacgcgcgtggtgtgggaggtggcctatcccaacgccttccgcgacagcatcgagaagcacaccgcggacgcgggcgtggagccggacctgctccaggcgttgatgcgggaggagagcgcgctggaccccaaggcgctctcgtgggcgggagcgatgggcctcacccagttgatgccgtccaccgcgaagggcgtggcgcgcgagctgaagctcaagcgcttcagcgtggaccagttgctccagcccgacctcaacatccgcatgggggcccactatcttggcggcttgctcaagcgcttcaacgggcacacgccctatgcggtgggcagctacaacgccggtcccggcgcggtgaatcgttggaggtccgacaggccggacctggcgctggacgcatgggtggaggaaatccccatctccgagacacgcggttacatcaagcgcgtgctgcgctccttcaacacgtaccaactgctgtacggacgggcgcccaagctgccggtgctcaagagcgccgcgaagtag

SEQ ID NO: 3230 - DNA, 837 bp, Myxococcus xanthus
ggcggtgtctcgaacccgggcgacccgactgtcatccaggacccgaccgcggacatcctggaccggctgcgggccattcccggcctcaccgtcgcggagaaccccaacggcgtcacggtccccgcgggtcaccgcttctttgtcatggagtacgaccagcccgccgaccacgcacgccccgagtgccagcgattcaagcagcgattggtccttctgcaccgttcggtcacggcgcccatggtcttctacgcgagcggctactacgtgtccctgaacgcgggccgtcgcgagctgacgacgttgctggccgcgaatcagctctccatcgagcaccgcttcttcctgcccagccgtccggagcccgctgactggagccagctcaccatcaagcagtcagcggacgacttccaccgggtcgctcaggcaatcaagcaaatctattccgcgtcctgggtgtccacgggcgtcagcaagggcggagagaccatggtgttctaccgccggttccacccggaggacgtggacgcgacggtggcctatgtggcgccgctcgtgcgcggcgaagatgagcgtttccccgccttccaagccaccgtgggaggtccgcagctggaggggtgccgcgagcaaatccacaccttccagcgcgccgtactgaaccgccgccaggagatggtggcgctgctgcgcgcctatgccgtgaaccagggcctcacctacaaccaccttggcttcgagcgggccctggagcacgccgtcatcgagacgtacttcgccttctggcagtactccctcccccagtactgcgacgcgttcccggatgacacggcgtcggct

SEQ ID NO: 3231 - DNA, 1968 bp, Myxococcus xanthus
ctcgtcatcgcccaggacctctgtctctcctacggaaagaaggtcctcttcgatcaggacagtttcacactgggtcccagggaccgggtgggcctcgtaggggccaacgggacgggtaagagctcgctgatgaaaatcctggcgggcgtgtcccaggccgactcggggacggtgcaatacagccgcaaggcccgagcgggctacctgccgcaggaaatcgccgggttgccggatggcaccgtggtggaggcggtgatgagcaccgtgcccggccgcgatgccatggaggcgcgcctcaaggagacggaggctgcgctcgccgccgccacggacgaggaggaccagctggagctgtcccagtccctggcggacctgcatgcggagctggacgacttcgagaaccgctacggccgccaccacgccgagcgcatcctcaagggtctgggcttccgcgacacggacctggccaagcccacctccgcgctgtccggcggctggcggatgcgcgcggccctggcgggactgctgctccaggaccccgacctgctcctgttggacgagcccaccaaccacctggacgtgcccacgctcacgtggttcgacgacttcatgcgccgctccaacaaggcgctggtgctcatctcccacgacaaggacttcctcaaccggcagatcaaccgggtggtgtccctggaagtggagggcgtgcgcgagtacgcggggaactacgacgaatacaagcgcctgcgcgcggaggagaaggagctgttgagggcccgcgccgagaaggtggagtcgcgccgcgcggagctgcagggcttcatcgaccgcttcggcgccaaggccaccaaggcgcgtcaggcccagagccgcgccaagatgttggagaagctggagaaggtgcaggtcctggaggagcggacgtcgatgaagttccgcttccccgaggtcgagcggagcgggcgcgacgtggtgacgctggagggcatcaccaaacggtacggcgcgcagaccatctacgacggcctcaccgggcgcgtggagcgtgggcagcgcatcgccgtggtgggcgcgaacggcgcgggcaagacgacactcctgaagatggtcgctggcgagctggcgccggacaccgggacggtgacgctggggcacaacgtggtggtgggctattacgcgcagcaccacgcggacaagctgaaccggcagaacaccatcatcgaagaggtgcgcccgctggccgcggacaagccggagagctacgtgcgcggcgtgctgggcgcgttcctcttcagcggcgatgaggtgcagaagcccattggcgtgctgagtggtggtgagcgcgcgcgggtggcgctgcccaagctgttgctggtgccgtccaacttcctgctgatggacgagcccaccaaccacctggacctggactcggccgagatgctgattgaagcgctgaagggctacggcggcacgttgctgttcgtcagccacagccggagcttcatcaacggcctggcgtcgcacgtgtgggaggtcgcggatgggaagctcacgccgcatccgggcaacctggacgactacctgtaccaccagcagaagctccagcaggcggcggcggaggcctcggccctggcggcgggccaggcgcggggtgagaaggtggcctccgggccgatgacggataaggaccgcaagcggctggaggcggaggcgcgccagcgccgcagcgtggtggaggggcccctcaagaaggaaattgcgaagctggaggcgcgcatcgccgaggtggaggccggacagaaggagcgcgaggcgcagctcgcggacccggccctctacaacgacttcgcgcgcgccaagccgctgatggacacgcaccgcgcgagcaaggaggagctggaagacctctatgcccgctgggaggctgcgcaggagaagctggccgaggcgtccgcgtcactgggatga

SEQ ID NO: 3232 - DNA, 705 bp, Myxococcus xanthus
ctgctcgttctcacgggcgcgggagtctccgctgaaagcggagttcccaccttccgcgggatgagcggactctgggaggaccaacccgtggaggccgtggcgtcgcccgagggcttccggaaggacccggcgctggtgtggcgcttctattcggagcgccgcaaggccgccgccgccgtccaccccaacccgggccacgaggcgctcgtcgcctgggaacgccacctgggggaccgcttcctgctcgccacccagaacgtcgatggcctgcacacgcgcgctggaagtcagcgggtggtggagatgcacggcaacctcttcaagacgcgctgcagccgctgcgggcggcccccgttcgaggacgccaccgtgtaccccgcaggggcggtgcccgagtgcgacgcgtgtggaaagctgctgcggccccacatcgtctggttcggcgaatacctggacccggcggacatccagcgcatcgaggacttctcgctgcgggccgccacttcgggtggacgcttcgtctttctggcggcggggacctctggcgccgtgtacccggccgctggaatcgtggaccaggtgcgcaaggcgggcgggaagacgtggctcgtcaacctggacccggcggagaactccaaccgcttcgagcaccgcatcgtggacaagagcggggaagtcctcccgaccctcgcgaagctcgcctga

SEQ ID NO: 3233 - DNA, 387 bp, Myxococcus xanthus
cccgtcatcggcgtggggacggacgagttgccgtcgttctacagcgggggttctggcatccccctggagcaccgcgcggatgacgtggacacggccgcccgcatcgcccgcgcccgcttcgagtcgctgaagcagggtggggtgctctacaccgtgcctccgcccgaggagacgtccctgcctcgcaacgaggtggagttgcacatcgccgcgacgctcgccgacgcggaccggcagggcatccgcggcaaggccgtgacgcccttcctcctgtcggaaatggcgaagcgcaccgggggcaagacgctcaaggccaacctggcgctgctcaccaacaacgcgcgcttcgccggtcagctcgccgtggcgtacgcacgcgcgagctga

SEQ ID NO: 3234 - DNA, 207 bp, Myxococcus xanthus
atgctggagacgggagagcgcatgttccgcggcgcctcctcgcggctggatgagcaatccgtcgaggcattcctggaccgcacgggacagttcgtgcggcagcgcccgggattgttgctcacgggactgctgggggcaggcctgctcgcggggcggatgtttcgcgccagcggtgctggcgatgtggaaggggaggctgagtcatga

SEQ ID NO: 3235 - DNA, 291 bp, Myxococcus xanthus
atgcgacagcatcccgtgggggcgggacttggggtcctggccctgggcttcctgtcggcgtccctcttgccggcctcggcgctggagcgtcgcgcgtatacacgtgtggcgggaaaggcgcgggacctggccgaccgcgtggacgcatcggggcgactcgaagacgtcctggcgaccgtacgacagatggcggcggacgcggcggccgagcagttggcctcgttgaggcccgagcccgaggaaggtcctacgcggcgcaagttggagcgggtggaccgaaagggtgggtga

SEQ ID NO: 3236 - DNA, 963 bp, Myxococcus xanthus
ctgtactccggtgacttccacaacgcgaagcagctcctcggcgcgctgagccggcggctgccgcggccagcgaaggcgcgctcgcccctggaggcattccgtgccgagcggcgggcccggcagctcgaacacgagacgctgtcgcgcatcgtggtgtctctcgaccgcgattaccggctcgggctcgcgcgggcaccggatacttcactggcatgccatcaggtatggggggcttcaacgacggacaccaccgtggtcccgctcaaacaactcctcggcatgctcggggcggcggagtggcgtcgcaaggggctcgctgttcctggcctcactgggctgcttcacccgcactacggcgtctaccttccgacccgcacggattacgtggagttgctgaactcagtcacggaggtgaagggcaagcgcgtgttcgacatcggcactgggaccggcgtgctctcattcatcctccttcagcggggcgcggcgtccgtgcaggcgactgactgtgactctcgcgccgtggcctgttcccaggagaacgcggagcggctcgggctcggcaagcgcttccaggtggccgaggccgacttgttcccgaagggcacggcggacctcgtggtgtgcaacccaccctggattcccgaaccgcccaagaaccgggtggaccgcgccgtgttcgacgaggacagccagttcttgcggcgctttctcgaaggactctccgcttcgcttgctcccgggggagtgggcctgctgctcctgtcggacctcgcggtgctgctcggcctgcgcccacccgggtggctcgaagcggagttcgaacggtgcggcctgtcggtgcagtgggcccggtcgaccccggcgcggcattcgaaagcgaaggacgcgtcagacccgctgcacatggcgcgctctcgcgagcgcaccacgctctactgcctgaagccggtgagcccgtag

SEQ ID NO: 3237 - DNA, 1527 bp, Myxococcus xanthus
atgtgtggattgttcattcctcgcaccgccagcgctcaggccgtcgtggtgagtggacctcccgtggcgccccttcccgagatgacgggggcgggtctctgcgtcgcgacgagcgtctcgcagaatcccgcggctgacttcccccaggctcagtcgacgtacatcgctggtatcaatgccttcatggaggcgaaccggggcaaccgcgtcacttcggtgctgcggacgcccttggacctgtccaacaacctcaatgacgggaggacgctgagctacggggacttcactggggccgtcgcgggctgccccgtcggcgggtgtgacttcggctacagcgatgccgtcacatccttcgcgacccgcctgcgtggcttcatcgcggtcacgagcgacatggtcgacaggcccctgcacttcgggttctacgccgacgactcggtgagcctggcgctcttcgaccgcgaccagacgagctacccggtcatcaaccgtccgctgacgctcggctttccgacgtggcgcgccaccaacacggtccacttcgcgcagcccggactctacggcgtggaggtgctccacacgaacgtcggggagcacgccgcactcgagatgtcggtatacgacggcgtcttcacggacttcgagagggcagcgaccatgccgcccatcatcaatctggctaccgagggcttcgtgcttgtcacgcccggcatgttccatcagacggagtcggggcagccctcgttcccaactcccaccgagtgcgcccaatgcaaccgtcagttcgccaacgcgccagggaatgggggatgcgagacgggctaccgctgcaacgcggcggccttgtgcgctccctgtgattcatcgctcttctgtggggagtcgtgcgctccgtgcggtgcatcgacgccgtactgtgtgagccagaccgagggcttcgtctgtgcgcagtgtcaggatgcgaatgactgtgtggcgccggatgaatgccacctgcccatctgcacggagacgggcaactgcgcctccactcccgtggaggatggcacggagtgcacgggagggacctgccagcagggcgagtgcaggcccgtggacgcggggacccccgacgctggagaggcggacgggggagaggcggacgggggagcggcggacgcgggcccctccgatgggggagcgacggatgcgggagcggcggacgcgggagaggcggacgcgggcccctccgatgggggagcgacggatgcgggagtgacggatgcgggcgcgacggacgcaggtgggcccggcgaggtggacggcggctccaaccctggcgtggatgggggaagcacggacacggacggtggaaatcccacggcggactcgggagttccggccggggacgcgggctctttggctggaggctcgccggaggacccttcggagccggagtctggctgcggctgtcagggtggtccgtccgcgctgttccccatggccctgctcgcgctatcgctcgtcgtgagacgcggtcggcgatag

SEQ ID NO: 3238 - DNA, 993 bp, Myxococcus xanthus
atgctcccatccctgtcccgcagcggcctgcccatctggacgctcgtgctcgccatgctcctctgcggcaccgccaacgcgcagttcaccggcaagcgccgcgcctatgcctccagcttctggggtggcaccggcgccagtgggaagaccatctcctggagcgcgctctacgtcgcgctccccctggactacggctacaacgccgccaacaacaccatcgtcaacctggctggcgtcaccgcggcccaatcggacctgcgcaccagcagcacgcgttcgctgaagtggggcacgcagattcgcatcaccaaccgccacccggggcacgcgggctatggccgcagcgtcctcaccacgctccaggactccgggcccgccgatagcatcctcagtgacgccgcgctgggcggccgcgcggcatctccctacaagcccctggggtgctggattgacgtcaccccgggcgtgaaacaggcgctgggcagcacgaagccggagacggaaaacctcatcgtcgacttcgaagtcgtgaacgacctcggcagctcactcgatctggactccaaccccaaccttgccttcggcatggcggccagcgcgagcgactcggagaacacgggcatcagcgcccccatcgccgccgtggacggcaatggcgcctaccacctggagaactatcgcagcgcatggcgctcggcgtaccacgccaacacctcggacacggtgtggctcaacgtcaacctgggccgggcggaggccgtgcgccgcgtcgtcgtgaaatggggcagcttcgtgccccccggctacacgctgatgggctggacgccgggcatgagttcctgggtgacgctcgccacccgcacgggcgcgggcggtggcacgcacgtccactccttcacgtcggaccagacgtaccagtacttcggcctgagcatgagcggcgcgacccgctatgacgtgaaggaactggaagtctaccgctgggactactga

SEQ ID NO: 3239 - DNA, 975 bp, Myxococcus xanthus
cggcggtgcatggcggtggtgggagtgtcgcgcggcgaatcgtgcaggcaggtagcacgtgctctggcgtgcgccacctccacagtcgtctctgcggtcaatcgctaccggacgggacggcgtaaagccctggtggaccgcagggcggccaatggcgaggcgaaggtggatgagcgcttcctcgccattctctcgcgcgtgctggcgggtactcccgaagaggtgggttggtgccgcccgacgtggacacgagagttgctcgcgctggagatggagcgccggggcctggcgcgggtgtcagttgccaccatgggccgtgcgcttgccaccctcggtgcgagcctgaaggcggccaaacccgtggtgggctgcccttggccgggctggaagcggcgccggcgtctcttcgagttgcgatgcctggaagcatgtgcccggtccgacgagccggtcctctatgtggacgaggtggacatccatctcaatccgaaagtgggacgcgactggtgcctgcccggccagcgccgggtggtgctcacgccaggcaacaacaagaagcgatacctggccggcgccctggactcgaagacgggccgcctcacctgggtggaaggcaagtcgaaggccagctcactcttcatccaactgctttggcgcatcgccggtgagtaccctggcgccccacgaatccacctcatcctggacaacgcctccatccacagcagccagaagacgagaaaggcgctcgagcgactcggcggcgggcttgtcctccacttcctgccgccttactgcccggacgccaatcgcattgagcgcgtctggctggacctccacgccaatgtcactcgcaaccatcgctgccgcaccctccagaagctcatgcggcgcgtccatgcctacctgcacgctcgcaacgcccagcggcgtgccagtcctatcctccgcaaggtccatctgcggagcgccgcctga

SEQ ID NO: 3240 - DNA, 675 bp, Myxococcus xanthus
atgaagccagagcaggagaagacgcttcacgaagaggtcgtggcaacggtggaccgcctggtcctcaagcatccggagctgaaaaaagagctggagcaggtacagggctatgccgtcttcccctcgctgggcagggcatcgctggtcctcggcggctcgtacggccacggcgaagtcttcgagaagggcaagccgattggcttcgccacgctgagccagctgaccctcggagtccaggtgggcggacagaccctgagcgagctcatcttcttcgaggaccgtgatgccattgaagcgttcaagggaggaaaggcggccttcgccgccaacgcgtccgcagtgatcgtgaaggcggcggcgtccggaaccatcaactatgcgaagtgcgttgctcacgcctactcgcgtggcggcatgctgctcgaggcctccctgggcggacagaagttcacgttcattccgcgttcgtcgggcgcatcggagcgagggaacggaggcctggtgcagcgcttccgcaggcaggatgcgtccgaggagaacggggccgatgacaccgggcagcgttcgcggctgcaagcgtcgcagccccctcctgccctgaccacggggctgacggctgccgccctgctgctcacccgaatcatcaaggcacaggccagtgctcgccacgaatga

SEQ ID NO: 3241 - DNA, 1471 bp, Myxococcus xanthus
ggaacagtgctggggcagaagtatcgactgcgccagcggattggcgtgggggggatgggcaccgtctacgaggcggagcaactggacgtaggccgaaccgaggccgtcaaggtgctccggcagcacctcctcggtgagccggccgtgcactgcacgcttccgccgcgaggcccaggccaccgcgggcgtgaagcatccgaacatcgtcgaggtgatggactttcacgacgcacccgatgaaccggcgttcctggtgatggagttgctgaagggccagactctgaaatggctgctgaataaggatggccctctgcccgtggaacgcgcgggggccattgcccatcaggtggcgaacgcgctggtggtggcgcatcaagccggcgtcgtccaccgcgacatcaagcccgacaacatcttcctggtcgacacggggaccgaagccctccacgtgaagctgctggacttcggcgtcgcgcggctcatgcacgaagacgacgccaccgcgctgggcacggagtctggcgcatgggtcggcacgccgtcgtacatggccccggagcagatccgctgccgccctgtcgacggacgcgcggacatctactcgctgggcgcctgcctgtaccagatggtgacgggacagcggcccatcgatgtggcggacaacgtggccctgctctccgccgtcatgcaccaggtgcccgctccgctcaacggcgtgcgcacggacgtgccggacggtttctcccaggtggtggcgcgcacgctggagaaggacccggccacgcgctacgcggactcccacgagctggcccaggcgctcgagcactggattcacgccgcctccgtggcggccccttcggcccctcagcctgaagtcgcaagcgccgcgcccctggagcccgcgaacacagcaccggtaccctcaacgcctgtcgcggcggaacacgtcgccacaccgcacacgagctccggcccgcagcccgtcctcgttgcggcggaacacgtccccccgccgcgcacgcgctcccgcctgcagaccctcctcatggtcgccagcgcgctggcggtgggcctcgccgcaacgggagggctcgtcttgacggcctctgggatgacgcccacggaggagctcgcccacctccgagtcatcgagctgccccgcctgacggagaacggcgccgtcgcgcccgcgccccgcgggtacgcggacggctgggtcgccgagtccattgaagggcgcctgcccgcgctcgacagttgctacgcgcggaacggcgaggacgtcgcatgccgtcaggatacctacgccgtggtctactcccccgagggcatcgtcctcggagcacgcatgcacccgccccagctcatcccgctcgcccagtgcatcaacaaggcgctccgggggctctccctgggcaagccacgcgaagccatcgacggcgccgccacggtcacgctcaggcgggagtaa

SEQ ID NO: 3242 - DNA, 360 bp, Myxococcus xanthus
atgagctccgttgagaacgagttccgaggcatcctcaacgccatcaagctgtatcaaaacgaccggctctacaatgagtacgacggcctgtgtcagctcatcgcggacctcgccccgtatttcacctacaacgccaactaccccgcgtcgcagtacccctcgcagaagctgccctatagctccgcctatttcacgatcgcgctggccatctacagcgcgcgctggcgctacttcgaccagatctacgcctcggcgccttggcccgcgaagcgcgaggccttcaggttgtgggtggcggagacgcacatccagtccaaccgaatcgccacgtggcgctaccgtgatgagccgttgagctga

SEQ ID NO: 3243 - DNA, 462 bp, Myxococcus xanthus
atgtggggctaccagcacgcctacatcaacttcacgggcgctcagaacgtctcggatctggatgactacaagttcacgctgtttggctccagctccccaggtagcgccaaggtgggggaccacatcgagtcgctggtgaccggcccccagacctggctcatcgccatcgacagcttccagatgttcagcgcccagcccgcggactggcccggtgcgtccgcggcacggaatggggccatcacccagttggcgattgtcgaacaaaaagcgctcttcgccaccatctcgaacgatctggagtcgctggtgggggcgctcatcaacctcatcccggacatcggagggttcctcagcagcctgatgggcattttctggccctccaccaccaaccccaacctcatctgggaagccatcagcggtacatcgtcaaggccgtttacctcggcgttgagtcatcggtga

SEQ ID NO: 3244 - DNA, 1266 bp, Myxococcus xanthus
atgtccaagaccaacgccccttcaggactcgggtccgagtaccacccgctcgactctccccagctcgagaatccgcatccgttcctcgcgcgtgcacggagtgaggaaccggtgttcttcagtccggcgttgggggcgtgggtggtgacgcgccatgcggacatcagcgccgtggtcgccgataccacacgcttctcgtccgcagagtccatcacggtgggcgccgcgacgacgccgccggaggtggtcaccgcgctgatggacggttaccccctggtgccaagcctcgtcgacaatgatccgccagcgcatggccgcttccggagcctcgtcagcaaggcctttaccgggaggcgcctcgcggagaaggagcccttcatccgcaccctcgtggacgcgctcatccactccttcaggcacgagaggcaggcggacctgttcctccggttcgcccatccgctgtcgtgcagcatcatcgcggagattctcggaatccccagctcggacatccaccggttccggcgctggtccgatgagctgtccacggtcctcgcggcgcatggccccatcgagcaccaggtcgcatgcgcgcaaggcgtggtcgagttccagcgatacctggcctcgacactcaaggagcgggaggtgtccccccgagaggacctgctgagcgacatcgtcaccggggcgcaggggatgacgccgcccatgagcatggcggagctcgtgagcctgctgatgcaggtgcacttcgcgggacatgagacgaccgcgggcctcatcgtgggagcggtggagctcctactcgagcatccggagcaactgcgggcacttcgggacgacccgggcctcatcgcaggcgcggtcgaggaggcggtgcggatgatctcccccgtgcatgccatgttccgtacggcgctggaggcggtggagattgggggtgtgcccattcccaagggagcccacatccgcatcgtctacgcgtcggccaaccgcgacgaggcccggttccacgagcctgagcgcttcgacatccggcggcctgaggtcaagaagcacctcgccttcgggcagggcctccatttctgcatcggcgcgccgctcgcgcggctcgaggcacgcctggcagtggaggcgctgcttcgaagtctcccggggctccggctcgtaccggggcagaagccgggcttcctgaggagcgtcaccgtccggaggcacgagagcctcgaggtcgcgtgggacgtccaggcgaatcaggccctctga

SEQ ID NO: 3245 - DNA, 408 bp, Myxococcus xanthus
ttggggcgttctcgaggaggtttttcaacgaaagttcacgccgtcactacgacgggaggtaagccgctccacgtcgcgctgacgcccggccagcagcacgagtccacaatggccgaagaacttatggtgcacgccgagggcgccgctttcattgcggataccggctatgacgccgaccgcatccgcgccaacgttcgaaagctcgggatgaagcctgtcatccattcaaacccgagccgtaagcgggcgttgccgttagaccgcaccctgtaccggatgcgctaccgggtggagtgcttcttccacgatctcaagcgctttcgggccgtcgccacccgctatgacaagacggcgacgagctacctcgccgtcctgcacgtcgcatccatgcttctttggctgcgctaa

SEQ ID NO: 3246 - DNA, 840 bp, Myxococcus xanthus
gggacggatgcgcacaacgagcatatcctggcgcccttcgcccggggcgagaagctgggctgcttcggcctcaccgagcccgaggccggcagcgacgccgccgcgcagaatacggtcgccgtgcgcaagggtgacgagtacgtcatcaacggctcgaagaactggatcaccaacggccccaaggccgacgccatcgtcctgatgacgatgaccaacaaggaagcgggccacaagggcatcaccgcgttcatggtccccacggacacgccggggttcatccgcgccgagccggacaagaagatgggcatcagcgccgcctggtcctgctccatgttctttgaggacatgcgcgtgccggccaagtacatgctcggcaaggaaggcgagggcttcaagatcgccatgagcacgctggacggcggccgcatcggcatcgcgtcgcaggcgctgggcatcgcgcgcgcggcgtacgaggaggcggtgcgctactccggtgagcgcaagtccttcggcaagcccatccgcgagcaccaggccatccagttcatgatcgccgacatggccacggagatcgacgcggcccggctgctcgtgtggcgggcggccctgcagaaggacaagggcgtgcgccacagcgcggagagcgccatggccaagctgtacgccagcgagatggccagccgcgtggcgaacaaggccctgcaggtgcacggcggcatgggctacagcaaggagatggacgtggagcgccacgtgcgcgacgcgcgcatcaccgaaatctacgaggggacgagcgaaatccagcgcatcgtcatcgccgccaacctgctgagggagtaa

SEQ ID NO: 3247 - DNA, 118 bp, Myxococcus xanthus
atgcccttcacgcccgactccatccgtcaggtcgtccagtaccaccagcgccgcatccaggagtgctacgaggaccacatggcggagaaggaccggacggtggaggggcggctgatga

SEQ ID NO: 3248 - DNA, 369 bp, Myxococcus xanthus
attccggacaggcccgaggcgctcgacctgggtgagcgggtcatcgtgggctacaaggcggggacgcaccgctacgtggcggcgttgtcggtggacgccattggcgaggtgacgccgctgtatccggaggcgggcgccagcgcccccgtggcacccggcagcggacagcactggctgcccggaggctgggagttcaccggctccggagatgagcgcgtcatcgtcgtgctgagtgacgagcccctgccccaggagacgctggtggaagccgcccggcgcgcctttgcccaggcggatggcgacgtcggccggatggccgaactggaagtccccggagcgcagacgcactgggtgctgcagaagccatga

SEQ ID NO: 3249 - DNA, 363 bp, Myxococcus xanthus
atgagccgtctgcccggcctcacgcgcgccctggcgcgggtgctcgccctgacagcgtccgccgcggacgcggacacgctgcgccgcttcgcgctggtggccggcgatgaccagggcggcgccgacacgcgtccgctgcgcttcgctcgggacgacgccgggaagatgcatgcgctcctgctgcggctgggcgacacgaggctggggttcgacgacctcaagcgctggctcgcggagccctcctcgagcatccgcatcgccatcctggattcatgccgcgctggcgcgatgacacgcaccaagggcgcgcgacgggccccggacggccggggcatggcggtgctggacgtgctggccggctag

SEQ ID NO: 3250 - DNA, 1275 bp, Myxococcus xanthus
atgtccaagccctccatcctcgaagttctcaagagcccgcgcatctggctgctcgtggccgttggtttcgcctcgggcctgcccctgtggttgacgggcgtcacgctgtccgcgtggatgaaggacgaaggcgtcaacctgaagacgattggcgtcttcggcctcgtgagcatgccgtacaccttcaaggtgctctgggcgccgttgatggaccgctacaccctgcccttcctgggccggcggcgcgggtggatgctggtgacgcaagtgctgctcatgggcgccattgccgccatgggcctggtgaatcccaaggacgcgccggtgaccatggccgccatggccgtgctggtgacgttcctgtccgccagtcaggacatcgtcgcggacgcgtggcgcacggacatcctcaccgtggaggagcgcggcctcggcaactccacgtacatcaccggctaccgactgggcatgctcaccgctggcgccctggccctgacgctgtcggacatcgccggctggtcccagacgtacttcatcatgggcctgctgatggccgtgggtgtggtggccacgctcctggcccctgagccccagggctcgaagccgccgcgcaacctgacggacgcggtggtgaagcccttcgtggagtacttcacgcgcaagggcgccgtcgccgtcatcctcttcctggtgctctacaagctgggagacgccatcgccgccggaatggtgacgcccttctacaaagagctgggcttctccaacacggagattggcgcgctcagcaagggcctgggcatggtgtccaccatcgcgggtggactgctggccggcgtgctgatggtgaagctgggcacgcggcgcagcctcttcgtcttcggcgcggcgcaagccctcaccaacctgatgttcatggggctggcgctggtgggaaagaacgacctgatgctggcggccaccatcaccgtggacaacctctgcggcggtctggcggtgacggccttcgccgcctacctgatgtcgctgtgccacaagagcttcagcgccacgcagtacgcgctcctgtccgcgctgggcacggtggccaaccgcctcatctccgcctcctccggctacctggctgagtggctgggctggcccaccttcttcgccggcaccgtgctgctcgccgtgcccgcgctggtgctgctcgcgttccttccggagaacgcggccacgccctccgacgagcctccagagacggcccctgcctcgccgagcgtctccaccgcctga

SEQ ID NO: 3251 - DNA, 1656 bp, Myxococcus xanthus
tggctatgttccgcggccatggcccacccgctcgctggcaagccccctccggaagacttcctcatcgaccccgagaaactgcgcgccgcgtacttctccggccggcccgacgtggacgtgccggagcaacgcgtggccttcggcacctccgggcaccgcggttcctccgcgcgcaacagcttcaacgaaggccacatcctcgcggtgacgcaggccatctgcgagtaccgccagcagcagggcatcgacgggccgctcttcctgggcatggacacccacgccctctcctcccccgcgcagcagacggcgctggaggtgctggcggcgaacggcgtgcaggtgcgcttcaccgacggcgccacgcccacgcccgtcatctcccacgccatcctcacgtacaaccgcggccgcacggcggggttcgcggacggcatcgtcatcaccccgtcccacaacccgccggaagacggtggcatcaagtacaacccgcccaacggcggccccgcggacacgaacgtcacctccgtcatcgagaagcgcgccaacgcgctgctgggtgcgggcaacgagggcgtccagcgcatcccccacgagcgcgcgcgcaccgcgcccacggtgaagccgtacgacttcatcaccccgtacgtggaggacctgggcaccgtcatcgacatggaggccctgcgcggtgcgaagctgcgcatcggcgcggacccgctcggcggctccaacgtcgcgtactgggagcccatcgccacgcgctacgggctgaacctgcacgtggtgaaccccacggtggacccgacgttccggttcatgccgctggaccacgacgggaagattcgcatggactgctcgtccccgcatgccatggcgaacctggtgcgcctgaaggacgcgtatgacatcgcgtttggcaacgacgcggactcggaccggcacggcatcgtcacccgcagcctggggctgatgaacccgaaccactacctggcggtcgccatcgactacctctatcgcaaccggcccggctggaagcccggcaccgcggtgggcaagacactggtgagcagcagcctcatcgaccgcgtggcgaaggacctgggccgccgagtcgtcgaggtgccggtgggcttcaagtggttcgtggacgggctgctggacggctcgctcggcttcggcggcgaggaaagcgccggcgcgtcgttcctccgccgagacggcacggtgtggaccaccgacaaggacggcatcatcctggacctgctgtcggtggagatcctcgcgcgcaccggaaaggaccccggtgagcactaccagtccctggcggcgaagttcggcgcgccgcactacacgcgcatcgaccagccggccaccgccgcgcagaaggccgcgctgaagaagctgtccccggaggcggtgaaggccaccacgctggccggtgagcccatcctccagcgcctcacccgcgcgcccggcaacaacgcggacatcggcgggctcaaggtggtggcggagaacggctggttcgccgcgcgtccctccggcaccgaggacgtctacaaaatctacgcggagagcttccgcgacgaagcccacctccaagacatcctccaggaggcgcgcgccatcgtcggcgaggcgttcgcgtcgacttga

SEQ ID NO: 3252 - DNA, 2637 bp, Myxococcus xanthus
atggtgtaccggttcaagcgcgtggacgacgggctccagttggagcggctggtcgtgcgtccggacaacaccgcgcgactgctggcgcgcagcctggcctcgctgctcaccaatcccgtggaggccgctcgcatccagacgcagccgtgcgacctgctctcggacaagctgctgctgaagcccacccggggcgcgctgccacccgagcggctcaacgcgctgctgcgcgtcctggagcccgcgcgcaccgtgctcttcgacggcgccctggtgtcggtgacgagcgagcccctcatgccccgcgtcaccgtggaggaccgcggtgagaacacggtgctcaaggtggagaaggacccgcgcgtcaccgaggtggtgagccccggcctcgcgctgtgcagcgggacgctctgtcccctgggggaacaaggcctcacgggaccctggctggagaagctgccgcaggagcgcgccttcgcgccccaccagatgggagacctgacgggaaaggtgctgccggacatcgcacggcgcatgccggtggatgtgcgaagtcaacggctgccgcccatcgaccgcacgctgaagcctcgcatctccctggagttgaaccagctcgacaccggcctctccgtgctgccgacgctggtgtatggctcgccgccgaccgtgcgcatcgacagcggacgcatggtgtacctgaagggcgccgcgcccgtgcgcgacgaggccgccgagcagatgctcatccaccagctccgcgacgagctgaacatggcccccgggcggcgcgtcacggtgcaggggaaggaagccgtccagctcgccgacaagctgcggcgctggcgcgggggcctcacgggggatggcgcggcggtggtgacgaacccgaacgtgcaactgcgcccggtgctcaaggtggacacgggcgccgtcaccgagggcgtgccgcacgtgggcttctccttcgacttccaggtggagggcgaggaccgggagtcgccccgctccgtggatgcggcggcggtcatgcgggcctgggaagaagggctcgggctggtgccgttggaaggtggcggctgggcgcccctgcccgcggagtggctgaagtcccatggccagcgcgtggcggacctgctgtccgcgcgaggccgggatggccggctcgccaaccacgccatcccgcagctcactggcctgtgtgaagcgctggagcacccctccccgccgggcctggagcggctggcgcccctggtgaagggcttcgagaagcttcccgagccgcagctgccggaagacctcacggcgacgctgcgcgcgtatcagctccagggcgtgagctggctcaccttcctccggcaggcgggactgggcggcgtgctcgcggacgacatgggcctgggcaagacgctgcagaccatctgcacgctgggcccgggcaccctggtggtggcgcccacgagcgtgctgcccaactgggaggcggaggtgaagcgcttccgtccctcgctgaaggtctccgtgtaccacggccccggacgcgcgctggatgagtcggccgacgtgacgttgacgacgtatgccttgatgcgcctggacgcggaggtcctgggcgcgaagcagtggagcaccgtcgtgctggacgaggcccaggccatcaagaacccagacagccaggtggcgcgagccgcgtatggattgcaggcggacttcaagctggcgctgagtggcacgcccatcgagaaccggctggaggagctctggagcctgatgcacttcaccaaccagggcctgctcggcggacggaaagacttcgaggagcgctgggcgcggccggtcgcggacaaccacaagggcgcggcggagcggctgcgggcgcgcatccggcccttcatcctgcgcaggctcaagcgggacgtggcgccggagctgccgccccggacggacgccgtgcgccacgtgacgctcacggagcgggagcgcgccgtctacgacgccatctacgcggcgacgcgcgaggaagtggtgtcgcagctcgaggcgggcggcagcgtgttgaaggccttggaggccctgctgcggctgcggcaggcggcgtgccacccggccctcgtgccgggccagcaggcgaagacctcgtccaaggtgcaagccctggtggaggcactgggtacggcggtggaggacgggcacaaggcgctggtcttctcacagtggacgtcgatgctggacctcatcgaacccgcgctccaggaagcgggcatcggcttcatccggctggatggcagcacggcgaaccgaggcgcggtggcggcgtcgttccaggacccgaagggcccaccggtgatgttgatttccctcaaggcgggagcgacggggctcaacctcacggcggcggaccacgtcttcctcgtggacccatggtggaacccgtccgtggaagcacaggccgcggaccgcgcgcaccgcatcggtcagcagcggcctgtcatggtgtaccggctggtgtcccaggggaccgtcgaggagaagattctcacgctccaggcgaagaagcgggagctgttcgaggcagcgctcggcggcggctccggagccaccgcgattacgcgtgcggacctgatgcaactcctcgagtag

SEQ ID NO: 3253 - DNA, 237 bp, Myxococcus xanthus
atggctcgcgttaccgtcgaagactgcctccccctcgtcgacaaccggttcgcgctggtgctgctcggcgccaagcgcgcgcggcagctgatggcgggtgcccgccccatcctcgagcagtccaagaacaagccccccgtgctgtccctgcgcgaggtggccaccggccgcgtgaagttcgaccgtgacgtgcgcgaggcgctgtccggcaagtacacgggcgacgagcccaagtag

SEQ ID NO: 3254 - DNA, 291 bp, Myxococcus xanthus
atgaagattcgtcccctgcaggatcggctcatcgtcaagcgcgtcgccgaggagaacaagaccaagggcggcctcttcatccccgacacggcgaaggagaagcccctcgagggcaaggtcatcgccgtgggcaacggcaaggtgcaggaggacggcaaggtccgtccgctggacatcaaggccggcgacaccatcctgttcagcaagtacgcgggcaccgagatcaagctcgacggcgaggagcacctcatcctccgtgaagaggatgtgctcggcgtgatcgagaagtaa

SEQ ID NO: 3255 - DNA, 1651 bp, Myxococcus xanthus
atggcgaaggacattcttttcgacgtgcgcgcgcgtgaggccatcctccgcggcgtcaacatcctggccgacgcggtcaaggtcaccctgggccccaagggccgcaacgtcgtcatcgagaagagcttcggctccccgaccatcaccaaggacggtgtgacggtcgccaaggagatcgagctcgagaacaagttcgagaacatgggcgcgcagatggtcaaggaggttgcctccaagacgtctgacgtcgccggtgacggcaccaccacggccaccgtgctggcgcaggccatcttccgcgagggcgcgaagctggtcgccgcgggccacaacccgatggacatcaagcgcggcatcgacaaggccgtgggcgccatcgtcgccgagctgaagaagctggccaagccgaccaaggacaagaaggagattgcccaggtcggtaccatctccgccaacggtgacgagaccatcggcaccatcatcgcggacgcgatggagaaggtgggcaaggaaggcgtcatcaccgtcgaagaggccaagggcctggagacgacgctggacgtggtcgaaggcatgcagttcgaccgcggctacctgtccccgtacttcgtgacggacccggagcgcatggaggcggcgctcaacgacgcgctcatcctcatcaacgagaagaagatctcctcgatgaaggacctcctgcccatcctggagcaggttgcccgcgccggtaagcccctgctcatcatcgccgaggacatcgagggcgaggccctggccaccctggtggtcaacaagatccgcggcgtgctgaacgtgtgcgcggtgaaggcgccgggcttcggtgaccgccgcaaggccatgctcgaggacatcgccaccctgacgggcggccggatgatcgccgaggacctgggcatcaagctggacaccatcaccctccaggacctgggccgcgcgaagcgcatcacggtggacaaggacaacaccaccatcgtcgacggtgcccggtggccagcaggagatcgaagcgcgcgtgaagcagatccgcgcccagatcgaggagacctccagcgactacgaccgcgagaagctccaggagcgcctggcgaagctcgtgggcggcgtggccgtcatcaacgtcggcgcggccaccgagacggagatgaaggagaagaaggcccgcgtcgaggacgcgctcaacgcgacccgcgcggccgtcgaagagggcgtcgtccctggcggcggcgtggcctacatccgctgcctcaaggcgctggacggcctgcagctgtccggcggtgagaagttcggcgtggacatcatccgccgcgccgtcgaggagcccctccgccagatcgtcggcaacggcggcctggagggcagcgtggtggtgaacaaggtcaaggagtcctccggtccgttcggcttcaacgccgccacgggcacctacgaggacctgctggccgccggcgtcatcgacccggccaaggtcagccgcaccgcgctgcagaacgcggcgtccgtgtcctcgctgatgctcaccaccgaggccatggtggcggagcgtccgaaggaggagaaggacctccccgccggcggtggcatgggcgggatgggtggcatgggcggtatgggcggtatgggcatgtag

SEQ ID NO: 3256 - DNA, 348 bp, Myxococcus xanthus
atggggacccgggggccgtcgtctttgtgggctgggtggcggcacgccctcctggcccttactttggtgaatacgaaggaggagacacccgtgaagcccgtgaagatttttacgaccacctactgtggcttctgcgtccgcgccaaggacctgctcaagcgcaagggcgtggacttcgaagaggtggatgtcaccggagacgacgacctgcgcgcgaagctcgtggagatgagcggtggccagcgcaccgtgccgcaaatcttcattggcgacacgcacgtcggcggctactccgacctgtcccggctggacaccgagggccgcctggagccgatgctccaggcctga

SEQ ID NO: 3257 - DNA, 405 bp, Myxococcus xanthus
atggcaggcgaagagcggcagacggggacccgggacgagcagtacaacctcatcagcgtcctgtaccacctgctcaagggggcctcgaccagtgaggcgtacatccgggatgccgaggaaatcggcgaccccgagctcgcccagttcttccgcgattggcaggaggagcagcgaaacctcgccgagcgggccaagaatctgctcggcgcccgcatggcgggcgtgtccagggcgggcaccggccgcaaacgctcggcccaagagggcaggcgcggcgcgggctcggtggagaagcaacccaccaacgcgagcgtcgcatcgggcggcaatgacacgacacgagacgccgtggacgaggagctgctggagacctttcccgcaagcgacccgccgggccgctactga

SEQ ID NO: 3258 - DNA, 1011 bp, Myxococcus xanthus
atgctgctcatggtggccatcctggccgcggcctgccggagcacgcccttccaggtgcggggcgccgtgcccgaatcgctgggcgcgtccgcggtggtcgtccagcccttcggcttccagtgggcggagcccgactggcgctccgtggagctgtctcagcggctggtgaacgtggccctggcgcagacgggtgacgcggccctcttcttcggccccaccgagctgcaggtggcgcggcccggcgaggacggcggtaacgggctgacgcgcgccgtggtcgcgacattggcctcctacggcgtccggcctgacggattgatggtcctccgcccctcggcggagaaacgcatccagtccggtgaacgtgaactgattgacaccgagggctacacggtgggccagagcgccaccgaggtggtgatgtacgtgggccgtgtcgaggtcctccaccccgccacgcacgaggtggtgctggaggtcttcggggaggccaccgtgaatccctacgcagacatcctcgatgagggcgcggatccggctccggagctgacgagcctcatggaggcgctcacgcgcgaagccctccgcggcctgtcgagccacctgaagccaccccgcgcgccatcccccgcgctggccacctccctggcgtgggcgccgtgggacgtgctcgacatggcggcgtggatgcccaaggacatgaccgacctggaagcgccgctgcgcacagaagccgggcaggacccgcgaagcctgcgcatgcagcgcctgcgcttcgccaacccgcacgcggacgccgcgctgctggaaacactggcgcggcgccccggcggcctctatgtgcgcgccgcacccgagggcgcgaagctctccgcgggggacctggtgctcacgctcgacggccgccccgcacttccccagacacttgcccgcgcacggctggcgctcgtgccagtcgaagcgcgcgttcaacaaccctcaggcaggattgttccactcgtactgccttga

SEQ ID NO: 3259 - DNA, 1380 bp, Myxococcus xanthus
atggataggcccgaggtcacccagaccactcagacggagcaggaaggccgcaccacccgaatccccatccccgaatggacggtggaggtggttgccggacctgacaagggcaagaaggtgaagacgcaggacggactggtccgcgtgggctccgacagcgcctgcgacctggtcctcaccgacgccacggtgagccgccgccacctggaggtggagcgcaccgcgcgcgggctgatgctgcgcgacaccggcagccgcaacggcaccttcctggacggccgacaggtggtgcaggcctacctgaccagcggcgacaaggtcgagctgggcaagacgaagctctccgtgaaggtcgccccgcgtcccaccgaggtggatgttgcgggggcggagtccttcggcgcgctggtgggcgcctcggagaagatgcgctgggtcttcacggagctgcgccgcatcgcccgcgaggacatgagcctgctcgtggagggtgagacaggcaccggcaaggagctggcggcgcgcgcggtgcaccagcactcggcgcggcgccacggccccttcaaggtcgtggactgcaacctcatctccgaggagaaggccgagcgcgagctcttcggcggcctgcgcgcgggtgacggcgaggaccgcgaggcgcggggcgtcttcgaggcggcccggggcggcaccctcttcatggacgaggtgggcgagctgccgctgcccgtgcagggcaagctgctgcgcgtgctggagacgcgcgaggtgccgtcgctggacggccagccggtggcggtggacgtgcgcgtcatcgcctccacccaccggaacctggaagaggacgtgcgccagggccgcttccgcgcggacctgtacttccggctcgcggtggcgcgcgtgcgcctgccgcccctgcgcacccggcgggacgatttgcccgcgctggcccaggccctggcccagacgctgcgcgccagcatcaccctcacgccccagacgctggccctcttcgagggctatgagtggccgggcaacgtgcgcgagctgcgcaacgtgctggagcgcggcgccctcatggaggagacgggcaacagcagctggctggacttcctcgcccagccctcgcgacgcgcggagggacagccccccaccacccaggtggccacgctggtgggcaccctgccctaccacgaggccaaggacagggtgctggccgacttcgagcgcctgtatttcgccgaggtcatgaaaaccgtgggcttcgacatgaaggccgcggagcagcgcaccggcctgtccatgcagagcctttatcgccttttgaaaaaaaacgggcttcggctcaaggacctcaagaacgccgagggcctggagaagtaa

SEQ ID NO: 3260 - DNA, 93 bp, Myxococcus xanthus
atgctgagcgcactgctcaccacgcgtccccaggtgatggagtgcttggtgtaccccaagcacccgggcgcggagaagagcaccacggtgtag

SEQ ID NO: 3261 - DNA, 141 bp, Myxococcus xanthus
atggcggcgaaggacgcggagaactggggtgacgtcgtcaccgccacccagaagaacgtcgacgagtccgtgaaggaactggccgacgcggagaagatggccgcgcaggacaaggccgcctgcccgaagaagaagttctag

SEQ ID NO: 3262 - DNA, 93 bp, Myxococcus xanthus
atgacgtcgtcgcacgtactggacacgtcgctggcgctcacgctgcgtgacgcgctggacctcatcttgaaggatgtgccccgtgtcatgccc

SEQ ID NO: 3263 - DNA, 480 bp, Myxococcus xanthus
atgccacgcgaggcgtccgcaggaggtgtcgtcatccgggagagcgccggccactgggaggtggtcgtcatccgtccccatggccgcaccttgtgggcgctccccaaggggcacgtggacccaggtgagtcgccggagcagacggccagccgcgaggtgcgtgaggagacggggctgtccgtgtcgctcatggccccgctgggcgagattcgctacgtgtaccagttccgcggacagcgcatcttcaagcgcgtccacttcttcctgttccgctatcaggagggggagctggggccgctgccgggaccgcgcatcgaggtggacgaggtgcgctgggtgccggtggtccaactggtgccactgctgggctacaaaggagagaaggccgttgcctcgcgggcggtgcgctggttgcgctcccagggcctgctccccgaagccccctccccggtgagcattgccgggaaggaagggggctga

SEQ ID NO: 3264 - DNA, 642 bp, Myxococcus xanthus
atgattggccgcgttcaggaccacctggaggccatctacggcttcacgtgcgaggcaagggcggaggtcttcgtggtggacacggaggccgccgcccaactgggaggcaccggccgcgccgacgaggagctgctggtgcacgaggcagacgacgcgctggagctggccctctacctgtcaccggcgctgctcgacaggctcaagccctacgaatccggtccgctgggttacgtgctggacagcgacctggccggttactgccagctggccgaaggcgtgagccacttcctctacgtggcccacacggcggcccacggccggacggtgtcgctgctggagctggaggcgcaggcggaggtggacaagttcgcggtgtgcctgctgcaccggtggggcgaaggcgtgggggcctgggcgcgggagctgctccagcgtctcttcgaccgggtgtcctaccgcaagcagctctccgtccaggagcggtggcgctacgaggaggcgaaccggctgtcacgccgcttctgctcgcggctgatggggcacgtcgccgcccggcggttggaccggctgctggcggacctgcgttacgcctaccggctgggggcggaggccaagcttcgccatttcgcgcatggcgggtga

SEQ ID NO: 3265 - DNA, 600 bp, Myxococcus xanthus
atgagtggactggtggcgtccctgtctctgaaggagttcttcacacctcttctgggcgaggtcacggggcggcagcgggtagaactggcggaagtgacggagttctacctggtgaacctgctgtccgagttcgccgtcacccacaagctgttcacctgcgaggagggcgggcgcaaggaccacgagcccctggccatcctctaccaccaggccttgcagcaggagcgcgccgagcgcatccgcacgctgcgccggctgggcgacgtgtcgctgtacaccgtgggcttcttctccggcgcgctgcagagcggcgtggtggggccggactactacatccagatgggtggcacggcgtatggccacgtggcggagctgacaccggcggcgggcttcgcgcaggtgtaccgggagctgtgcgagaagttccgcaaggtggtggaggtgctggaggagatctccgcgcggggcatggtgcgggccggccccagcggcgtgctgaaggtctatgaggcgtgggtccgcaccgggagtgaccggctggagcgcgtgctgctcgacgcggggatgatgccgcggcccaagggacagctcgccaactag

SEQ ID NO: 3266 - DNA, 3603 bp, Myxococcus xanthus
atgcgaatcaagcggttggacatcaccggcttcaagtccttcatggaacggagcgtcttcacgttcgacgaaggcgtgacgggcatcgtcgggcccaacggctgcggcaagtccaacgtcgtggacgccatccgctgggtgatgggtgagcagagcgcgaagaacctccgtggccgcggcatggaggacgtcatcttcaacggctcggagaacaagccgccgctgtccatggcggaggtgtcgctcacgttcatcgtggatgacacggaccagctcgcgccccagtaccagggcttctccgaagtgacggtgacgcggcgcctgttccgcaacggcgactccgagtacctcatcaacaagacgctgtgccgcctgctggacatcaccgagttgttcctcggcaccggcgtgggcacgaaggcgtactccatcatcgagcagggccgcgtgggcctcatcgtgtccagcaagccggaggaccggcgccacctgctggaggaggccgcgggcgtcaccaagtacaaggcccgccgcaaggccgccgagcgcaagatggaggcgaccgacgccaacctgctgcgcgtcactgacatcaccaacgagttggagaagcggctcgacgcgctgtcgcgccaggcgaagaaggcggagaagtacaagaagctcaaggcgcgcatgcgggacatcgacctgcacgcggccacgcaccgccagttggagctgatggcggagaagaagatgctccagtcgcggctggagaacctgggctccgaggagcgggagagcctggaccgggtgaaggagctggaggagaccatcacccggcgccgcacggagttggaggcggaaaccgccgcgctccaggcgctggccgcggaggtgcacacgctggagagctccctgcagcgcgacacgcaggagatgacctacggcaagcgcgacctggaggagacgcgggcccgcgtggccgccgcccaggtggagctggacgggctcctggcgcgcaaggcggagatgtccgaggccatggccgcccgcgaggcggagctgtcgggcatcgccggctcgtggaaggaggacgaggtcgcgatgcaggtggcgcaggaggaactgcgccgcgtgtcccagctccagacggaggtggcgctgcgcctggagcaggagcgcgccggcctggtggccgtggccacgcgcctggccaaccacgagagcaacctggtcaacctcgctcgccagcggggggatttgggtgcccgccgcgcgaagctccagggcgagctggaaaccctgcgcgcccaggagcagacgctggagaacgtccggggcgacgtggcgaagcgggtggaggacacccggcacctcgccgcggagctggccgagcgcaagggccaggaggaggacgcgctcacccgcacccgcgcggccttcacggagaacgaaatcgaggtcatcgcgctgcgggaggagctgagcgacaagcgcagccgcctctccacgctggaagacatccagaagaactacgacggcttcgaccgcggcgtgcgcgccgtgatgacgcgcgccggtgtgcaggcccgtgagcagggcatcttcggcctggtggcggacgtcatcaacgtcaccccgcgctacgagcgcgcggtggaggccgccctgggagagcggctccagcacgtcatcgtcgagagccgcgacaagggcgtggagctggtggactacctcaagggccacgccgagggccggggcagcttcctcccggtgcccgcgctggacacgctgccggccccgctggagccggacttcagccagcccggcgtgctcgcgcatgccctgcgtgaggtgacgtgtgaggaggcgctgacgccgctcgtccaactgctgctgggggatgtcgtcatcgtccaggacgtagccacggcgcgcgcgtggaccgagtcgggcggcccggcgtgcacgctggtgacggtggagggcgaggtgttccgcccggacggcaccatcgtcggcggtgagagcgagggcgcggcggtgggcgcgctccagaagaagcgcgaaatcgccgagctggccaccgaggtggcccgcgtggaggagcgctacaacgagattctcacccggcactacacgctccagaagcagatggggcacgcggagggcgtcctcaaggggctggcgaagaatcagcacgccgaggagctgaacctcgccagccaggagaaggacctgcacaaggcgggcgaggacctggcccgcgtgcgcgagcgggtgcgggccctggaagtggaggaggggcagctcacccagagccaccaggccctggagcacgaggaggaggcgagccgcggcgaggtggcgcacggccaggcggaccgcgagggccgcgaggagcgggtgaagcagctcgtgtccgaacaggagtcgctgcgcctgcgcgcagagacggccaacggcgagctgacgggcctgcgcatcaaggtggccgctggcagcgagcgtggcgagtcggcccgcaaggagctggacagcctcgtctcccagcgtcaggacatggagacgcgcatcacccggctccaggccacggtggtggagggtggggcgcgcgtcgaggagctggcgcggcgcacgacggacaccgagggcggcctgtcccagcgcgccgaggagcaccggctcgccgcggaagggctggaggcgcaccgcgcggcgcacaccacggcctccgcggaggtgcgtgagcaggacgcgacgttccgcgagctgcgcggccgcgtggacaagctgatgcagggcctgtcgcaaatctcgctgcgggagcgcgaaatccccctggagctggagcacctggcggggggcatccatgagcggcaccaggtggagctggctaacgaactgcacaagtaccacatgctggccgcgctggccccggagacggaggccgatctgaaggacctgcgcgcgcaggtggagaagatgggggagatcaacctcaccgccatcgacgagcacgcggagctgtccaagcgctacgatttcctcaccgcgcagaagaaggacctgcagtcctccatcgagcagttgaaggaggccatccagcgcatcgacgccaccagccgcgagcgcttcaagcagaccttcgacgtggtgaacgagaagttccaggccatcttcccccgcctgttcggcggtggccgggccagcctcatcctcaccaacgaggggccgggcggggagccgggcgtggaaatcgtcgcccagccgcccggcaagaagctgcagagcgtcaacctcctgtcgggtggcgagaaggccctcaccgccgtgggcctcatcttcggcatcttcctcatcaagccgacgcccttctgcctcctcgacgaggtcgacgcgccgttggatgagggcaacgtgggccgctacaacgacatggtgaaggagatgagcaagcagtcgcagttcatcctcatcacccacaacaagcggaccatggaggtttccaacaccctctatggcgtcaccatggaggagccgggcatctccaagctcgtcagcgtgcgcatgcgcgaggcgggcgcggccaacgacgacaaggtgacggcggcgtag

SEQ ID NO: 3267 - DNA, 1392 bp, Myxococcus xanthus
atgggcaacgaatggttgttcctggggttggcgatcctcctcgtattcgccaacggcttcttcgtggcgaccgagttcgccatcgtgaagattcgcgccacgcggctccaggccctggtggacgaaggtgcgccgggcgcgcccacggccatgaagatggtggagaagctggacgcgtacctctccgccacgcagttcggcatcaccctggcctccctgggcctgggctggctgggtgagccggccttcgcgcgtttgttggagccggtgctggtgcaactggtgccggagggcgccgccaccacgttggctcactccgcggcggtggtgattggcttcagcatcatcaccttcctgcacatcgtcctcggtgagctggcgcccaagagcctggcgattcagcggcccgaggacacgacgctcgcggtggcgctgcccatgcgggtgttctacgtcctgttctacccggccatcgtcctgctcaacgggctggcggcgtgggtgctgcgcgtcttcggcctccagtcggtgggggaggcgcacgaggcgcacagcgaggatgagctgctggtcatcctccacagctcggcgcaggcgggcgcgattacgacggcgcgcgcggagctgctggagcgcgcgctggagatggcgcagaagacggcgcggcaggtgatggttccgcgcaaccaggtgaagttcctggacgtggaagagccgctggagaagtgcatcgcggatgctcgcgcggcgggccacacgtggctgccggtgtgccggggcaatctcgatgaggtcgagggcgtggtgaacgccaaggacctcttcttcctgctgtcccggggcgagctgcgcagcctggcgcaggtccagcggccggtgctgttcatccccgagggcgccacgctggagcagttgctggcggagttccggcgccggcgccggcagacggcgctggtggtggacgagcacggcggcacgtccgggctggtgacgattgccgacgtggtggcggaggtggtgggcgacgtcgcggagctgggccgccgcatggacgaggtccgcgcgctgcctggcggccgcttcgagctgccgggcaccgcgcagctcgacgacctggaggagcggctggacgtcaacttcgacctggatgaggacgaagagggcgaagtgacgaccatcgccggctacctcatgacgaggctgggccgtgttcccgtgaagggggacacgctgcggctcgacatgtggcgcatcgtcgtggacgcggtggaagggccacgcgtggtgcgtgtcaccgtggagccgcaagcgcggacggcgtccgcgcgcaccgtgtcggacggctcggcgggcgccggtgagccgccctctggcgcctcgaacgagtcctga

SEQ ID NO: 3268 - DNA, 234 bp, Myxococcus xanthus
gctctcagggaggcggagcgtgcctatgagcgtgcgcgggcgctcaacccggaagacctgctgctcaactacaacctgtccgcgctgttcgcgctgtgggggcgtcccaaggacgccgtgcagtacctgcagaagtcgctcaccgcggaccggccgaaggtgatggggtggctgtccaccgaccccatgttcgacgccctcaagggtgacccggacttcgaagccttgttctga

SEQ ID NO: 3269 - DNA, 1083 bp, Myxococcus xanthus
cggctgttgattgagagcgtcactgaccatgccatcctgacgctcgacctggacggatacgtagcgagctggaacccgggcgctgagcgcatcaagggctaccgcgcggacgagattctggggcagcacttcagccgcttctatccgcccgaagccgtggcgcggaaccggccgcggcacgggctcgaggtggcgacgcgtgagggccgcttcgaggaggacggctggcgcgtccgcaaggacggcagccgcttctgggccaacgtcgtcatcaccgcgctgtatgacgagacagggcaactgcgtggcttcggcaaggtgacgcgcgacttcaccgcccgctaccaggcccaggagcaacgggagatggagcgcctacgggaggcgcttcgcatccgtgacgacttcctgtccgtggcgtcccacgagctgcgcacgccgctcaccccgctgcaactgaagctgacggccatgcgccgcgccgtcgacagcgccccgggaggcatgctgccgagcgagcgcgtggagcgcgacctcgacgtcgccgtccgccaggtgcgcaagctggtggagctggtggacgacctgcttgacgtgtcacgtatcagcgtgggccagctggccctggagcgcgtgcccgcggacctcacggcgctgcttcgagaggtcgtcgcccgctacctgccacaagccagccagctcggaagcaccgtggaactggacgcgcctgcgcccgtgcagggcgaatgggacacacgccgggtggagcaggtgatgaccaacctcctctccaacgcgctcaagtacggagggggcaagccgattcacgtcagcctgcgcgcggaaggcggcatggcgctgctgagcgttcgcgacgagggcatcggcatcgcgccggaagcactgccccacgtcttcgaccggttcatgcgggccgtgtccggccgcaacttcagtgggctggggctcggcctcttcatcgcccaccaggtcgtttcggcgcacgggggcgacatccaggtgtccagcgtgccggacaaagggagcacgttcagcgtccggctcccgctcggccccacgtag

SEQ ID NO: 3270 - DNA, 1358 bp, Myxococcus xanthus
atggaagtcgaaggtgggcgtgacacgccgctgcacgtcacgctgccctacgagcacgcgcgccggggctatgacgcctccacggtgcgccggttccggctcacggtggcggaaggcccgaacatggggacgacgtgggagtccacgggcgacacctgctcggtgggctcgcacccgctgaacgacttcgccgtggaggactccacggtgtcccggttccactgcgaggtgcgcatcgggccacggggcccccaggtgaaggacctggacagcctcaacggcgtcatcgtcgacggggtgcaggtggtggagggcgtgctgcgcagtggcagcctgctgcgcctgggccgcgtggtgctgcgcttcgacttcagcgcggagacaaccgcctgccgctgtcggagaactcgcgcttcggcacgctggtgggcgcctccgtggccatgcggggctgcttcgcgatgatggagcgcgcggcgggccgcgacgtgacggtgctgctcgaaggcgagacgggcacgggcaagagccaggccgcgctggccatccaccaggccagtccccggcgcgacgcgcccttcctcatcgtggactgcggcgccatccccgcgcacctgttggagagcgagctgttcggccacgagaagggcgcgttcaccggcgccgtccagcggcgcgcgggcgtcttcgaggaagccgacggcggcaccgtcttcctggacgagattggcgagctgcccgcggagttgcagcccaagctgctgcgcgtgctggagaaccgcgagattcgccgcgtgggcagcaacacgtatcagccggtgaacgtgcgcctcctcgccgccacgcaccgagaccttcgcgcggaggtcaacgcgggccggttccgctccgacctcttcttccggctcgcggtgctgcgcttgctgcttccaccgctgcgtcagcgtccggaggacctgcccatgttggtggaaggcatcctcgacctgctcggcgcggaccgcgagcgcacgggcgcgctgcgcacgcaggacttcctggccaggttgcggcacgcggcgtggcccggcaacgtgcgcgagctgcgcaactacctggagcgctgccttgtcttcgaggaagcagtcgagctctccgaggaagaagcccaccgctccggcccacccgaggtggacccctcgcagccgtacgccgaccagcgccgtcacgtcgtcgacgacttcgagcgccgctatctgcgcgcgctgctggagaaacaccagggcaaggtggcccaggcagccgtcaccgcgggcatggaccgcgtccacctctaccgcctgctgcgacgccacggcatcaagccgtgagcctcaccg

SEQ ID NO: 3271 - DNA, 1449 bp, Myxococcus xanthus
atgttcacacgcatcacgcatgccgcggcgctaggcgccctcatcgcactggtggcgggcggcagcgccctggcgcaggatggcaccaccgtcagcctcggcgtgggttcccagaaggtgatcaccatccctggtctcagccgcgtggcgctcggtgatccgagcgtcgccgaggtgaagacgctcggctccggccagctgctcatcaccggtcaggctgaaggcaagacgacgctgctcgtctggaagtcctcgggccagcgcgtcagctacctggtggcggtgcgcaagcaggaccccaacgaggtcatctccgaaatcaagcgcttgctgggtgagattgaaggcgtctccgtccgcatggtgggtgatcgcatctacctggacggtcaggcctacaccacgcaggacgccgaccgcatcgagcaggtggtgggcctctacccgaacgtgaagtcgttcgtgaagattgcccccaacgccaagaagctggtggcccagaacctcaatgcggccttccagaaggcgggcctgaagaacgtccaggccaacgtggtgggcgccaccatcttcctggagggctccgtggagagccagcaggatctccagaaggcggagctcatcaccaaggccatcggtgagaaggtggagaacctcctcgtcgtcggcatcaagcggatgatcctctccgaggtccagttcgtcgaaatccgccgcaacagccgagaccgctacggcatccgctacccgacggacatcacggggaccgcgacggccatcgccagcatctcccaggagctcttcccgggcaccttcggctccggcgtttccacgctcaccctcaacgcgaacgcggacttctccttcggcttccagggcaacgacggttacggccgtctgctcgcgcagcccaagctggtgtgcgccagcggtgagaaggcggagttcctcgccggtggcgaggttcccatcccgctcatcacgaacaaccagttcacggtggagttcaagaagtacggcgtcatcctgaacctgcgccccaccgcggaccgcaacggcaacatccagacggagatcgaggcggaggcctccgaaatcgacacctccgtggcggtgtccttcggtggttcggcctccatccccggcttccggacccggaaggtgaagacgaacgtcaccgtgcgccacggtgagaccatcgtcctgtccggcgtgttcagccacgacgagcagaagtccgtgtcgaagctccccggcctgggtcacatcccgatcatcggtgagctcttcaagagccgcggtttcgactccaccaagcgcgagctggtcatcttcgtcaccccgcgcatcgtcaacccggactccgacaaggtccgcaccatcatcgaggacgtgaagagccgctacaagcaggcccggtccgaggtgaacttcaacatcttcgactga

SEQ ID NO: 3272 - DNA, 945 bp, Myxococcus xanthus
atgaagggctgcgtcgccgcgctcctcgtcgcgctgctgccggcggcggtcgtggcgcagcagcccgcccgtccccgcgtggtggcggtgaagtccgcccacttggcgccgtatgcctccgtcatcgccggcttcgcggcggaggcccgggccgaggtgcaggaggtcatgctggacgaaagcgcgggcgcggccgcgcggctcttcaagaagctggcggcccagaagcccgcgctggtgctggccctggggcccctggccgccaacgccgcacggcgctcgctgggcgaggacgtgcccgtcctcttcgccatggtgccctactacgagaagtacggcctggatggcgccaacgtcaccggtatctccctcaccagcgacatggggccagagctggaggcgctgaaggccgtgtcgccgaaggtgaagcgcgtaggcatcctgcatgacccgcggttctcctcggggacggtgacgcaggcccgcgcggcggcggcctcgaggggcatgtccatcctcccgctggaattggaggcggggggccgggcggagaaggcgttggacggcgcggtgggcaaggtggacgcgctgctgatggtggcggacaagacagtgggcaacgcggcggtcgtccaggcgctcatcgccttcgcggcggcgcaccgggtgccgttggccgctctaacgcccagccaggtgaaggaaggggccacgttggcgctctcgcccagtcccacggccatcggccagcaggccgggcggctggccaaccgcatcatccacgagaaggtgaatccaggagcgctggcggtggttcagcctgaggggttggacttgtctctcaatctcaccgccgccaggaagttgggtccgtcctccgacgccgtgctggaactcctccggctcgcggcgcggcgggactttgccgtgaaggtctacgagtga

SEQ ID NO: 3273 - DNA, 273 bp, Myxococcus xanthus
atgggcggggtcggagccgtgctgggcttcccggcggtgctcgcggccgcggccttcatctcactggtgggtgcgcttcaagcggtggtgacactgctctggcaaggcgcggtttgggacacgctggcggcagtggtgcgccggtggacggtgtgggtgcgtttggccagcacgcacgcgcagccggcgccccagcgccacattccccatggagtggccatcgcgctcggcaccgtctgggcgctgtggtggcagcacggaacgttgggttag

SEQ ID NO: 3274 - DNA, 795 bp, Myxococcus xanthus
atggcccagcagatgggctcggatcgcgatgccctgatcaaccaggcgctcttcatgttcgcgcgcctgaacggcttcctcgaggtgaagtcccgctccgaggccgccgtggcacccgtggccgctgcgccggtgaagcccgtgcaggccgctgccgccgcgccgccgcgtccggccgcgccgccggtgctggcgcccgcgccccggcctgagtccacgcccgcgcccgcgcgtcctcccgtgcgcgccacgccggaagagcgggcccccgccaatggcctggacaatgacccggtgcgccgcgaggtggccgagcgcgtcctggagaccgccgcggagctggagcgcctcatcaagggcaagaacagcgagccgccccctcccgccgacgacatggtggaggaggacgaggagccgctgcccgaggccgaggatccgggcctcatggacgaggagccgccccccgatgaggcggaggaagagcccgccgacgacctcgccgaggaggaggaggtcggcgcgctgtacctggtgaccgagtccggtgatcaggagcagatcgtcaaggaccgcttcgtcatcggccgcggcaagcactgcgacttcgtcatcaactccggcaaggtctcccgtgagcacgcggtcatcgtccacgagggcgacgactggatcatcgaagacctgggctcgtccaacggcacctggttcaacaagcagcgcatcaagcgccgcaaggttgaggacggggacgagtatttcatctgcagcgagaaaatccgtctcctggtccgataa

SEQ ID NO: 3275 - DNA, 1305 bp, Myxococcus xanthus
atggatttgtccgagggcttcggcaacgtgccggtgcggctcctggtgagccacccccggatcctcatccccgacgtcgaggccatcaacgcgggccgctacatcttcggcgtccgtgacgaggcctcttgctctgccgcgcgcgagtgttccggagtgctcgcggtggacaccgagtcatccccccctgggcagacggcgcgggacctcagcggtgcgccgatgctgcccatcttccccgcgggcggcttgccgacgggactgaccctggttccggacgcgcagcttcgcatcgtgctcgacgatggctcggcgaccgaggtgcgggtgccgctcctgggcgtcatgccgtcctccaacggctacatctcgttgttctccgcgagcgacctgcgccaattcgacctgtcgggggcgagcgcacgctccacggtggcgctgctggacagcaacgagttgccgatcgtcatcgagacggcggacctggtgacggtgacccaagaccagacgctccagtcgacggtgctctacgagggctccgttccgaacggcttctaccggatcatctaccagggcgcgttgccagggctgagcggcctgcctcgggagccctccaccccgcggctctttgaggtcgaggccactgcggccgcttcggcgcgggccggggacatcatcgtcctggagggcacggatgtcgtgtgcgccgttgacctgcccatcgcgtcggtggagcccgttgcggggaccacccgggtgcgcttcgccatcgcggactcgcaggagattccgacggactgcgccagcttgacgcgcttcaccgtccgtgcgggtggagaccaacccttcgtcctcttcgacgaggcgggcaccttcctgtcccgcgatgtgacggggggctcgagctacagcatccccacggagtacttcttccaccccgacaccttctacttcgacgacgactccaaccctcagacgccgccggtgccgaacctgtccaagttcccccagccgccgccgccgctgcgcattcgcgtggcggccgtgggccgcgaggtgcgtcggggagaccgctacgtggtgacggtgatttccggcatccgaaactacgtcttcacccctgacgtcagggcggggacgcagctggccttctacacgctgcctgggcctgtggtggctgcccaggaccgcagcgcgaggttcgcctacatcgcctacccgtcggcggatggcatcctccaggtcggctttcaggggctcaccgacaaccgggcgcagtcattggcactggttcccttcgagtaa

SEQ ID NO: 3276 - DNA, 669 bp, Myxococcus xanthus
atgggggcgctgccggcgcgcttcatcctgcggctggtggaccggaccgtcgcgggccgcgtgctggagaccgacctggagctgtcgtactcggtgcgtgaggcgcgcggcgtggcggtggttccctcggccacgcgcgtgcccgacccggcgtcgcccgagctcaccatcgtggacgagcgcgtctacctgctggcgcgcggtccggacacgttgctcatcctggacgtcctgaacgcggcgggcacggcgcccgacgcggggacgacccccagcgtgcgcatcgtgtcggcgctgccggtgcccgcgggcgccagcgaactggaagtcattcctcgcggccctgggcgcggcaacctggtggcggtgacgggcagcggcgacgaagccgtggccatcttcgacgaagaagtggggcagctcgtcgcccaggtgcaggtgggcgacaacgatccgaaccagcccagccagccctttggcctggccgcggacgtccgcggcaacagcgctcgcatcttcaccagcacctttggtgacggccgcgtggccatcatcgacattcccgacctcgaccggccgcagaacgcccggttggtggcgcggctcggcgcccggcagggaagagacccgcgccagggcaccagcctgtgccaggagacctcaccgtga

SEQ ID NO: 3277 - DNA, 2112 bp, Myxococcus xanthus
atggcgcgtgacctgctcctggaagtgggcgcggaagagattccggcgtccttcatcggccccgcactggatgacctgaagcgcgtcatcaccgagcgcatggcggatgcccgcctgaagcacggcgaggtgcggaccttcggcacgccgcggcggctcgcggtgtgggtgaaggacgtggcggacgcgggcgaggacatcatcaaggaggtgctcggccccagcgccaaggcggccttcgacgcgcagggcaagcccaccaaggcggcggagaagttcgccgagagcctcaagctcgcggtggaccagctgggccgcgccaccaccgccaagggcgagtacctgtccgcgcgcgtggaggagaaggtccgcccggcggcggacatcctgaaggacacgctgcacgcggcggtgcacggcatcaacttccgcaagtccatgcgctggggtgacgtggacacgtccttcgcgcgcccggttcagtggctggtggcgctgctggggagcgatgttctgcccgtggtgttcggtgacgtgacgagcggccggaccacgcgggggcaccgcttcctgtcgcctgacgccatcgagctgaaggctccggcggagtacgaggtggcgctggagaaggcgcacgtggtggcggacatcacgaagcgccgcgcgcagttggtggagaaggtgagggcggccgcgagcaaggccggagcccaactgctggaggacgagtcgctggtggaccaggtgactaacctggtcgagctgcccagcccggtggtgggcaccttcgaggagcgccacctggacctgcccccggaggtgctggtgcaggagatgaagagccaccagcgctacttctcgctggtggacagcgcgggcaagctgcagccgaagttcatcgccgtgtccaacacgccggtgcgcgacgagcagctcagcctgcgtggctaccagcgcgtgctgcgcgcgcgactggccgacggacgcttcttcttcgacgaggaccggaagacgccgctcatcgaccgcgtggagaagctgggccgcgtggtgtggcaggggcaactggggagctacctggagaaggtggagcgtttccgcacgctggcggtgtggctgggccaggaggcggggcgagcaggggaggcggctaccatcgagcgcgccgccaccctggccaaggccgacctcgtcaccggcatggtgggcgagttccccgagctccagggcatcatgggccgggagtacgcccgcgcgggcggtgagccggacgccgtggctctggccatcgcggagcactacctgccgcgtggcgccgaggacgcgctgcccacgcaggacccgggcgcgctcatcggtatcgcggacaggctcgactcgctgtgcggcatcttcgccatcggcaaggcgcctacgggggcggcggacccgttcgccctgcgccgcgcgtgcatcgccatcatccggctggtgctggggcggggttaccgcttcagcctgtcggccgcggtggacgagtcgctccggttgctggcgccgaagattgccaacgccaagcgcaaggccggcgagcccgcgccgcgtgagcaggtgctggagttcttccgcggccgcctcaaggcgctgtggggtgagcagcaccgcacggacgtcgtggaggcggtgctgtccgccggcttcgacgacctggtggccgcgcagaagcgcctggaggccctgagccacatcgtcggccgggcggacttccagcccctggccgtggccttcaagcgcgtggtcaacatcgtggagaagcagggccgcgacgtgcaggggggggagaccaacccccagaagctggtggacgagccggagcggaacctccacaccgccttcacccaggcccggagcacggtgtcggggttggtgcgcgtggatgatttctccggtgctctccgggaaatcacgggcctgaagcccgccgtggacaccttcttcgacaaggtgatggtcatggccgaggacaaggccctgagggaaaaccgcatccgcctgctcgtggagattggcgccctgttcaaccaggtggccgacttctcgaagatccaggctgaaacagccgccgcggcctga

SEQ ID NO: 3278 - DNA, 993 bp, Myxococcus xanthus
atgtattttcaggaccttatcttcacgctccagaagcactgggccgaccaggggtgcatcaacacgcagccctacgatgtcgaggtcggcgcgggcacgatggccccgtacaccttcctgcgtgccctggggccggaaccctggaacgtggcgtatgtgcagccctcgcggcgtcccgcggacggccggttcggagagaatcccaaccgcctgttccagcaccaccagttccaggtcatcctcaagccggcgccgaagaacgtccaggagctgtacctggagtcgctgcggaagattggcatcgacccgttggagcacgacatccggttcgtcgaggacgactgggagtcgcccacgctcggcgcctggggcctgggctgggaagtgtggtgtgacggcatggaggtgacgcagttcacctacttccagcagtgcggcggcttcgactgcaagcccgtctccgtggagctcacctacgggttggagcgcatctgcatgtacctgcagaacgtggagaacgtcttccacctcgagtgggtcaagggcgtgaagtaccgcgaggtgttccaccccaacgaggtggagatgagcaagtacgcgctccaggagtcggacgcgcagatgctcttcgcgcttttcgacgcgtacgagaaggagtgcaagcgcttcatcgaacgccagttgccgctgccggcgtacgacttcgcgctgaagtgttcgcacgcgttcaacctgctggacgcgcgcggcgccatctccgtcacggagcgcgccaacttcatcaagcgcgtgcgcgacaacgccaggctgtgcgcggagggctatctccagatgcgtgagcggctgggctacccactgctcaagtcgccgtggacggtgggtgagcagcccccggtgctggagggcaagccggccagcgactactggaagacggtcgtcctcaacaagcccgtggagaagaagcagaaggcggaggtggcccatggcgcgtga

SEQ ID NO: 3279 - DNA, 2301 bp, Myxococcus xanthus
atgcagggtggcgccggtgacgatcccgatcgggggcggcgcatcgggaaatacgaaatcctcacgcgcctctccatcggagggatggcggagctgttcctggcctacacctcggggcctgggggatttcgcaagttcgtcgcggtgaaacagattctcccggacatcaagaaggacgagcaattcgtccagatgttcctggacgaggcgcgcatcaccgcggccttctcgcacgcgaacatcggtcaggtgttcgacctgggcgaggatggcggcgagctgtacctcgccatggagttcctgcccgggcagaacctggagcaggtgatgaaagcctccacgcgccagggctacgcgttgccgctcggcttcgtcgggcgggtgattcgcgatacctgcctgggcctgcactacgcgcaccacttcacggacccgtcgggccggcccgcggtggtggtgcaccgcgacgtgtctccgaagaacgtgatgctcacctacgacggcgtcgtgaaggtgatcgacttcggcatcgccaaggcgcgcggacggttggggcgcactcaggtggggacggtgaaggggaccagtggctacatgtccccggagcaggtgcgaggcgtggccaccctggatggccgcagtgacttgttctccgtgggcgtcatgctgcacgagctgctgagtggccagcggttgttcagcgggccgcacgaagcggcggtgatgatgcagatcgtggaggccgacgtgcctccgctgcgcggcatcaacccggacgtccccgaagccttggaagccgtggcgacgcgagcgctgtcccgggacgtgtcccagcgcttcaccaactgccgggagatggcgcgcgccattgaagcggcgctcggctcggagctcttcgacgaggacgccatgaccgccgtcatgggcgacctcttcgccgacaagcgccagaagacgcgcacgctgttggagctggccagccgcgcggaggatgcccgcgtcagcgaggcggcgggtgccctccagcaggaggacagcgcggactccgcccccacgtcgcagatgccggccccgcgcgcccggcctggtgcgccttcggccccgcattcgagcgcgcccaagcccgtgccccagcgccgtccggcggagggcggcgtggccttgcgtggcccctcagtcgccggcaacgggagcgcgcccaagcccgcccctcagcgccggaccagtgaggcggcttctccggtttcgcgcacaccgcgcggagggcaggacagcgcgccggccgcgcgtacacctcggccgcggcccactgcccggcaggaggtcccggccgagtccgaatctctcgacgagccgagcgatctccagacgcagcgcttccgttcccggccccagcggcccggcgcggacggtgctcgggtctccggacggtcggcgcgccccgatacgtcccgggcctcggacacgccggtggagacgcccgcagcccgtccgccatcgcgctgggccagtcggctgttcctgctccttctgctgggaggcctcggttgggctgcgacgctgcctgccgtgcgtgcgcagctcctgccgggcttcgaggccgccaaggcgtgggtgagcgcggagttgaatccgccgccggcggaggaccccgcgaaccagccctggccaccgcagcaggcgggcccgccacccggcttccgtcaggccgagccttcccaagctgttgcccaggtcgagcaggctgctggcggcgaaggctcggacgaagaggcggtggacggcgcgccggaagccaaggctccgacaaaggccccgcccgggcagaaggcgaaggaaggtgcctcttcgccgtcgcgccgagcagccgccccgaaggccgaggccgaacctgtcagtgcgaaggccgcgccgcccgtgcaggccagcccacctccgcgtgagccagcgcctcgcgtggcggctgcccagccggccgccgagcccgtcaccacggtgacgcaggaccccgagggaatggcggaggtgctggataccagcaccgcgaagggggccgcgaaggcgggcctggggtggatgaccctctacacggtgccgcgggcggccgtgttcgacggcgccacggagctgggcaccacgcccctgaagaaattcccgctgcccgtgggggtctaccgcctgcgcgtggtggacccgacgggggtggagtcggtgagccggctcctgtcggctcccatcaagccgggcgaggagacgaagattcaaatccggctggcggatctcccaccgtacaaggagtga

SEQ ID NO: 3280 - DNA, 1200 bp, Myxococcus xanthus
atgacagagtcagcaggtggtcagggcgaggggagcgggcggctgcgcacgcccgtggagggtgccctccgcgcggtgcgctctctggtcgagttggaggacacggaccgggcggcacagctctacgaggagctgggcgatgcgcagcgcgagcgcatccgtcacgaagctgaacaggggccggcgaaggagcgccgtggcttcgtcgaggtgctgcggcgcgcgcgggacttcctgggcgcggcccggctgatggacggccagggcgaggacgccaccgccggggacctctacttccagagtggcaagtacatggccgccgcggagagctacctccgagcgggtgatgccgagcgcgccgccgccgccttcgagcgaggtggcgcgctggaacgcgcgctggccatctaccgggagctgggctcgcgcgaagccatggcgcagtgcctggtgcgcctggaccgtcccttcgaggcggccacgctctaccgggagctgggacaggcgcacgcggaggtcgaggcgctcggaggcgtgcgcgcggaggacccgcgcttcgtggaggcggtgctgcgcatctgccagttgctggacgcggagggcttcacgcaccgggcgctggcggtgctcgcggacgcggtgagcagctcggaggatgcgcgcggggacccggcgctggtgacggagaaggcccggctgctgcgccgcatggggatggaggcggaagcggaggccatgctcattcgccgttccggaggcgcgtcggcgcctgcggcgaacgggtaccggttcctcaaggccatccccatcttcggcgagctgtccctggaggacatgaaggacctctatcggctggcgcgtcaggtcgtcatcgcgcccggcgccgtgttgctggagaagggcgcgcccggcctgggactcttcgtcctcatggacggctccgtggacgtcttcagtggccccgaggaggacgcccggcacctcaacacgctggggcccggggcgtacctgggggaaatctccctggtgcaggatgggcccgtgtccgcccatgtccgtgcgcggacctccgtgcgggcgctgcgcatcagccgtgtcgacttcgaacgcttcgtggatacgcacgaggcggcggcgctgcgcatcttccgcctcttcacccagaacctcgcgggccgggtgcgtgcgctgagcacctga

SEQ ID NO: 3281 - DNA, 369 bp, Myxococcus xanthus
atgcgcggtggggggacgcaggggctgacgttcgacgcggtgcgcgcgctggcgctgtctctaccggggatggaggagggcacgtctttcgggacgcccgcgttccgcgtgcgcaagaagttcatcgcccgcttccatgaggacggcgagtcgctggtggtgaaggtcgagcccggcgtgcgggacgtcctcattcaggccgagccagacagttgctacatcaccgaacattacgcggggtaccccgagtacctgctcgtgcgcgttgccgcggcgcgtccggcgctcgtccgccaactgttggaggacgcgtggcggaggactgcctcccagcggcagctggcggagcgggcgcgggacgcggactga

SEQ ID NO: 3282 - DNA, 1173 bp, Myxococcus xanthus
atgcgccacgtcacctgtcctgtcgccgcgctgctgggcgcggccctgtcgttcctttctggctgtgggggcacgatgtcgagcaatccctcgcccatcgacgctcagagccagaccgccacttctcagcaggccgcggaggcctggaagcgtgcccgcgtgggcgatcgcgtcacctatgccttctccgcgacccagggcccgaccccccgtgcggctgacgccgcgcgcacgctcgacggccagttgacgctggatgtcgtgtccgtccagcagccctgggtctatgtgcgggtggccttcacggacgcggcgggaaatccgttgacgcagacgcggctggcgcgggacctggtggttcccgtgcgctcggacatgacgcgctcgctggacgtgccgcgtccagggcaggtgacggcggagcgtccttccttctccgggcgcaactgggaggccactcgctatgtcagcgatcaacggcccgtggacggtccgctgcgcacgcgcgtgtatgccaatgattcggcattgctctacctgacgcgcggcctgctggaggccagcacggagtccgccgggttccggacgccgggcggcatcaggctgtcgctgcgtgagttccaggagggctccaccggggccagcgcccccgtgcccgcgctggagcggcccctggggcccggcgcgtactacgacaggaaggtggacatggcgcccacgcacgaggtgctgcgcgtgtgtttcaccgcggagcgcggctacatcctgcgcgcggagggccccttgggcactgggagcgagccgtgcgccgacttctccaaggcggagcctgagtccctggaggaggtggtgatgggccttccttgggaggcgctggtgtcaggcgagtggcctccctccaaggacggcgcccgtggcaccttcaccgtgggagaccggaacgtgccctccatcacggagcagcgcacggaggacctggagggcacgcagcacgtcttcatggacacctacgcggcggagccctgggcgccggggctcgcgggcctgccgtatgaagcgcgcttccagtcgctctccagcggctccgagcgcgtgggccccggggggcagcgtgagttcgcgggcggcagtcggatcgtccagtggggcccgtggctcggcgggcagccgtga

SEQ ID NO: 3283 - DNA, 2388 bp, Myxococcus xanthus
ggggacgtcgtcgccggccgctacgccatccaggaagtggtgggctccgggcccatgggcttcgtcttccgagcccaggacgaggagattgacgtcgaagtggcgctcaaggcggtgcacccgcgcctggtgcagcagcccgaggaacgcatgcagttcgcgctgtccatgcgcgtggccaagaagctcaatcatccgaacctcctgcgcgtgtacgaggagggcgtggatggggacaggcccttcatcaccatgcagctgctggagggcatgacgctgcgccggatgatggagcagcgcaccgcgcgggggcagctcttctcgctgaaggaagtggagccgctgctggcgcagatggcggcggccctggacgcggcgcaccgcttcggaccgcactccgacgtcaagccggagaacgtcatcgtcctgccggacctgctcaaggtgacggactacggcctgggcctggccgtgccgcacctgcccttcgtgcaggcgcagaaggggcagcgcgcggacgtctacatcgcgccggagtacgtgggcgggggcgagctggacacgcgcatggacgtgtactcgctcgcggccatcgtgggggagatgctcaccgggctcgtgcccgaggacggcgtcatccccggtctgacgatgcaccacccggacctgccgacctccatcgaggcactgtaccggcgcgcgctcaacttcaacccgctggcccgtccgaagacggcgggtgagttcctcaccgagttctccaacatcctggcgcgcacgccggccgcggtggtgtcgcgcgcgcggagcctcccggcgcctccgggctcgtcggccgcgaacaccgcgaggcaggcggcgaggcctccgcccccggtgcccacgggcatgctcccggccgtgcaggaggaggacctgcctccaccgcccggtgtcgccgcgcccaagccgcccgcacccattccggacctgccgccgccggtggatgccacgcagccgctggacgcggcgtcgctggccgccatcatgggacggggcaagcccgcggcctcgcccgcgccgcagcacctgacggagcaggcgctgcccttcatcgcaccacctgtcgtcgccgcgaaggcggcaccctcggcgcagggcagtgcttcgcggcctgcgtcatctccccccgtgccctcgcgcgccgcgccagcgcggaaggattccgaggacgccagtgagcgtggcgccccgtccgaggccgcgctgagccgctccaccgcgcccacgcaggtggatgcccccgcggtgacggatggccgctccactgctgcgatgaccctggacgaagcgccagcggtgcccgcggggcgccccgccgcgcccacgctggatgccgcgcccgcggtgggccgttcccggtcgcgtgctcgcgacggcgcgcaggacgaggcgtcgtctcgttcgcgagaaggcggcgccgaggacaccggcagccgagctcgcggccgtgcctccgaggactcaggtgttcgcacccgccgccggggttcggaggtggcagagtcgggcgctcgttccggcgcgaagcggagcgaaccgtcggaagggtccagttctcgcgccgcgcctcgcggagcggtgctcaccaagtccgccacgcgcgcggcgaagccccagcgttccatgtggaggttggtgttgctcgtcctcggctgcctggcgttgggcgcgggcgggggcttcctggccatcaaggcgctgcagaagtccagagggcaggggacggcgcctgttgccggacccggtggcgcggcagcgctggcggcgcccgtgggcggctgtcctgcgggcatgcgactggtgagtggcggagccttcaagatgggccggagcgacgatgacgcactggccagcccggacgagcgctccgtcgcgagcatccaggtgtcttcgttctgcgtggatgagtacgaattccccaaccgggctggcgcgatgccgaaggtggccgtggcctgggaagaggcgcggggaatgtgcgagcgcgagggcaagcggctctgcacggaagaggaatgggagaaggcatgcaagggccccggcaactcgcggttccccttcggcgaggagcaggccgtgggcgcgtgcaacaccgcggcgagcccgggtggactggcggcctccgggcgcttcgagcgctgcaagtcgggctacgcggtgatggacctggcgggcaacgcggcggagtggacggccacccgcgtcggcgcccaagcatacgcgctgaagggcggcgccttcgaccagccggacccggcgtcacgttgctcggcgcggagcaacggcgtgcccaccgtgcgctcgaacgcggtgggcttccgctgctgcgcgagcgtgcggcaatga

SEQ ID NO: 3284 - DNA, 1056 bp, Myxococcus xanthus
atggggtgctcggaggacgacgggggtgtggacacgcccaaccccctgacgaatcccaaggatgggcctcccgccgggaatcagaacccggaggccacgtgcgccatcccggccgaggctggcctcgcggatgtcgcccggcccaccacggtcgtcggcacgggcagtccggagagctgtaccagtgacgcgttcatccaggccgtggcgcggggcggggtcatcaccttcgactgcggtcccgagcccgtcaccatcaccctggagcggacggcgaagatcttcaacgacacggggccggagatcgtcatcgacggcaaggggttggtgacgctgagcggggcggggcggcaccgcatcctgtacatgaacacctgcgaccgggatcaggtgtggacgacggcgcactgccaggaccaggaccaccctcggctgacgctgcagaacctgacgttcgtggatgccagctccaagacggaggccgagttcgacggcggcggcgcggtctgggtgcgcggcgggcgcttgaaggtcatcaactcccggttcttcaacaacgtctgctcggatgtgggaccggacgtgggcggcgccgcgctccgtgcgttcagccagcaccggaaccagcccgtgtacgtggtgaacacgaccttcgggggcaaggctggttacggcggtgcctgctccaacggcggtggcatcagcagcatcggcgtgtcctggaccatcatcaacagcctgttctcccacaaccgggccgtcggcaatggcgccaatcccgcgcggccgggaactccgggagggggcagtggcggagccatctacaacgatgggaacacgatgacgctgtcactttgtggcacccggattgagcacaacgaggtcaatgcgcacggcagcgccatcttcttcgtgagcaatgaccactcgggagatatccgcatcgaccgctccgtgattcggaacaatacgggcgggtcgtggtacccgacgcatccacagatttcgaatcacgatgacacgcccatcgtcgtgacgaactccacgattgagtga

SEQ ID NO: 3285 - DNA, 2250 bp, Myxococcus xanthus
atgtacggctccatcaagattcgcggggcacgcgagaacaacctgaagaatgtctcgctcgacatccccaagcggaagatcacggtcttcacgggcgtctcgggttcgggcaagtcatccctggttttcggcaccatcgcggctgagagccagcggctcatcaacgagacctatccggcctttgtgcaacagttcatgccgcactacggccagccggacgcggagagcctggagaacatctccgcggccatcatcgtggaccagcagcggctgggagggaactcacgctccacggtcgccaccgtcaccgacgccgcgcagatgctccgcgtggtgttctcacgcctcgccgagccgcacctgggcagtccgggcttctattcctacaacgaccctcgggggctttgttcggagtgcgagggaatcggtcaggtcgcgtccatggacatggacgccgtcatcgacaagtccaagtccctcaatgagggcgccatcctgcccaaggactatgcggtcgacagttggtactgggccatctacgcacgctcgggcttcttcgacgtcgacaagaagctgtccaagtacacgaaggaggagatggagaagctcctccacctggacgacggccggaagatcaagctcgacaagatgaacctcacctacgagggccttgtccccaagctgcgccggacgctgggtgccaaggaccctgagacggtccagccgcacgtccgcgccgaatacgagcgcatcttcacccgagccacctgcccttcctgcaagggtgggcggctcaaccaggcagcgctcggcagccacatccaggggaagagcatcgcggagtgctccgcgatgcaggtgtcggacctcgccgcgttcgtccggaagattgccgctccgtccgtggggcccatgctggaggccctggcccaccggctcgacaacctggtgaccattggcctggggtacctcagcctcgaccgcgagagttcgacgctgtcgggtggagagagccagcgggtgaagatggtgcggcacctgggctccagcctcaccgatgtgacgtacatcttcgatgagcccagcgtggggctccacccgcacgacgtaggtcggctcgcgggcctgatgcagcaactgcgcgacaagggcaacaccgtgctcatcgtggagcacaagccggacatgattgccattgcggaccatgtggtcgacatggggcccaaggccggcaacaagggtggacaggtcgtcttcgagggcacctacgaggggttgctgacctcgggcacgctcacgggcaaccacatgaagaagcaccagccgctgaagaccacgcctcgaaagcccacggggcagcttcaaatcaagggcgcccggctcaacaacctccaggacctgtccgtttcgattccgcgaggtgtgctcacggtggtgacgggcgtggcgggttcgggaaagtcgtcgctgattcagggctgcctgcccaaggcgtacccggagaccatcatcatcgaccagaacctggctcggggctcgcgccgctccaacaccgccacgtacaccggcatcctcgacaacgtccgcaaggccttcgccaaggcgaacaaggtggatgccgcgctgttctccgccaactcgaagggtgcttgcccggactgcagtggcctgggcgtcatctacacggacctggcgcacctggacccgatggtgaccgtctgcgaaacgtgcgagggcaagcggttcaccgaggaggtgctggcgcaccggctgcgcggcaagtccatcagcgacgtctacgagatggccgtcagtgacgcggtggccttcttcaccgaaccggcgatcgccaaaatcctccaggggctggatgacgtcgggctcggctacctcacgctggggcagccgctgtcaacgctgtcgggcggtgagcgccagcggttgaagctcgccgcggagctgggccgttctgggaacatctacgtgctcgatgagcccaccacgggactgcacatgaacgacgtggacacgttgattggcctgttcgaccggttggtggatgccgggtcgacggtcatcgtcatcgagcacaacctcgacgtggtgtcccgcgcggactgggtcatcgacctggggcccggcgccgggcatgagggcggacaggtcgtcttcgaaggacttccggctcagctcgccgcgcacccgcgctcgctgaccgggcagcacatggcccgccgaggcaaggcgtaa

SEQ ID NO: 3286 - DNA, 604 bp, Myxococcus xanthus
atggcgcgacaccccacagacttccacctgacgctgtggggttcgctcctcgctgggaccgtcttcctgggcctcaccgcctgcggaggacggtccgagccggccgagcctgcggtctgtgagccacccgccagtccggaggttcgtgctttcgcgcagtgcggtccgacgctcgacttcacccccatcaacagctacgtcggcgagctctcggacatcatccaggaccgggaagacgccgtcgtgctcattgacgggcgctgcaccggaacgctgattcaagcaagcgcgggccccgtggtgctcaccgcgggccactgtgtcaacctcggggacatcccgctgattgtcttcaacttcgaggacgacgcggacggcgaccctttgattacggagggcaccgtcatcgagcagtcgatggagccggactacgcgctcatccagctcgacgtcctcccggatgtcacgcccatcccgctgacggcccaggccaccgagcaactggccatcatccagcaccctcgcggacgccccaaggtcataaccgaggaaccgttatctggacgcgtgcaacaacctcatcttctacggggacctggacacg

SEQ ID NO: 3287 - DNA, 798 bp, Myxococcus xanthus
atgcccatgttcaagaagatgttcaagggagctgcagtcctcgcggtgaccggtagcatgatgctgacgggctgcggcactgacgtgcaggccgattcgcagcacgagcaggatgagatcatctccaacctggtcgaggccggcttcccggcggacgacatcctgctctccgacggccaggtgtacgtgggtcgcgacgcgcacgtgacgctcgaggcgtcccgcgagatgctccagacggacctgaagacgcaggagcagtaccgcacgacgaacctcgtcgccgcctccatcacccgcatctgcatcgtcccgaactccgcgtacgccgccaacaccacgctgatgtccgccctggaccgggcgatcgccaactacaacgcgctgggcctgtcgttcaccatgcagcgcggcggctccggctgcagcgcgaccatctccgcacgcaccatgtccggcgctggcggctcggcgggcttcccctccggcggccgtccctacggcatcatcaacatcggcaccggcacggccacctacggcgtggccgtggtcgagcacgtcgtgacccacgagctgggccacgccgtgggcctgcgccactctgactactacaaccgcagcatcagctgcggcggcgcggccaccaacgaaggcaccgcgggcgttggcgccatccacatcccgggcacgccgaccacggccacccgcggcggctcgctcatgaactcctgcttcggctcgtccgagacgggtaacttcaagagctccgacgtcacggcgctccagtacctgtactga

SEQ ID NO: 3288 - DNA, 772 bp, Myxococcus xanthus
gagatttccggtcggggcgacccattgaaatcactgcagttgctatggggacgaaccgaggcaccgaagcgcggcccgaaggcgaaggccagcgtcgcggagctggtgtcagccgccgtcaccatcgcggatgccgaggggctcgaagcggtcagcacgcgccgcgtcgcggaggcagtgggcatctcccccatgtcgttctacacgcacatccccggcaaggccgagctgttggacttgatgatggatgtcgtgtccggcgaaatcctgaaggaccggcccgtcttcaagcccgccgactggcgcgccaacctgacagcgggtggcgacggactatcgcgacttctacctggcccacccgtgggtgattccactcgcgacccaccgcactgtgctgggcccgaacaccttccgttccgcagacatcgcgttgagcgccattgaaggcctggggctcacggacctcgagatggaccggatcatcaccctggtcctcgactacgtccacggcgcggtccgcaacgcggcccgggaaaagatggtcaaggacctgaccggcatgacggacgaggagtggtggtaccgcgtcgcccccttcctcgaaaccatcgacttcacgccctaccccgtcctgtcccgcgtcgggaagaccgcgggagagacctacggggcacacgaccccaggggggcgtttgccttcggtctcgagcgagtgctcgatggactggcggtactcattgacggaaaggcaccgggaaagaagcggcgctga

SEQ ID NO: 3289 - DNA, 4284 bp, Myxococcus xanthus
atgacgaagggcgcggacgagggccgcatcctcaagcagcgcctcttcgacatcgcccccggtgagacggccttcagcctcaacgcccgctgctacacgctgggcatggagaccttcgcggagctcgcggaagagctggtcgcgggcacgtccgaggcgaaggagcaggacttcgcgcagcgcagctacttcggcctcgcgcagcgtccggaggccgcgggcgtcgtcgacctccacggagacgtggacgtggcgcacgcgctggtatcggcgctcgactacggcggctaccccaacccgctgtccttcgcgaaggtctggctgggcaacgggcccatcgccatctccgaggcccgccgcgccgagccggcatccgagtccgccccgggcaccgtgctcgacatcgagggtgacgcgctgacggtggcgctccagggcggagacctcacgctgaagggccccaaggggctgtgcggcgcgccgctgtcatgggccgacgtgctcggcgctcgaatgcttgcccggggtgacgccctgcccgccgccgctccggagctgcgcgcccggctgaccgaggtgggcacgcaggcgggcaaggcggagtcgttcttcctccgtcgcctggagacgctcgcgccaccggacctgtccttcctgggcggcagctccaaggacgtggggacgcacacactgaagttcgaggccagcgaccttaccccaggctgggtcacggacctgcctcccgaggagcggctgctcttcaccgccatggctttcctggcgcgcctgtcccccgagccccgcttcgacgtcggctacgcggatgcgtccacgcgcgcccacatcgaaggcgtggaaggcttcttcgcctcgcagctcccgctgcgcatcgagctgccgatgaaggatgcgccggagcaggccgcgggtgccttccgcaaggcgctgacgcaactgcgcgacaagggcgtgctcgcgcgcgacgccctgggccgctccgcgcagctctccaacctccagcgccacggcggcgaagtggcgtatcccgtcgcgctgcgcatcggagcggcgaaccccgccgtgggtggcgcggcgctcgtcattgacgtggacgcgcagggccgacacgcccacctgcactttgatgccacgcgcgtggacaaggcccgcgtggacgacgtggcgcggcagctcaacgcgttcctcgcctcgctccgggacgcgccgggcaaggcggtgggcgagcatgacctgctgggcgcggaggagcgccagttgctggcccggtggaacgacacgcggcgggacttcccccgcgacgccaccctggcctcgctcttccaggcccaggcgcggcgcacgccggacgacaccgcgctcatctgccggggcacctcgctgacctaccgcgaactggacgcgcgcgccgaggtgctcgcacggcacctgcgcggcgcgggcgtgggccgcgacgtgcgcgtgggcatcttcatggagcgctcgctggagatgatggtgggcgtgctggccacgcacaaggcgggcggctgctacgtgccgttggacccggcctatcccgccgagcgcatcgctttcatggaggaggacgcgggctgccacctggtgctcacccaggagcggctgctgtcgcgcgtgccgtccgcggcgaaggccgtgctcgcggtggaccagcagtgggagcgcatcgccgccgcgccggaggcccagacgccgccggccacgccggacagcctggcctacgtcatctacacctcgggcagcacgggcaagcccaagggggtgatgattgaacaccgcaacgtcgtgaacttcggcgttggcatggacgagcgcttgggcacggagcgcggcacctggctggcggtgacgagcctcaacttcgacatctccgtgctggagctgctctggacgctcacgcgcggcttcacggtggtgctgcacgcggagcggcacgacacggcgcaggccggcaagcacgcctcgcgcgccatggagttcagtctcttctacttctccagtgatgaaggcgagcgtcccgagggacgctatgacctgctcatggagagcgcgcgcttcgcggacacgaacggcttctgcgccgtgtggacgccggagcggcacttccacgcgttcggcggactcttccccaacccggcggtgacgtcggccgcgctggcggcggtgacgcgcaacgtgcagcttcgcgccggcagcctcgtgtcgccgctgcaccccacgctgcgcatcgccgaggactggtccgtggtggacaacatctcccacggccgcgtgggcatttcgttcgccgcgggctggcagcccaacgacttcgcgctgcgtccggagaccttcccggaccgcaagcgcatcatgttccagcagattgaagacgtgcgccggctatggcgtggcgaggcgctggagacgaagagcggcacgggccacaccgtgaagctgcgcaccctgccccgcccggtgcagaaagagctgcccatctgggtcaccaccgcgggcaacccggagaccttcgaggaagcggcgcgcgcgggctgccacgtcctcacccacctgctgggccagtcggtggaagaggtggcgcagaagattgccctctaccgggagacgtgggccaaggccggccaccccggcaagggcaccgtgtcgctgatgctgcacaccttcgtcggtgactccgaggcttccgtgaaggaggtcgtccgcgagccgatgaagtcgtacctcaggtcgtcggtgggcctcatcaaggaggcggcctggagcttcccggccttcaaggcgcagacgacgctggccaacggcaacttcggcaccgaccacctgtccgccgaggagatggacgcgcttctcgacttctccttcgagcgctacttccagtcctccggcctgttcggcagcgtggatgcgtgcgtcgcgctcgtggaccggctcaagggactggacgtggacgagattgcctgcctcgtggacttcggtgtgcccacggagctggtgatgaagcacctgccgctgctggccgaggtgcgccagcgcgccaactcgggcgtgggccagccgggcgccgagcccgaactcgacggctccatccccgcgctgatggagcgtcacgcggtgacgcatctccagtgcacgccgtcccaggcgagcatgctcctggccgaggagcgctcgcgcgagggcctcaagcggctgaagaagatgatggtgggcggcgaggccttccccgtcccgctggcgcgacagctctccgagacggtgtccggcgacgtcatcaacatgtacggccccaccgagacgaccatctggtcctccacgcacccggtgaagaacgtgggcgaaggcgtccctatcggtacgcccatcgcgaacacgcagttctacatcctggatgcgcagcagcgtccgctgcccattggcgcggcgggtgagctgtacatcggcggcgagggcgtggtgcggggctaccaccaccgtccggagctggaccgcgagcgcttcgtgccggacccgttctcctcccagccaggcgcgcagatgtaccgcaccggtgatgccgcgcggtggaggcacgacggtctggtggagtacatcggccggctggaccaccaggtgaaggtgcgcggcttccgcatcgagctgggcgaaatcgaatcccggctgggcgaacaccccgcggtgcgggagacggttgtcatcgtccgcgaggacatcccgggcgacaagcggctggtggcctacctcatcgcgaagccgggcgagccgcccgcggcggacgcgctgcgcgagtttctgcgcacgaggctgcccgagtacatggtgccgcagtccttcgtgacgctgagcaccttcccccagacgccgaacaagaaggtggaccgcaaggccctgccacctccggagcaggcgcaggcgcgcggtgagctggtccggccggaaggcgagacggaggcgctgattgccagcatctggcaggacgtgctcaagctcgacaaggtcggcgtggaggacaaattcgtcgacctgggcggccactcgctgctgatggtgcaggtgctggagaagctcaaggcccaggtggagaaacccctcacgctggtggacctgttccgctaccccaccatccgcaccctctccgggttcctgtcgggtgacagcggcgaggaagaagcgctcaaggaagtcgcggcgcgcggtgaggcccgggccgcggctcgccgggcgatgcagcagcgccgccgccggtag

SEQ ID NO: 3290 - DNA, 417 bp, Myxococcus xanthus
atgcgctggctgacggagacacatcctgccgcggcgcaggacatccacctcgtgggcttctccatgggaaccatgtcggcgctcgcggcggcccacgcgcttcgggcgcaggagacgcccgctcggagcctggtgctgttcgcgccgttccaggcgatgaaggtggggcgcatggggctcatcggcagcctcgtcgggcggcaccggtacgacaaccagccgctgctgcaacccaagcgactcccgcccgcgctcgtgctgcatggaggcgccgacagcgcgctgccccccgtccagggcgagcgcgtcagccgtgggcttcgcgctcccctcaagacgtaccccggtatcggtcacgccgagcttttgaagcatccccccgcgctcgccgacgcccggcagggcctgggcttgtga

SEQ ID NO: 3291 - DNA, 4296 bp, Myxococcus xanthus
tacgagcagaagcccgtgttccgccgcgcgctggatgagtgcctgtcgctgctcgaacagcaccagtcgttgaagctgcggcccctgctcttcccggaggccggcgccgagaaggaagcgcgcgcccagttggagcaggccacgtacgccctgccggcgctgctgtccgtggagctgtcgctcgccgcgctgtggaaggcgcgtggcctgacgccgcagtcctgcatgggccacagcatgggcgagtacgcctgcgcgcagctcaacggcgttttctccgtgaaggacgcgctgggcatcgtcgcctgccgtggccgcctcttcgaccagctccccgccggcgcgatgctcagcgtggagatgcccgaggcggagctgaagccgctgctgggcgagggcctggacctgggcgcgcacaacgcgccggggctgtgcctcgtctccggtgaagtggccgccatcgaagcgctggaggcccagctcaaggctcgcgaggtggaggcgcggcggctgcacatccgcgtggccgcgcactcgcgcatgctggagcccatcctcgcgcccttccgtgagttcctgggcacggtgcgcttcaccaagcccaccggcccgtggatctccaatgtcaccgggacatgggtgacgccggaggaggccacgtcgcccgactactgggtgcggcacctgcgtcagccggtgcgcttcgccgagggcgcgggcgtgctcctggcggacaaggcgcgtgtctacctggaggtcggccctggccagacgctgacgcagttgctgcgcgcccaggtagagaagccgcaggccgagcagttggtgccgtcactgcggcaccccaacgacaccgtggcggacctggcgttcttccagctcgcgctcggccgcctctgggccgcgggcgtggacctggacgccgccgcgctcttcgatggccagaagcggcgccgcgtggcgctgcccacgtatgccttcgagcgcgagcgccactgggtggagccaggcagtggcaccttcatggcgcggcgcgagggtgagcgcccgctggtgcgtgaagagaacgtgtcgcgctggggctacgtgccgcgcttccgcgagcaggccggcgcggcgccggaggcaccaacggagaacgagcgctggctcctcgtgggcgagcagcacctgttgcttagcgagctggctcgcgagctgtcggcgcgcggcgcccaggtgatgcgcgtgctgccgggcgatgcctttggccgcgcggacgaggggcacttcaccctgcggttcgacgcgcgcgaggactgggaagcgctctgggatgcgctgggcgccgaggggcgcgtgccacctcgcatcgtggacatcaccagccgggacaaggccccgctgggttgggaactcgcggtgtcgcggtacttcctcacgccgctggcgctgatgcagtccctgacctccgagtcgctgcctccgggcctgcgctacatgcgggtgacccaggaggccctgcccgccgaaggacacgccacgagcccggagcaggcgctcagcttcggtccgctgctcgtgggccccaaggagcttcccgagctcaaggcccgcgtggtggacctgcaactggtggtcaacgtgatgggccaggcgcgggagctcgcggacgagctgctgcgcccggacgtcgaggcgccggtggcgctgcgcggtggacgccggctggtgcaggtgatggagcggacggcgctggacgagggcccgacgccgctgcgtgagcagggcgtctacctcatcacgggcggcctgggcggcatcggccgcacgctcgccgagctcttcgctcgcaaggtgaaggcccggctcgcgctggtgtcgcggtcggcggccagcgcgtcgcacgcggagcttcagcgcacgttggaaggacttggcgcgcaggtgctgctgctcaaggcggacaccaccgacgccggccaactgcgcgcggccatcgcccaggtgcgggagcgcttcggcgccttgcatggcgtggtacacgcggcgggcacgctcgaggacgggccgctggaggcgaaaacgcgcgactcggccctgcgggtgctcgcgcccaaggcgatgggggcgctcgcgctggaagaagcgctgcaaggcgcggccctggacttcttcgtcagcttcgcgtcgacgagcgcgtggcttgggcccccggggcaggtggactacgtcgccgccaacgcgtacctgctggcgcaggcgacacggctggaggccacgggcatcgcgaagcgcgcactcgcgttgggctggggcgtctggcaggaggtcggcatggccgcggcgcagctcgcgccgcagttgccgcccggcgagtccgtcatccacccgctgctccagcggcgcgtggaggcccccgaagggcaccacgtcttccgcgccatctacgacgcgaaggcccactgggtgctggatgagcaccggatgcgcggcggaggccccgtcctccccggcacggcctatgtcgagctggcccgcgccgcctgggcgctggcgcgtcctggcgagccgctggagttgtcgcagctctcgctggtgtcaccgctggacgtcccggacggcgaggtacgggaggtggagatcgggctggcgccggagggcgacggcttcaccttccgcgtgcgcagccgcgcggccggaaacgcatggacggagcacgccaccgcgcggctccaccaggccacgggccagcgtcccacggcgctgaacgtgtccgcggcgaaggttcgctgtggtgagcggccgctgaccttcggcgagggtgagcagtccctgccgcaggacgcgctcatcgcgttcggtccacgctggaaggtgctgcgcagcgcgggcttcggcacgtccgaggccctgggccgtctggagctgcccgccgcctaccgcgaggacctgtcgacgtacgggattccgcccgggctgctggacatcgcctccggcttcgccttctccctgctccccgacgcgggacagccggggaagctgcacgtgcccgtctcctaccggcaactccaggtctggggcccctggccccaggtggcgctgagccacgtccgcgtgcgccaggaggaaggccgcggggcgctgctcgacgtcacgctcaccgacacggacgggaatgtcttctgcgccatcgagggctacctcgtcgcgtccgtcgaggcgcggcgtttcggccgctcgccgcagaagaagggctcactgctggagagctggctgcctttgggcatcaagccagcggaaggtcaggacgccttcctgcgcgcgctgtccctcgaggacacgcccgcgctcttcgtcagctccatggacctgcacaccctcgcggcccgcatgcgcccgaagcaggaggcgaagcccgcggcggcggcggcggccacggcccaggcaggcgcgccgtccggtgtggcggccgcggacgcaccgcgcgacgacgtggagcgcaagctggcggagctgtggcagcaactgctcggtgcgccgaaggtggggctcaaggacaacttcttcgagctgggcggacactcgctcatcgcggtgcgcctgttcgcgcgcatcaagaagacgctgggcgcggacctgacgctggccacgctgttcgaggctcccacgctggagcagtgcgccgcgctggtgcgtgaggccgccgggattcccttcacgccggacgcgggtccgggtgacgcggcgccggctgcgcaggccccgggcgtcaaggcggtgccgaagagctggtctccgctggtcaccatccagaagggcggcaataccctccccttcttctgcgtgcacggcgcgggcggcaacgtcctcaacttccgcgagctggcgcagacgctcggcaaggagcagcccttctacgggctccaggcgcgtggcgtggacggcaagctgcctccggccgacagcatcgaggagatggcgtccatctacctggagagcatccgtcaggtgcagccccacgggccctacctgctcggcggctactccggcggcggcgtggtcgcctacaaaatagcgcagcggctgcacgcgctgggcgagccggtggcgctggtcgcgttcctggacaccttccacccgtccacccaggagcgacgccagtccctccatgagcgcctgcgggagctgcgccgggagggcgcgggcagctacgtcagccggaagctgcgcaccaaggtggagcgcgacggcacccggctgttgagccagctcaagctgcgctggtacgagcagcggggagaagcgctgccatga

SEQ ID NO: 3292 - DNA, 801 bp, Myxococcus xanthus
gacgtgctcgttctcccgtcgctggcgattccgttcatggagcccgcgcggcagccaccggggctctcggactggattgccgggcaacaccggcgagggtgcctggtgctcgcgctcaccacagggagctggttgctcgcggagacaggtttgctcgatggccacacggcgaccacgcactgggcctgcctggagcgctgtcgccgccagtatccacgggtgaactggacgagcgaacaacggctcgcggtaacgggaagactcgtgaccgcgcgggacatgagcgcgtcagcgacggcgctctgtcacgcaatcggtcgcgtcctgagcgcgccgatcgccgagcgcacctatcagtactcgctcatctacgagcccggcgcggatgcgctgcccctgctgcacaccattccccttcgcgaccacggagacgcccaggtcctcatggtgcaggagtggatcgaaacgcactacggcgagcctgtcgctgcagagggagttgcgcggatggtgcacatgagcccgcgcaatctccggcgccgcttcctcgacgccacggggaagacccttgtcgactacctcacggaggttcggctggcgcgcgcccgagcgcttctactctccagcaacgaggccgtctcgcagatcgcataccgcgttgggtacgaggacgcctccacgttcaccgcgctcttcaagaagcggcacgggctgacaccgagcgcatatcggaagacgtcggcggggcccgctggcttgagccccgcatacgacggcgagcgtcgtactgcgattacgtag

SEQ ID NO: 3293 - DNA, 186 bp, Myxococcus xanthus
atgtcctgccggtcctgcgtcagccacatcaacaccgcgctgcggaaagtcgaaggcgtgcaggacgtcaacgtgcggttcgagcaacgccaggttctcgtgaaacacgacgccgcgaccgcgaacgtcaacatcctcatcgaggcgctccgcgacgccgggtacgaatccgcccccaccgcatga

SEQ ID NO: 3294 - DNA, 2247 bp, Myxococcus xanthus
atgaagaaggacctcgggcttccggagcagcccgccgtgccacgcgtggtcacggcggagccattggctcacgttgcagaagacggccgggctcatctgctgcgcgagcacttggaggccgtggggcagtgggccgcgatgctggcgccgcgagaggatttgcgtgcgccggccctggtcaccgggcgctggcatgacctgggcaagtacacccgggacttccagatacgcatccgcaaggagaacggcttcgaggctcacttggagaaagagggggcgctggagcgagaccactcgacggccggtgcgctctggtcgctgagccgggaccggcatctgatgccgctggcattcgcgatagccgggcaccactcaggcttgcccgacgcgtcgaacctccggaaccgcgtggggcgcacggagaagcaggcgttgctctccgatgcgcgggctcgttgtgacgcacccgctttgctggacggaccgttgggcttctctccggaggcgctcgacaagctcgaaccacggcaagtggagctctggacgcggatgctcttctccgtcctctgtgacgcggacttcctggacaccgaagccttcttcgatgcgaacaggagcgcggcccgcgaggtgccggtgtcgttgtcgcagctcgccgagcgtctccgcggcttcctgcgggagaagcagcgtagggccccggacacggaggtgaaccgggtgcgccgcgaggtgctcaccgccgccgtggaggccgcggtgcagcgccccggtgtcttcagcctcacggtacccacggggggagggaagacgctgacgtccatggccttcgcgctcgaacatgcgcggacgcaggggcttcagcgcgtcatcgtcgccatcccctacacctccatcatcgagcagagcgcggaggcgtaccgccaggccttccaggggctggagcacgccgtcatcgagcaccactccgctgtcgacccggaccgggagacgccgctcaaccgcgtggccagtgagaactgggacgcgcccatcatcgttaccaccacggtgcagcttctggagagcctcttcgcccgccgcccgtcggcgtgccgcaagctgcaccgcgtggcccggagcgtcatcgtgctcgacgaggcacagacgctgcccgcctcgctcctggagcccatcctggatggcttgggcgcgttggtgagggactacggctgctccgtggtcatctgtaccgccacgcagccggcgctgggacgccgcccggacttccaggagggcctgccggaggtgcgtgaaatcgtcccggcctcggtgcgcgccttcgagcggctacgccgtgtgcgcgtgcgctggccctcgtcagggcggaagctcccctatgccgagctggccgacgccgtggcggccgagcgggacgtgctcgcggtggtccacttgcgggccgacgcgcggcggctctgcgaactcgtggatgaacggctggggcatgaagagacgctgcacctgtccgcgttgatgtgcccggagcatcgctcccaggtgctcgcggacatcaaggcccgaaaacgaagaagggagcctgtgcggttggtggccacccaactcgtcgaggcgggcgtggacctggacttcggcgtcgtctaccgaggactgggaggcctggacgcgctggctcaggccgctggccggtgcaaccgggaggggctgatggagggcctgggcgagctgcgcgtctatgagcctgagacgcagccacccaggggcgttcctcgcgccgcccaggacgtcacacgcggcctgctggagcagtcaccggacctggacttgttcgcgcccgagagcttccagcgctacttcgccaggctctacgccacgcgccaccgggatgagaagggtattcaggcgctgcgcgcgaagttccagttcgaagaggtgtccaaggcgttcaagctcgtcgaggacgactggagcgcttcggtggtggtgccctacgtgggccatgcgccgctggtgaatgcgctgcgtgagcgaggcccttcgcgagagcggctgcgcgcgctgcaacgcttcacggtgacggtgccccgcaagctccgggacgactggctggcgcgcgagctggcgcggctcgctgccgagacggtggcgtacctggggccggagcacacgtccgcgtaccacaagcgcttcggcctgcttccggaccacgtcggcatcttcgacccgtccttcctcattcccgcttga

SEQ ID NO: 3295 - DNA, 456 bp, Myxococcus xanthus
atgtcttcccccctcacggtgaaggtgcgccgcgtgcgcacccatgcggagcctctgccacttccccgctacgaaacggcacaggccgcgggcctggacctgcgcgcggacatcgacggggaacgggtgctggggcccctggaccggctggcggtgcccaccgggctcgcgctcgcgctacccgctgggtacgaagggcaggtgcgcccgcgctcgggcctggcgctccggcatggcgtcacgctcctcaactcgccggggacggtggacgcggactaccggggggaggtgcaggtcatcctcatcaacctctcccatgagcccttcaccctgcgccggggcgaccgcgtggcccaactggtggtggccgccgtgccgccggtctccctcctggaggtggagtttctggaggaaacctcccggggtggaaatggcttcgggtccacggggcgctag

SEQ ID NO: 3296 - DNA, 474 bp, Myxococcus xanthus
atgaagaagagcctgatgggactccttgctgcactccccctgattgccgcggcccccgcggtcgcgtgtgacgagcacgccaagcacggcgagcacgccagccacggcgagcacgccaagcacggcgatcattccgcgctcggaggcacggccaagaaggccgctgcgcccgcacagaagcccgcctcggccccggccaccaggaatggcgtccagaccgtggacctcacggtgacccccaagggcttcgagccctcggacgtgaaggtgaaggcggggcagcccgtccgcctcgtggtcacgcgcaagacggccaagacgtgcgccacggaaatcgtcatggccgacctgggcatcaacaagccgctccccatggacacgccggtgaccgtggagttcacccccagcaagtcgggcacgctgcgctacgcctgcgcgatggaccacatcagcgggctcgtcaccatccagtag

SEQ ID NO: 3297 - DNA, 1395 bp, Myxococcus xanthus
atgctcgcggcactcggcctcggccaggaggatgatgccgccatggcgacgctccggcagccgcgcgtggcaccgccctaccctgaagacaccccgtccacgggccgcgtgcgcgagttcgagctcgtcgcggccccgacagccctcccgctcctggatggccggagtctggaggtctgggcctacaacggccaggtacccggccccacccttcgcgccacccatggcgacacggtccgcgtgcgattcaccaacaagctgccgcagccgacgaccattcactggcacggcatccgtcttccgaacggaatggacggcgtgcccggggtgacccagcctcccatcccacctgggggaaccttcctctatgagttcaaagtgaaggacgcaggaacctactggtttcacccgcacctgcgcgggagcgagcaagtcgagcgagggctgttcggcgtgctcatcgtggaggaccagaagcccggtcctttctcacgcgagctcgtctgggtgctcgacgactggcgactcgacgcgagtggccagattgacggccgattcaacacgcgccacgacctcgcgcacgacggccgctgggggcaggtctccacggtgaacggggctgtccagccagaagtcccgctgcagcccggcgagcgggtgcgactgcggatggtcaacgttgcaaacgggcgcgtgttcgcgccttccttcgaagggctgggcgcatctgtcatcgcgatcgacgggctggccacggaccggccgcagccggcctcccgcttggagctcgctccagggaaccgcgtcgacctggacttcaccgttcccgaggcgctgagcaaccagcgcatggaggtgatggaccacttcacccgcaggccgttccctctcgcaacgctggtggtgtctggagaggtcgtgcggccacccgaagtggcagcagttgccccgcccccgagtcctgacctctctccagcgcgtgcactgcaacccgcggagacctttcggctgaatgcgaggcgaggaggccccttcggcatcgagtggaccatcaatgacgaggcgttccaccacgagggggagcatgcctccgcgcaccacaaggtctaccggctccctgcccaccaatgggccacgctgcgtttcgtcaacgagtcctcccgcctgcaccccatgcacgtgcatggccagttcttccgggtggtggcacgcaatggtgcatcggtggacgagggacactggcgcgacaccgtgctgattcgtccaagagagacggtggatgtggcgatgttcccgcaggacgtgggggcctggatgctccactgccacatccaagagcacgccgaggctgggatgatgacgctcgtggacgtccatgcggagggttcccagtaa

SEQ ID NO: 3298 - DNA, 1104 bp, Myxococcus xanthus
atgcgccgcaccacgacggagctggaccggcttttccgcgaggcgctcgtgccagccgtgctgcgcgaggaccacgccaccgcggcccgtgaacacgccagggccctggaactggtcgacgtcatccaggagagcgcggacaccctggcctcgcactacgagcgcgccattggcaacttcgaggagcacgcgagcacggtccagcacgccagcttccagtggacggtcgccatcctggccgccgccgccctgctcgcggcgggcgtaggcctctacatcggccgctcggtggcccgcccggtttcactgctggaggccggcgcggcccgtatcgccgcgggcgacctcatgactcgcatcgcgctggaccgcccggatgagttcggaaggctggcgcagcagttcaaccggatgaccgccgcgctacgcgagcaccaggagcgcctggttcaaagcgagcggctggcgggcatcggccgcctcgcggcgggcgtggcgcatgaaatcaacaatcccctaggggtcatcctcggctacgtgcgcctgcttcagcgcaaggcggagggtgcgctcgcggacgacctgcgcatcatcgaagaggagacgctgcgctgccgtgacatcgtggaggggatgctcgacctgtcgcggcccctccaggtcccgggcgagacgctggagctgcgagagctggtggaggaagtcgtctcccggcagcgggagtccgcccagcactccgcggcatccctgacggtggaaggcgaagcccaggtggcagggcatccgcagcggctgcggcaggtggtcacgaacctggtcaagaacgccatggaggccgcaggtccctctggacaggtgacagtggccatccaggcccacgaaggcgaggtggcgctttcattccgcgacagcgggcccggcctctctcccgaggcacagaagcggatgttcgagcccttcttcaccaccaaaccccatggcaccgggctggggttggcggtgtcgcaggccatcgcccaggcccatggtgggcgcatccagccgcgcaacctgcctggacgtggtgcggaattcaccctgcatctcccccggagtacgccgtga

SEQ ID NO: 3299 - DNA, 675 bp, Myxococcus xanthus
atggagctgcgccgcatggcgctccaggcggccgtggcggcggcggacctctccgcccggctgcgcgcagcgggcaacatcaccgagctggagcttgcgagtgaacaggccgccgccgagggagcccggctcgaactggcggagggggagctcgcgttggtggaggcccgggagcacctcaaccgcctcatgggcctgtgggggccacgtacgcaatggactctctccgagaagctcccgccgttgcctgaccaggaggtttcgctggcgcacctggagtcgctcgccatccgtcaccggctggacatcgacgctgcccgaaagcaggtcatgctgctctggaatgcgctggagctcgcgcggagtactcgcttcttcgggcgcgtggacgtgggcgttcacgagcaccgggacgcggacggccccaggctctttggcccgaccctgtctctggagttgcccatcttcgaccagcgccaggccctcatcgcccggctggaagctcagcaccgccagggtgagcggcggctgatggagctgtccgtcaacacccgctcggaagtgcgcgccgcccgcgcccggctgctggcgcttcgcctggtggccgaccgttaccggcgagtggtgttgccccttcgtgagaaggtcgtcgagcagtcgcagctccttagagaa

SEQ ID NO: 3300 - DNA, 390 bp, Myxococcus xanthus
atggctgaaaccaccgctggacgagagtatttcgagaaggacgccttcgcacgagagcttggcatcgaactcctggaggtcggtcccggaacgtcgcgcgtccgtcttcccacatcgtcgcgccgctcaaatgggctcggaacaacgcacggtgccgtgatcttcgctctggcggacgttgccttcgcggtggcctgcaactcccacgaccagagagccatcggcgtgcaagccaacatcgcgtacctcgcggctgccggcgatggggccatcgaggcgcgagccaccgagatatcgcgaggccgtaagctggccacctacgacgtgcgcatcgtcgatgccgaggaacggttggtcgccgccttccagggcaccgcctacctgcgctga

SEQ ID NO: 3301 - DNA, 2334 bp, Myxococcus xanthus
acgtgggaggagtccgagccggccttccccgtgcctcccgaggcgccgaagggggcgccgaacatcctgtacatcatcctcgacgacgtcggttacggggcgtgtgacacgttcggcggcctggtcgagacgccgaacatcacgcggctcgccggcaacggtctccggtacaccaacttccacacgacggccctctgctcaccgacgcgcgcgtgcctcttgacggggcgcaaccaccactcggttggcatggccaacatcaccgagctcgcaaccggcttccctggctacgacgcgcgccagaagccggacaaggccgccattggcgcgatgctccaccagcacggctacgcgtcgttcgcgctcggcaagtggcacaacacgccgtcggaggagtccggcccctcgggcccgttcgaccggtggcccgacgggccgctcttcgggttcgaccgcttctacggcttcatgggcggtgacaacaaccagtggtacccgaagctctacgcggggcgcgaggccatcgaccctccgcgcctgccgcaggagggctaccacctgtcggaggacctcgccgacaagacggtcgatttcatctcgaaccatgcgtcgttgacgcccgagaagccgtggctcgcctacctcgcgttcggcgcctgccacgctccgcaccacgtctggccagagtggattgagaagtaccgtggcaagttcgacatggggtgggaccgctaccgcgagcaggtgctggcgcggcagaagcagttgggcgtcattccggccaacgccgcactcgcgcccatgctcgaaggcgtgcccaggtgggatgatttgtcggacgaccagaagcggctcttcgcgcggatggccgaggtctacgccgccttcctgtcgcacgcggacgcgcagattgggcgcgtcgtcgagtacttggagcggtcgggccagctcgacaacacgttgctcttcgtgttcatcggcgacaacggctgctccggcgaaggcacgaactcgggcctcttcaacgagggcgcgctcggcacggagcgccccgagacggtcgagactctggaggggaacctccagcgcatcgacaggctcgggcagccgggctcctataaccacttcccggtggggtgggcactggcgatgaatgcaccgttcaagctctgcaagcagtacacgcacttcggcgggacgcggaatcccctcgtggtgcactggcccaagggcatccaggcccgaggtgaaatcaggacgcagttccaccacgtcatcgacatcgtccccaccatcctgaaggccgccaggattgaggcgcccgccgtcgtcaactccgtctcccaggcgccgatggaaggcgtgccgatgaattactcgttcgacgacgcggacgcgcccactcatcacccgacgcaatacttcgagatgctgggcaaccgcgccatcgtcaacgggaagtggaaggccgtcacctaccacggtcgcaagccgtgggagaaccatgcggcctggtccttcgacgaggatcactgggaggtctacgacctcgagaaagacccgaccgagtgtcatgacctcatggcgcagcgggatttgtcgaagcaagatgacccggccgtgaagcggatgattcatctggtcggcctgtggtgggccgaggccggccgctacaacgtgctcccgctcgatgaccggttccaggagcgcctgctggggagggccgagctggccaagaaacggacgcggttcacgttcgggctgggggcggtacggattcccgaggccgcggcgcccgacacgaaaaaccgctcgtgggccatgaccgccgagattgaaatccccgagcagggcgccgaaggtcccatcgtcgtgatgggcggagacaccgccgggtggtccctctacctgaaaggcggcgtccccacgttttgctacaacttcgccgctgtcgaatacacatacatccgtgcgcagcagaagatcggtccgggccgccacacgctccgcttcgagttcgaaatccagcccgagcatcgaaccgacacgggcaagcccgtcatttacggcgccggaggcatgggccgcctcgcggtggacggcaagtgggtcgccgagggcaggattccgcagacgatggcgttcatgtacagcctcgacgagacgttcgacgtcggctgcgacaagggagcgcccgtgaccgacgagtatgagccgctcgcggcctttacgggcaaggtcgtcgaagtcaccgtggacttgcacccggagacagcgttggagccagcacgccacacggatgctcaggtcacccaggcgatggcccggcagtga

SEQ ID NO: 3302 - DNA, 798 bp, Myxococcus xanthus
  unsure (1)..(798): unsure at all n locations
caccgggagttcttgcgcttcctcgagcgtcgggttgggagccgcgcggtggcggaagacatccttcaggatgcgttcgtccgtggcatgggcaaggcggagacgctccgcgaagatgagtcgctgacggcatggttctacagcgtgctgcgcaacgcggtcatcgaccattaccggcgtcgtggcacgacggagcgcgcgctggcttcgctggccagcgagctcgaggagggccatgcgccggaagcggaactggcgcaggctgtttgccagtgcgtgggccggctggccggcaccctcaagcccgagtatgccgaggcgctgcggcgtgtggaggtggagggcgtcagcgtcccggctttcgccctggaggcgggcatcacgtccaacaacgcggcggtgcgactgcaccgtgctcgcaaggcgctcaagaaacagttggaggtttcgtgcggtacgtgcgcctcgcacggctgtctggactgcacgtgcgcgacgcagggcgccgagaagaaggccgggggctgcgggagcgcgaaggcattgactctgaccgagtctccaaagcgacatgcccggctgttccagtcgaacggactcagccaagccggcaggagcccgagtccgtctgggcttcacgcgcaggttggctgtcattccctcggcgccggctcacacgaggggattggtgtggggaacgactggtggaacgcatgggcaagnaggnccgtccgcacacgggggcagttcatgcggtgggggcggattcgtacccggcgtcgcggagcgcctcgatga

SEQ ID NO: 3303 - DNA, 1092 bp, Myxococcus xanthus
atgcctgtgaagcacaccttcgcccctgggctggaggtggaagcgtggggctacaacggctcgacgccagggcccaccatcgaggcggtggagggagagcgccttcgcatctacgtcaccaaccggctgcctgagccgaccaccgtgcactggcacgggctcatcattcccaatggcatggatggcgtgtccgggctgaaccagcgccccatcgcccccggagaaacgttcgcctacgagttcacgctgaaccagccgggcacgtacatgtatcacccgcactacgacgagatgacccagatggcgctggggatgatgggcatgttcatcgtccatccgaagcgtccgcgcggcccgaaggtggtccgcgacttcgcgctgatgacgcacgagtggaaggtgcttccaggcatgcgccggccggaccccaacgcgatgagcgacttcaatgtcctcacgttcaactccaaggccttcccggccaccgagccgctcgtcatcggacgcagggagcgggtgcgcatccgcctggggaatctgtccgccatggaccaccaccccattcacctgcatggcctgtccttcgaaatgacggggacggatgggggcttcgtccccgagtccgcccgctacccggagacttcgatcctggtgccggtggggagcacccgggtcatcgagttcgtcgcggacgaaccgggtgactgggccatgcactgccacatgacccaccacgtgatgaaccagatgggacacgcgggtccggtgacgctgggcgctgacgcacgggccatcgaccggcgggtgcaggcgctggtgccggggtacatgacgatggggcaggatggcatgggcggcatggaagagatgggcatgccaatgccggccaacagcattcccatgaagggcggaaaggggcccttcggccccatcgacatgggcggcatgttcacgctcctcaaggtgcgcgagaacccggacaccgaggatgggagcggctggtacgtgcacccgaaggggacggtggcggaaaaggccgacccggtgcgcatggacgcggacggcatcaatccggacgtgcgctttggttga

SEQ ID NO: 3304 - DNA, 1305 bp, Myxococcus xanthus
atggccgggctcaccagcgaggccctccggggagaggacgcggacgcggcagtgcgggcgctgctggcccagccgctcaccgccgacacggccgtccgcatcgcgctgctgaacaaccgcgacctgcgcgccgcgatgcacgcgctgggcatcgccactggcaacctggtgcagatgagccttcctcccaatccagaggtggaactggagatgcgaaagcccacccgtggcgggcagccgctgcaaggggacatcgggctcgagtacgacctgtccgagctcatcctcctgccgcagcgtcgcggggtggcccaggccgagcgcgcggctgagcgcgcactcacggcgggcgaggtgctgcatgtggcctaccgcacgcgcctgggcttctacgaggtccaggcccggcaccagcaactggaactgcgcaaccgggcgctgcaggtcgcacaggcgggctacggcacggcggtggagctggagaaggcgggcaacgtccgcgcactggaggtggccaccgagcgctccgccgtggagtccgcgcgcctggccgtggccgaagccgagaacgccctgctggactcgcgcgaggccctcaatgtgttgctgggcctcttcggtccccgcacgcagtggacggtggattcgccgctggccgacccagtcaacgacctggattcgggggaggggctggaggcgcgcgccatcgaggcgagcctcgacctggccgagctgcgcggccgcatggaggccgccgaccggcgccacaggctcgcgcggacggaggggtttctgccccacctgtccggcggcttccacggcgagaaggacgaggaccggtgggagatgggggcgcacctcacggtggggctgccgctgttcgaccgcaagcagggcgtgcgcatggcggccctttcttcgcgtgagtccttgaaggcccgttacgaggccacggccaccgcaatccgcgcctcgctgcgccaggccagcggccgagtggagtccacggggcgacgagcgcggcacgtccgtgacgtgctcctgccggcccggcgccaggtgctcgacgagacggtgctccagtacaacgccatgcaggtgggcgtcttcgaggtgctgcgtgcccaggccgccgtgacggacacggccagcacctacgtggagacgctgctcgaccaccaccgcgcccgctcggcgctggagcaactcctggcgggccgtcaccaaggcttggagttgggctccatccgcgtttcgtcgatgagcgcgagctccggtccagccgccgcggcggacgcgcactga

SEQ ID NO: 3305 - DNA, 246 bp, Myxococcus xanthus
atggtggacggcggctaccgccccgaccgcatcgtggtgcgcgcgggcgtgccggtgaagctcaacgtcctgcgcacggaccgctccgcgtgctcggagcagatcgtgctcggcgacctcggcgtctcgcgcacgctgcccaccgggcgcgtggtgaccattgacctgcccgcgctcacgcccggcgcgtacgacttcacctgcggcatgagcatgctgcgcggccgcctcatcgcagaggtttga

SEQ ID NO: 3306 - DNA, 411 bp, Myxococcus xanthus
tggcccgttcatgagagcgcgcgtgtaacgagtcccttcggcgatcgcttccacccggtgctggggcgccggaagatgcacaccggtgtggacctgggcgtgccggtggggacgcccgtggtggcggtggcggatggcgtcgtccggcgtgccagcgaggacgccgtgaatggccgcgtgctcgtggtggaccacgggcggggcgtcacgacggcgtactgtcacaactcggagctgctggtgaaggtgggacagcgcgtgcgccggggagaacgggtggcgcattcgggcaacacgggacgctccaccggtccccacctgcactaccagttggagctggcggcgcggcccatggacccgctgaagttccgcaccgcccttcggcccgtggcgaaggaccctgcgccctga

SEQ ID NO: 3307 - DNA, 2229 bp, Myxococcus xanthus
gacctcgccgtgtcgggtatgacgtgcgccgcatgcgcgcgccgcgtggaacgcactctgagcgaggtggagggggtccaggagtgcagcgtcaacttcgccacccgccgtgccagcgtactcttcgatgctcgggctacgtccgtcagtgcactggccgatgcggtggccgacgccggctatcgcgctgaggtgccgcaggcttccaccgccgaagagacggacgccgcggaggagcgagggctccggcgccggctcgccgtggccgtgctcttcggcttgccggtggtcgtgctggccatgtcccacggagcgctcgacttcaccggttccatctgggtgcagctcggcctgacggtgccagtcatggcgtacagcggtggtcccatcttccgggcggcgtgggccgcgttgcggcacaggtcggccgacatgaacgtcctggtggcgctcgggaccggcgcggctttcattttctcggtggtggccaccgtgtggccgacattcatggtcaccggggaccacggaggtcatggtgggcacggagccgcaccccccatctacttcgaggcggcggccgcggtgattgccttcgtactgctcggccgcttcctggagtcgcgagcacgcacccgggcaggggatgccatccggcggcttcaggcgttggccccttccatcgccaccgtgctggagaatggcgtcgagcgagaggttcctctcgccgaggtgcgggtgggggaccgtgtggtggtgcgtccggggcagtccatccccgtcgatggctccgtcgtggacggggcctcctcggtggacgaatccatgctcacgggggaaagcctgccggtggagaaggccgcgggcgcggaggtcttcgccgggacgatgaacggcacgggccgcctggtcttccgcgcggccaaggtggggagtgacaccgcgctccagcagattgtccaggtggtggagcgggcccagggcaccaaggcgcccatcgcgcgcctcgcggacgtggtgagcggcgtcttcactccggtggtgctgctcatcgccatcgccacgttcgcggcctggttcgtcttggcccccgaggagacgcgcctgacgatggccctgctcaacgcggtggccgtgctggtcatcgcttgcccgtgcgccctgggcctggccacgcctgcggcgctcatggtggggatggggcggggtgcgcagctcggagtgctggtgaagagcgccgcttcgttggaaggcgcgagccgtatcgacaccgtggtgctcgacaagacgggcacgctgacccaggggcgcccggcggtggtccgcgtcctcaccgcgagcggcatgacggaggaggaagtgctgaccctcgccgccgccgccgaatcggcgagcgagcacccgctggcccgtgccgtcgtgtccgaggcctccaaccggggcctgaaggtcggaacgcccgagtcgttcaccgccactccgggacatggcgtggaagccgaggttggcgggcgcaaggtgctcgtgggcagtcgtcggatgctggacggacggggcgtgtccgggagcgaggacgccgagcgtgtgctcacgacggacgggcagacgcccgtgctcatcgcggtggacgggcgctgggtaggcgccatcggcatcgcggatccagagcgggaggaggccgccacggtggtccaatccctgcggagcatggggctgcacgtggtgatgctcacgggcgaccatgatggaccggccgcacgggtggcgcgcgcgctcggcatcgaccgggtcttcgccggtgtactgccgtccggcaaggcgcacgtggtgcgtacgctccagacggagggacggcgcgtggccatggtgggggatggcatcaacgacgcaccggccctggcggaggcggacctcgcagttgccatgggcacggggacggacgtggcccgggatgccgcgggcgtcgcgctgcttcgctccgatttgcgaggactgccggccgcactcggggtggctcgccccacgattcgggtcatccgacagaacctgttgtgggccttcctctacaacgtgcttggcatcccggtaacggcggggttgctatacggcctgacaggctggctgttgtcaccaatgctggcgagcgtgcccatgtccctgtcgagtgtgtcggtcctgctcaacagcgtgtgtctacggcgcctgcgcctgccagcgccccaggcggcgtga

SEQ ID NO: 3308 - DNA, 537 bp, Myxococcus xanthus
gagttcctggtgaacaacgcgggcttcggttcgtgcggtcccttcctggcgcaggacctggcgcgggaggcggagatggtggaggtcaactgcaccgccctcctgaagctgtcgcacctgttcgcgcggcccatgcaggagcggggcagcgggcgcatcctcaacgtcgcctccaccgcggcctttcagcccggccccttcatggccacgtacttcgcgactaaggccttcgtggtgtccctgtcggaggcgctggcgcacgaactgaagggcacgggcgtgacggtgacgtgccactgtccgggtgccacgcacacggagttcacccagcgcgcgggcaacggccagacgcggctgttccagcagccgggcgtggccaaggcggaggacgtggccgcccatgcctacgcgatgatgatgcgcggccgggtgctctccatccacggactgctcaactgggtggggaccctgggcgtgcgcttcagcccgcgcgtggcggtgcgcgcgctcgcggccagcctcaaccagcagggctga

SEQ ID NO: 3309 - DNA, 786 bp, Myxococcus xanthus
atgaccgcgaccgtggaccacgaggcactggcacatttcctggactcggccaggctggagcgtcgcgaggtggcgcccctcacccgcgagcaacccgcgttgagcgtgccggatgcctacgccatccaggaggccggaatccggctgcgcctgtcccacggcgagcgcgtggtgggcttgaagatgggcctcacctccgaggccaagcgcaagcagatgaacctggactcgcccgtgtatggcgtactcacggaccggatgcaggtgcccgctggcggcgtgattcaactgtcacagggcgtccaccccaaaatcgagccggagattgccttccgcaccgcgcgtgagcttcgcggcacggtgacgcgcgacgaggtgctggacgcctgcgagtccgtgttcgcggcgatggaaatcctcgactcgcgctaccgcgacttcaagtacttctccctgccggacgtggtggcggacaacgcgtcgtcctcgctgttcgtgctgggcaccgccgagcatcctccgcgcgcgatggacctcacgcggctggagatgaccctgtcggtgaatggcgagcccgttcaatccgcccgcgcggatgccatctctggcgaccctgtcgtctccgtcatccagttgtgtgagctgttggcccagcgcggccaggtgttgccggcggggagcatcgtgctcgcgggcgccgccaccgcggcgcacatgctgcgcccgggggaccgggtgcaactcacggtggaaggactgggcatcgtggcggtgtccgccgagtaa

SEQ ID NO: 3310 - DNA, 588 bp, Myxococcus xanthus
atgcgcgagcccatcatcgaccagcgggagcacggcgcggtggcccaggcgctgctcggctggccattgccggaacagacagaagacatcgtctccatggcatggctggtggagcggctgcgctccagcagggtcgactggggactgctggacaaactggtgcgcttcgagccctcgggctacacgcggcagacgattgcccggacgacagcgtgcgagctgctgctcgtctcctggctccccgggcaggcgtcccgcgtccatgaccatggcggctccggaggggcctcctggctggtgcggggcatgctgcgagagacgcgcttcgcgtgggcgggggaccggctggtgcccgaggtcatcgtgggcgcgaacgagggcgacctcctggtggagtttccggacaccatccaccgcatcgacaatgcgtcccgccacggggcggtgtccctgcacctctacgcgccgccgatgcaggggatgacgccgtacgacgcgagcctggcgccggagtcgctcaggccaccgcgtccgcttgctgcgaagcgcgaggcgcctgggcgaaggcgccggccacgggcaacgtga

SEQ ID NO: 3311 - DNA, 1545 bp, Myxococcus xanthus
atggacatcaccgcgcgcaagctggccgaacaggagctgcaccgccaatcgctcatcttcgagagcatctacgacggcgtggtgattaccgacctgggtggcggcatcatcgactggaactccagcgccgagcgcatgttcgggcgacagaagtcggaagcgctggggcagacgctcttcagcgtgctgcacccggatgagcccgaccggctcaccggcctggttctcaccgcgctggacaagcaggggcgctggtccggagagctggagttcaagcgccacgacggcaccacctgttggtgcgagtccgtcgtcgtgccgctgcgcgacagcgaggggcgcgccatcgccaacatcatggtccaccgcgacacgacggagcggaagcagctccaggcgcacctggtggtggcggaccggctggcgtcggtgggcacgctgggcgcgggcgtggcgcacgaaatcaacaacccgctggcctacatgctcgtcaacctgcatctcatccgcgaagggctggagcgactggagagccaggcgcccgcggcgcccgtggcgtcgttgcagcagttggtgcgtgagacagcggaaggcgcggagcgcatcgccaccatcgtccgcgacctgaaggtcttcgcgcgcggtgagcaggagacgcggctgatgccggtggacgtgcgccgggcggtggagctggcgtgcaagatggcggacaacgtcatccgccaccgggcgcggctggtgacggagttcgagccggtggcgccggtggaggccagcgagtcgcggctgtgccaggtgttcctcaacctgctgctcaacgcggcgcaggcgattccggaggagggcacgccgggcgtggagcacgagattcgcgtggtcatccgcgccggagagaaggaccgggtggtggtggaggtccgcgacacgggcatgggcatgggccaagaggtgctgggccgcatcttcgacccgttcttcaccaccaagccggtgggcgtgggcacggggctggggctgtccatctgccacggcatcatcgaatccatgggcggctccatccaggcggagagcgagccgggccggggcagcaccttccgcgtggtgctgtgcgccgccacgcgtgagctggaggtgttaccgcgcctgtccgccaccatgcaggccaacgtgcgcgcgcgcatcctggtggtggatgacgagcccaacgtgacgctggcgctccagcgctcgctggccgcggaccacgaggtgtccaccgcgaacagcgcccaggccgcgctgcggctggtgagcgacggcggccgtttcgacctcatcctctgtgatgtgatgatgcccgggatgacgggcatggacctgtaccacgagctgggccgctgcgccccggagcaagctggacgcatggtgttcatgacgggcggcgccttcacgccgcgcacggtgtccttcctgcgtgacgtgcccaacgccaagattgccaagccgctggacctgatgcagttgcgcgagctcgtgggccgctccgccgaggcggggcgatga

SEQ ID NO: 3312 - DNA, 1779 bp, Myxococcus xanthus
atgagccacccggtgagtggcctctctggaacggacccctcggaggtcgcgcccgcgccctccctggccctggtgacggagcgccccgcgccgctggagttgacgacacgcgcgctgggcatgggtctgctcattggtgggctgctggccatcaccaatgtgtacatggggttgaagacgggctggtgggagagcggctccgtcaccgccgcggtgctgggcttcagcgccctggcctcggtgtcccgcaggcgtggcgcgccctatacgccgttggagaacaacctcacgcagacggcggcggcggccgtgggggccatgccggcggcggcgggcctcttgggcgcgttgccagcgctggcgctgctgggcacctccgtcccgggctggggtgtggcggtgtggagcgtggcgctgggggtgttgggcgtgctcgccgcgcacctgttgcggcggcggctggtagcccaggaggccctgccgtttcccaccggcatcgccaccgcggagctgattaccgcgatgcacgcgtccacgggcgacacggtccgcgcgggccgtggacggctgctggcgggcgcgggcgtggcggcggtggcggtgaccgccgcgcgggatgcgttcaaatggctgcctgggatgacggcgctgcccggcacgctggcgggccttcccgccgcgtcgctgacgtggggcgtggggtggagccccatgctgctggccattggcatgatgacggggccgcgcctgggcctgagcatgctggcgggcgcggcggtggcgtggggcctgctggcgccggggctcgcgggcatgggtgcgctggcggacacgcgctacgagacgctctccgcctggctcacgtggccgggcgtggggctgatggtgggctcggccctggcggcgctgttggcgcaggcgcgcgacttcctgagcgcggcgcgtgacgtgagcagcctggggcggggcgcggcggtgccgtcctgggcgctgggcgcgggcctggcggcgtgcgtgctggcggtggtggtgggctcggcgctgttcggcctcggcgtgccgtacatgctgctggcgctggtactggtgctgcccctgtgcgcggtgtgcgcgcgcggcgcgggacaggtggacgtgtcccctgtgacgcagatggggcaggtgacgcaggtcatcttcggcgcgctgctgccgggggccatggcgcccaacgtcgccgcgggcgccgtggtgtcaggcgcggccgcgcagacgggcgtcagcatgtggtcgctcaaggcggggcacctgctgggggcctccgcgcgccaccagctcgccgcgcagctcgtgggcgtgctggcgggctcggtggtgggcgtgccggtgtacctgctgctgtccaggacgtacggcctgggctcggaggcgctgcccgcgcccttcgcccatcagttccgcgcggtggcggaggtggcggtgcgagggctggacgggctgccgcctcacgcggccctggcggcctgcgtggccgtgggcgtgggcgcgctgctcacctgggtgtcccgtggccgggcggcgcggtggctgccgctgccggtggcgctgggcatcggcttcatcctgccggcctactacgcggtgacgctgtgcctgggcgcgctgggactggcggcggcgcgttggcgctggccccaggcggcggaccggaacacgtccacgctggcggcgggcgccatcgcgggcgagtcgctggcgggcgtgctcatcgccgcgttgatggccttcggcctcacgtag

SEQ ID NO: 3313 - DNA, 609 bp, Myxococcus xanthus
atgcgataccccagcatcatcgcggccctgcttttcaccgccaccaccgcgagcgcccaggaatacgacgagcacgcccacgacggcttctacctgcgcctgcaggtgggcggtggctatctccgagccaaggcgactgacgtctcgcccgatctcgtggtgaagggcggcggcgccaacatcaacgcggagctcggcttcgcgctcgtcaacaacttcatcctctacgcgaagttctacggtgcgtccgcccccaacccgagcctccaggtgggggacctcaccgtcgaagggcagaacgagaacttgagcgagaacttcggcgccgtgggcttgggcgtcacctattacatcatgcccgcgaacgtgtatctgtccggtgcgctcacgtacacgcagctcagcgtcaccgacgacggtgagaaggtggccgagtcggacatcggcggcggactgcacctgggcgtgggcaaggagtggtgggtgagcaagaactggggcctcggcatcggtgccgagctggccctgggccgcatccggaacgagtcgaacagcgatagctggaacgtcaccaacgtgtcgctcgtcttctccgcgacgtacaactga

SEQ ID NO: 3314 - DNA, 1515 bp, Myxococcus xanthus
gtgcgagcactagggtggtgggatgtggccatcgtggggggaggcgccagcggcacgctgctggccgtgcagctcctgaggagcgcgcgtgcgccgctccacgtggccttggtggagcggagcgggcgggcgggcctgggactggcgtattcgacgacgagcccatgtcacctgctgaacgtgccagcggcgcggatgggggccctcgcggacgacccggagcacttcctgcgctgggtgcgccgtgagttgccggacacggcgcccggcgcgttcgtctcccgccagcgctatggccgctacctggagtcggtgctgcgcgaggcgcgcgcccacgccgcgcagggcgtgcatctggaagtggtgaccagcgacgtcgcctcggtcgaggagacggacgacggcgcggtgcgcgtcgcgctggccagcgggggacagttggaggcccggaccgtggtgctggccctgggcaacgcgctgccctccaacctgcgcgtgcccgacggcgggctatacgccagccgccggtatcaccgctccccttgggctcaagacgcgctccggggcgtgtccgccaccgacgacgtgctgctcatcggcacggggctcaccatggtggacaccgtattgtcgctgatggagatgggacaccgggggcacatccatgcgctgtcccggcacggcctgttgccccacgtgcaccaggagataccccgggcaggcgccacgacgtatgcctcgcccggcatccgggaggcgctgcgggccctgcgccaggaggtgcggcgcgagcgcggcgacatgagcgtgacgggcacgcactccgttcccgtgcgcatccgccccatcctccacctcttgcgccgggaggtgcggcgcgcggcggaggcgggcgcggactggcggacggtggtggacgcgctgcggcccgtgacgataccgctgtggcagcggttgccggtgggcgagcgacagcgcttcctccggcacctgcgctcgtactgggacgtgcaccggcaccggatggcgccctgcatcggcgagacggtggagcggctgcggcgcgagggccggctgacgctccatgcggcgcgcgtccggagcttcgcgctggaggcgtccggcgtggaagtccgcgtacgccctcggggccagggcgaggaggagacgctgcacgtccagcacgtcatcaactgcacggggccagagggcgccatgacgcgcggccatccggtgctgggtgggctggtggaggccgggctggtgcgcccggacgtcctgggcatgggactggccacggacgctgacggcgcgctgctgggcgcgggtggacgtgcctctggacgcctctacaccctgggcccgccgcgccggggcgagttgtgggagacgacggccgtccccgagattcgaggccaggcgcgggagctggcgtggcacctgctccagcgcctgtcatccacgcgcgcgcctcgacccgtaatggaagcggcgggcgctccgctcgacgggtag

SEQ ID NO: 3315 - DNA, 1002 bp, Myxococcus xanthus
atgacgctgcgagcgagggtgatgctgatgtcggcggtggcacagcggcgcggaacactgcggcgcgccttcgacacgctccagggccccaccgtgaatggcgtgcggcttcgcgcgccgcggtcctccacacgggaggcggcgctgctggaggagacggtccgcgaacggaccgcggcgctggaggcggccaacgtcaagctgtcccgcagcctggagcagctgcgcgccacccaggcgcagctgctgttcgcggatcgactgattgcgctgggccgcatcgccgcgggcgtgggacacgaaatcaacaacccgctggccttcatcctcagcaacctggagtacatccaccaggagctgcagcagaaggagcacctgtccgagcaggaccggcaggaggtgctggaggcgctggcggagacgcgcgacggagcagagcgcatccgcctcatcgtccgggacctgcagacgctgtcacgcgcggaggacgtgggcacgggcccgtcggacctgggctcggtggtgcgcacggcggcgaagatggccatgcacgagctgcggcaccgcgcgcggctggtggtggagtgtgagggcctgccgccggtccagggcaatggcgcgcggctgggtcaggtgttcctcaacctgctgctcaacgcggcgcagtccatcgtccccggcgaggtggagaagaacgaggtccacatcgtcgcctgcgagtcgaaggccggacgggtggcggtggaggtgcgcgacaccggctgcggcatttccccggagcatcgcgagcgcatcttcgaccccttcttcaccaccaagcccctgggcgtgggcacgggcctggggctggcggtatgccatggcatcgtgacgtcgctgggcggcaccctgacggtggagagcgccccggtgcggggcagcatcttccgcgtcacgttgcccgtggccggcgccttcgcccaggcgcctcgcgcttcgcagcaagcggacgcggtggcctga

SEQ ID NO: 3316 - DNA, 702 bp, Myxococcus xanthus
atgcgctacatcatccggtgcgcggtgaaggagaatcagcagcgcaagtacaccaacccggtgacgggggtgaagtacacctgggagggaggcctgggcctcgcactcaactgggccacgggcgcaccggcgacagcccaggaagaagaaatcgtctcagcctgcctggcggcccatgcgaacaagttcgggcttcccgtcgccatctccgtgctgggccgcaacgcgcggggcggtgccctgccgtacacggagcaggagctgtcgacgttcagcgagcgggaggcgtgcttcttcggcaacctcttcgacggcaccggcgtcttcgcggccacggaccgcggctacctgcgcgaggacgaaagcaccgtgcgcgcctgcggcctgccctcgaaccccgcccactcggactgcctgcccatcatccacgcgggcacctgcgagtcgctctgccaacgcgccgccacggcggccctccccttcgaccgggacgcggacaggaagaacccacccccctacggcgagccgccctattacgaaacctgcacgtataacggacggaccttccagccgctcacgacgcgtctgcagccacgcgacatccaccgctgtggagacggcgtctgtcagctcacggaacgttgcggcgacggcgtcgaggcgggaagctgccaggcggactgcggcacgtgcccctactga

SEQ ID NO: 3317 - DNA, 345 bp, Myxococcus xanthus
atgcggtggctgcggcctctggcgacggcggccgtggtgctggcgggcgcgtgcgcggtggccaggctcatccagggctcggtgtacctctcctggcgtgagctcttcggggatggtgccgcggacgtggcggcgcgggcactggccgtggcctcgctggtgggcgtcctggtttcgctcgggtggcgcgcggtgctgcgcaacctgcaacacgcggacgcggtgtgtgaggaagccgggggcagagcggccttgcggcgcggactgctgggctgcgcggtcgtggtgccgctggccgtggcggcggtggtggatgcgacgcccgtgctgtccttcttccggtag

SEQ ID NO: 3318 - DNA, 8563 bp, Myxococcus xanthus
tctaaaccggagcggggcctttcacccaacggcctcgtggacgtgtccgccgtcaccgtgcagcgccgccccaccggcgcgccgcgctacctgggcgccatcctgtcccgcgaggaccgctatcccagcgggcccgaggcccatggcctcctgctgtctcccgccgccgccgaggccgtgcccgaggtgccctgcatggaggtgccggagctgcggggcctgttgcgccccgcgccgccgggcgtcgcgcctcgtccggacatcaccgtcctccagctcggcagcgaggtgctggtgggccgcgaggcggagctggccgagctgctggagagcgcacgctccgcggtgggcggcgccacgcccaccatcgtcaccgtcttgagcgagcgaggcctgggcaagagccacctggccgccaccctcgcccgccgcctccgcctgctgctgccccacgcgcgggtgtacagctcgcgctcccgggagccggtgcagggcgaccccgacggcaccctgcgcacgctgctgcggtgcgcactcaacgccttcgagcgcgacgacacggacaccgagcagcagacacgcgccgccatcctccagcgcctgggccccacgctgggcaccgagctgtggcccggcgtggccgccacgctgggttggtacacgcccgggggtccggagctccagagctgggccgccgcgcccggtgcgcttcgctcgctggccatgcgcgccgccggtgagctgctggccgccaatgcccgcgagcgtccgctgtgcctcgtcctggacgacgggcacttcgcggaggagacggcgctggacgcgctggagtacgcctgcctcgccgaggccagtgtcccgctgtgggtgtgcgtgctggcgcgcccgggcttcgagaagagccgtcccacctggggcactcgcgccgcgaagcaggccacgttggccctgccggtgctggcggccgaccaggcgcagtcgctgtgccgcctgctgctcaagccggtggagaacgtgcccgcgcaagcggtggagcgcatcgtcgagcgcgcgcaatacgtccccctctacctggtggagctggtgcgcggcctcaagcgccagggcctggtgcgccagcgcgcgccgggagggagctggtacctcgtcacagacgggctggagaaggtgcccgagctgcggctggtggagtggctggcggaccgcgagctgggcgcgctgccgccatcgctggccgcgcacgcgcgcctgtgcgcgatgctgggcacggacttcaccgcggccacggccgaaggcgtggtgcgcgagctggagcgcgaaggcgccgcgggcggcttccccctggacgcgggccacgccaccaagcggctcctggactccggcctgctggtgtcccaccgccacgatgggttgagcttccgcaacgagctgctgcgcgaggcggtggcctccaccctgcccgccgccgagcgcgagcacgtccaccacgccgcctaccgctacttcctcagcgcggccggcgccggtgagcgccagcgcctgcctcgcctggccctgcacgcggccgccgccgggcgccgcgacgaggccgccgcgctctccatcgacctggccgagtccgcccggggccgccacgcgttcctcgacgccgaggccatgtacacacgggcgctggagctgctggagcccaccgacgagctgcgctgcctcaccgcgctgcgcggccggggcctgatgcgcatccgcattggccggtatgacgactcgctggcggacttcgccgcggcccgcgagcgcgcccgccggctgggccacacgcgcacggaggtggagctgttgctggacgaggccatggcgctggactgggtgaacgactacacgcgcagcgaggcccgcgcgctggaggcccagcacctggcggccaccgtggcctcgccctacgtacaggcgcggctgctgctggcgctgggacgcgcccagttccgcaagggtgagtggcaggaggcgcgcatgcccctggaggccgccgccgagcgcgcgcgccgcctgggcgacgcgggctatgagacgcaggtggtggcgcagctgctgctggccgtcatccttcccaacctgggcgacatcgacgagacggagcacgtgctcaccgaagtcatcaccgcctgcaccgagcgcggtgaccacttccacctgggcagcgccatcaacaaccggcgcaacttgtgggtggcgcgcaaggagctgtcgcgggcgctgaaggaccaggagcgcttcatgcacctgggacgcgagctgggcatggtgggatgggagtacttcgccgagcacaacctcggtgagctgcactaccaggccggcgacgccgacgccgcggcgccccacatcgctcgcgccatcgcgttggagcgacggcacccagaggtggcgtcacgcccgtgggccctgctgctccaggcgcgggccctggcctggatgggccggcacacccgtgcccgcgaggtgctagcccaggtgcggcacgtgatggcggaaggcccgccgggcgtggagctgagcccgtcggaggaggtactcttctccatggtggagctggccacccgcgacgccgcccccgaggcgtggtggtccctgcgcgagcgctccgcgcaggtgtccgtggagcaggagccgctggaggtcctggagatgatggggctggcggcgctgcgccggggcgaccgggaagaagccgcgcgcgtgctgcgcgaggctctggagcgcgcgcggcacgtgcccaacctcatggagggccgcatccgccgctccctggagaaggtgcacgagtcttcgtcgactacgtgaggccgaaggccatcaacgcggcgatgagcacgcccgccagcgactcgcccgcgatggcgcccgccgccagcgtggacgtgttccggtccgccgcctggggccagcgccaacgcgccgccgccagtcccagcgcgcccaggcacagcgtcaccgcgtagtaggccggcaggatgaagccgatgcccagcgccaccggcagcggcagccaccgcgccgcccggccacgggacacccaggtgagcagcgcgcccacgcccacggccacgcaggccgccagggccgcgtgaggcggcagcccgtccagccctcgcaccgccacctccgccaccgcgcggaactgatgggcgaagggcgcgggcagcgcctccgagcccaggccgtacgtcctggacagcagcaggtacaccggcacgcccaccaccgagcccgccagcacgcccacgagctgcgcggcgagctggtggcgcgcggaggcccccagcaggtgccccgccttgagcgaccacatgctgacgcccgtctgcgcggccgcgcctgacaccacggcgcccgcggcgacgttgggcgccatggcccccggcagcagcgcgccgaagatgacctgcgtcacctgccccatctgcgtcacaggggacacgtccacctgtcccgcgccgcgcgcgcacaccgcgcacaggggcagcaccagtaccagcgccagcagcatgtacggcacgccgaggccgaacagcgccgagcccaccaccaccgccagcacgcacgccgccaggcccgcgcccagcgcccaggacggcaccgccgcgccccgccccaggctgctcacgtcacgcgccgcgctcaggaagtcgcgcgcctgcgccaacagcgccgccagggccgagcccaccatcagccccacgcccggccacgtgagccaggcggagagcgtctcgtagcgcgtgtccgccagcgcacccatgcccgcgagccccggcgccagcaggccccacgccaccgccgcgcccgccagcatgctcaggcccaggcgcggccccgtcatcatgccaatggccagcagcatggggctccaccccacgccccacgtcagcgacgcggcgggaaggcccgccagcgtgccgggcagcgccgtcatcccaggcagccatttgaacgcatcccgcgcggcggtcaccgccaccgccgccacgcccgcgcccgccagcagccgtccacggcccgcgcggaccgtgtcgcccgtggacgcgtgcatcgcggtaatcagctccgcggtggcgatgccggtgggaaacggcagggcctcctgggctaccagccgccgccgcaacaggtgcgcggcgagcacgcccaacacccccagcgccacgctccacaccgccacaccccagcccgggacggaggtgcccagcagcgccagcgctggcaacgcgcccaagaggcccgccgccgccggcatggcccccacggccgccgccgccgtctgcgtgaggttgttctccaacggcgtatagggcgcgccacgcctgcgggacaccgaggccagggcgctgaagcccagcaccgcggcggtgacggagccgctctcccaccagcccgtcttcaaccccatgtacacattggtgatggccagcagcccaccaatgagcagacccatgcccagcgcgcgtgtcgtcaactccagcggcgcggggcgctccgtcaccagggccagggagggcgcgggcgcgacctccgaggggtccgttccagagaggccactcaccgggtggctcatcgccccgcctcggcggagcggcccacgagctcgcgcaactgcatcaggtccagcggcttggcaatcttggcgttgggcacgtcacgcaggaaggacaccgtgcgcggcgtgaaggcgccgcccgtcatgaacaccatgcgtccagcttgctccggggcgcagcggcccagctcgtggtacaggtccatgcccgtcatcccgggcatcatcacatcacagaggatgaggtcgaaacggccgccgtcgctcaccagccgcagcgcggcctgggcgctgttcgcggtggacacctcgtggtccgcggccagcgagcgctggagcgccagcgtcacgttgggctcgtcatccaccaccaggatgcgcgcgcgcacgttggcctgcatggtggcggacaggcgcggtaacacctccagctcacgcgtggcggcgcacagcaccacgcggaaggtgctgccccggcccggctcgctctccgcctggatggagccgcccatggattcgatgatgccgtggcagatggacagccccagccccgtgcccacgcccaccggcttggtggtgaagaacgggtcgaagatgcggcccagcacctcttggcccatgcccatgcccgtgtcgcggacctccaccaccacccggtccttctctccggcgcggatgaccacgcgaatctcgtgctccacgcccggcgtgccctcctccggaatcgcctgcgccgcgttgagcagcaggttgaggaacacctggcacagccgcgactcgctggcctccaccggcgccaccggctcgaactccgtcaccagccgcgcccggtggcggatgacgttgtccgccatcttgcacgccagctccaccgcccggcgcacgtccaccggcatcagccgcgtctcctgctcaccgcgcgcgaagaccttcaggtcgcggacgatggtggcgatgcgctccgcgccttccgctgtctcacgcaccaactgctgcaacgacgccacgggcgccgcgggcgcctggctctccagtcgctccagcccttcgcggatgagatgcaggttgacgagcatgtaggccagcgggttgttgatttcgtgcgccacgcccgcgcccagcgtgcccaccgacgccagccggtccgccaccaccaggtgcgcctggagctgcttccgctccgtcgtgtcgcggtggaccatgatgttggcgatggcgcgcccctcgctgtcgcgcagcggcacgacgacggactcgcaccaacaggtggtgccgtcgtggcgcttgaactccagctctccggaccagcgcccctgcttgtccagcgcggtgagaaccaggccggtgagccggtcgggctcatccgggtgcagcacgctgaagagcgtctgccccagcgcttccgacttctgtcgcccgaacatgcgctcggcgctggagttccagtcgatgatgccgccacccaggtcggtaatcaccacgccgtcgtagatgctctcgaagatgagcgattggcggtgcagctcctgttcggccagcttgcgcgcggtgatgtccatcaccgtgcccgtcacccgcgctggcgcgcccgaggcgtcacacagcacgtcacccttgcaggaaatccaccgccagccgctcccctgcggctcgatgcggtactccacgtccacctgcgtcttcttctccagcgcggcgcccagcacctcgctcacgcgcggcaggtccgctgggtgcaccacctccgacagctccatggcgcggccggacaacttgcccacgggaagccccagcagccggtccacctgctcgctccacgtcacccggccgctctgcgcgttccagtcccagatgcccacgcgcgcggcggtcagcgcctggcgaagctgctcctcccgctgctccaggacttcgcgcttggagaagcggaacacggtgacggtgccgatctgcagccggtccccttccatcaactcggcggtgctgacgggcacgccgttgagcagcgttccgttggtggagtccaggtcggtgacgtggcaggcaccgtcgcccgcacgaacgacgcgcgcgtgcttgcgtgacaccccgtggtcgtcgatgcgcacggtgacgtcggaaccgcggccgatgatgtgctcgccctggtccaggcggtaggccttgccgatggctgccggcgtggtggtgctgatgaggatgaggcaggctcccgtggaggacggtggcgccaaggcaaggcccgcgcacgtcgtgagttcatccaacgtcgtcatgtagcagccccccgacgctcgcccgaagccccgcgctcccgccatccccgctctctccgtgcgaagtttcacgccccctgaatcccatcagtgccagggcccctccgtccaatcccccccgactccagggcagcagaccttccgccagcgaacaccccgcggacacgcccacgtcctccccgatgggtggccaacgcccacacgccgatgccgcggcgcggcgggaattcagcccggcgtctgagcagactcctgggggaaaggtgtaaggatgaggcaccccatggcggcggactccgagagcacctttcgcatccaggcccgagcggacctgcatgcatccgagcgggcacagagcgaaccttcccgtgcgcaacgaggcccgggcacgctggccggggagtacgtcctcaaggcgctgctcgcctcgggcgggcacggcagcgtgtacgaggcggagcaccgcatcctgggccggcgggccgcggtgaaggtcctccacccgcacctggcggaccagggggagatgctcaagcgcttcgtgcgcgaggcgcgcgtggtgaaccagattcgccaccccaacatcgtggacgtgtatgacttcgggctgatgccggacggcagcccctactacgtcatggagctgctcaccggccgcaccctcagtcaggtggtgcaggagcgcgggcggctgtcgtcgacgcgcgcgctcgcgtacctggagcccgtctgcggcgcgctggaggccgcgcaccgtgcgggcgtcgtccaccgcgacttgaaggccagcaacatcctcgtcgtggaggaaggtgagcgcccccgggtgaagctgctggacttcggcatcgccaagctgctgcacgccgagccttcgcaggaagggctcaccatcgccggccagcggctgggcaccgcgcacgccatggcgcccgagcagttccgcggcggccccattggcccgcacacggacatctacgcgctgggcgtgctgctgcatcaactcatcaccggccgctatcccttccagtgcgaggaccggatggagctggagcggctgcacctggaggcgcccgcgccccggcccagcgccatcgccgcggtgtccccggcggtggacgcggtggtgctgcgctgcctggagaaggacggcagccgccgcttcggcagcgtgacggccttcctcgccgcgctcagcgaagcggccgaggagcccgtccagcccacgcgccgcacgcggctggcgctggccgtccacgccgaggtcgtcctcgccgcctccgcccaggatgacgacgccgtgtacgcggtgctcgcggacgtgctggatgggctcgagcagggcctgcgcggcggcggcttcctgctggcgctccagtccggcacctccctgctggccgtacacccgctggaccacggcgcccccagcgccgagcgcaccgagtacctgcgcgaggcggagcgtacgctgcgggtgctccaggacatggcgcagaagctggcggacccggtgaacgcccgcgtccacctctgcgtccacctgggccaggcggagacgcgcggcgactcctcggagtcggaagtcgtgggaggccccgtcaccgacgtaggcacatggcgcctgcgcaccgcggatggcttcgcactcacgccagcagcgtcgctcgccctggagttcgacgggagcgactag

SEQ ID NO: 3319 - DNA, 2832 bp, Myxococcus xanthus
atgaagcgtcgtaccccgctctccctgatggcggccctgatgatggtggccggcactccagtgtgggcccagactcccgcccccgccaacaaggcccccgccacccagtccgttgtcacgaagagcaaggcgaagggccgcgtgctcgcccccgtgacgagcgtggaaggcatctccgagtaccgcctgcccaacgggctgaaggtgctcctttttcccgaccccaccaagcccacggtgacggtcaacgtgacgtacttcgtgggcagcaagcacgaaggctacggcgagacgggcatggcccatctgctggagcacctgatgttcaagggcacgcccaccacgcgcaacgtgccccaggcgctcaccgagcgcggcgcccggcccaacggcaccacctggctggaccgcaccaactactacgagacgctgccggcctccgacgccaacctccgctgggccctgtccttcgaagccgaccgcatggtcaacagcttcatcgcgaagaaggacctcgacagcgagatgaccgtcgtccgcaacgagttcgaatccggtgagaacgacccgcgcggcatcctcttcgagcgcgtgatgagcgccgcgtacatctggcacagctacggcaagtccaccatcggcgcgcgctccgacttggagaacgttcccatcgaccggctccaggccttctaccggaagtactaccggccggataacgccatgctggtggtggcgggccgcttcgacgaggccaaggccctgtcgatgattcaggacaccttcggcaagctgaagaagcccagcctgcccctgcccgccacgtacaccgcggagcccacgcaggacggcgagcgcgaggtgcaactgcgccgcgtgggcgacaccgcgctgctcaccagcctgtaccacgtgcccgaaggtgcgcaccccgacttcgcggccatcgacgtgctgacgctggtcatgggcaacaacccctccgggcgcctctacaagtcgatggtggagacgaagaagtcctcgcgcgtgagcgcgtcgaacctccagcttcgcgacccgggcatcatcgtcttcagcgcggagatgcgtgacgaccaaccggtggccgcggcccgcgaggcgctgctgaagacggtggaggacgcatcccgcacgccgttcaccgaggaagaggtcaaccgggccaaggccacgttgtccaagtacatcgacctcaccatcaacaactccgagcgtgtcgccatcaacctgtcggagtgggaggccactggtgactggcgcctgctcttcctgcaccgcgaccgcatcgaggccgtgacgcccgaggacgtgacgcgcgtggcggccgcctacctcaagtcctccaaccggacgctgggcactttcatcccgacgccgaagccggaccgcgcggagctgccggcgccagtggacgtggcgaagatgatggacggcttcaagggccgtgacgccgtggcgcagggcgaggcgttcgacccgtcaccggccaacatcgagtcgcgcgtgcagcgcggtgagctgccgggcggcgtgaagtacgcggtgctgccgaagaagacgcgcggcaacatggtgaacgtgtccctctccctgcgctggggcaccgaggaggcccttcgcggcaagtcggacgcggcgcagtacgccggacgcatgctgatgcgcggcacgaagaagcgcacgcggcagcaactccaggacgcgttcgacaagctgaaggcgcgcgtgggcgtggatggcagcagcaccggtgcctccgcctccattgagtgcccgcgggagagcctgccggaagtcctcaagctggtggccgaggtgctgcgcgagcccgccttcgacgagaaggagttcgccatgctgaagcaggagcggctggcgtcgctggagtccgagcgcagtgagccgcagacgctgggcaacatcgccttctggcgttcgctgtcgggccactatgcgaagggccacccctactacgtggccacgctggacgagcgcatcgccggggtgaaggacaccacgctggagcaggcgcgtgcctaccacaaggccttctacggcgcgtcgaacggcgagctggccgtggtgggtgacttcgagcccaaggacatcgtggcgctcgccggcaccctgctgggcgactggaagagccccgcgccgtaccagcgcgtgcagcaggtgttcggcggcggtgcgcccgcgtccgtcgcgctggagacgccggacaaggccaacgcgtactacatggcgggccagtcgctgaagcttcgcaaggacgacaaggattggccggcgctggtgctgggcaacttcgtgttgggcggcggtttcctcaactcgcggctggccacgcgcatccgtcagcaggacggcctctcctacggcgtggccagcagcctggacgcgagcgacgtcgacgaggtgggcaccttcttcacgtacgccatctacgccccggagaacgcggcccggctggagacggccatgcgtgaagaggtgactcgcgcggtgcagaagggctactcggcggaggagctgcagaaggcgcgcacgggcatcctggagtaccggcagtcggcgcgggcgcaggatggcagcctcgcgcggcagctcgccagctacctgttcctgggccgcacgctggccttcgatgcggcgctggagcagaagctgacccagctcaagccggaggacgtgcgcaaggccatggatcgtcacctggactggacgaaggtgacgcaggtgcgcgcgggtgacttcgccaccgcgcagaagaaggccgcgcccgccgcgaaggtcccggccgcgccgtga

SEQ ID NO: 3320 - DNA, 1848 bp, Myxococcus xanthus
atgggactccggtacgacgtcatcgtggtgggactgggccatgcgggcagtgaggcggcgctcgcctgcgcgcggatgggattggccacgttgggcctgacgctgaagcgcgagcgctcggcggtgttgagctgcaacccggcggtgggtggcacggccaagggccacctggtgcgtgagctggacgcgctcggcggggagatggggcgcgcggccgaccaggtgggcacgcacttcaagacgctgaatgcctccaaggggccggcggtgcaggcctcgcgcctgctctgcgaccgggatgcctacgcggtcggcatgcaggcggtgctcttctcgcagccgaacctcacggtgcgcgagggcgaagtcgccgcgctggtggctggcggaggccgggtggagggcgtggtgttgggggacggcacgcaggtgtccgcctccgcggtgctgctcaccacggggaccttcctccaggcgctgatgcacgtgggcgagcagaaggaagtcggcggccgtctgggggacgacgcggcgcgcgggctgtcggagtcgctgcgcgcgctgggcttcaccctgggccgcttcaagacgggcacgccggcgcggctggcgcgcgcgagcatcgactgggacgcgctggagccgcagccgggggacacccgcgtgcggcctttctcctggcgcaccaaggtggaaggggagggcgggatgccgtttccccgtcagccctcggtgacgtgcgcgctcacggagacgacgccgcgcacgcacgcggtgctgcgcgacaacctgcaccgctcgccgctgtaccagggggacatcgtcggccgggggccgcgctactgcccgtcactggaggacaaggtggtgcgcttcgcctcgcgcgagaggcaccaggtgttcctggagccggaggggcccacgtcgccgctggtgtacccggcgggcctgtccacgagcctgccggcggacgtgcagctcaccttcctgcacaccatccggggcctggagcaggtggaggtggtccgcttcggctacgcggtggagtacgactacgcgccgcccacacagctcaaggccacgctggagacgaaggccattgccggcctgtacttcgcggggcagctcaacggcacctcgggctacgaggaggccgccttccagggcctgtgggccggcatcaacgcggcgctccagttgaagggcgagccgccgctcctgccgggccgcgacgaggcccacggcgcggtgctggtggatgacctggtgaccaagggcgtggacgagccgttccgcatgttcaccagccgctccgagcatcggctgaagctgcgcgagggcaacgcggacctgcgactggcccgtcacgggcaccgggtggggctgctgccgcgcgaggccttggagcgggtcgaggcgcgaggccgcgcggtgacagaggaggtggctcggctgaagcgcaccgggctggcggcgcggctgcggcggccggaggtgacgtacgcgcagttgggcgaaggccgcgaggactggcccgtgctgtcacccgacgtcgccgaggaggtggaggtcgaggtgaagtacgagggctacgtggcccaggccgcgagggcagcggcgcgcgaggccgagtccacggaccggtggcggattccggagggctattgcttccatgaggtgcggggtctgagttcggaggcggtggagaagctgaccgcgcatcggcccgggacggtgggacaggctcgccggattccggggctgacgcccgccgcagtgtcgctgctgctggtggcgctcaagcgcggaacagaggcccccgcagtctgcgctcagcccgaggattga

SEQ ID NO: 3321 - DNA, 636 bp, Myxococcus xanthus
gaggatcagctcgcggcggggtgccgggcgctgggagtgacggtggcggcggacctggggccgcggctccagcggttgatgagcgagctgctcaagtggaacgcgaaggtgaacctcacggcgattacggcgccggaggaggtgctggaaaagcacttcctggattcgctcgcggtgttgccggaggtgacgggcgcggcgacgttgctggacctgggcgcgggcgcgggcttcccgggtctgccattgaagctcgcgctgcccgcgctgggcgtcacgctggtggacacggtgggcaagaaggtcgcgttcatcaaggccgcggcggcgagcctggggttgcagggtgtgcgcggtttgcacgcgcgtgcagaaggccagccggagacggaagggattccgcgcgccgaggtgctgattgcgcgcgccttcatggacctgccggattggctcgcgctggcgcccgcgtatgtggagccgggcggacgtgtggtggcgatgctcggcaagccgcagacggacgcggagctggcggcgcgcgcggcggagcggcaactgcgcgtcgtctccgcgcgggcgtaccggctgccgttctctggcgccgagcgccaggtggcggtgttcgccaaggagtag

SEQ ID NO: 3322 - DNA, 309 bp, Myxococcus xanthus
atggatgagacgggcaatcgctacgacgtcgcgcagtcgcccgagcgcgcgcacgtggcgtgcttcgcgcgcatcctcgaagaccgtgcgcacaagcagtcgtactacgtcgagtttcgcggcacgccagccgatgaggacgccgcgcggaaggactgggccgtcatccgtcaggacgagtacggcaatcgtgcggaggtggctcggcttcagtgtgagcagggtgctcgcgcattcgctgatgtctacgaggcggacccacggcacaagcagacgtacttcgtggagcccgtggctccgcgttcgtga

SEQ ID NO: 3323 - DNA, 459 bp, Myxococcus xanthus
atgacccggaaggacatcctcgaggcagtgaagagtttcgtcggagttctcgacgagcagaatcactttgaggaccgcgagggagtgctgcgtgcttccctggaccggctcgcgctggcctaccattttgccgacgccccgttcgaccctacgaagtatccggacgcgcctcgtgccgactacaggtccctgcgagagtgcatcgcgccactctttcccgccctcggcctgtacaacgaggcgttgcacatcgcggacaaggtgggtgagtccgagttcagcatcggcgacgccatcgacgacctcacggacatcgcgatggacatgcacagcgtcctcttccgctgggaaaacacgagcgaaggagatgcgctctggcacttccgctttggcttcgagacccattggggactgcacctgcgaagcttgcagctctacctccaccagcgtgcctgctga

SEQ ID NO: 3324 - DNA, 528 bp, Myxococcus xanthus
cgactcgttcgcgcccggccggagcacgtggacttctggctggacatgcgggcggcccctggcgcgcggcgcttcgtggacacggaggacgacacgcgggagctgctcctgcggcgcatcctggaagcgggcgcgttgggtgagccccgcgcgcggagcttccggtggttcgtggaggcggacgggcagctcgtggggacggtgtccgcgcgggatttgtcgcgcgtgcatggccgcatcgagctgggctacatgatggcggacgcgcaccacggccggggcctgggctcccgcgcggtggggttgatgctggagcagttgttcacgctgccctacctccagcgggtgtggctgacgacgctggcggagaacacgggctctcagggcgtggcgcgcaaggtgggcttcacgatggaaggcaccctgcgcgggcactgtctgttccaggggcaacgccgggaccagcaactctggggcctgctgcgcccggagtgggacgcccggcgcgcggcgttcgtcgcgggctga

SEQ ID NO: 3325 - DNA, 858 bp, Myxococcus xanthus
atgcatccctacgccgctgagctttcccaggagctgggcctcaggcccgagcaggtggaccggaccctcgcgctgcaagaggacggagccacagtccctttcatcgcgcgctaccgcaaggaagtcacgggcggcctggacgaggtccagattcaaaccctcttcgaccgggccaccgagcgcgccgagctggactcccggcgcgacaccatcctccgctccatcgaggagcaggggaagctgacgccggagctcgcgaaggcgctcaaggccgccagggcgcgcacggagctggaggacctctaccttccttacaagcccaagcgccgcacgcgcgccgccattgcccgggagcgcgggctggagccgctggcggacctggtgtggaagcaggacggtcgtcgcggcgaggacgtggccgcgcgcgtgcgcccctacgtcaacccggagaaggacgtaccggaccaggccgcggcgctcgcgggcgcgcgcgacatctgcgccgagcgcgtggccgaggacgccggcctgcgccgcgaggcccgcgaggtgagcgcgcgccggggcacgctgtgttcgaacgtggtgcccgcgaagaagggcgagacgaccaagttcgagaactactatggccacgaggagcccctgtcccaggccccctcgcaccgcgtgctggcactgctgcgcggcgaggaagagggcgtgctgaaggtgaagctctccctgcccgatgacgaggtgaagggcctgctggccgggcgcgtggtgacgaagccgcagtccatcttctcacaggagctgcgcgccgccgtggaggacagctgggaccggctgatggggccgtcgctggagccgtag

SEQ ID NO: 3326 - DNA, 183 bp, Myxococcus xanthus
atgaaacgattcttcatcggcgcgctggccttcgtgggcgcgctgtctgtcctcttcgtggtgggcctcgtgggcctgatgctgctcgcgtccgcgagcaagcccggggtgccctccaacctcgtgctcgagctggacctggaagacccgctgtcggagcacgggggaggggagtcgctgatg

SEQ ID NO: 3327 - DNA, 2169 bp, Myxococcus xanthus
atgttgaagaagagcgtcaagattggcgagagcgagctgagcatcgaagtgggccgtctggcgaagcaggccgacggttccgtggtggtccgctatggcgacaccatgctgctggtgacggcggtgagcgcccgggagaagaaggacatcgacttccttcccctgacggtggagtaccaggagaagctgtattcggccggccgcatccccggcagctacttcaagcgcgagggccgtctcacggagaaggagacgctggccagccgcctggtcgaccgctcctgccgcccgctgttcccggaaggctacgcgtacgagacgcagatcatcgccagcgtcatctcctccgacccggagaacgagggtgacatccacggcatcaccggcgcctccgcggcgctgtgggtgtcggacatcccgtttgacggccccattgccggcatccgcgtgggccgcgtcggcggtcagctggtggccaaccccaccgcgaagcagcgcgagcagagcgacctggacctggtcatggcggtgagccgtaaggccatcgtcatggtggaaggtggcgcggaggaggtctccgaggccgacatggtcgcggcgctcgacttcggcttcacgacggcgcagcccgcgctggacctgcaggacgagctgcggcgcgagctgaacaagcaggttcgctccttcgagaagcccgccgccgtggacgagggcctgcgcgccaaggtgcgtgagctggccatggacggcatcaaggcgggctacggcatcaaggagaagggcgcgcgttacgaggcgctcggcaagacgaagaaggaggcgctcgccaagctcaaggagcagctgggcgacggctacacccccctggtggagaagcacgccaaggcggtggtggaggacctgaagtacgagcacatgcgcgagatgacggtcaacggtggccgcatcggcgaccgtggccacgacgtggtccgttcgattacgtgcgaggtgggcgtgctcccgcgcacccacggcagcgccgtcttcacgcgcggcgagacgcaggcgctcgtggtcaccacgctgggtaccagcgatgacgagcagcgcctggagatgctgggcggcatggccttcaagcgcttcatgctgcactacaacttcccgccgttcagcgtgaacgagacgaagccgctgcgtggcccgggccgccgtgaagtcggccacggggcgctggcggagcgcgcgctgcgcaacatggtgccgaagagcgagtccttcccgtacacggtgcgcttggtgtcggacatcctggagtccaacggctcctcgtccatggcctccgtctgcggcggcacgctggcgctgatggacgcgggtgttccgctcaaggcccctgtggcgggtatcgccatgggtctggtgaaggagggcgacaagattgccatcctctccgacatcctcggtgacgaggaccacctgggcgacatggacttcaaggtgtgcggcacctcgaagggcatcacgtccatccagatggacatcaagatcaccggcctcacgacggaaatcatgagccgcgcgctggagcaggcgcgtcagggccgcctccacatcctgggtgagatgctcaagacgctggccgagtcccgcaaggagatcagccagtacgcgccgcgcatcaccaccatccagattcgtcccgagttcatcaagaacgtcatcgggccgggcggcaaggtcatcaaggacatcatcgcccgcacgggtgccgcgattaacatcgaggactcgggccgcgtggacatcgccagcgcgaacggcgaggccgtgaaggccgccatcgcgatgattcaggcgctgacccgcgaggcggagatcgggaagatctacacgggtacggtgcgcaagatcgccgagttcggcgccttcgtggagctgttcccgggcaccgacggcctcatccacatctccgagctgtccgacaagcgcgtcaagagcgtctccgacgtgctgaacgagggcgacgaggtgttggtgaaggtcgtcagcatcgacaagacgggcaagattcgcctgtcgcgcaaggaggccatggcggagcgcgccgcgcagcagggcgccgccgccggtgaggccgccgcgcagccggcgcccgcgcccacgcagcctgacgccaaggcctga

SEQ ID NO: 3328 - DNA, 333 bp, Myxococcus xanthus
atggacgcatggttcacgcccatcctccagaacgcgaagccacacacgcacgagtcggtgatgcgctggctgcatgccacgccgcgcgaggtggtggtcggggcgctggagagcatgctcacgttcaattcggaccgtgtgctggaacgctacaagggccctctccacacgctcgtcgtggatgccttcatccagcccaatgcctaccacctcctgtacccgggcacgccgcacaccgtgttctcaggtgtcagccattggctgatgatggatgcaccggagcgcttcaacgccgcgctggatgcattcctcgccacactgccgccgcgttga

SEQ ID NO: 3329 - DNA, 1191 bp, Myxococcus xanthus
gcgttcgcaccgctctccatcgacatgtatctgccggcactcccgcgcatcgcggaggacctgcaatccaccgcgcccgccatccagctcacgctcgcgtcgtgcttcgcgggattggcgctgggccagctcttcacgggcccgctcatcgaccgcttcgggcgcacgcgtccgctctacgcgggcctggcgctgtacgtcctgggctcgctcggctgcgcgctggcaccgtcggcgtccatgctggtggccatgcgcttcgtgcaggcgctcggtggctcggtggcattggtcgttccacgcgccgtggtgcgcgacttgtggtccggcgccaacgccgcgcggacgatgtcgcggctgatgctggtcatgggcgtggcgcccatcctcgcgccgctgctgggcggaatggtgctccagtactcgggatggcgggccatcttcgtggtgctggcggcggtgggcgcggtggcgctggccttcgtgctgaagtcgctgccggagacggcgccgccgcacgtgggggcgcagtcgatgcgctcccggatgggcgcattgatgaaggacccggacttcgtgggccccgcactggctggaggcttcgcgcaggcgggcatgttcgcgtacatcgcgggctcgccgttcgtgttcatctcgctgtatggcattccggaggagcacttcggctggttcttcggcgtcaatgcaatggggttgattgcggtggcgcagctcaaccgcaagctggtgacacacctgccgctgcaccggctgctgcgtctggcattgagcctgtgcgtcgtcgcggcggtggccgtgctggcggtggcgtggaccggcttcatgggcctgtggggcatcgccgtcacgctgttcttcttcgtgtcggccatgggcctggtgggacccaacgcggctgcgattgcgctggagcggcatgccacgcgcgcgggcatggcgtcggccgcgctgggcgcgctccagttcaccgcggcggccggcgcgtcgtgggccgtgagcacgttcaacaatggcaccgcgatgcccatggccggggtcatgaccgccatggcactgcttgcgtggctcgccgcgttcttcgggctccgggcgcgcacgcgccagcaggaggcaggggagggtgcccaagcgcacgggccgcgaatcgtgtcatcgtcctccgcgccatga

SEQ ID NO: 3330 - DNA, 1524 bp, Myxococcus xanthus
ccttgggccatggacgacgagcagcgggcgcacaggtcgctttggacggtgacggcccccccgcgggacttcccggcgctgccgggtgacgtgacggtggacgtggccatcattggcggggggatggcggggctgaccacggcgtggctcctgaagcgcgctggcaagcgcgtggtggtgctggacatgcaccgcatcctgtcggggcagacgggccagacgaccgcgcacctcaccgaggtgctcgacacgccctacgccacgctgcggcgcgacttcggtgagaagggggctcagctcgcggcgtcctccagccgcgcggccatcgagcagatcgccgcgcgggtcgacgagctcggcatcgactgtgacttccagcgcgtgcccatgtaccgctacgcggagacggagcgcgagctggccgagctgcaccacgaagtcaccgccgcgcgcgaggccggcttgctggccaccttcacccaggacgtgcccttgccgtatcccgtgaagggcgccctgcgggtggaggaccaggcgctcttccatcctcgcaagtacctgctggcgctggcggaccggattcccggcgacggcagccacatcttcgagaacacgcgggtgacggaggttcacgacggcgcgccctgccgcgtcgttaccgaccggggcaccgtcaccgccgcggccgtggtggaggccaccaccacgccgctcaaccgcgtggccatgcacaccaagctctacccctaccgcacctacgtggtggcagggccgctcaacgggccgctggagccgggccagtactgcgacagccaggagccctatcactacatccgcacgcagcaggtgaacgggcgcacctacgtcatcgtgggcggcgaggaccacaaggtcggcaccgacgaggacaccgcccggcgctacgccgcgctggaggcctacacgctgcggcgcttcccggtgacggacatcacccaccgctggtccggccaggtcatcgagcccgcggacgggctggcgtacatcggccgcaacacggccagccgccacgtgtacgtggccaccggcttctccggcacgggcatgacgttcggcacgctggcggggatgattctctccgacgccatcctcgacaggcagaaccccttcgcggcgctctactcggcgacgcgggtgaagccccaggcgggcgcgaaggacttcatccaggagaacgcggaggtcgccttccgcttcgtcgcggatcgcctgtcccggccgaacgagcaccggctggcggacgtggcgcccggcgagggcaaggtcctggaggtggcgggacagaaggtcgcggtgtaccgcgcggaggacggcatcacgcacgcggtgtccccggtgtgtacgcacctgggctgccacgtgcactggaacggcgcggagcgctcctgggactgtccctgtcacggggggcgcttcagtcccaccggcaaggtgctcaacggccccgccgtgaaggacctgccggcgaagaagctgccgacctga

SEQ ID NO: 3331 - DNA, 489 bp, Myxococcus xanthus
atggacgctatcgaactgttggcgcagcaacacgacgaggtgaagaagctgttcaagaagtacgagaagctctcggagggggcggaggcgaaacgccaggagctcttcgagatgattaccgaccgcttgagcgcgcacgcctccatcgaggagcaatacttctatcccgcggccaaggcgcaggacacggaggacctcttgcgcgaggccgccgaggaacacctgtccgccaagcgcctcatcgccgacctgctggacctggagccgtcggacgaggagttcgacgcgaagatgcaggtgctccaggagcagattgagcaccacgtcgaagaggaagagggcgagctgttcaagaaggtccgcaagctcctgtccaaggagcagctcgtggacctgggtgtccagatgcagcaggagttcgaggagctcatggagggcgagcctcgcacccaggtgccggccgagacggagcacgccgcgccgatttga

SEQ ID NO: 3332 - DNA, 675 bp, Myxococcus xanthus
atgccgcgtcctcctcccgacgtcattcgataccccagctactacacgccctcggtccgccgtgccctgtcgcgcgcggacccgacgctgggcgcgttgatgaagagcgttggccccttccggctccaggtgcgtccgctgcacagccccttcggtgcgctggcggagtccatcgtctaccagcagctccacggcaaggcggccgccaccatcttcggtcgcgtgtgcgagcgcgtgggctcgggacgcaagttcacgccggaagcgctgctggccgttccggacacgtcgctgcgcgaagcgggactgtccgccaacaagctggccgcgctccaggacctggcgcgcaagacgctggacggcaccgtgcctccgctggccaaggtgcggcgcatggatgacgccgagctcatcgagcacttcacccaggtgcgtggcattggccagtggacggtggagatgctgctcatgttccaactcgagcggcctgacgtgctgcccgtggacgactacggcgtgcgcaagggcttcatgaaggcctatggcctgacggagatgcccaagcccaaggcgctgcttgcttatggcgaacgctggcggccctggcgctcggtggccagttggtacatgtggcgctcggcggagctccccgacgcgccgaccgtggagggctga

SEQ ID NO: 3333 - DNA, 1425 bp, Myxococcus xanthus
caggagcagcaagcaggagtcgaagtcgtgaagcgtggtgagtccgcgccgtcgccgtcgttgcgcgtgctggatgtgatggccctgacagtgggcatcgtcctgggagcaggcatcttcaaggcgccctcgctggtggccgcgcagtccggcagcggtgaggccatgctgctcacgtggctgctgggcggtgtcgcgtcgctggtgggcgcgctgtgttacgcggagctggccagcgcctggccacacccgggcggggactaccactacctgtaccgcgcgctgggcaaggggcccgctttccttttcgcgtgggcgcggctgaccgtcatccccaccggctccatcgcactgctggccttcgtcttcggggactacgccacgcagctcttccccctgggcctgtattcgtcgcccgtctatgcggccatgctggtggtggggctgacggcggtgaacatcgccggacttcggcaggggacccgtacgcagaacctgctcacggccctggaggttctgggcgtgggggctgtcgtcatcgtggggttgcttttcacgcccgcgctggtgcccgcggcggcgccgccggcaccggccgcgtcgtcagggaccgcctggggcctggccatggtgttcgtgctgctgacgtacggcggctggaatgaggtggcgtacctgtcctcggaggtgcggggttcgcggcgcaccatcgcctggtcgctgttggcgagcatcgggctggtgacggcgctgtacctgctggtcaacgtggcctacctgcgcggcctggggctcgaaggcatggcgcgttcggaggcggtggccgcggacctgatgcagcgcgcggtgggcagcgggggcgcgctggtgttgagcgtcatcatcgccatctccgcgctgacgtccgccaacgccacggtgctgacgggggctcggacccactatgccttcgggcgggacagcgtgctgttcaatgggctggggcagtggcatgcgaagtccaatggcccgtcccgcgcgctgctggtgcagggggccatctccctggcgctggtggggctggggacgctgacgcgtcagggcttcgagacgatggtggagtacaccgcgcccgtcttctggctcttcttcctgctgacgggcgtgtcgctgatggtgctgcgcgtgcgtgagccggatgcgccgcggccgttccgcgtgccgctgtatccgctcacgccgctgctcttcatcggcatctgcgcctacgtcctctattccagcctggccttcaccgggctgggcgcgctcgcggggctggcagtgctgggcacgggcggcgtgctgctcgccgtggaggcggtgcgcacccgcaggggctcgcaggggacctcccccaaggccagttcctctcccagactgcaacgaacgaaggaggcgacatga

SEQ ID NO: 3334 - DNA, 567 bp, Myxococcus xanthus
atggccgcgaacgccgcgagcgtttcgacggcgcagcagacggtgacggtgcaggtccgcggacccgcgggcagttcgattcagtcgcccgaggttcccttcgtccccacgccggaaggtgccgtggacgggatgctggcattggctggcgtgaagcccggggacactgtctatgatttgggcagcggtgacggccgcatcgtcatctccgcggtccagaagcacggggcgaagcacgccgtgggcgtggacatcaacccggagcgcatcgccgaggccaaccagaacgcgagccaggcgggcgtgaagaacaaggtggagttccgccagggggacctcttcgacgcggacatccgtgacgcgtcggtggtgacgctctacctgttgccctccgtcaacgagcggctcaagtccaagctgctctcggagctgaagccaggcacgcgcatcgtgtcgcacagcttcgacatgggtgactgggcgccgaccaagacggtgcagagcgagggacggacgctctacctctgggtcgtccccgagcgcggcacgggcggcgcgccccgctga

SEQ ID NO: 3335 - DNA, 1491 bp, Myxococcus xanthus
ctcgactggctgacgcgggtggtgcgcttcgacctggccacggtgttcctcctgaaggagggccggctggtggcggtggccgcacgagggtcgttggccaacgcgaaggtgcggcagcactcgttgccgttgtcggagttcccctcgctgcggcaggccctggagacgcggcgggcgaaggccttcacggaagaggaccatgcccacggggatggagaccctttcgacggcgtgttggatttgccgccggggcattcgtgcatggtggtgccgctgtgcgcgggtgatcgctgctacggcgtgctctccctggaccgcgccgagtgtgagacgtacccccagccggtggtggacctggtggaggtgtacgggcagatgctggccacggccatccagtcggccgagcagcgcgccaccttcgagcgtctccaccgtcaggaccacgagcacgcgaagctgctggaggcgcagctcggcggagactcggagggcatcctcgagacgtcgaagagcccggtgatgcgagacctggcgcggcgggcgcggcaggtggcggagacggacacgccagtgctgattaccggtgagacgggcacgggcaaggagcggctggcccgcgccatccaccgttggagcgcccgcgcggaccagcccttcgtcacgctcaactgcgctgccattccggcgggcttgctggagagcgagctgtttggccacgtgaagggcgccttcaccggcgccacgaaggaccgggccggacgcttccagatggcgcatggcggcacgctgctgctggatgaagtgggcgagctgcccttcgacctccaggcgaagctgctgcgggcgctgcaggagaagacattcgagccggtgggcagcgacaagacggtgcgcgcggacgtgcgcatcctcgcggccacgcacgtggaccttcagcaagccattgcccagaagcgcttccgcgaggacctctactaccggttgagcgtgttccccctgcgcctgccgccgctgcgcgagcgccgggaggacctgccgcagttgtgcgccttcctcctggaggaacaggcgaaccggacgggacggcggggcatgcgggtgacgccagagggcctggtgcggttggaggcctacgagtggccgggcaacctgcgcgagctggccaatgcgctggagcgggccaccatcctcacgcgagggacggagctggggccggagtccttcgacgttcccacgcgcggcgcggccgtggtggcggccctgccggaggagccggcgcccgcggcgggagggccgaagcggggccccgtgctgacgctggcggccgtgcagcgcgagcacatcatgcgagtgctcacgctcacgcggggccgcgtctacggcgccaatggggccgcggcgctgctggggctcaagccgtccacgctccagagccggatgaagaagctgggcatcgcccggctggagcagttcgttgtcgacgaggcgtga

SEQ ID NO: 3336 - DNA, 222 bp, Myxococcus xanthus
atgcgcaacgtgacggacctgggccgcgccacccaggcgctgggtgagagctaccggcgcctgcgcgacacggagcgggaggcccgcagcgagcgtcaccggctggaccgcgtgctggactccgtgccggaccccctcatcctgtccgacccggcgggcggaatggtgatgatgaacagcccggcggagaagctattaggcacgcaaaccgacagtggttag

SEQ ID NO: 3337 - DNA, 1248 bp, Myxococcus xanthus
cggctcgccctgctgtgcatgctctacttcgtgcagggcctgcccttcggcttccaggccaccgccctgccggtgtacctgcgctcgcagggcgtctcgctgaccaccattggactgctcggcgcgctgtggttgccctgggccctcaaggcgctctgggcgcccctggtggaccggtatggctcgacgcgcatcggccggcgcaagtcgtggattctgccgatgcaggtggggctcgcggccagttgcgccgcggcggcggtcgcggcttcacgagacgcgctccccgccctgctggcgctcgtcttcctgatgaacctgttcgccgccacgcaggacatcgcggtggatggcttcgccgtggacaccctgcgccccagtgagctgggcctgggcaacaccgcgcaggtggtgggctacaagctgggaatgctgacgggcggcgggctgctggtgtgggccagcgcgcgcatcggctggtccggcctcttcgtcgccatggcgctgctgtgtctggccgtcttcatggtgatgctcttcgcccgggagtctccccccgaggcgcacgccacgccgtccgcggccaccgcccggcaggagccggattggcgcgagctgttccagcggctcaagaaggcgctcctgctgccgggcgcgggctggctgctgctcttcatcaccacgtacaagctgggcgagagcatgtccgacgtgctcttcaagccgttcctcgtcgacgcgggcttcaccgccgcgcagattggcctgtgggtgggaacgtggggcacgggcgcgtccattgtcggctcactagccggaggactgctggcctcgcgcatgccgctgctgggcgccgtggggctcaccgcgtcgctgcgggtgattcccctggtggggcggtggctgctggccaccggaggcgtcaccgacgcgggcgtcatcggcatcaccatggccgaggagctcttcggcggcgcactcaccacggtgatgttcgccttcatgatgtcgcgcgtggaccgccgcatcggcgccacgcactacacgctgctcgccagcatggaggtctggggcaaggcgcccgcgggcccgctcgcgggctggctcgcggacgcgaagcacggactcagcctgggctacgcgcccgtcttcctgctgggcaccgtcctgtccgtggccttcctggtgctgctggtgcccatgcggcgccagaagcacgccccgagcaccacgctcaacaccgcctga

SEQ ID NO: 3338 - DNA, 270 bp, Myxococcus xanthus
atgtcgctgcaccaggagcgtaagtcggagctggtgtcgaagttccggacccacgagtcggacacgggttcccccgaggtccaggtggcgctgctgtccgagcgcatcaccatgctcaccgagcacttcaagacgcacaagaaggaccaccactcccgccgcggtctgctgaagctggtcggtcagcgccgccgcctgctggactacctgaagtccaaggacgtcgcgcggtacaagaagctcatcgacggcctcggcatccgcaagtag

SEQ ID NO: 3339 - DNA, 1176 bp, Myxococcus xanthus
aacctgggccagggccagccggagacgggagacctccccggcgcgccgccccggctgaaccaggtcaccatcgacgtggccgacatggagtacgcccccgtcgccgggctctgggaggtgcgcgagtccatcgcaagcctctacaaccggctctaccgccggggcatgcccagccagtacagcgcggagaacgtgtgcctgtctggcggcggccgcgcggcgctcacccgcgccgcggccagcctgggcgccatcaacctgggccacttcctgccggactacacggcgtatgaggagctgttggacgtcttcaaggcgttcaccgccatccccatcctcctggagggtgagcgcggctacgccttcaccgcggaggacttgcggcgcgaggtgcagggccggggtctgtccgccctgctcttctccaacccctgcaaccccaccggcaagctcgtgcacggcgaggagatggcgcgctgggtgagcgtggcccgcgagcatgagtgcgcgctgctggtcgacgagttctattcgcactacatctggacgggccgccccggacacctgccggtggagagcgccgcccgctacgtggaggacgtgaacaaggacccggtggtcttgttcgacggcttcaccaagaactggcgctacccgggctggcgcatgacgtggaccgtggggccgcgccaggtcatcgatgcggtcgccagcgcggggagcttcctggatggcggagggagccggccgctccagcgcgcggcgattcagctcctccaggaggagcccgtggtggcggagacgatggccatccacaacaccttccgggagaagcgggaccgcttccactcccggctggagcgcatcggcatccgcacggaccgcgcgccggacggcaccttctatgtctggggcaacgtgtccgggctgccgccgccgctcaacgacggcatgggcttcttccgcgccgcgctggaccagaaaatcatcgccgttccgggcgagttcttcgacgtgaatcccggcaagcgccgcgcgcgaccctcccgcttccgcggctacgtgcgcctgtccttcggcccgtccatggagacgctggagaaggccctgtcgcggctggaggccatggtgctccactactcgcgcacgccgggtcagccgcctccggcgccctga

SEQ ID NO: 3340 - DNA, 270 bp, Myxococcus xanthus
atgcgagccggcatgcccgtgtttggtggcacgtcgctggtgctggacggtccaggcgagctgacgggccctcagggcaccgaccgcctcacgctgacggggctgcactacgaggtgggtgaatacctgccgaaggaaggtaccgcggtgctggagacggcggacgggcggcgcgtggaagcccgcttccagcccgtcctgtggcgcctgggcaaggccgaggtgacggtcgacgacctggagccggtgacggtgcccatcgtccgctga

SEQ ID NO: 3341 - DNA, 489 bp, Myxococcus xanthus
aaggaagacaccatgtaccgcagccccagcccccttcccgagaaggcccgcgccgccatcgctgaatcgctcaacgagcggctcgccgacgggctcgacctgcactcgcaaatcaaggtcgcgcactggaacatcaagggtccgcagttcgcctcgctccacccgctgttcgagacgttcgcggtgagcctggccacgcacaacgactccatcgccgagcgcgcggtgacgctcggtggcaaggcctacggcaccagccgccacgtgggcaagacgagccgcctgccggagtatccgcaggagacgacgcgtgacatggagcacgtgaagctcctggccgagcgcatcgaagtctacctggacggcctgcggaagagccgcgccctcttcgtcgagaacggggactcggactccgagggcctcaccacggacatcatcaccgagttcgagaagcacgcgtggttcctgcgcgcttcgctcgaaggctga

SEQ ID NO: 3342 - DNA, 531 bp, Myxococcus xanthus
tcgctcgaagtcgtccgctctgaactcgcggactcccacaaggacacccgcctcaacctccagggtgtcctggaaggtggcagcctcaccgcggagcagcgttggggtgtggccgtggcatgcgccttcgccgctcggaatgagcggctgaaggaggccatgctcaacgaggcgaagaaggccctcgcgaatcccgagcctgtcatcgaggacgcgcgtgcggcggcgtcgttgatggcgatgaacaatgtgtactaccgcttcaggcacatgatcgggaaggagtcctactcgaccaagcgtgccgggctgcggatgaaccggctcgcgcaggtgctgacgaacaaggtggacttcgagctggtctgcctcgccgtcagcgccatcaacggctgcgagatgtgcatgcagtcccacgagaaggtcgtcctcgacggcggcctctccgaggaccaggtgcacgacgcggttcgcatcgcgtcggtcatccacgcggcggcggtggggctggagtcttaagcccctctgtcg

SEQ ID NO: 3343 - DNA, 567 bp, Myxococcus xanthus
caaggagccgtaatgctgaccgttggcgacaagatcccgaacttcaaggtgaaggccaccgtgtccctggagaagggcaaggagttccaggacatcacgaacgagaccttcaagggcaagtggctggtcctgttcgcgtggccgaaggacttcaccttcatctgccccacggagatcgcggagttcggcaagaagaacaaggacttcactgaccgtgacgcgcaggtcctcggcctgagcaccgacagcgagttcgtgcaccacgcgtggcgcacgcaccacccggacctgaagaacctgcccttcccgatgctggcggacatcaagcacgagctgtgcaacgcgctgggcatcctccacaaggaagagggcgtggccctccgcgcgacgttcatcgcggaccccgagggcatcatccgccacgtgacggtcaacgacctgtccgtgggccgcaacgtctccgagacgattcgcacgctggacgcgctccagacggacgagctgtgcccctgcaactggaccaagggtgaggagaccctgacccagaagctgtcgaaggcggggtaa

SEQ ID NO: 3344 - DNA, 1245 bp, Myxococcus xanthus
atgtccggggtgtcccagttcgagtccccgcccgcccggcaacagcccgtggcgctgaacgcccccgcggccctggcgcgcggcccgagcgtcgcgccgggcagctatcccaccgccgcggacgtgcggaacatcgccgccatgcaggacccggtggcgcgcaaccatgcgattacccagggctattcggacctgtccaacgccatgggtcagttgctgggcacggagaacgccaactggtccaccttcgcgacctgggcctcgaagcaagccggcgtgagcatccgcggcgaggacatgcccaagttcttcacggacgcgctcaagggcgccgacggcgtcatggggccgatgtccaaggtggacgacctgctgcgcaagctgggcctcccttcgctgccgctgggcgacatcgcctcggcgggcaatcaggcgctccagaacgtcagcaaggccatcgccgacggcaacaagctggtgttcgaggaggtgggccaggagttcgcccgcttcgtggagaccttccagggcgacacccagtatgacgccgccaaggcggagcagtacctgagtggcttccccgcggacaagccgctgctgaaggaggccttcggccactacgcccaggccatgttcgagaaggacccgaacaagaaggccgagctgatgctcctggccaacgacaaggtgggcctgcacgagcagacgcaactccagccctacgtcgagaaggcgctcaactcgccggtgaaggacaccttccgcgacatcctcaagcagaccgtcgaggcgcaaatcaatgcgctccccttccccgccaacctcgcgggcaaggcggccttgaagacgggcctggtggacgcggcgctgaaccccgtggtggatggcgtggcgaacgtgttccgccgcgtcgccaccgagcacatgatgaagctggccgtgccgggcagcgcgctgaagctgggcaatgatttgccgccgcctccgggcatggagtcgacgctcttcccgccgcacctgcgctccatcgaaaaccccgagctgcgcgcgctgctgggccagctcgacaagagccaggacagcctcaagggctccggggcgaaggactggagcaagctggaccagcggatgaactacatcgtcgacctcttccgctcgcggcagtcggacccggcgctgttcgacccgccgttcggtcagcggggaacctacccggtggcgccctcggcaccgcgcgtctcctag

SEQ ID NO: 3345 - DNA, 894 bp, Myxococcus xanthus
atgacgggctggctggacatcacgggcgtgggtgcgcccgtcacggtgcaggacgcgggacggccggggaagatgcaccacggcgtgcctccgggaggaccgctggtcccggagctgctcgccctggccaatctcgccgtgggcaacgcgagtggaacggcggcgctggaagccttcggtcggttggagctgcgcgcccgaggccgaagcgttcgcgtgtccatgggcggacacgccttcgcgctggcggatggagagcgcctcaccgtccccgcgcccgagtcgacgagcgtgcgctatgtcgcggtggacggcgggctcgccgtgccggaagtgctgggaggacgcggcacactgctggtcgcgcgcctgggcggacacgaaggccgcctgctgcgttcgggagacagcctgcccctgggtgacacgaacgagcgcgccgaggcacgagcgcccggtgcgtcactggatgcagcggcgcccatccgcgtgacgctcggaccggacaaccgccgcttcggacccgcaaccgtggccaccctgctgtcgggcgccttcaccgtgtccgccgccaccgaccgtgtggggatgcggctccaagggccatcgctcacccatggcgacgaaggcacgggcacgtcgcgccccatggttcgtggggccatccaggtgacgctttcaggaacgcccatcgtgctgggccccgaccatccgacgacaggtggctatccactcatcgcgacagtcattcgcgccgattggggacggctgtgcgcccgccgtccaggagccgctgtccggttccaggaagtgagcctggaagaggcacgggaagcgtggcggcaccacgcggagcacttcggtgtcggtggaaggccgaccccgcccccctga

SEQ ID NO: 3346 - DNA, 228 bp, Myxococcus xanthus
gtcgtcacctggcgcgacgatgaaatcgtctacgagatggtgacggacatggacgaaagcgacatccgccggatgctcgccgagcgtgacagcggtgagaagctcgcgcgcaagtccgcgccggaggccgacgagccgctgtattcgctcccgcccgcgccgcgcacgccgcactcctggccgcccatctccgtcgagccagtgacgtacccgacgtaccctcagtga

SEQ ID NO: 3347 - DNA, 1689 bp, Myxococcus xanthus
atgtcgaagaaaatcctgatcgtcgaaagcgacaccgcgctctccgccaccctgcgctcggccctggagggccggggcttcacggtcgacgagacgaccgacggcaagggcagcgtggagcagatccgcagggaccggccagacctcgtggtgctcgcggtggacctctccgcgggacagaacggctacctcatctgcggcaagctgaagaaggacgatgacctcaagaacgtccccatcgtcatcatcggcaacccggacggcttcgcgcagcaccgcaagctgaaggcccacgccgacgagtacgtcgccaagccggtggacgcggatcaactggtggagcgcgcgggtgcgctgatcggctttcccgagctgcccgccaccgaggatgtcgtcgacgagagcctcacgctggacgcgctcggcgacgagccgatgacggcggacttcggcgaggagatctccgtggagaccgcggaggagccttccgttacgggcgaggagctggacctggacgccgccttcggcgacctgtccgcgcccgaggagacgccgtccttcgaggaagaagtcgtcgtcgcgccgcccgaagcggtggtggaaggcgtggaggaggacttctccacgctcgactcgctgggcaccgactcggtggatccgctcgaggggctggatgacgcctccgacgagaagacggtgatcggcttcattgctccggcccccgtcgccgcgcctccgcccgagccgccccgcgccgtcgcgccgcccccggtgccccgtccctccgcgccggcccgccctgccccgccgcccgtcgcggtggcgcccgcggccgacgccgcggagctgcgcagcctgcgcgcgaaggtggccgaactgcaggccgagctcgacgactcgcgtggcgcggcgtcccacgccgaggagcgcgtgcgtgacctggaggcgcagttggagagccaggccacggagctggagacggcccgggcgtcctcggggaagaacgacaaggacaccttcgccctccgcgacgcggccaacaagaaggacaaggagatcctccgcctcaagacggagctgaatcaaaaggaccaggaaatcatcgagctcaaggacgagagcctggagctggagcagaaggccagcaccgccgagtccgagctcgcccagcgcgacgcccagctcaagacgctgagcgcccgggcggagtcgctcgccacggaccgcaggcgcgtggaccagcagttggccgccgccaaggaagaggcccggggcgcgtccgcgcagctcaccgcgctgcagacggagctggaccagcaccaggcccaggcgcatgcctacgccgcggagctggaggagctgcgcgctcgcgcggggcagctggaggcggacgtccaggccgcgcagcatgaggccgaggacctgcgcgtccaggtgggccaggcccaggtggagctgtccgagcagagcagccgcgccagcgcggaggccgacgaactgcgcggccgcatcgccgagctggaggccgccacggcccgcaacgaggagcgcgtgacgcgcctctacgcgcgcatcaagagcgaggagaagctgcgcgagaagacgaagaaggcgctcgtcatcgcgcagcagctcctggacgagcccgcgtcctcggtggcggacgacgccagcgaagccgcggcctag

SEQ ID NO: 3348 - DNA, 1653 bp, Myxococcus xanthus
atgagccgtggcgccgcgcgaggaacggccggactgcttgcgcccctgctggcagcgggcgaggtctggctgtcgctgcccggcaagcccgaggcctggcgcgtccccagcccgccgttcctgacggcgctggagctgtcgcgactggcggtggagctggcgcgcgcggtggagctgggcgaaagccgcttcgaactggcccccgcgggcgcgaagccttcgctcctggtcgacctgaagacgggccaggcgaaggcgggacgcaccgggacgcccttcccgctcacgggcaccgtgctcgccgccgccctcttccacctgggcgagtccctggccgcggccttcgcggaagcggaccacgcgctggtggccaacccgtaccgaatggagctggcggagcgctgccgcgagggcctttcgcacctgcgaggccccgtgcagccccccgaggccaagggcgcggcccgcgagaagaaggcccgggccacgggccagggcacgtcacggccgttgaaggtccccggccgcttgcgccggctgcgcttcgcgaagctgtgggagaagcgcggtctgccggacgcggaggaatcgcggctgctgcttggccggcacggaccggtgtactgcgcgccgcacctggcctccgcgttctcccgaaaggacggagaactgctgtggaggcgcgccgcggcgctgggtgtggccgcgtcggcggatggccacgcggtggcggcggacatcgcgcgcgtctacggcttcacgggccggggcggtggcgcgcgctggctgcatgaccacgacggaatcccgctgggcccgctgctgctgcgcaaggacggcctgctgctcaccttgtccgaggaccgcaccgtcgtggccttcgcggaggccacgggccgcgaggtctggcgcctggcgccgccgcgcacccagcgcagctggctggccacccagggacaccgcgcgctggtgggcacggactcgggctacctctatgggctcgacctggaggatggacaggtgcgctaccgcatgcgcgcgcccatgccgttccacgggcccccggtggcctggggccggcgattcctggccatgctgggccgcggctcgcactgggccgtgctgctcgcggacgcgcacaccggcgaatccgtgtggacgtatgagccggacctgtcccacctgtccgcgccgttgcccgtgggctcacgggtgttcatcgccggagagcgcgagcgcgaaggcatgctgctctgcctggacacgaagggccggcgcctctgggagcgcccgctcaacctgggccctggcccctttgcgttggcgtccctcccccgcgcggtcgtggtgacgagcgcctcgggcgccgccacccgggtggccgcatccggcacggtggactggcgcgtgggcgccgcgggcgagccgctcatcagcgcgctccccgcccataccgcgcgcgacatcacgctggtgccgggggagcgcgtccgcgccgtggacccccgcggcgggcaggtgctcgcggaggtccaggccggcgtcgggctcgtcgcgctccaggccgacgtgcgcctcaacctctacttcctggacgacgccggcacgctgtccgcgtaccggctcggctctcacttcacggtggtggagtaa

SEQ ID NO: 3349 - DNA, 875 bp, Myxococcus xanthus
cgtgccatggacggcgtcctcgtcattgacaagcccaccggtcccacgtcgttcgacgtggtccgccaggtgcgttcgctgcttcgcctgaagaaggtgggccacacggggacgctggacccgctggccactggagtgctgccgctctgcctgggggaagccaccaaggtcgcgggcttcatcaccgagggcgacaaggcctacgacgccacggtgcgtctgggctcggagacggacaccctggacgcggaagggcaggtgacggcgcaggcgcccgtgcccgccctgacgcccgcgctgattgaatccgcgttggcgcgcttccggggcactttcgaccaggtcccacccatgtattcggccgtcaaggtgggcgggaagcggctctacgaactggctcgtgcgggcgaggaagtggagcgcgccgcccgtcaggtgacggtgtacgagttggtgctgcgggacttctccgccgagcgcctgcagctgtcggtgcgctgctccagggcttcttcgtgcgcaccctggcccaggaggtgggccgggcgctgggttgtggtgcccacctggaggcactgctgcacaccgccagtggccccttcaccctggcgcaggcgctgccgctggcggacgtgccggagctgctgaaggagggcgcgctggccagccggctgatgaccatgtcgcatgcgctggtggaactgccggaggtccgggtgggcgccgccgatgccaagcgcgtctcccacggtgtcccggtggaggtccccgccgggaaggtgggacgggtgcgcgtcatgggcccggacgacgcgctgctggcggtggccgaagtggccggtggccgcctgcgctatttgcgcgtcctggtgtaa

SEQ ID NO: 3350 - DNA, 162 bp, Myxococcus xanthus
atggccccggtgaaccgggtgcgtgacacctaccacctgctgagcgccgcgggcgtgagcgcccgtttcctcgagctgccggggcccggggaccacgcagcactgctccaggacgcggagcggctccatgccccgctgagcgacttcctgcggcggtgctga

SEQ ID NO: 3351 - DNA, 669 bp, Myxococcus xanthus
atgaactccgccttcctgcgcgcgcccgtcgaaacggaacaagcgctggcggcctcggcggcctccgcggcgcgctacttctccgccggcaaacatggctggagcttcgtcatctgcgacgactggctggcgccctccgtgcgcgacaacgcgccatccatcctcgcctggtacgggctcaagtccgagatggacgtcaccggcatggtggcggaccggctggcgccctccattcacccacggcatccgttcgccgtgcgtcccgtcacggatacctggggccggcaggccgtggccgacatcaacgccaacgtctacgacgtcccccgccacttcggccgtgaagccttcgacgaggacacgctctacaccccggactgccagggcttcgtggcgtgccgcgacgaagaggccgcggccagcacggtggtgctgcgcgtggatgccgccgcctacgtcgccctggtcgcgacccagccgcaacaccgccggcaaggtgccgccgaggccgtgatgcgacacgcgctggccaaggcccatcaggactggggcaccgagcgcaccgtcctccacgccacgagcgcaggcgagcccgtctacacccgcatgggctaccggccggtgacgcgcttccgcatgtacatggcgccaccacctggccagggctga

SEQ ID NO: 3352 - DNA, 561 bp, Myxococcus xanthus
atgggcaccgagcgcgacaaggcgcggctgtcgttcatcgccctgcacttgggcctctgctggctgctgctgggcacggagcgggatgcgcgggagtggatgcagctggcccaccgcacggccgtggaggccatgaaggacatcctggtggaagcctcgaagcaccagggcctcacccagaaccggtacctggatccagcgctcaccttcttcatgttcttcaccagcacggccacgctgggcgcgggctacctcttctgggaccgggtgctcagcaagcgcacgggcacggtgatgcggcgcgcgctggggcagatgcaggcgctggcggactacgtggacatgctgggcgatgtccgcctccacctgggcgagctcccccatgacgtcgcccgttacgagctgacccacggcgtggacgaacagcagtccgtcgcccgcatcaccatccggaagctcatcaacgaccgggaggccatctacttcaacggccgggagacccggaaggtcacctggaacgaccaggaacgctccgaggtcatcacccgcgagctgatctga

SEQ ID NO: 3353 - DNA, 488 bp, Myxococcus xanthus
gcaaccctcccctcccgagcagccgtggccgaacgtcccacagtcctggtcgtcgacgatgatcctcacctgagggaaatcgtccgcttcgcgctggagcagggaggcttccgggtggatgaggccgccgatggccgcgccgccctgacgcaggtcgaccgcggcctcccagcgctcatcgtcctggacatcatgatgccggagctggacgggctcgccgtgtgccgtgaggtccggcgcaagcacgagctgcccatcgtcttcctctcctcgcgggatgacgaggtcgaccgcatcctgggcctggagctgggcggcgacgactacctcaccaagcccttcagcccgcgcgagctcgtggcgcgcgtgaaggcggtgctccggcgcgcacggcccgcgccggccccggaggtcgaagcgcccgcggcgcggatgcagtcccgagggccgctgcgcatggatgcggagcgctggcgcgcgtggtggca

SEQ ID NO: 3354 - DNA, 972 bp, Myxococcus xanthus
atggtgggcgcgctctacatgctcacgttcgacccggacgcgaacgtgcgcgagacggccgcgaagacggccgcggggctgccggacaggattctgggctccgcgctgcgtgacgaagaggtacagccgcaggtgctcggcttcctcctggggctcgtgaagggcaacgaggcctacgcggagatgctggtcctcaacgccagcacgccggacgatgcggtggcggacgtggcgaaggactgcagcccgaagctggcggagatcatcgggcagaaccagctccgtctgctgcgccacgaggacatcctccgcaacctctgcgccaacgcgagcgcgccggtgtcgctcgtcgacaacgtctgcgacttcgcggtgcgcagcgggctgacgctgatggacgtgccgcagatgaaggccgcgcgcgtgcgcgtcttcggccccgaggccgcggaggcgcccccgccgcagggccccaccgcggaggaggtgctccaggagttccaggaggccgcggacgagtccgccgcgcccatggaggagggcaagcgcctgacgctggcccagcgtgtcatgcgcatgtccatcgcggagaagatcaagctggccacgctgggcaacaaggaagcccgcaccgcgctcatccgcgagacgaacaagctggtggcggtggccgtcatccgcagcccgcgcatcaccgacggtgaggtgctttcgtgcgccgccaaccgcgcgatgatggatgacgtgctgcgcgtcatctacagcaaccgcgagtggacgaagaaccacaaggtgaagatggcgctggtgaagaaccccaaggtcccgctcaccgtcaccatgaagttcctcaactcgttccgcgacgccgagctgaaggacctcagccgcgacaagaacgtgcccgcggccgtgcagggtttcgcgaagaagctgcacgagaagaagacggccccgaagaagcaggggtag

SEQ ID NO: 3355 - DNA, 771 bp, Myxococcus xanthus
atgctcctggccatcgacgtcggcaacaccaataccgtgctcggagtgttcgagggccggcgcctgctcgaccactggcgcgtagagaccagcacgcgccgcacctcggatgagtacggcatcctggtccggcagctcttcacccatcgcggcatcgacccgatgaaggtgaccgcggtcgtcgtctccagcgtggtgccgccgctccagtccaacctggagaagatgagcgagcggtacttccgcgtccgtcccatgttcatcgggcccggcgtgaagacgggcatgcccatcctctacgacaacccccgggaggtgggcgcggaccgcatcgtcaacgcggtgtccgcctacgagagacaccacgccggcgtgttggtcgtggacttcggcaccgcgacgacgttcgacgcggtgtcgccgaagggggagtacctggggggctgcatctgccccggcatcaacatctccatggaggcgctgttccagaatgcctccaagttgccgcgcgtggagttcgcgcggccgccgcatgtcatcgggcgcaacaccgtgcactccatgcaggccgggctcgtctacggctacgtgggcatggtggacggcatctgcgcccgcatgcaggccgaactgggctttccggtgaaggtcgtcgccaccggagggctcgcgtcgctggtggccagcgagtccaaggccatccaccaggtggatgagttcctcacgctcgagggcctgcgcatcatctacggaaggaatcacgcgtcatga

SEQ ID NO: 3356 - DNA, 588 bp, Myxococcus xanthus
atgggcggggccgcggtgctggcggccttggtgctgggcacgggctgttccaagaacgtcgacgcggctgcgggcgcgagcgccagcaccgatgacgtgtccgagtactacccgctcgcggtgggcaacagctggacctaccggatcaacggccgcgacgacaaacaagtcaccgtggagattctcaaggaagaggccggcgtcttccatgacagccagggcggtcagctctcgctggacggctacggcttgagagatcccaagcgctacctgctgcgcggtccggtgaggaccgggcactcgtggacgaacgtggtgtccgtgtcctccacggagcgctaccacatcgtccaggcgggagactcctgtgagacgcccgcgggcaccttcccgcgctgtgtccaggtggagggccgcaaccgggtggacgccaaggccacgctggtgaacacgatgacgttcgcgcctggcgtcggcatggtgcgcatcgaaatggccgtggagaccaacggccagctgatgccgcagacctccctggagctgacggcctggcagcttcgggacggcgcggcgccgccttcgggctga

SEQ ID NO: 3357 - DNA, 681 bp, Myxococcus xanthus
atgacgctggacgtgcccttcacccgcgaagtgctgaaggacggtgatccgcgcagcttcgccgaagtgggtgccaacctggtcctggagcgcttcggtgggagtctgccccagcgctacgaactggtcgggctcggagaggcgcccgtcgaggaggactcgcccgcgggacggcagatggccatgcgcacggcgctgaccaacgtgctgcgccaggtgaccgagtccgccgtcatgcagttgacggcgctggaccgctccgatgaagcgctggtgttggacctcaaggccacggactcgcgggtgcgggagttcagcctgcgcacgctggcggaacggcagcacccggcggccgcgccgctgctcatcgaccggctcaaggaagcgaccgacgcagagacggtgcgcaggacgatgggctcgctcgtggagatgaaggcgcgagtcgccgtgcccgtgctcatcgacctggcgcgtggccgtgacctgggcttcgtgcaggagattgtcttcgcggtgggcgaaatcggtggcccggaggcggaggcctatctctacacgatggcgcaggggcacgatgcgcccgccgtccaggccgccgcgcaacaggcgctggacacgctctacgcatcacgtaagcactcacctgcggaggcgcgtggccccggccgcgcggactga

SEQ ID NO: 3358 - DNA, 888 bp, Myxococcus xanthus
atgacattctacgaggccgcgctccgcatcctggagagcgaaggtcgtcccctccacttccttgaaattaccgagaagtccatccagcagagcctgctctcccacgtgggcaagacgcctgaggtgacgatgctgtcgcgcctcgcagccatggcgcgccgcacgcgggatcgcaaggtacttgtgacggcgaaggataccttcgcgctggttgactggtcgattcccgaggacgtcgaggcactggctcaaaccggcgtggtggagccgcatcctgaagaagaactgccgccgctgcgtccgccggagcgtcacccggagccgcgcacggacaacgtgcgggtcgcgggccgtggcagcgaccgcaagcgccgccgcgacgaggacgaggagcgtggcggtcgccgcaagcgcttcccgccgctgcccgaggtggtgttcgagattctcagcgagtcggacatcgggctgcgcaccgagcagatcatcgagcacgcccgggtcaaggagctgtgcgccgaggacaccacggtggaggcggtgctcaccgcgctgctggaggacaaccagcgtcgcatcgacgcgggccgccggccgcagtacgccttcaacaaggactcgaagaggtgtcgctggagcgcgctggcgccccgagcgaggccccgccgctggagctccaggccgcgttcgcgcaggcgctgggcattccgctggaggcgggccgtccggtgctgggcaagccggctgccgcgggcgaggcccctgcggatgccgcgctggtgtccacgctgcgcgccgcgctcaaggacgcgcgccgctccgtggcgcgtgggctgcgcaagcgcctgggcgagctggacgtcggtacgttcgagaagtccgtcgtga

SEQ ID NO: 3359 - DNA, 762 bp, Myxococcus xanthus
atgcgcgccaacccggacgaggccagctaccgtgatgagttgaagcccttcttcaagaactacttcgagcaggtggatgcgcacctgacgcgtttcaaggggaacacgaagttcgacgactacctcctggagctggagaagcgcgaggagagtggcgcgaaggatgaccgcgccaaggaccgcaaggccttctacgagtacacgcgcaagacgttcgacagcctgcgcgagggccgttaccgcccggtgtggtcggccacggacaagggcatgcgcctggacatcatctcctccgacgtggtgatggtgctgggcaagccgcagatccgcctgcagttggcggtgtggggcgcgcagcgcgtgctcaaggatgacggcaaggtgctgaagatggttaccagcgcaacgttcgacacggtgtggaagctcacggacgcgaaggggaagctgctgggcgagatgcgcggcgccgacccgtccatgaagattgaccacccggagcgcttcgtccgggcgttccccccgcagatgatgctgggccattacgacctggacctgctcccgaacgaggtggcgaaggtggagatgaccatcaacctctcctccagcgcggcgtcgggcggcaccgcggcgtccacctacgtgtggaagctggacgtgccgtcggaatggaagctcggcgctggcgagacctgggagggcgccacccaggaagagcggcccgaggaggagatcgacccgtcgaaggccgcggccaactag

SEQ ID NO: 3360 - DNA, 636 bp, Myxococcus xanthus
atggcgtcccccctcgtcgtcggaatcgcgggcggcaccgcgtccggcaagaccaccgttgcccgcaaggtacgcgaggcattggccgattgccgcgtggccttcatcgatcaggattcatactaccgggacttgaaggaccttccgctggcggacaggcgtgaggtgaacttcgaccacccggatgccttcgacagagagctgctggttcagcacctgcaagcgctgaagtccgggcagcccatccagaagcccgtctacgacttcgtcacttcgtcgcgtacgccgcagacgaagaaagtggaccccggcgacatcatcctcatcgagggcatcctggtgctccacatgaaggaggtccgggatgagatggacgtgaagatctacgtcgacgcggacgacgaccttcgcatcctccggcgcctcacccgcgacatcaaggaccgtggccgcgacttcgaccacgtggtgagccagtacctgcgccacgtgcggcccatgcacatgggcttcgtggagccgtccaagcacttcgcggacatcatcatcccgcacggcggcaacaacgagattgccatcggcatgctggtgggcgcgcttcgcggcaagctctctggcgccgtgaatcgggactag

SEQ ID NO: 3361 - DNA, 1182 bp, Myxococcus xanthus
atggcgaagctgcacgcgcgcaccggggcgccgctgctgctcgacctggggcacctgctcagccatcaactctccgccggcctgccgctgcagacggggctggacggctttccgctcgaccaggtcatcgagctgcacatcgccggaggcgtggtgacgcaccgggggccgcgcagcttctacgtggatgaccacacgcagccggtgcgcgaggagctgttcgacctgctggcctcgttgattccgcgctgcccagcgctgcgcgccgtcaccttcgagggggatggccacccgcccgaggtcgcccggatgtccttgcgccgcctgcgccagtgggtgcccgcgggagcgcgcccgccgctgacgtggcgcgtcccggcggctgtcgcggccgtgcctccactcacggaggacagccagccctgggccttgttcgacgccggttacgccgctgcgcccgcggcctccgtggaggacgaagcgggcacgctggcggaccaggacttccgcctggccgtggtcgcggaggtcctggaccgcgattggccactcacccggttgttgctcgcgggcacgcgggaggggctggcggccttcaccggctcgaaggagtaccggaagctcttcgactccgtggcgcggacgcccggtcagtccttcgcgtcctgggccatgcgccgcctgcgcgagtcaccggatgagggggcatcggcggcgctgacgctggagatgctgctgccgtcgctgttcacgcggcgggtgcccgcgcccgcgccggggcaggtggggttgatggaggacgtgcgggtcgggtcgcttcccgtggacctgtccgagctggtccattccgcccgagccgtgcgccggcacctcacggcccgtgcgtgggcgtgtggcacgttggagctgtccggcctggattcgctgaaccaggtggcgcgccggccgggcccggggccctggtccttcgtcgctcggcgcagggcaggaggaccggaggtgatgtcagtgcccccggccttgggggaattcctgggaatgctcgctgtgcggcccatggtcgaggcggaggtcgcccctgggttgttggaggcggcgagggcgcgagggctgatccgccaggcagagcgggaagaattgtctggaagtgggcccaaccgttggcctggaggtcagggttag

SEQ ID NO: 3362 - DNA, 1011 bp, Myxococcus xanthus
cagcctcgcgcggtggacgccctccaggcggccctgcgcagcggcgcggtccaccacgcgtacctcttcgccgggccagaaggggtgggcaaggagctggcggccgtcgggctggcccaggccctcacgtgccccgagcagccagacgtgggctgcggcgcctgcgcgagctgccagcgggtggagaggggcctccacccggacgtcacctgggtgatgcctgacgatgaacgggtgtcccgggggctggcgggtcggtccgacttcactgggacgcccagccgggagctacgcgtggagcaggtgcgccagctccaggagcgcatcgcccttcgcggcctggagtcgcgccgcaaggtggcgctcatcgtctccgcccagaccatgaacgtgcaggcgcagaacgcgttcctcaagacgctggaggagccgccttcggacaccacgatcatcctggtggccagcgcgattgaccgcctgctgcccaccattcgcagccggtgcggaaaggtgcacttcggcccactgccggtggacatggtggcccagcgcgtggcggaggcgcgcaagctggacgcggagacggccatgctcgcggccgtcatggcgggcggcagcctgggccgggccatggcgctggacgtggacgcgctgtcgcggcgcaaggacaccctcaccgccttcgaggccctgcgcggcgaggacgccgtcggcctgctgcgcttcgcggaggcccatggcggctcgcgcgaggaggcggagagcaccctggagctgctggcgctgtggacgcgcgacgtggcgctggtgaagtcaggcctggagtcggggctggccaaccgcgacatggtggacctggcccggcaggtggcggcccgcacgtccgacatcctcctgcaccgccggcattcgctgctggatgcggcgcgggcggccattgcccggaacggtgcgccccggctccaactggagcggatgctcatcgacctgttcacggaggcgtcgcgatga

SEQ ID NO: 3363 - DNA, 1320 bp, Myxococcus xanthus
atggatgacgtgctggcgagcgtgaaggggggcaaggtcgccccggtgtacctcttggtgggcgaggaattcctggtccgcaagggcgctgacgagctggtgaagctgctcgtccccgacgcggccatgggcctcaacctggccgtgttggacgcgggcagcccgcgcgaggtggcgcaggagctggccacgctgccgctgttccccggccgcaaggtggtgctggtccgcgacccggagttcctggcgcccaagaaggggcgaggggacgcgctgggcaaggcacgcgaggcgtggaaggcgggcaagcgaaaggagggcgcgcggcgactgttggcgctggcggcccgtgctggctggggcgtggaccagttggacccgagcacgcccggggctccgtcggtggagaagtggaaggacgagctcaacgtcgagctggccgacgtggacgtggccttcctcaaggaggcggccgccttctgccgcgaggagcgcatctccgcgcccgagggggatgcctcggcgctgctggacctcatccagaagggcgtgccggcgggccatgcgctggtgctggccgcgtccgacatggacgccaagaatccgctggtgaagctggcccacgacaagggctacgtcgtcgagcggaaggtggcggcgcgtcacaaggacctggacctgacggacatcgccaaggagttcctggcgcccttcaagaagaagctgggccccggtgcgctggacgaactcaaggagcgcattggcgggaacatccgcctgctccagtcggaactggagaagctggccacgtattcggaagggcccgccattgagcgggcggacgtggccgcgctggtccaccacgcgcgcgaggaggagttcttcgagctgtccgaggcgctccagaagcgcgacttcggcggggcgctgtcctacgcgaatgacgccatggggcaggggacgcacgcgttgcagttgctgggcgcggtcgcctccatcgttcggggcctgctggagagccatgagtggctgtggcgctatgcgggaggcaatccgcctcgcaccgcgaaggacgtggaggcgcgcgtcttcccccggctggaagcggagctgaagggcagcaagcggaagatgcccaacgcgtgggcgctcacgttcagcatgaaggccgcggcgggttatgagcggcgggagctgctgggcgcgctggtggcctgcgcagaggcggacctggcgctgaagtcgtcggcgaacggccggctggtcatcgagcggctgctggccacggtgtgtgtgcgccagcacggcgcgggttattag

SEQ ID NO: 3364 - DNA, 459 bp, Myxococcus xanthus
atggcggacaagcgtcgtttcgacctcttcgcggatttcctggtggagcgcttcaacgcgccgcgggtcttcgacgtggcgggcgggcaggggaagctcaacgaggcgctgacgaagcggggccgagccgtcaccaccttcgacctgcggcacaagcacctgcccgtcacctacgcccagcgcatcttcacactggaggagccgtgcgaggcggagctggtggtgggcatgcacccggatggcgccacccgcatcatcatccagtacgcggcggcgcaccggctgcccttcgccgtggtgccgtgctgctcggacaacggcatgccctacaacccgtggatgcggcacctggccgagctggctcgcgagtcaggcttcaccatcgtggaggaggtgaagctctccatggacgggcgggcccgggtcctcgtgggcgagcatggcgccgctgcgtcttga

SEQ ID NO: 3365 - DNA, 2112 bp, Myxococcus xanthus
atggctgagagaaccctcgtcaccagcgcgctgccctacgcgaacggcccgctccacatcggccacgccgtcgagtacgtgcagaccgacatctacgttcgtttcctccgctcgtgcggcagggacgtcgtctacttctgtgccgatgacacccacggcacgcccatcgagctgaacgcggcgaagcagggcctcaagcccgaggaattcatcgcccgcttccacgaggagcaccagcgggacttccacgacctcgatgtccgcttcgactacttccactccaccaactcgccggagaaccgccagtacgcggagctcatctacgggcggctgaaggagaagggcgacatcgagcgccggaacatcgagcagacctactgcgagaacgaccgccgcttccttccggaccgcttcatcaaggggacctgccccaactgcaaggcttccgaccagtacggcgacgcctgtgagaagtgcggcaaggcctacgaccccacggacctcatcgacgcgcgctgtgccctgtgtggcacgcctccggtccgcaagcactccgaacacctgttcttcaagctgtcgcggcacgaggacttcctccaggacgtgctgcgcaagccaggcttcatccatccgggcctggcgacccaactccagggcttcttcgagaagggcctgtcggactgggacatcagccgcgacgggccgtacttcggcttcgccattccgggtgagacggacaagtacttctacgtctggttggacgcgcccatcgggtacatcgccaccacggagaagtgggcgaaggagacgggcaaggcgaagagcgcgctggactactggagcgcggacgcggacacccgcatcatccacttcatcggcaaggacatcgtctacttccacgcgctgttctggccggccgtgctcaacgtcgcgggcttccacatccccagcgaaatcaaggtccacggccacctgatgttgaacggcgagaagatgtcgaagactcgcggcaccatggtgccagtgcgcgactacctggaccagttggaccccagctacttgcgctacttctacgcggccaacctgggcccgggggtggaggacctggacctcaacctcaaggacttccgccagcgcgtgaatggcgagctggtcaacaacgtgggcaacctggccaaccgcgccctgtcgctgctggccggtccgctggagaagcgtctcgcgcccggccgtgccgagggcccgggccgcgagttggtggaggccgcgctcgcccgcgtgccggaggttcgcgacgcgttcgacaagctggagtaccggtccgccatccgcgtcatcaccgagattgcgtcggccgcgaacggcttcctccagacggccgcgccgtgggcccaggtgaagaaggacgcggaggtcgctcgcgcggacctgtccgacgccgcggacgtggcctacctcctgggcgcgctgctcgccccggtgacaccgcgcctgtccgagaagctcttcgctcagctcggcgccgagccgctgacgttccaggccctggagggcgcgaagtacccgctgttggatcgcagccgtcccatcggcacgcccgagccgctgctgccgcggctggaggaggagcgcgtcaacgccatcatcaagctaccggaaggcgccgctgcgccggacgccgcggaggccaggccggccaagggcgccaagacggagaagaagcccgccgaggctcccgccgcgacgcaggcggcggctccgagcgctggcgcggccgagtcgccgggtgaaatcgagtacgacgacttcgccaaggtggtgctgaaggcgggcaaggtgctggccgcggagaaggtgcagaaggcagacaagctgctcaagctcacggtggacgtgggcgaggggagcccgcgcaccatcgtctccggcatcgcggaggccttcgctcccgaggcgctcaccgggcgcaacgtggtggtggtggccaacctcaagccgcgcaagctcaagggcatcgagtcgcgcggcatgctcctgacggcggggccgggcggcaaggagctgtcgctgctcgacccgggcgatgtggcccctggcagcgaggtgaagtga

SEQ ID NO: 3366 - DNA, 636 bp, Myxococcus xanthus
atgctggaggatggcaccttcgaggtccgcttcgaggcggcacgcggcatcgccagcctccatcacgccgcggggctggaggtgttgctggaggcgctggacgcggacctgctgcgcttccgggccctgggcgcgctggcggagctgggggacgcgcgcgcgctgccccaggtgaagaagctgttcggccggtggcttctgcccgccttcgacaagacgcaggccgccggggtgctggcgaagctgggcgattcggacggcccgacgtacctcatccagcggatggcgaagaagcggtggagcccggaccgggccctggccgtggaactctgcggcgaggtgaaggtacccggcgcgctggagcgcttgaaggaagtcctggacgacgtgaaggacccctgccggggcgcggccgcgagaggcctgggccggctgggcgatgcgcgggcgctgccctggctggtcgggctgctccaggacgcgcaggcctccgaggacacccgattggacgccgctgacgggctgtggcgcctgggcggggctgaggcgcgtgaggccgttcgcaacgcggtgagtacctttccctcaccagaggcccgcgccgaactggaagagctgttgcaggaggagccatga

SEQ ID NO: 3367 - DNA, 777 bp, Myxococcus xanthus
atgaaattcgtcgacgcccactgtcacctcgaggtgaaggactacccggacgtcgtggccgtgctcgacgcggctcgcgcggcggggctggtccatgccgtcgtggtggggcagttccacggcccgggtaactggggcaacgcgctggaggtggcggcggcgcacccggagttcctgtcgcccacgttgggcatccacccgcacgaggccgcccgggccaccgaggaggacctggccacgctggagcgcacctgcgcgcgtcccgaggtccgggcggtgggggaggcgggcctggactactactacgaccactcaccgcgtgaggcgcaggcggaggtcttccggcggcagtgcgcgctggcgctccggctgggcaagccgctggtggtgcacgtgcgcgacgcgcatgacgactgtgacgccatcctcggcgagacgggcgtggcgaagggcgtcatccactgcttcaccggtgacacggacgcggcgcggcgctacctggaccggggcttcctgctgtcgctgtcgggcgtcatcacctacaagaagacggaggcgctccaggacgcggtgcgcttcgcgccgttggacaggctgatggtggagacggacagcccgtacctggcgccggtgccgcaccgggggcggaagaaccagccctcgcacgtggtggagacggcgaagaaggtcgccgaactcaagggcgtgacgctggaggaggtggcctcggtcaccaccgccaacgccgccgccctcttcaacctcaacctgcgttga

SEQ ID NO: 3368 - DNA, 138 bp, Myxococcus xanthus
atggctgcctacaacgtccacgtgagcgtggagttcttcgggcggctggaccgggccctgctcacccgttgtgtgaacgaggtggtgcgccgtcacgaatccctgcgctcgacgctgaggagcccgggggagatccgg

SEQ ID NO: 3369 - DNA, 4591 bp, Myxococcus xanthus
gattcgccagacatcgcggtggtggggatggccgcgcgactgcctggagcgcgcgatgtggacacgttctggcgccgcgtgcgcgacggcgtcgagtccgtcacgcacttcagtgacgcgcagctcctgagcgcgggcgtggacccggcgctgctccaggacccgaactacgtgaagtcgggcatggtgtacgagggcctggaggacttcgacgcgggcttcttcggcttcagcgcgcgcgaggcgtccctcatggacccgcagcaccgccacttcctggaagtgtgctgggaagcgctggagcacagcggccatccgccggagcggttcaaggggcccgtcggcgtgttcggcggctcgggcatgaacgcgtacatgccctacaacctcttcaccaacccgcaactgatggaacaggtgggactgttcctcgtgcggcatacgggcaacgacaaggacttcctcaccacccgtgtctcgtattgcctggacctgcgcgggcccagcctcaacgtgcagacggcgtgctccacgtcgctcgtcgccatccactccgcctgccagagcttgctggcgcgcgagtgcgacctggcgctggcgggcggcgtcacgctggagctgccgcactaccgcggctacctgtaccaggagggagaaatcctctcaccggacgggcactgccgcgcgttcgaccaccgctcccagggcacgctcttcggcagcggcgcgggcgtcatcgtgctgcgccgcctggaggacgcgctggcggatggcgacaccatctacgcggtggtgaagggcagcgcggtgaacaacgacggcgcgcgcaaggtgggctacctggcgccgtccgtggacgggcaggcggacgccgtcgtggaggcgctcaacgtctccggcatcagcgccgactccatcgactacatcgagtgccacggcaccggcacgccggtgggcgacccgattgaaatcaccgccctcacccaggccttccgcacgcagacgcagaagagcgggttctgccgcatcggctcggtgaagacgaacatcggccacctggacacggccgcgggcgtggcgagcttcgtcaaggtcgtccagatgctgcgccacaagcagatggcgcccacgctgcacttcgagaaacccaacccacagatcgacttcgcgcgctcgcccttcagcgtgaacgccgcgctgagggactggcccgccgggcccctcccctcgccgagccggtgtcagcgcctttggcattggtggcaccaacgcgcacgtcatcctggaggaggccccagccgtcgcccccaccgcggacgcccgtccctggtacgtgctgccgttgtcggcgaagacaagcaccgccctggataccgcgacggaggcgctggccagccacctggaacaacacccggagcaggcgctgaaggacgtggcctacacgctgcaagtgggacggcaggccttccagcaccgccgcatcgccgtggtgaaggaccgggagcacgccatccgcgtgttgcgaggcgaggagccagagcggctggtgacgctgaagcaagaggcacgaggccgccccgtggcgttcctcttcccgggaggaggcacccaccacctgggcatgggcgcgggcctctaccgcacggagcccgtcttccgtgaggccgccgacgaggtcgccagcgtcctgcgcccgcacctgggcgtggatctgcgcacggtgctctaccaggagcccctccaggaggtgccggggctctcccgcaacgcgctcgcgctgcccgccatcttcctgacggagtacgcccttgcgcggctgtggatgtcatgtggcgtggagccggagcagatgctcggccacagcctgggcgagtacgcggcggcgtgcatcgccggtgtgctgtcggtggaggatgcggcggccctggtggcgctgcgtggccagctcatggatgagctgcccgccgggtccatgctgagcatcagccttcccgaggcggaggtggtgccgctgctgggccaggagttggacctcgcggcggtgaatgcgccctcgcagtgcgtggtctccggcccactggcggaggtgaagcgattgatggcggagctgacggctcgaggcgtggagcaccgccaactgcacgtggaggcggcggcgcactcgcgcatgctggagcgcatcctgccgcgcttccacgagcgcgtgtcccgtctgacgctccgtccccccgagcgcccctacatttccagccggaccggccagcccgtcacgggggacgaggtgacgcggcctcagtactgggtggaccatctgcgccactcggtacgcttccgggacggcatgcaggtgctgctggaggactcgacgcgcgtcctgctggaggtggggcccgcgcagtcgctgaccgccgtggcaaggctccaaggcgagcccgccggcgcgcgcaccatcgtctcctccgcgcgccatcccaaggatgaccagccggacgaggccgtcttcttgaatgcgctgggacggctgtggctcgcgggcgtggaggtggactggagcggcgtgcacgggacggagacggtccggcgcatcccccttcccacgtaccccttcgaagggcagcgatattgggttgctcctctggaccggtccgccgcgctgctggcctcgcaggccgcgggcgccagcaagctgaccgacatcgcggactggtttcacctgccctcgtggcggcgcacgcctccggccacgctggcgccctcggcgctcgcccagccccggtgctgggtggtgttcaccgacggaggtccgttggcctcgcggctcgtctctcggttggaagaggcgggacagtacgtcgtcaccgtgcacgcgggcgccgcgttctcccgtgacgatgagcggcgcttcaccgtggctccgagcgcacctggagactacgccgcgctgctgagcgcgctggaggacctgacaccccggcctgaagtgttcgtccacctgtggagcctgacgccgcagggcgagcgcgagtccatactgacgcggttccaggccgcgcaagcgttgggctactacagcgtggtgcacctggggcaagcccttgccggactgaaggatgcgcgcccactccgggtggaggtcatctccaaccacctgttcgacccggacggccgagcggaggcgctgccggagaaggcgcccctgttgggcccctgccaggtgctgtcgcagcaacacgtgcacatcaccgcgcgcggcgtcgatgtgatcctccctggcgcagaaggcgttgcggccctggccgaacagctcgtcgccgagctcgccacggaggcacgagacgtccgggtggccttgcgcggttcacgccgctgggtccaggagctgtctcccgttcggctgacggagacggccgcccccgcgcgacctctgcgtgagcgcggcgtgtacctcatcaccggcggcctgggccgcgtgggcctgctgctggccagccatctggcgcgcacgaagcaggcgcggctggcgctggtgggccgcacgccgctgccgccccggcgtctctgggacgattgggtttccacccagggtgaggacgacgacgccagcctgctcatccggcgcgtgcgtgaattggagtcacacggagcagaggtgctcgtcctgagcgccgacgtctccaagccgcactggatgcaggaagtcctggccgaggtggaccagctcttcggcgcgctccacggggtgctgcactgcgcggaccttcccctggctccgcccgaacggaccccgccctccgcgacgaacccggacgcggaggcccgtttccgcgccaaggtgcgcggcacgtacgtgctggaggacgtcctgcgcgaccgggcgctggacttcgtgatgctgttctccgcgtcggcggcggtgctgtcgcccttcggcgacacgccttcgacggcggccaacctcttcgtggatgcgttcgcggctcaccgcagccggagcgcaggaacgccttggatgagcgtggcctgggacccgtggccgcgagcggccggcgccagcgatgcgcgcgctcctggcctcgagccgtatgccatgaccgagaacgaagccaccgaggccttccagcgagtcgtcacgggcggcctggatggcccggtggtggtggccacgggtgacgtgtcacggcgactgactgcgtggctccagcgggcggtcgcgctgcccaaggtcgctcgcaaggtccgcaccggagacgaagagcttcccgccaatgagctggagcgtgtcatcgcggccctgtggcaggaggtcctgggtgtcgaacaggtggcgcggcacgaccacttcttcgagctgggcgggcactcgctgctcgccacgcaggtcgtcgggcgccttcgctcacggctgcagctggacctgagtctggcactgctcttcacgtcgcccaccgtggcgggtctggcgaaggcaatcgccgacctccaggcgcggcaacaagagtccctctatcgcgagctgctcgaccgggtcacccgcgtctccgagcaggagctcgccgaagagcttcggcgccgcggcgtgaaggccgcgtga

SEQ ID NO: 3370 - DNA, 195 bp, Myxococcus xanthus
atgggcaacgagcaggagcgggcggacacgcagaagggcctggaagccgccaagggcttcgtgcgccgcgaggtgacgtccgccgtcaacctgcgcgtgtcgccggaaatcttcttctccttcgacgaatcggtgggcgaaggtgacaagattgaccggctgctgcgcgaagtccgcaacaaggaaggctggtag

SEQ ID NO: 3371 - DNA, 2139 bp, Myxococcus xanthus
atgtccaccggcagtgggccgaagtgcacctttccgcaccggctgcgaatggtgggcagcaggcggtcaatcgcgctggccaccaggatgatcgtggtgtccgaaggcggctcctccagcgtcttgaggaacgcgttctgcgcctgcacgttcatggtctgggcggagacgatgagcgccaccttgcggcgcgactccaggccgcgaagggcgatgcgctcctggagctggcgcacctgctccacgcgtagctcccggctgggcgtcccagtgaagtcggaccgacccgccagcccccgggacacccgttcatcgtcaggcatcacccaggtgacgtccgggtggaggcccctctccacccgctggcagctcgcgcaggcgccgcagcccacgtctggctgctcggggcacgtgagggcctgggccagcccgacggccgccagctccttgcccaccccttctggcccggcgaagaggtacgcgtggtggaccgcgccgctgcgcagggccgcctggagggcgtccaccgcgcgaggctgtcccagtaccgttgcgagcgtcatggcgcgtgtatccccgctcacgcggcacgcgtcaacggccgccttgacccccatggagatggcgggagacattccccccgccttgctgcccttccttcagagcaacctgtccctggccgtgggtgcgctgctcatcgtcgtgctgatgggggtgcgcgccgccgctcaagacgccgaccttcggcaggatttgaagagcgccaaccggctcctcatcgcgttcatcgtgctccggctggcgacgtgggccttgccggcgaccgcccccgaaggcctcaagaaggcgctccaggtcagctggatgctgatgttcaccttcggtggcatccgcgccagcgtggccctggcgctgaaggtgatccggctgcgcgcgccggcggtgggcacaccgaaaatcctgcgcaacgtcatcgacttcacgctgtacccactggcggtgctgccgctcctgcgcacccagttcaacgtggacctggcgggcctggtggccacgtccgcggtgctgtcggtggtcatcggtctggcgctccaggagacgctgggcaacctcttcgcgggcctgtccctccaactggaccgccccttcgaggtcggccacttcatccgcatcggcacacacaccggacgcgtggtcttcattggctggcgctccatccggctggccaacttccgccgcgaggtcatcacgctgcccaacagcatggtggccaaggagctggtcctcaacttcacccaggaccccaaccccgtcggcatcgacgtggagttccgcctgtcacgggacgccgcgcccaaccaggtcaagcacgcgctgctggagacgatgcgggagacccccctcatcctcccggagccgtctcccatcgcgcgcacgctgggctacgaggattccgccatccgctacatggtgcggttcttcatcggcgattacggcctggcggacgcggtgaaggaggacctccactcccgcctgtggtaccggctgcgccgggcgaacatcgagattccctacgcccagcggacggtgcacgtacgacaggagatggcgcgcacggagctgtcggaggacaccatccgcagcctcctgggcgccgtggacctcttccagtccctggacacggaggagctggaccggcttcgccaggagtcgctggtgcgccgcttcggcgccggcgagcgcatcatccaggagggcgacgagggccggaccttctacgtgctcgcctccggagaggtgagcgtgcgcacggggaagtcccagtcggaagtcacccgcctgggccgcggcagctacttcggagagatgtgcctgctgacgggagagcgccgttcggccacggtggtggcggtggaggactcattgctcctcgaagtagaccgtcccaccttcgcccgcctcttcacggagtatcccggcctggcccggcagctctcctccatgcttgcccagcggcggacccagctgcgcgcggtggccgaagcgagcggaacgagcaacgacgccattcccgccgaggtcggccgtatactcggacggctgcgccagatattcgggctcaatgccacacacgagtag

SEQ ID NO: 3372 - DNA, 801 bp, Myxococcus xanthus
atgtgcaccatcatcatcctgcgccacatcccccccgaatggccgctggtgctcgcggccaaccgggacgagttctacgcccgccctgcgactggcccccaagtgcttctggagtccccgctcgccgtgggcggccgggatgaggaacgcggtgggacgtggatgggtgtaacccacggcggtttgttcgtcggcctgacgaaccagcggggcgagcgaggccagggtccggccccccgctcgcggggcgaggtggtgctcaaggccctccaggccggcagcgtggacgccgtggaccggtacctagattccctgccaggggatgagttcatgcccttcaacctgctctatggggacgcccagcgactgcgcgtggcctacgcccggaggacggaccggcagttgcggcgggaggatgtccccccgggggtccatgtcctgcccaatgacgtgctgaatgccccggagctgcccaaggtggaacgggcccggctgctgaccaccgaggtggcgaagaagccctggccggagctggcggagggcttgaaggcggtgctggccgacccgaccctccccaccgaggagctgattccgcccccgggcgccggtgaggacctgccccgcgacttcctgcaacggctccaggcgctctgcatccacacgccgctctacgggacgcgctcgtccgccgtggtggcgctggcgccggggcgcgtcgggcactacctcgcctcggacacgccgccctgccagggaccctggaaggatgtcacgggcctgctgaccgggcccaccgagtga

SEQ ID NO: 3373 - DNA, 1983 bp, Myxococcus xanthus
atggtgaagaggttgggagagcgcctcatcgaggcgggactcgtcaacgccggggccgtggaacaggccctggagcaccagaaaatcaccggccacaaggtcggtgattgtctggtggagctgggactgctccaggaagcggcgctgctgcgcttcctggcggcggagttccagacgcgcttcgtcagcgcggacaagctggcgaaggcgcgcatcgccaccgaggtgctggaccggcttccggtgcgcctggccgaggcgcagaacgtgctgccactggcggtggacccggagcgcaagctgctctccgtggtcgccgccgagccgcagaacaagtcgctgatggacgagattgccctcgtcacgggcatgtcggaggtctacgcgtacgtgggcctgcgcagcgccatctccgccgccatccgcaagcactactacggcgatcccaccgccttcgccgcgctgctggaaggcgccaacgcccagggccaggccccggccgcgccgtcccgcccgggcgccccggagcacggacgcacctacgcgggcagcggcaccgggacgggcgcgggcaaccgtggcggactcagcctcaacttccgcgtggagacggacgcgcggatgcggctgcaacgcggcagcagcaccggcacccccgcggtccgcccgtccacccagcggcgcgaacccggcgggccgcgcgggctggtgagcgacagcgactacgtggagacgctgggcatcatggtcggcctgctggagcaggaccggcagcgccaccgcgggcactccgcgcagttggcgcggcaggccggcatcgtgggccagcgcatgggcatgccccacaaggagctggccgcgctggccatcgccgcctacctgcacgacctgggaaagccggcggagcggcacttctcgctggcgagcaacgccgtcaacccggagtggaaggcgcaggcgaaggtggcctgccgcatccccacccgcatgttcgagacggtgcacctgcccgcgcagacgaacaccatcctcgcgcagatgtacgaagcctgggacggctccggcacgccccagggcgccaagggcgaggacatcaccctgggcgcgcgcatcctcgccgcggtggacagcttcctggagctgacgaagaacccgggcaacgccctgggccgcgtgctgcccaaggagcaggccctggagcacctgcgcaagtacgcgggcgcgctctatgacccggtggtggcggacatcgtcatccagctccagagtggtgagctgctgcgccaccggctggagagcgaaggccgccaggtgctcgtggtggagccggacgagacggcgcgcggcgagctgctggaagcggtgctgaagcagggcctggtggcgcacgcgctgtccaccgtcgagggcgcgcaggacggactggcgcggcaggactgcgacgtgctggtggtgagcctgcggctggggctgcaggacgtgacggacctgctggcgcaggcccgctcggcgccggagacggcgggtctgcccatcgcggtggtgggcgagcccgacaatgccacgcgggagcgcctgctcatggcgggcgccacggacgtgctgtcgcccgcggacaagcccgccatcgcgaagacggtgcaggccctctacgacgaccgggtccagcacaacgggccggggcgcgtggtgcgcggcagcttcgacgaactcccccctcgcgagctgctgcgcacgctgggcggtggccacaagagcggccggctcaacctgcgccagcacacgctggagggctacctgcacctggagcgaggccgcgtcgtcttcgcgtccttcggtggtcactcaggcgagcccgcgctccaggcgctgctgaagctgaagcaggcggacttccagtacgacccggacgcgttgctgctggacgtgccgcagatggaccaggacctcgcggccctggccggcggcctcaacgcaggttga

SEQ ID NO: 3374 - DNA, 789 bp, Myxococcus xanthus
cctggcggactggcggagcacatcctgtcggtgatgcggctgacgctccgcgtggcggaccagtaccccatggcggaccgcgacctgctgctggccggcgcgctgttgcagcaggtgcagaaggcggcggacgcctccgagacctccgacgagggccggctggtgggcaacctcgtcctgacggcgcagaagctgcgcgagaaggcgctggccatccccggcttcccgccgctcctggagcagcacctcacgcacctggtcatctcccagcacggcgacgcgcagcacggcagcccgaagtcgccggtgacgctggaagcgcagatcatccactcgctggagtcgctggacgcgcgcatcgcctcgtggctggaggccatgcagcgcgactcgcacgacaagtggacggacgtggtgcgcccctatgagcgccagttgtggaagggcccctcgcccacctcgcggggccgcgccccggtggaggggggtggccgccgcaagggccgcgaggagaagcgcaaggcccgggcggagaagcagcagcagccgggtaccccggccgagggcgccccgcagcaggagcaggcccagcgcccgccccgcaaggagcgtccgccccgcgaggagcgcgcgcgtgaggagcgcccgccccgtccgccccgcgaggagcgtccgccgcgtgacgcgagctcgctgcccaaggagctgaccttcaagccgttcagcgcgctgacgtcgttaccgtccgattccggcaacaagggcggtgagggttcctcggagagctga

SEQ ID NO: 3375 - DNA, 2073 bp, Myxococcus xanthus
atgtcgggtcacgcgagtgcttcgcaggcggcggagttcaaggagaacgccttcaccgagcgggtggtggacatcatcgcggaagccggtgccattactggtgggcatacctgctatttccgcaaggaactcgggaaccgtcatctcaaggcgaacggttacaacgtgggggaggacgaggagcatctcgatatcatcatcagtatctacagagatactcccgttccgccgacgctgcgcatgacagaggtctatcaggctatccagcgtgccttgaacttcgtcagtgcggccgcggctgacctctcgagcaagatggaacaggcccaccctgcctacgacatggcggagcgggtcagggaggtcttctccaaagccagtgtgcagcgtgtgaacgtgatcgtgctcacggattgtgtggtgcgtgagcaccaactgcagaagccgctgaagattagcaagcaatcccggatcgatgttcgtgcggatatctgggacatcgagcgtctgtatcggagcatgagttcggggtgcgtccgcgagacgatcgatatcgactttggcgaattcgagcgcaccatcccctgtctgccggttccaatctccgaaggcgaatacggagcctacctcgccgtggttccgggggaggttctcttcaggctgtacgacgaatacggtgagcggctcctcgaactcaacgttcgctccttcctccaggctcgtggcaagatcaaccgcggcattcgtgacacgctgctcaaggagcctcagctcttcttcgcctacaacaacggcatcacagcggtggcggaggacgtgaagacgaagttgctcccggacgggacgacggctcttgtctggatcagggggttgcagatcgtcaacggtggccagacgacggcctccatccaccgtgctggaaagaaggaccaggcggaactctctcgggtcttcgtacagatgaagctctcacaggtgcgcttggtgcatcttgagacactcgttccgcgcatctccctgtatgcgaacagccagaacaaggtaaacgaggccgatttctccgcgaacgatttgttccatcagaagttggagagcctctcacgtacgatttgggcaccaggcgagcagagccgctggttctacgagcgcgcgcgcggtcaataccaggtagcccgcgggaaggcctctacacccgccaagcagcgacaattcgacagcatccatccgccatcacagatgttcacgaagacggatcttgcgggctttgagcacagttggggtcaacggcccgacttggtcagcaagggatcccagaaaaacttcgtggagttcatgctcttgttcaaagcgcagcagcccgatttcagcccggacgagcagtacttcacccagctcgtagctaaggcaatcatcttccgtaaggtccaggcgcttgcacgtgaagccaggattggcgcgtacagagcgaacatcgttacttactcggtggcgtatcttgcatcacgagtcggtgcgcgcttggatcttgccgaaatctggcgagcgcagaagctgacgcctcagttggaggcggcgcttcgtgggctgctgatgcccattgaagaagccatcaagcgaacagctgaggggcggaacgttacggagtggtgcaagaaggcggagtgctggcgcgctatcaaggccatgaattttcccgtcccggccaatgtggcgggcgcgttgtatgctgcgcgcgccggccggaagggggccgcgaaggaggtgcaggagaacctccggaaggcagcgttacccaagcttgcggaagccgtgaatatcgccctgatcagcttcgcccgagcgggacagaaggcagatgcggcttcgattgcggacgcaatcacgaagacactcgcaccaggggggcttgaggttatcaacaacgttccatccggaggagttctctgggttgtgggcggtatggaactttcatcgattatgagggaggtgcgtgagcatgggcttcgcgccgagtttcgcgaaggtggaggcagggcaaccgagcaccgccctgcgtggtacatcacctgctga

SEQ ID NO: 3376 - DNA, 915 bp, Myxococcus xanthus
agcactgcaccgtaccctattggttcccccggaagcccctggggtgaggcggaagtcacgacctggcggtcccgccagacccgcaagcgcagctacgcggccgacgtgctgagcgcgatagagcgcctgcgcgcgcgcttcgacgtggtgcagtacggcctgctggactacccgccggacacgtacccgctgttcgcgctcgcgagccgcgactggcgcgacgggttgccggtggcgctggtcacgggtggggtacatggctacgagacgagcggcgtccacggcgcgctgcagttcgtcgagcggcatgcggctggctacgcgggccgcttcaacctgctcgtcgtcccgtgcgtcagcccgtgggcctacgagcggatccagcgctggaacatgaatgcaattgacccgaaccgctccttccgcgagcccagccccgcggaggagtcggcggccctcatgcggctggtcgccccgctgcgcgaccgcgtgctcgtgcacgtggacctgcatgagaccaccgactcggacgaggcggagttccgccccgccttggccgcgcgcgacggcaagccctttgagcccgaccacacccccgacggattctacgtcgtgggcgacaccgagaacccgcggctcgacttccagcaggcggtcatcgccgcggtcgcgaaggtcacccacatcgccccgcccgacgccgacggcaagatcattggctctcccgtcgtcgccccgggcgtcatccactacgcactccgccagctcggactgtgcgctggcatcacgcgcgcccgctacgtgacgaccaccgaggtctaccccgacagcccgcgtgcgacgcccgcgcagtgcagcgacgcgcaggtggcggcggtcacggcggcgctcgattacgcattggcgcatccgtag

SEQ ID NO: 3377 - DNA, 675 bp, Myxococcus xanthus
atgcgtgcgctccttgtcgaggatgagccggaactcgcgcggctggtggcaaatgaagcgacgtcccagggcttctcggtcgacgccgtggcttcggtcaccgaggcccgtagcgcgatccatctgggcgcctacgcgatcgtgcttctggaccgccgcctgcccgatggcgacggcctgtgcctgattcccgagctccgtgccatgcagccggaggcgggcgtgctggtgatcagcgcgatgggagatgtcccggagagagtcgcaggcctggatgcgggtgcggatgactacatgggaaagcctttccatgcagacgagctgcgggcgcgcatccgctcggtgctgcgacggcctgcacaggcgcgacagctgcagccggtgcgctgcggcgccatcgagtacgacctcggctccaggcagatgacggtgcagggaaggccgctgctgcttcgccggcgcgaggcctcgctgctggccgccctgatgcgccgcgcgcggcgggtcgtccagcgcgacaccctcatcaaggaggtctacgggttcgacgaggagcccagtgccaacaccctggaagcacacatctccaggctgcggcggcggctcgaggattgtggcgcgggtgtggtgctgcacccggtccggggcgtcggctatcttatcgacgagccatga

SEQ ID NO: 3378 - DNA, 1473 bp, Myxococcus xanthus
atgaagcgtctcacggactccctggcgccgcgcctgatcgcggccgtcctcgcaacgcagctcatcgtcatcaccgggctgatgctgttctggatggtgttctcccactccgtctcgcacgacgatctgtccgccgcgacctcccaacgtcgcgtcgccgagtcgatcacgctggacccggcaggcgcccctcgcatcgagccctcgagcgctctgcgcgcctatcaggcacgacgtccgcagctggcctacgccgtgtacctggacggccgcctggtgtccggatcatcgcagcagcttgcccacgcgatctctccacgcggctgggccgcacctggcgcgaacctcgaaccggcgcccaccctcgccgacctgtaccggcacttccccgacctgcagtgtgtgcagctgcttgctgagtgcggagatccggtgatcgccctcggagagggccagcgcgcgaacgtctcgatgttcccgatccacggcatcgggaccgcggtcgtcgtgacgagcggcaatcgcctcggactggatgacctgccaaccgcgctgctgacgctgattccgcgcgtgatgaagctgtttggttcggccgtcctcgccaccgtcctcgtgctgccactgatgctgcgtcgcgcgctacaacccctcacgagggccgccaacgccgcatccggcatcggcctcgagacgctggaccagcggctgtcgcccgatggcgtgcccaaggagatccagcccttcgtcacggccatcaatcagctgctggaaaggctcgagcgcggcgtctcccgccagcaactgttcgtcgccaatgccgcgcacgagttgcgcacccctgtggcgattctctgcgcccggctcgactccctgggcgacagccccgccacgcgcgacctgcggcgcgatgcgacgcggctggggctgatggtcgaccagctgctcgcggctttccgcatgcagggacagaccccggcggattggagagcgctggatctggtccagcagctgcgtgatctgatcagcgacatggcgccgctggcgctgcggagcggacgagccatcgccctggaagccgcatcgccctccgagatggtgctgggacaggccgatggccttcggtcggcgttggccaacctgctcgacaatgcgctgcgcgccgagcccgctggcgggacggtgatcgtcaggatggaagccagcacgtccagcgtcacggtcgacgtcgtcgatcacggccccggcgtcgaggagtccgaccgagagaacatcttcgagcccttttggcgccgggaaggtcagtggagtggaaccgggttgggtctggccatcgcccgccgcatctcggaaggccacggcggtagcctgcagcacctgcccacagaaggcggcggcgcgacattccggatgcgggtgggaagatctcccgcaggaagaagcatcgacccgtcagcgtgttgcaaggattga

SEQ ID NO: 3379 - DNA, 165 bp, Myxococcus xanthus
atgacgcagacaccagagctcaccatacagaccgcgctgggcatgagccccgagaccttctggaccatgccgttcgagaaactcctgccaccgacggagccgctcaacgaaggtcgagacagcgttgcgctggcccaccgccttggcaacgctgtcgacgacatc

SEQ ID NO: 3380 - DNA, 453 bp, Myxococcus xanthus
tcactggcgctcgcggtggtgggcaacgagcggcgccacgtggacgagcagctggagaaaatcatccactccgtcgaggagatgtatgtcgccccgctgttgtcgcgggagacggaaatcctcggcttcggggaccagctcttcgcgagcggccaggcggcctcgcgaggttccttctcggcgcaggccgtggatgaggacgtggaggagttggacctttccccagagcaggcggcggcgcattcggaggccgccattgcccgcttcctgcgcggcgagcgcggctcgctcgcggaggcggaggggttgggagagtgggaaagccgccatgaaggcggcatggatggcggcacgagccgcccgtctccgtcgagcggtggacggatgacgttcgacgaggcacgggctcgggcccgttccctgcgcaacccgcgagactgggagaagaaatga

SEQ ID NO: 3381 - DNA, 999 bp, Myxococcus xanthus
ctggagaagatccgcatcggcgggatcgaccaatgggtctcgatccgcggcgtcgaccgggcgaatcccgtgttgctgatgctccacggaggtcccggcttcgtgtcgatgccgacgagctggtacttccagcgggggtgggaggagtacttcaccgtcatccagtgggatcagcgcggtgctggaaaaacctacctggcgaatgacccctccgcggtcgcggcgaccatgacggcggagcggttgatcgccgataccgaggagatgattcactgggcacgcaaggagctcggcaaggagaagatcttcctgctcggacattcatggggcagctacctcggcctgtccgtagcgcaacgtcacccggaatggctgcacgcgtatatcggaatgggacaggcgaccgatgttctggagagcgaacggcgcggatggcgctttgccatggacagagcacgcgcagccggaaacgaggaggcgatcagggagctgcaatcgattgcgccctacgcggcgcatggcgctgcgctcgagctgcccgtcgtcgcgatccagcgcaagtggctcggcttctatggtggccaggtgcacgggcggacgggtggccaggccgaagcggagggcttcgcactctctccggagtacacggatgccgagctggcctcggtgtggaccgccaacgagctctccgaggagaagctgttccccgccgtgttgcgggccgacttcagcaacgtgacccggctcgagtgcccgatgctcctcttcaatggccggcacgactacaacgtgtcggcaagcgtcgcggccgaatggttcgagcgccttcacgcacccatcaagcacctggtctggttcgagaactcggctcacgagatcatgaacgaagagccgggcaagatgctgctgtcgctggtcaggtacgcccggcccatcgccgaggcggcaggcgatgcaccgaagcctgcaccccgggacgcggccaccggggcgcgatag

SEQ ID NO: 3382 - DNA, 585 bp, Myxococcus xanthus
atgggccgcccccgcgggttcgaccgcgacgaggcactcgtggaggcgatgcgggtgttttgggcgcgcggctacgagggcacgtccatccaggatctggtcgatgcgatgggcgtcaacaagcccagcctctattccatcttcggctgcaaggaagagctcttccgcgaagccgttgaactctacgaccggctcgaaggcattcacaccacccgcagcctggaggatgctccgtccgcacgcgcggcggtggaggagatgctgcgcgccaatgcgcgggcctacaccgccagcgacaaacctcgggggtgcatgatcgtcctgtcttcgctcctgggctcgccggagaacgagcgggtcaggaccttcctcgcggagaatcgcctcaggggtgagcgtgcgctgaagcagcgactcgagcgaggcattctcgatggagacctccctgcatccgccgaggtggggatgctcgccgcgttctacaccacggtgctggagggcttgtcgatacagtctcgcgatggcgcctccgcgaagaagctcgccgccatcattgatgccgcgatgctcgcttggccgacatga

SEQ ID NO: 3383 - DNA, 1104 bp, Myxococcus xanthus
ctaaggggccagcgcttcgacctggaggcgaagtaccggggcgccacctccagtgtgtttcccaagcgcagcctcacgctgaaattcccggacgaggacctgttcaccgagcctgtcttcggaaacggcttcgaggaccgcaagcgcgtggtgctcatcaccacgttcaatgacaactcctacattcgctcacggctcgccttcgacgtgtggagccggatgagcccgggccatatccacctgcgcacctacagcgcggtgctctacgccaacaacaaatacgtcggcctttacacggctgcggaccacgtcaacaaacgcctgatggccgcgcacggcatcgacaaggacgcggacgccttcaaggccgtggaccaccgcgccaacttctcgcgcctgcgcaaagacggcacgaccaagagcagcctccacgaaggcttcgaaaagtcggagggcgatcccgaggaaggcgagcctggcgccttcgcgcccatggaggcgctcaccgccttcatcgcggactcgaacgcggacgccttccgcgccggcttcccgcagcggatgaatgcgcgggactacgaagactggtggatcttcaacacgctcatcctgggcgtggactcgcaggcgaagaatgcctaccacgcctacgacccggccaccggcggcccctggcgcttcatcccctgggacttggacgcgagcttcgggcagacctacgacaccacccggacctcacccacggcgcggcccaatttccgggcggacaacctgctcttccagcgcatgctggccgaccccaccatcgccgggcccttgcgcgagcgctaccgggcgctgctgcacggcagcctgaacgtggaggtcatgcaggccctcatcgacggctacgtccaggagacggcgccttccgcgcggcgtgactgggcgaagtggggcgccaagcaccgcgccttcggcgacccgaatgacccgtggggcggccatggcaacttcccccactggcacacgcgcaaggacttcaactcctacgagaaggaaatcgagtacgtgcgccagtggattcggacccgctgggacgcgctggagagccagttgccctga

SEQ ID NO: 3384 - DNA, 1116 bp, Myxococcus xanthus
caaaaggggaccagcgattccacgaaaccctcacgtccctcgcaggcctcacggcctgccctggccgtgccctacctggagagtcacatggctactcgtaagacgtccaagcgcaatgtcgtcgcccgcaaccgctccaccgaggccaccaaggccgccttcgaggagctcgctcgcaaggcgcgcaacaagcccatcgtctccaccaaggagcaggacgcgcaggaggcccacgcgaagaacgtcctcgcggacgtgtccagcctcaccgccgaatccgccgtgaagaaagtcacggaggcgggcctcaccatcaacaagacgctggccggcatcaacgagcaggtcatctcgctggtggaggagctgaagcagctcgacgaggccatccagctcaagacggaggagctgaacgggctgcacggcaaggacgtggccgccagcgccatcgacgtgctcgtggccgagtacgacaagaagaaggccgagctcgaggcggagatggagcggctccagaaggacatcgaggacacccgggcgaaggccgccgcggaccagtcctccgagcggcaggccaccgaggtctcccgcaagcgcgccgaggaggagtacgcctatgacacccagctccagcgcaagaaggagcaggatgccttcgccgagtcgctgcgccagcaggccgccaccgagcgcgaccgcaaggagaagctggagaaggactgggccacccgcgaggacgccctgaagcagcgtgagaaggagttggaggacctgcgcaagcaggtggcggacttcccgctggtgctcaagaaggagacggacaccgccgcggccatcaccggcaaccgggtgaagtccgagtgggagctcaagctcacgctcgccaccaaggacgcggagacggcgcagcgcgtcgccgccatggagatttcctcgctcaaggagaccgccaccaagcaggcccaggcgctccagacgcttcagacggagctggccgaggccaagcgccaggtccaggccatcgccgagaaggcgctcgagtccgcgtccggcgcccgcgcgctggccgaggtccagggcgtcatcgccagccgcgactacagcaagggcaagtag

SEQ ID NO: 3385 - DNA, 1014 bp, Myxococcus xanthus
cccggcgggactccgtttcccacgcagctactctatgagcgaatcggcggctattggctcacccaggtcattggcacggcggcccgtctgggaatcgcggacctgctctccaagggcccgcggagcagtgacgcgctggcggacgagctcggcatcagcgcggatggcctgtaccggctgctgcgaggcggcatctccgcgggcgtcttccaggaggtcggtgagcggacctttgccctgacgcccatgggcgaagggctccgctcggatatccccggctcgctgcgggacgtggccatcgcgcagagtgaccgcgcccactggctgccctggggccagctcatcgaggccgtccgcaccgggaagtccaccgtccgcgaggccctggggacagacatctgggagcacttcgccaagcaccccgaagaggcgacgcacttcgcccgggccatgggcaacctgtcggccctggtggcccatgagctgacgcaacaggtcgacttctcccccttcgcccatgtggcggacatcggcggcagccagggcgcgctgctagcgcgggtgctgcgcgccaacccctcctgccggggcattcttttcgacctgccgcacgtgctcgaaggcgcgaaggccccaatggaagcccagggcctccatggacgggtggagctggtgggcggcagcttcttcgagccgggcctcccctccgccgaggcctacctcctcaaacacatccttcacgactgggacgaggagtccgccaccgccatcctgcggaacatccatgccgcggcgcccgcgggagcccggctcttcgtgatggagctggtgatgcccgacaaccagacgccctctcccgtgcccctgatggacctcaacatgatggtgctggcggacggacgggagcgcacggccaacgaattccagacactgctgacccggacctcctgggagttggtgggcatccgccccacccaggccggcacgtgcatcatcgaagccgtgaagcgctga

SEQ ID NO: 3386 - DNA, 141 bp, Myxococcus xanthus
atgggcatccccggccgcgcgcaggcccactcggaccaccccgtcgtcgccctggaacagggcgacttcctgctggtgagcctcatccgcaccagccccgaagaaattccgcagaccacgtcgatacgttggaggccctga

SEQ ID NO: 3387 - DNA, 810 bp, Myxococcus xanthus
atggataccgaagcgctcgcccgaatcccgggcgtcaacccgaacgtccccaatgccgcccgcatctacgactacacgttgggaggcacgcaccacttcgaagccgaccggcaagcggcggagtacctgttctcgctggtgccctccacccggaagtgggtgcccatgctgcgcgcctgcctgcgcaccgccgcgcagcgcctggcggccgacggcttccaccattgggtggacttcgcgtcggggctgcccaccggggaccacgtccacgccgtgctgccagacgcccgcgtgctctacagcgacgtcaatccgctcaccatcaccacggcccaccatctgctgggggacacgcctcgcgtccgctacatggaatgcgacatccgccaggcgggcgccttcctgcggcggccggacgtcaatgccttcctggggggagagcgccgcgtcgctttcggcgccaatggcatcaccgtgttcctgtccgcagaggagaaccgccagttcttccgtgacctgtacgactgggcagccccgggctcgaagctgttcaccaccttcgagacgaagtcaccggacctcagcaccccgaagtgggagcagttcgtcggcatgttccggcagatgggcgagtccttccagctctactccctgcccgagtacctggacctgtgtggcccctgggcccgggatgccaccggcgtgctgcccgtgcgcgagttcctcgggctgcccccggagcacatcaccgacgaggaccgtgagggcgtgggcatcgagttctacgccgtcgtcctggagaagcgctga

SEQ ID NO: 3388 - DNA, 294 bp, Myxococcus xanthus
atggaggccctgaaggacctgcgggagagcgagctggcggaggccgacgcgaagctcagccaggccgagtacgaggccctgaagacgaaccaggacgtgcgcgcccagaatctgtccgaggccgacttcgcctccgccacggcggacgcccagcgcaaggtggaggagtcccagcgcaagctccagtcgcagcagcagcaggagcggcaggctcgcgccacctgggagcggatgcgcaaccaggtgcagggctacggcggcagcggcaccgagcacaagcagcgcaatccgtaa

SEQ ID NO: 3389 - DNA, 1599 bp, Myxococcus xanthus
atgtactacatcgtgcgatgtgagcccgcctgcggcggcgccatcgtcacgtcggacgagttccaggccaccgtgcgcggcctccacaacggcttcgcgtacaccttcaaggtcgcggcggtgaacatcaacggggaaggtcccgcctccgtgcagtcggagctggtgacgccgcagcccggcctctccatccccaaccccaccgtcccgggccaaccccgtggcgtccgggccacgccgggcaacggccacgccttcgtgagctggctggctccagccagctacggtggccggccgctgcgccaataccggctgacggcggagccagggggcgtctccgtgatggtggacgcgccggccgcgagcgccgtcatccccggactggtcaacggcgtgccgtaccgcatcaccgtggcggccaccaacgagaagggggaaggccccgtcgcggtcgccaacaccatccagccccgcgccgggggcgagcccaccgaatgggtgacgggctacttcgtgggctaccaactgtggatgcagccggtggacgcggtggacctggcgggcatcacccacctcgtcgtgggccgcgtcaagccgaaccccaacggcaccctcaacgcgaacttcgacgccaacatcgacgacagccacggccgcgccatggccaaggccctggcgacgcgcgcgcaccagcaagggcgcaaggcgctgctgatgctcggcggcttcggcgagcatgagcacttcgtgcacgcggcgtccgaggcccagcgcgcgcacttcatccgcaacatcatccagctcatggacgagctgggctacgacggcatcgacgtcgactgggagcccatcatcctggccgcggacatcccggaaggcgcgcccatggagcccgatgacggagagcccctgctcgcgctgctggagggcctgcgcgccgcgcggccggacatcatcctcacagtgccggtggactggctgaactccaacttcaagatgagccgctatcgcgccgacttcatgaagcaactggcgtcgcgcgtggaccagctcaacatcatgtcctacaagatgagcggtcactggggcggctgggagagctggcactccagtccgctctacggccactcgcagttccaccccacctccgtctcgcactccgtggagggctacctggacgcgggcgtgcccgcgggacggctgggcatgggcattggcttcttcgggacgtgctggggcggcgtgacggagccgaacactcccctggatggtcgtgagggtgtcttcgagggccagagcgacaacttcatgagctacaccaacatcatgacgcactactaccgtgcggacgccagccgctgggacgacgaggcgaaggttccctacctatccttccccaccggccacggcccggggctctgcaactacgtctcctacgaggacccgcgctccatctccgtcaagggccagtacgcgcgcgagaagaacctgggcggcgccatcatctggaccatcagccaggggcacttcctccagccgacgaacggccacagggacccgctgctggacgcggtgaaacacgccttcctggacccgtga

SEQ ID NO: 3390 - DNA, 1401 bp, Myxococcus xanthus
atgcaggtcgtcagtgtgaagaaggccctcgcgggaggggtggaggaggggacgaaggtggaggtccgcggctgggtgcgcacgcgccgcgactccaaggcgggcatcagcttcgtcaacgtcagcgacgggtcgacgttcgaccccatccaggtcgtcgctccgaattcgctgcccaactacgagaaggaaatcctgcacctcaccgcgggctgctcggtcatcagccggggcacgctggtgaagtcccagggcaaggggcaggcctatgaagtccaggcggacgaagtccaggtgctgggcttcgtggacgacccggacacgtaccccatccagcccaagcagcacacgctggagttcctgcgcgacgtggcccacctgcgcgtgcgcaccaacacgttcagcgccgtcacgcgcgtgcggcaccgcgccgcccaggccgtccaccgcttcttcgacgaggagggcttcttctgggtcaacacgcccatcatcaccgcgagcgacgcggagggcgccgggcagatgttccgcgtctccacgctggacgcggtgaatccgccgcgcacgtcggacgggaagattgactggcacaaggacttcttcggcaaggaggcgtacctgaccgtctctggccagctcaacgcggaggcctacgccctggctatgtccaaggtgtacacgttcggccccacgttccgggcggagaactccaacaccacgcggcacctggccgagttctggatgatcgagccggaggttgccttcgcggacctcaacgaggacgcgaacctggccgagcgcttcctcaagcatgtcttcaaggcggtgctcaatgactgtgcgccggacctgaagttcttcgaggagcgggtgcagaaaggcgtcatcgagcgcatggagaagttcatcaactccagcttcgagcgcatcgactacaccgaggccgtcgaaatcctgaagaaggccaagaagaagttcgagttcgagcccgagtggggcaaggacctccagacggagcacgagcgctatctcaccgaggagcacgtgggccggccggtggtggtgatgaactacccggaggccatcaagtccttctacatgcgcctgaacgatgacgggaagacggtcgccgccatggacgtgctcgccccgggcattggcgaaatcatcggcggcagccagcgcgaggagcgcctggatgtgctggatcagcgcatccagaagttcggcctgaagccggagagctaccagtggtaccgcgacctgcggcgctacggctccgtgccacacgcgggcttcgggctcggcttcgagcggctcatcgtctacatgtgcggtctgcagaacatccgggacgcgattccctacccgcgcgtgccgggctccgcggcgttctaa

SEQ ID NO: 3391 - DNA, 1494 bp, Myxococcus xanthus
ctgggggagcgcgtgctggccgcgctgcgagaagcgcgcgtcacggtgtggatgaccgcgcagtccgccaatggccagtcactggccgtcgtcgtgcctcgccccgacgcggagcacgcgcggtccgtgctcgtcaccgagctggcgcaggagctgtcacgccgcgaagtggaaccgctggaggtccgccagccggtgacgctgctgacgctggtggcggagaccatgggccacggcgtcaacgtggccgggcgcttcttcagcgcgctgggcgcggtgggcgtcaacgtgcgcgccagcgcccagggtgccagctcccgctccctttcgtgtgtcgtcgacgcggcggacaccgccgtcgccgcgcgcaccacgcacgcggccttcaacctggcccatcagcaggtgagcctcttcgtcctcggccgaggcacggtgggcggacaactgctggcccagctgcgcgcccagcaagcgctgctccgggacaggcacggcatcgcgctgcgcgtcgtggggctggcggacagcaagcgcgcgctcttcgacgcggcggggctcacgctcgatggcgtggaggcgcggctcgaaggcgtgacgcccgaggcgccccaggcgcgcaccctggtccccttgttggacgcgctccggcggctgcccgtccccatcctggtcgactgcaccgccgcgggcgggttggaggcgctctacacggaggccttccagcgcggcatccacgtggtggcggccaacaagaagccgctggcgctgccgtgggaggcccgcgaagcgctggtggacacggcgcgccgcaaccacgtcgcgtaccactacgagacgacggtggcgtccagcctgcccgtcatcgacacgctggcgaacctggtgcgcaccggtgacaccgttcgcctcatcaccgcgtccctgtccggcagcctgggcttcatctgcaacgaactgacggccggcgtgcccctgtcccgggccgtccgcaccgcccgggagcgcggcttcacggagccggaccctcgcgaggacctgagcggcacggacgtcgcgcgcaaggcgctcatcctcgctcgggagctgggcctgccgctctccctgtcggacgtggcgctggagcccttcgtcgccacggacgaatgcgccagcgtggactcgttcttccaggtgctcgccacgcaggatgcggcctacgcggagcgcgtggcccgctgccgccacgccggcaccgtgctgcgctacctggcacgcatcgacccatcgaaggcgggcacaggcagtcccgtcatccgtgtgggccccgtaggcgttgaagcgggccaccccgcggcggacctccgcggctccgagtccttcgtctccttcaccaccacccgccacagcgacttcccgctcaccgttcgaggcgcgggcgcgggcggcgccgtcaccgcgtccggcgtgctggcggacatcctccgcatctcccagacgctgcgcggtcgctga

SEQ ID NO: 3392 - DNA, 1491 bp, Myxococcus xanthus
agcgcgagcttctgcacgctcgccatcgaactggcggccagccgcatcctggcgcctaccgtgggtgtttccctgctgagctggacaggcatcatcggcgtggtgctgacgggcatggcgctgggcaacttcctgggcggccacctggcggaccggtggccccggcaggaggtgctcgccggctccatgctgctggcggcggccagctgcctgctgattccgcccatccatcagtggctggtgctgaagggctacttcgacggcctgggcctgcaggctcgcatcgtcgggtacacggccgcggtgttcctgctgccggtgacggccctgggcacgctgtcaccccaggtgctccggttggcgctggcggacgtggagcgggcggggcgcaccgtgggccggttgtacgcgtggagcaccgcgggtgcgctgctgggctcgttcctcaccggctggtggctcatcgcgaaggtgggcgtctacccgctggtcatgggagccagcctgggcctggtggcgctggcggccttcgtggggcaggtgtggcggcggcccctcttcgtcggcgccaccgcgggcacgctcgcgctggcgggcatgttcggcgcgctggggctgttcgcgtcgccgtgcacggaggagacggactacttctgcatcaaggtcaaccaggtggagcatgacggtcggcggctgctggccatgcaactggaccacctgacgcacaccatggtggacctggaggacccgtcgtacctgggctacccgcacgggtacatccactcggaggtggtgcgccacgtggccgcgcgcaccgcggagccccgggtactcgtgattggcggcggcggctacgtggtgccgcgctgggtggagacctacgtcccgcaggtccggatggaggtggtggagatagacccggccgtgacgcgcatcgcgctggagcgcttcggtgtgaagccggacacgcgcatcgcctccttcagcctggatgggcggcagtacctccaggagatggcggagcgcggcgcgtacgacttgattgtccaggacgcggtgaacgacctgtcggtgccctaccacctgatgacgcgcgagtacgacatgctggtgcgctcgctgctcaagccggacggcctctacctgctgaccgtcatcgacgagattccccggggctcctttctgcgctcggccctccggacgatgcaggaggtcttcccccacgtggagctgctccacgacgcccgcagtggctccaaggggcagggtgtctacatcgtcgcgggctcggcacggcccatggaactggagcgtctcccggagctgctgcgcggcgtgggcatcgagcagccgcgcacaggccgggtgcctcgcgcggagattgacgcctatctggccgcgggccccgcgttgctgctcacggatgacttcgctccggtggacaacctgctcgcggagctcttcctcctccgcgaacaggtcgcgccgtag

SEQ ID NO: 3393 - DNA, 1455 bp, Myxococcus xanthus
atggcctcccgttcgttcgcgcttccgctgtgcgtcatgttgctcgcgcttgccgcgccggcacggggggcggtggtgcgcccgggcttgcctcctcccgaagaggtcatggcgacgctgcggcagttggagacggcccgggcacgcggccgtgccagcgcgatggacagcgagctggaagagcagtcacgggtccggcccggggatttgatgccgcggatgtaccgggcgtggctcacctttccctcggacgcgtgctggaacgagctgaaggcgctctccaccctggacccggagaatccgtggcccttcgtgggcatggggctcatctacgtgcggtgggggctgctggcggaggcgcgaccgcccatcgccgccgccctgaagcaggtccctggcttcgcaccagcgctgtgggcgcagggcgtgttgctccaagcggagggcaagcccgcggaggcggaagtccggctgcgtgaggcgctcgctcagttggatgcgccgcagattcggacgtccctggccatgttgctggcggggattcccgagcgggaagcggacgcgcgcgcggagctgacgcggaccgtggaggcgtggcccgagcagcccgaggcgctgcggaagctggcgcagttggcccgcgcagccaacgacgtgcgtgcggcggcgaccgcgggcgagaagctggtggccctcaagccccgggacaaagatgcgcaccggctccaggccgacctgtggctggccgcctcggagaaggagaaggccgccgggtcgctggagcgctacgcggagctgggcggcatggagcctgcggccctggggttgctggtgcggttgtatcgggagctgggccgcgccgacgtggaggacaaggccctggtccggctcgtcgccgccgcgccagaagacccggagccgttgcttcgcctggccgagctggccgaagcgcgcggagattccaaggcggccgaaacccacctggtgaaggcttccgagcgagcgcccgcccgcgccgacatccacgtgctgcgggcccgattggtgttgaagcaggagcgtcaccaggatgcgctggccgcctaccgcgcggcgctggctgcgcccgagcgccgggtcgccgaggccgagagcgaagccgccgcgctggtgcgccacttccggttgccgtcccagcccgctcgggggacccaggaccagatatacaaccgggtgtcattgggcctggtcgcgctctacatgaaccggctccagcagacgccgggcatcaaaggcaacctcaaggttcaagtccaggtagacgcgtccggccgggccaccggcgtgacggtgctctatgacagcctcaacgaagcggtcatcaccggccacgcccacttcgcgttcatggacgcgcagtacccgccggggcccgacacgcccgtgttccagtacgtcttccgtccgccgaagtga

SEQ ID NO: 3394 - DNA, 1752 bp, Myxococcus xanthus
atggtgaacccccatcgcaggtctcggctggcgagcgcgttgctcgcatctcttctcttcacattggtggcctgtaacggcgggggaggctcgacgaagcccgatgccggcaccggcccgaacaccccggacgggtcgacgccggatgctggcgacgactgtggtgacggccagcgccagtccggcgaggcctgtgacgacggcaacagggtggacggtgacggctgtaacgcgacgtgcaccacggtggagggcgggttcatctgcgaggtgccaggagcgccgtgcgtccacctggtgaactgcggaaacggccgcgtcgaggacggcgaggagtgcgacgaccggaacctggtcagcggtgatggttgcaacgggagctgccgggtcgaacgtggctgggcgtgcccggcccagggtggccgctgccgcgccaaggagtgcggtgacaacatcatcgccggtgatgaggagtgcgaggatggcaacaccactccgggcgacggctgcagcgacgtctgccggctcgaggaaggctggaagtgcccgccgggtcagccgtgcagccgcaccacctgtggtgacggcatcaccgagggcaccgagcagtgcgacgacggcaacaccgtgatgggtgacggctgctcgccgctgtgcaccaaggagccccgctgctcggatggaaactgcgaggagacgtgcggcgacgggctcatcctccccaacagcgccgttgaggagtgcgacgacggcaacacgcgcgccaatgacggctgctcgccggactgcaagttggaggatggcttcgcgtgcgtgctcatcgagcaggagccgccggcgcaggtgtccatccccgtcgtctaccgtgacttccgcggttgggacctgcccgccgatccggcgaatgacctgccccgcggccacgaggacttccagaaccggaacgcgggccgtgaggatggcatcgtcgagaaccggctcgatgccaatggccgccccgtctacgcgaaggaaggacaggcgtcgaacaacaccagcaaccgggccaatttcgaccagtggtacaaggcggtcgagaacgtcaacaagaccatcgtcggctccttcgtgctggggcggcagtccgatggctcgtacgtgttcgataacgatgcgttcttcccgctcgacgatgtcagcggcagttgggtggccgagggccacgagccgctgcgcagggacttggcgaggcagcagcgcaacttccacttcaccagcgaggcccgctactggttcgagtacaagggctccgaggagctgacgttccgcggtgacgacgacgtgtgggtcttcgtcaacggccggctggcgctggacctgggcggcgtgcacggcccggcggatggcaccatcttcatgtcgggccaggcgagcacgctggggctgcggcggggcggcatctacgaggtggtggtgttccaggccgagcgccacaccgagggctcgtcgtaccgcctcacgctcaacaacttcctcaccgcccgcaccgagtgcaccgccacctgcggcgacggcgtggtggacgcggatgccggcgaggagtgcgacgacggcgtcaacgcgggtggctatggtgagtgcggccgtggctgcctctggggcccccgatgcggcgacggcgaaacccaggagaacgagggcgaggagtgcgacgacggcaacaccgtcagccgcgatggttgcagctcaacgtgccggctggagattggctga

SEQ ID NO: 3395 - DNA, 1239 bp, Myxococcus xanthus
ctccacgactacatgcgggagcaatacccccggcttcatcaggcgctgaagcgcgagcccgtgggggcgcactcggtgctgtacacctggacggggacggacgcgtcgctgcgcccggcgctgctgctggggcacctggacgtggtgcccgtggagcccggcacggaggcgtcctggactcacccgccctatagcgggctggtggcggacggctatgtctggggccggggcgcgctggacgacaaggggagcgtgttcggcatcctggagtcggtggaggcgctgctcgcggcgggcttccagcccaagcgcacggtgctgctcgccttcggtggggatgaagaggtgggtgggcgcgagggcgcggaggcgatggcgaagctgctccgcgagcggggcgtgacgctggaatccgtgctggacgagggcgggatgattgtgtccggcaccgtgcccggcgtggcctcaccggtggccctggtcggcgtgtcggagaagggcttcgccagcgcggagttggtggcggatggcgaaggcggccattcgtccatgccgccgccccagacggccgtgggcgtgctgagccgcgccatctcccggctggaggatgcgcccatgcccgcgaagctgcgcggtggcagccgggccctgttcgagttcgcggggccggagatgggcttcgggatgcgcacgctcttcgccaacctgtggctgttcgagccgctggtgctgcgccagctcaccgcgaaggccaccaccaacgcggcggtgcgcaccaccaccgcggccaccatgttcgagggcagcgagcgcgacaacgtgctgcccgcccgcgcccgcgcggtggtgaacttccgcatcctccccggagactccgtggcgggcgtgctggagcacgtgcggcgcgtggtggatgacccgcgggtgaaggtgcgcacgctgggcttcatcagtgaaccgtcgcccgtgtcgcgcatggactccgaggcgtggtcgcagctccagcgcagcgtgcgccaggtgttccccgacgtcgtcgtggccccgtacctcatgctgggcgcgacggattcgcgctacttcaccgggctgagtgagaacgtctaccgcttcatgccgctgcgcctggacggcgccgacctgtcacgcctccacggcaaggacgagcgcgtgtcggtgaagggctacgcggacgcggtgcgcttctatgcccaatacgtccgcaacgtggcccagtga

SEQ ID NO: 3396 - DNA, 1176 bp, Myxococcus xanthus
ctgttcacgtctgaatccgtcactgaaggccacccggacaagatcgccgaccagatctccgacggtgtgctggatgccatcatcgccaaggaccctcaggcgcgcgtcgccgtggagacgctcgtcaagacgggcctcgccatcgtcgcgggtgaggtgacgacgaactgttacgtggacatcccgaagctcgtccgcagcaccatctgccgcatcgggtacaccgacagctccatgggctacgacggcaacacctgcggcgtcatggtggccatcgaaggccagagccaggacatcgcccggggtgtcgacaacaagaaggaccagggcgccggcgaccagggcatgatgttcggcttcgcctgcgacgagacgccggagctgatgccggctcccatccactacgcgcacgccatcacccgccgcctggcggatgtgcgtcgcaagcagcacccgtggatccgcccggacggcaagagccaggtgacggtggagtaccgcgacggccgccccgcccgcatcgacgcggtggtggtgtccacgcagcactccgatgaggtctccaacaagaagatccaggaggccatccgcgaggacgtcatcgcgaacgcgctgcccaagaagctcatcgacaacaagacgaagttcttcatcaaccccaccggtcgcttggtggcgggtggccccatgggtgactccggcctgacgggccggaagatcatcgtggacacctacggcggcatgggccgtcacggtggcggcgcgttcagtggcaaggacccgtccaaggtggaccgctcggccgcgtacatgggccgtcacatcgccaagacggtggtggccgcgggcctggcccggcgctgcgaggtgcaggtgtcctacgccatcggcgtggccgagcccgtcagcgtcatggtggagaccttcggcaccgccacggttccggaagagcgcatcgccctggccgtccgcaagacgttcggcctgcgtccgcgcgaaatcaccgagtacctgaacctgctgcggcccatctaccagaagaccgccgcctacggtcacttcggccgcacggagaaggagttcacctgggagcgcgtcgaggagaagaaggacgcgctgcgggatgccgccaagagcgccacgccgtcaggtggccgccgcctgaaggccgtctga

SEQ ID NO: 3397 - DNA, 894 bp, Myxococcus xanthus
atgagcctcctcgaagccatcgtcctgggtctggtccagggtctcacggagttccttcccatcagctccacggcgcacttgcgcatcgcgccggagctgttcggctggagggacccgggcgcggcgtactcggcggtcatccagttgggcacggtggcggccgtgctcatctacttccgcaaggacatcgtgtcgctggtggcggccttcttccgggggttggcgcggcgcgagcccttcggcacgctggaggcgcggctggcgtggttcgtcctggtgggcacgctgcctgtcggtatcgccgggctgacgttgaagaagttcatcgagaacgagttccgctcgctctacgtcatctccggaagcctcatcgtgctggccctcatcctcctcgtggtggagaagcgggcctcgcaccagcggacgctggcggacatgcggtggaaggatggcatcctcatcggcatgtggcaggcgctggcgctgattccgggtgcgtctcgctctggcacgacgctgacgggcggcctgtcgctggggctcaagcgcgaggatgcggcacgctactcgttcctgctgtccatcccggccaccacgctggcgggcgtcttcgagctcaagcacctgctggaggcggagacgcggccttccgcgatggcgctctgggtggggacgctggtggccttcgcgtcgggcatggcggccatcgcgtggctgttgcgcttcctgcgcacgcggacgacgttggtgttcgtggtgtaccgcgtggcgctgggcgtgctgctgctggtgctgctccagacggggaagctgagcccgatgtcgggagtggagaacgtggaggtccctggcgagccaggggctccgccggtggagaagcagattaccgactag

SEQ ID NO: 3398 - DNA, 537 bp, Myxococcus xanthus
cgtgaggtgcacctgccggggtggaccctgcgggaggcctcggtgctggtgccggtgttcgagcgggacggcgtgccccacgtgctcttcacgcgcaggcccgcgacgctgcggacgcatgcggatcagtacagcttcccggggggaggccgcgaccccgaggacgcgacgcccctgcacacggcgctgcgcgagacggaagaggaactgggcatcgaccggcgcggcgtgcgggtgctggggatgctggatgaggtgcccacgatttcgcagtaccgggtgcggcccttcgtgggcgtgattcccggggacgggaagtaccggccgagcgcggaggaggtggccttcatcctggaggtgccactgtcggggctgttggacccgtccatcctccgcgtggagcagaaggaaatcatgggggcggagcgggacctgtacttctacacgtatgggacgcacgtcatctggggcgcgacggcgcgcatcctgcgcgacttcctgaaccacgtgacgcaggtgcctggcggggcggggtag

SEQ ID NO: 3399 - DNA, 972 bp, Myxococcus xanthus
ctctcgcgcttgatggcgatgcctctccatgcactggccgcggacgcgctgccgtcgtggaacgaagggcccgtgaagcaggccatcatcgacttcgtcgcccgcgccaccaccaagggtggggccggcttcgttccgcccgaggcgcgcatcgccaccttcgacaacgatggcacgctctggccggagcagccgctcgtacagggcgctttcatgctgaagccgctccgttcccgcgtgaaggaggacccgtcgctcgcgaagcggcagccgttcaaggcgatcctggagggggacctctccgaactctccaccatggacaagtccaagctgatgaaggtgctgggagtgacccatgccggcatgaccgaagaggcgttcatccgcaaggtccgcgcgttcttccaacacgctcgccaccccaggtggagcgttccgtacaaccaactggcctacgcccccatgctggagttgctccggtacctgcgcgcgaacggtttccagacctggctcgcctcggcggggggcatcgacttcatgcgtgtcatctccgaggacacctacggcatcccgccccagcaggtcatcggcagccatctgaagaagaccttcgacgacgcgcacgctccctcggtcctgcgccgagaggcgcgcgtcgcccacgtcaatgacaaggcgggcaaaccggtgggcatcgacgagcacatcggccggcggcccgtcttcgcggcgggcaacgtgcgctccggcggcgacatccagatgctccagtacacgcgaaagcgcccgcgcccaggcttcgccttgctcatccaccacgacgacgcggcgcgcgagttcgcctacgaggagaaggacggcgcgtcattgaaggccgcgcgagagggcggctgggccgtggtcagcatgcggcgggattggaggcgcatcttcgatgaaacgcgagcacggactgggaacgggaggggatga

SEQ ID NO: 3400 - DNA, 195 bp, Myxococcus xanthus
  unsure (1)..(195): unsure at all n locations
atgacgcaggtggtggcccctcgacggtcgcccgccgacttcgngcggntgcccttcgcccccctcttcctgcccggcatgttcgacccgcccaccgccgcgcgagagctgtcggattccgcgcgcgaagaggagccggagctgctgagcgcctccggtgagctgccgacgctgcgcgagacgagaaaccgctga

SEQ ID NO: 3401 - DNA, 726 bp, Myxococcus xanthus
atgacggcgcccgcggccacggcccggctgccggtgacggtgctctccggcttcctgggggcgggcaagacgacgctgctcaaccacatcctccagaaccgggagggcctgcgggtggcggtcatcgtcaacgacatgagcgaggtgaacatcgacggccggctggtgaagacgggcggcggcgcgctgagccgcgtggacgagaagctggtggagctgtccaacggctgcatctgctgcacgctgcgcgaggacctgctgctggaggtctcccggctcgcccgggaaggccgcttcgactacctgctcatcgaatccaccggcatctccgaaccgctgcccgtcgcggagacgttcaccttcacggacgagcagggccaaggactgtcggacgtcgcgcggctggacacgctcgtcacggtggtggacgccctcaacttcctgcgggactggagcgccgcagatgacctcgccacgcgcggactggccgcggcggacgaggacgagcgcaccgtggtggacctgctggtggagcaggtggagttcgcggacgtgctcgtcctcaacaagacggacctcgtcccggcggaggagctggcccggctgaaggacatcctgcgcaagctcaacccggacgcgcacctcgttacctccgaacggggccgcgtgccaccctccgccgtgctcaacacgggccgcttcgacttcgaacgcgcacggggcgcc

SEQ ID NO: 3402 - DNA, 618 bp, Myxococcus xanthus
ggacccgtggcctgtttcacgcggcccgagatgaaggccgagcgcgtcagctacgaggtgatgacgccctcagcggcacgtggggtgctggaggccatcctgtggaagccggccattcgttggcacgtccacgaaatcgccgtgctcgcgccggtgcggtggaccagcttccgccgtaacgaggtcaacagccgggccactgtggggaagttcgactacgcggcggacgaggaccgggcccagcgcaacacggtggcgctgcgagacgtggactacgtcatcaccgcgtccttcgccctggtgccgggcaaggcggggcccgatgacaacgtgcgcaagttcgaggacatgttcgagcggcgtctggagcgaggccagttcttccatgcgccctacctgggatgccgtgagttcgcggcgcgcgtcgagcccgcggaggacgtcctgttgccgcatgagtcaggccaggggcggaggccgctgggcctcatgttctacgacttcgtcttcgacattcctggagagccggtgcgccctgagttcttccaggcgttcctggaggacggcgtgctgcgtgtgccgcctcgggcgcaggtgctggggggaggcgttccatga

SEQ ID NO: 3403 - DNA, 2170 bp, Myxococcus xanthus
atgaaactcgccaccgctctcgtccacgccggcgtgcgccgcgaccccaccaccggcgcggtcgccgtccccatctaccaatccgccaccttccagcaccccgcgctcgggcaatccaccggctacgactactcgcgcacgcgaaaccccacccgctccgcgctggaggatgcgctggcgcaactggagggtggcagccggggcctggccttcagctccggcatggcggcgctgcactgtgccctccagctcttcggcccggaggaccacatcctcctcaccgaggacctctacggcggcacctaccggctggtggaccgcatcctccacgtcccctgcaccttcgtggacacctcacaccccagcgccgtgcgggacgcgctgcgccccaacacccgcgccatcgtcgtggagacgcccaccaacccgatgatgcgcaccgccgacctctccgaactggcggccattgcccgcaaggccggggtgctgctcatcgtcgacaacaccttcctcacgccgtggttgcaacgcccgctggagctgggcgcggacatcgtcgtgcacagcgcgacgaagtacctggccggacacaacgacgtcgtcgcgggcgcgctggtggtcaaggacgccgcgctgggcgagcggctggcgtacctccagaacggcatcggcgcgattctcggtccgcaggacgcgtacctggtgattcgcggcctgaagacgctggccctgcgcatggagcggcaccaggccaacgcgcgggaagtggccgcgtggctgcgcgcccacccgggcgtggagcgcgtcttctatcccggcgtgggcggaatgctgtccttcaccgtcgcccacgcggccctggtgccccaggtgctcgcgtccgtgcagttgtgtctcttcgccgagtcgctcggcggcgttgaaacgctcatcacctaccccaccacgcagacccacgctgacatccccgccgagcgccgggaggcgctgggcatctccgaccggctgctccggctctccgtaggaatcgaggactcccatgacatcatcgccgacctggcccaggcgcttcgcgacccgtctgctgcacacggggcatgagcaggaccccaccacgggcgccgccgctgtccccatctaccaggtgtccatgttcgaccagccgggcctggagacgcccggcgagttcgactacgcgcgctccggcaatcccacgcgcaaggccctggagggcgtgctcgcggcactggacgaaggccacgcggcctttgccttcggctctggcatggccgccgtgtccagcgtgctgatgctcttcagcgcgggggaccacgtcgtcgtgacggacgactgttacggcggcacctaccgggtgctcacacgcgtcttcagccgcttcggcctgcaggccaccttcgtggacaccagcgacccggacgccgtgcgcgcagccctccgccccaacacacgagcgctgctggtggagagcgtgagcaatcccttcctcaagcgcaccgacatccccgcgatggcgcgggtggcccaggcgcatggggcgctgctcatcgtggacaacacgttcctgtccccggccctctcgcgtccgctgaccgagggcgcggacatcgtcatccactccgccaccaagtacctcggcggccacagtgacgtcgtcgccggtgcggtggtggtgaagacgcccgcgctcgcgcaggagctcggcttcctccagaacgcggtgggcgcagtgctgggaccccaggactgcttcctcctccagcggggcatcaagacgctgcaggtccgcctggagcgacaggtgcgcacggcgggagccctggcgaagtggctcaccgagcggccggaggtgcggcgggtcttctatccgggcacgggcgcggtggtgtcgttccggctggcccaggacacgctggcggcgcccttcgtggaatcgctccagctccccctgctgggtgtgtcgctgggcgcggtggagagcatcgtcaccgtccctgcgcggcactcccacgcctccgtgcccgtcgccgagcgggagcgccgaggcatcaccgacggactcatccgcttctcggtgggactggaggacctggaggacctgcaagaggacttcgtgcgggcattcacgcaggcagaccgcgcggcggcatag

SEQ ID NO: 3404 - DNA, 165 bp, Myxococcus xanthus
atgcccaagggaaaccgcaccatcatccatctcgtgtcgtcggcggggactggctacgtctacacaacgacgaagaacaagcggaagtcgcaggagaagctccagctcaggaagtacgacccgcgcgtgcgcaagcatgtgctgttcgtggagggcaagccatga

SEQ ID NO: 3405 - DNA, 120 bp, Myxococcus xanthus
atgaccattgccctgctgtgcctggcgggcctgcgtcccctggagcgcgccatcaggcgttaccggaagcggcgcagcgcgactcgcgccccggacgtggacgaagacgccgaggcttag

SEQ ID NO: 3406 - DNA, 597 bp, Myxococcus xanthus
atgatgaagcgactgttgcccgtgctcgggctgggcctgctgtccggatgctccgcggtgaagaatcagcggctgcgcagtgactacgacacggtggacaagcaccaggtgaagcgactggtggtggtgacgcagccgctgcccgacggcaaggtcgccgtgggcgagctgtggagcctcatcgcccgccagtgggtgaaccagaaccgcgacttcctggtgaaggagagcgcggcgctgcccgacgtgcccacggacgccacgttcaagacgctgtgcgtggaggggctggagggcgtgctctggctgtctccccagattcagctccggggcagcggcgcggaggccgcggtgagcgcgaagctggtgcgctgccgcgacggtgaagaggtctggtccgccgacgccgccgggagctggaactccaaggacgaggactacgagcagcgcgtgggtcagtacgtccaggagctgggtgaagaagtggcgccctacgtggtgccatccagcaagctgctgacggccacgctggccaccttgcccaatcccgaactgagcgaagcggacaaggacgagaaaatcgagctgggtgagtag

SEQ ID NO: 3407 - DNA, 2592 bp, Myxococcus xanthus
atgctggccctgctggccgtgtcgctgtgggggacgtcgaagcttcacatcaactccaaccagctcgacctcatctcccaggacctggaagaggtgaaggacgtcaagcaggtcatcgacatggtgggcggcagcggcttcctcatggtcgccctgcgctcggaggacgaggccgcgctcaagcgcaccgccgacgatctcgcgaaaatcatgcaggacgacaaggagaacgtccgcaacgtctcctacaagctgcccgtcgagttcatccagcagaacatggtcctcttcgtgaagacggaggacctggtcgagggcaagcgccgcatcatggcgttcctgcgcgacaagctgaagcgcagcaacccgttcttcatcgacctgggcggctccaagcccgtcgagctcgacatgcaggacctggtcgacaagtactcttccattggcaagaagagcatccgcgacgactacaacatctccaacgacaagaagatgttgatgctgctcgtcaagccgatgtgggacaacaccgaaatcggcaagacgaaggactatctcgagcggctcaagggccagattgacgcgtactccgcgcagccgggcaaggtgaagctggtggaggactacaagctgatgggtgatgggaagaccatcgcctacggcttcaccggttcctacaagacgacggtggatgactccttcgcgattgaagagtcgctggagccggtgacgctcatcgccctgggctccatcttcctcatcaccatcatcttcttccgcaagctggcgccgaccttcctggtcgtcatcggcacggtggtgggcacgatttatacgctcgggttcacctacgcgacggtgggcgagctgaacatgattacgtccatcctgggcggcatcctgctcggcttcggcatcgactacggcatccacttcgtcttccgcacgcggctggagttgggcgcgggcaagccgtacgacgtggccatccgggacgcggtgatgaacgcgggccgtccggccgcggtggccgcggtggtgacggcgggctccttcttcgtgctgatggtcagcgagttccgcggcttcagccagttcggcttcctggccggcatgggcacgctcatcctgggcctgacgctgttctgctggagcgcggccatcctggcgctggccggccgcatcaacccggagctgccccagaagctcatcggcgtgatgaagccgccgcccaccaactccgccaccaccggcaaggagctgcgcatccccaagccgaagatggtgctgggcatcagcacggccatcgtcgcgctcatctgcgccgccgcggtgccctgggccggttcggaggagccgcccaagggcgtggagctgggcttcttcgagcgcctcaagtacggcgtgagcttcaactacaacacccgcgcgctcatccccgacggcatgtcgtccgtgctgctccaggacgaaatcaacgagcgcttcaacatctccagcgacccgatggccatctacaccaaggacctggacgaggccgaaggtgtgtaccgggagctgacgcagaacgcgcacaagtacccctccatcgaccaggtggtgagcatcttcaccttcgtgcccccggcggagacggccgcggccaacgccaaggtgctggaggagtggaaggcggagatgcagcagttggaggacgagggcttctccgtcgccgcgctgccgccggagatgcaggccaacgcggacttcttcaagaaggtgctggacgccaagcccttcgacgtccacggcgtcccggccaactacaccgcgcagttccgcaacctgccctccgcgaagccggagaaccacggctacctcacgtacatctacgcgagcgtggacctgatggacggccagaagatgctgaagttctccgacgagacgaaggtcatcaaggccgcgtacacgccgggcaagttcgaccaggacgcgtgggaccccaaggcccccacggtggagaaggagttccgcgccgcgggcgccacgcagctctacgcgcggctggcgcgcatcgtcctctgggacggcaaggtcaccgtggtgctcaccgcgatctggattctggccatgcacttcctggacttccgcaacgtgaagctggcgctggcgtccgtgattccgctcggcgtgggcgtggcgatgatgctgggcatcatggcgctgacggggctgcgcctgaacttcatgaacatcatcatcctgcccatcctcctgggcttcggggtgagtcacggcctctacctgctccatcgcttcctggagggcacatcccccctggtggccctgcgcagcgtgggcgcggccgtcgcgtcctccacgctcactgccgtggtggccttcgcggcgctgctggccgcggcccacaacggcctgcgctccatgggtctggtagcgtgcattggcctcatcaccacgctggtggtgtccttcacggtgctggccgcggtgatgcagctcatgtacgaccggcgtcagcgcgagtcgggcgcgtcctccggtgagggcggctcgactggcggtggcaaggactccgagccgaaggcggcctga

SEQ ID NO: 3408 - DNA, 2064 bp, Myxococcus xanthus
atgcagtacgcgccccgggcgccgggccactccgccgtgcgggatttgtaccggctgctgtgcgacgtgcccgagggcggcctggaggaccggctccaatgggtggagcgctggatgcagtggctgcgcgagcgcatccccgcccacgcgctggtggacgcctccgaacccgaggtctccgccgccgacagccggctggccctgatggtgcgcgtgctcgaaggcgagcccgccatgcgcgccgccctcacgcggctggtggccgccgtgttcgagggcagccggggcctcaagctcttcgcccaggtagggctgcccgccggacagggcttcttcgcggaggcgtcggaccggctcgcccgttcgctgctgcccgcccctccggagcgcggcaagctgtcggagctgctgctgcgcctgtgcccgaacccggacgacgcggattggctggcacggctgtcccccgcacggctcgcgcagctcgcggcgctggtcggcgaacccgcgtcgccagagcccatgcccgccgcccgcgtgcgcgcggatttgatggacgcgctgctgctgctggcggtgcaggtggcggccctgggcatcgccgaggacgtgcgcgaccgcagcccggagacgtccttccgcgcctcgcccttcctgcggatgcggctggtctgtgacgcggtcctggcgcgcgacgcggcggcggacacgctgcgggatttatcgcaatgcgtggccgactgccgccaggtggtggccagcgtgtcacgccacctggaggactcgggcgtcagcgtggacctggtgtaccggctggagcgcatccgccggggcctggagcgcatggaggccattgcccgagtgctgggggcccctcgaggcgaagcgcgctggcgcgaggccatgacgctggtgtcggacctgctgcggcgcgcgcacgcggaccgctccgtggtggagctggtgaagcgcaacatgcggatgctggcgcgcaaaatcatcgaacgcgcggggcactccggcgagcactacatcaccagcactcgcgagggcttccacgcgatggtgcactccgcggcgggcggcgggctggtgacggcgatcgcggtggtcaccaagacgttcctgtcgggcctgatgctggcgcccttcttctccttcctggccgtgggcctcaactacgccctggccttcctcctcatccaagcgctgggcttcaccctggccaccaagcagccgtccgtgacggcggccacgctggcgggcgcggtgggggaaggtgcccgggggcagcggctggcgagcctggtggagctcatcccgcgaatcacccgttcccagttggcggccttcatgggcaacctgggcgtggtggccccgacggccatcgtgttcgcgctggggtacgagttcatcaccggccacaccttcatgagcccggccaaggcccaggccacgttggcctcgctgcatccgtggaagagcggcacgttgatattcgccgccatcacgggcgtttttctgtggatgagcagcgtggcgggcggttggctggagaacttcgtggtgtaccggcggctgcccgaggcgctggcccaccaccgcgtgctgcggcggcttctgggggaggcccgcgcccggcgcctggcggataccttccagcacgcggcatctggcctgggggccaacgtgacactgggcttcctgctggtcctgggaccgttggtgggcggcttcttcgggctggggctggacgtgcgccacgtcaccttcgtgctcggcttgatttccctggcgggcacggcgatggggcccggcgcggtgctccagccggagttcctggccgcgctggcgggcatggccttcaccggcctcatcaacttcggggtgtccttctcgctggcgctgggggtggccgtccgcgcccgcgacgtcccggcccgcgaggccctgcccttcctgcgcgccgtgctctcgcacctggtgaagcacccgcgctcgttccttttacctcccaaggaaccggaaaacgacgtgctgcgggtctccgcgccgcccgcccactga

SEQ ID NO: 3409 - DNA, 576 bp, Myxococcus xanthus
atgaacgcccgcttccgtaccctcgccttcctggccaccttcgccttcgccctccccgcgctcgccgcgaaggaagaccccatcgccaagccggtgaagaccgtggtgcagtccgtgcgctacgagcgcgacgccctggccctcaagcacttcggcagccaggagcagggaaagttcctgctcggcgataactgggacaagggcaccgatgcgcagcgcaaggagttcgtcacgctgttccaggacctcttcgcgaacatcgccttcccccgcgtgcgggagaacttcaagaacctggacagcatcacctacgagccctcgcaggtgcagggccccgaggccacggtggcctccaccgtcttcatcaagcacccgctgaagacgcaggagatgaagctcaagtatcggctggtgaaggaagccgccgcctggaaggtcgtggacgtgacggtgctgggctcgtccatgctccaggacatccgggacacgcaggtgaagccgctgatggagaagggcggctgggacctgttgctggagcgcatgcgcacggagctggcgaaggtgaagaagaagtag

SEQ ID NO: 3410 - DNA, 1431 bp, Myxococcus xanthus
atgaccgccgcaaccaagtccctgaagcaggattacgccatcgccgacctgtcgctcgccgactggggccgcaaggaaatccgcatcgccgagagcgaaatgcccgcgctcatggccatccgcgaggagtacgccaagacgcagccgctcaagggcgcgcgcgtgacgggctcgctgcacatgaccatccagacggccgtgctggtggagacgctccaggcgctgggcgccgaggtccgctgggcgtcgtgcaacatcttctccacgcaggaccacgccgccgccgcgctggtgcaggccggcacgccggtgttcgcgcacaagggcgagtccctcaaggagtactgggacttcacccaccgcatcttcgacttcggccccgcgggcagcgaccacgagggtccgaacatgattctggacgacggtggtgacgccacgctgctcatgcacctgggcaagcgcgcggagaaggacgccagcgtcctcgccaacccccagagcgaggaagagcgcgagctgtacgccgccatcaaggcgaagctggccgaggacgcgacctggtacacacgcaagagcgcgaagattctcggcgtcaccgaggagaccaccacgggcgtgcaccgcctccaggaaatgtccgccaagggcacgctcctgttccgcgccatcaacgtcaacgacagcgtgacgaagagcaagttcgacaacctgtacggttgccgtgagtcgctggtggacggcatcaagcgcgccacggacgtgatggtcgccggcaagattgccgtcgtcgcgggctacggcgacgtgggcaagggctccgcgcaggcgctgcgcgcgctgtccgcccaggtgtgggtgacggagatcgaccccatctgcgcgctccaggcggccatggagggctaccgcgtcgtcaccatggactacgccgcggacaaggcggacatcttcgtcaccgccaccggcaacaagggcgtcatcacccatgaccacatggccaagatgaaggaccaggccatcgtctgcaacatcggccacttcgacaacgaaatcgaggtcgcctccctggagaagtacaagtgggaggagatcaagccgcaggtcgaccacatcatcttcccggacaacaagcgcatcatcctgctggccaagggccggctggtgaacctgggctgcggcaccggccaccccagctacgtgatgtccagctcgttcgcgaaccagaccatcgctcagattgagctgtactcgcacagcgccaactacgaggtcggcaaggtgtacgtgctgcccaagcacctggacgagaaggtcgctcgcctccagctcaagaagctcaacgcccagctcaccgagctgagccaggagcaggcggactacatcggcgtgaagacctccggcccgtacaagccggacacctaccgctactga

SEQ ID NO: 3411 - DNA, 456 bp, Myxococcus xanthus
ctctgtccctgctcctccggcctgcgctaccgcgagtgctgcgcgcccttccaccgaggcgaggccgagccgcccgacgccgagcgcctcatgcgcagccgctacagcgccttcgccctgcgcgaagtggcctggctgtggaagacgctgcacccccaccacccggaccgcgcgcggccccaggacgaggtgctgcgcgagctgcgcgccttcgcccaggcgcaccagtacccgaagctggtggtgatggaccgccgggaaccggacgcggacggcctggcgcaggtgctcttcttcgccaaggtgttcgagaagggaaaggaccgctccttcgtggagcgctccgacttccggcacgacggcaccggctggcgctacctgtccggcgtggcgctggcgcccaaggagctggccgtccctcccgagtccctcacgctcgccacgttccctcgctag

SEQ ID NO: 3412 - DNA, 117 bp, Myxococcus xanthus
atgcgaagactcaagcacgggctcaacaccctggcccacgccctgcacaatacacaggtggagcagaagcacccggagctcgtcccctggctccagttccggacccgactggtctga

SEQ ID NO: 3413 - DNA, 435 bp, Myxococcus xanthus
atgcgcgtcatggtcattgtgaaggcgacgaagaactccgaggccggtgtgatgcccggcgagcagctgatgaccgagatgggcaagtacaacgaggagctgatgaaggcgggcgtgctcctggccggtgacggtctccacccgagcaccaagggcaaacgcatccggttcgcggacgggaagaagagcgtcatcgacggtccgttcgcggagacgaaggagctcatcgccggctattggatctggcaggtgaagtcgatggaagaggccgtggagtgggcgcgccgctgcccgccccccatgcccggcgaggagtcggagctggagattcgccccgtcttcgaggccgaggacttcggcgccgagttcaccccggagttgcgcgcgcaggaagagaagctgcgcgcggagttggagcagaagcagaaggcgtga

SEQ ID NO: 3414 - DNA, 744 bp, Myxococcus xanthus
atgtacaaccttctcatctccctcggtgtgggaatcgccgtcgcgctcctggtgaaggtggccggcttctccatctgggcggggctcgtccccggaatcctggccctcgtcggcacctacatcgtgctcgctcgccgggtggccagccgcgtgcagtcgctgatgacggtggtccagaaggacctccagtcccagcccaccagccagaaggacgcccagtcgcgggtggaccgggcggtgaagacgctggagcaggggctcgtctacgacaagtggcagttcctggtcggtccggagctccactcccagatcggcatgctgaagtacatggtgaaggaccatgagggcgccaaggccgccttcgagaagggcagcggccgcaactacatggccaaggccatggaaggcgccctgtacttccagcgtaaggacttcgacgccatgaagaaggcgttcgagtccgccacgaagagcggcaagaaggagtccattgtctgggcggcctatgcctggtgcctgatgcagaacaaggacaaggacggcgcgctgcgcgtgctcgcccggggcgtagagcagaaccccaaggacgagaagctcaagggcagcctcgcccagctccagaacgacaagcgcctgaagatgaagccgtacgagcccacgtggtggcagttcgggctcgaggctccgccgccggtcatgccccccatgggcggccgccgcatgcagttcagcacccgacgctag

SEQ ID NO: 3415 - DNA, 957 bp, Myxococcus xanthus
atggaacggcgcggccggacctccgagcggtcccttctgctcatcatcgaggatgacgcacaggtccgcgagagcctcgtagacctgctctccgtacgcttcgacgtgctcgccgctccggattcgaatgaggggctggagctggcgcgggagcaccacccggacctcatcctcctggacaggttccttcccagcggagacgggctcgcggtgctcgagttgctccagcgcgagtcgtgcacggaagccgtgcccgtcatcttcctgacgggcgacgcggacgaggccacgctggagcgctgcctggagatgggcgccgtggacttcatccacaagccggccagcgcgcgggagttgctggcccgtatcgaccgggcgctgcgccagagcgagcagcagcgccgactgcagatcctcgcgcagacggacggcctcacggggctcgccaacttccgtgcgctgagcatccggatggaagaagagttccgccgggcccagcgctaccagtacccgctgagcgtcgtcatcatcgacctggaccacctcaaggccatcaacgacggcatgggccatgacgtgggcaaccgggcgattctcgcgctggccacccagttgaagcacgagctgcgtgagtcggacttcgcggcccgcttcggtggagacgagttcgtcgcgctgctgccgcaccagacggcgttggaagcagccgtcttcgccgagcgcatccgcaccgggctgcgcgccgtcggcgtccagaagagcgacggccgccccgctcccttcggactgagcgtgagcgtgggcatcgccgaccataccttcgaagggcctcgcgaggacaccgagtcgctgatgaaggcggcggacgcggccctctacgaggcaaagcgcgaggggcgggatcgggtcgtcgtgttcggccggcccgcgaattcgcctccggcgcagcggcactga

SEQ ID NO: 3416 - DNA, 1734 bp, Myxococcus xanthus
atgatgctggggaacagactggcgacgggttcgagggtggcggtggtgggaggcggcattgccggagcggggcttgccgcctcactccttttcaacgggagggctcgcgggctggcgctggacgtgcgcgtctactccggaggaacacaggagcgcaccgcaccgccggcggtgctgacgccggagtgccgctcacgcctggccgcgctgggctgccgcatcccctccgaatggcgtgcccatgagctgcgcggtgttgagatcatcgccgagggccggcgcgagctgctgtcctccacgcccggtggactctgggtggtggacggctggccccaggggttgggcggcctcgagcaggtgcgggatgtgctcgccaccgcggccagcgcccagggcgctcgcttccttccccgccacgtcgagcgcgtggagcgacaggcccccgcgccggatgcgcccgccgcggtgcgcggcgcgggttcgttggtggtacgcgcccagggaagtggcgatcgctttcatgcggtggcgctggcctcgggcgccgggccgctgatgggagacgccttcttcaagggcttccgccccgcccccaccatcccggcggtgcaggcccgcctgcgccacgcttcgcctcggctggaactggctccggtggcccggctgtggattgcgcccctgccagcggtcgatggcctgttcctgctgcctggcgccaactcggtgtacgcgctggccttcgggccggcggtgacgcccgcggacctgtgccaggtgctgatgatggccgcgcgtgacggcctggtggaggaaggcttcgagctggcggccctggagaccacccgcctgccctacggaccgggccggacgctggtcgcgccggggcagatcgcggtcgggcccgcggccttcggccacccgctccaggtgggattgtcggagacactggcttcgtgcagccgcgcggcggtggcgctactcgacggcgggctggacacgggcctcctggagcgccgctacgtgcgcgaaggcctgggcgaaatgctggaggacgccgccgcgggagcccggacgatgacctggctgcgccgagcggggcctcgggcgccggaggccttcgtcagggcgaaggggcgacggacgctgggtggcaccttcggcggcggggtgctgggcctgagcggaccctcgcccatcgcgctcctgggcgccgcgcgctgggagggactcaaggagctggtgggctcctggctgcgcaccacggtggagccggtgccctcggtggtgccggagttggagccggacctctactacgtcgtagatgacgacccggacgcacgcgaggcgctcacggcgctgctcgagagcaccggagccacggtggtgtccttcgccgacgagctggccctcttctgcgcggtggcccggcggccacccacggccatcctcctggacgtggtgctgcactgggtggacggcctgcggctggccgagggcctgaagcagcatcccctcacccggaacacccgcgtgctggtgatgagtggcctcaaccggccgcatgtccggcagcgggccctggacgcaggggcggaggccttcttgcccaagcccgtggacccagaccggctgctgcgcatcctcaccggccgagtccccgtcctggagcccgcgcccgcgccgcatgccgcggacgacacgcgcgagctggccgcggaccgctacgcgtcctga

SEQ ID NO: 3417 - DNA, 630 bp, Myxococcus xanthus
atgggcgagctcatctcagagctcgcgcaggtccacgcggtcagcaccggggaggaagcggtcgaggccctcgaggccgggcgcttcgtcctggtcatcagtgatctgcgcatctccggaggtgagctgggcggccggacggtcgtcgaggccgcccggaagcgtcatcaggcggtggccattgtcagcgccgcgacgccggacgaggtgatccaggccgtccagccgcaggtggcggacgccatgctcctcaagccgttccagatcgacgacatctacgccctggtggagcgcttcatcgcgctgcgtcaggacgtggagcaactggccacccaggggcagcggcctgccgcgagcgtctggtcgccgcggggcgcccacgttcagatcgcgcgggaagacgcgttgagggcaatgtgggtgtccgtgacggccggcggcgacttcggctggacgttccacccgacgccctcgggcgtgggggttcaggtggtcgaaggtgtcctcgaagtggatgacgtgtcgtactcggcgcccggatatttcttcctgggggccgggcaggcgcctcggatgcgcagcccggagggctgcctggtcgtggcagtgggactgaaagggcagggctga

SEQ ID NO: 3418 - DNA, 870 bp, Myxococcus xanthus
atggtccgcgagattgtggcccgggtcctcatctgtgtgttgtgggccgtgggcgtcaccgcggttcatcaccacaccaagcccctggacatcccggccacggtgcacacgctggcgggcatctcgctcagcttgttgctcgtcttccggaccaacgcctcctacgaccgcttctgggaaggccggaagctgtggggcggcatcgtcaacgagacgcgcaacctggctcgtgcatccagcgtcttcatgcgtcgggacgccgggctctacggcacgctggtgcggtggatcagcgccttcccctatgccgccgccgcgtcactgcgaggggagcgagacctgggccccgtcgcctccgagctgccgcgcgacgaagcggacgccgtgctgggcagccagcacgtcccgctcgcggtgtcgcagaagatgtccgccgtgctcgatgagggccggctgcggggctactaccccgaacacgtccagatgcagctcgaccagaatgtccaactgctcatcgactacatcggcggctgcgagcgcattcacaagacgcccatgccgttcgcctacatgatgcacctgcggcgagcgctgatggtctactgctacacgctgccgttcgcgctggtggattcgttcggctggataacggtgccggccacgttcgtcgtcgcctacgtcttcttcggcatcgaggagattggcgtggagatcgaggacccgttcggccacgacgacaacgacctgccgctggagcggatctgcgagacgatccacggcaacctcaaggcgctgatgcccgggagcgccgaggccatccacgccccggtctccgtggtcgccattcccggcggtggtcaggacgcgtag

SEQ ID NO: 3419 - DNA, 567 bp, Myxococcus xanthus
ccgagggtgaactcggcggcctggggtggccccttcatcatggggattttgatggtgctgctggggattgtcgcgctgggggccgccttcttcaccagcctggtgtcggccatcctcttcggcgcgatgctggccgcggcaggcgtcatggaagtcatctccgccttccggacgcgcaaggagggcgggccgttctggctgtacctgctcagcggcatcctctccgtcgtcgtgggtctgttcatccttgtctacccggcggcgggactgggggccatgaccctgctgctggcgggctacttcttcgccagcgggctctttcacgccgtcacctcggtgatggaccgctatccccggtggggctgggacttcttctacggcgccgtgtccatcttcctgggcatcgtcgtgatgcggcagtggcccatctccgccgtctggctggtgggcacgctggtgggaatcggcatcttcttccggggcgtggcgctgatggcgggcgccctcaccgtgcgcaaggtgctccgctcgggcggtccgacgacgcctgcctccatctcccattga

SEQ ID NO: 3420 - DNA, 897 bp, Myxococcus xanthus
ttgacggtgattgccgggccgacggcgtcggggaagacggcgctggcgattgcgctggctcagcgtgctggtggcgagattgtcagcgcggactcgcagcaggtgtatcggcacttcgatatcggcacggcgaagccctcctcggaggagctggctgcggtgcctcatcacctggtgtccgccgtggacccgatggaggcgttctccgctgtcgagtaccagcgccgtgcggacgccgtcatcgcggagattgccgcacgcggccggcctgtcttcgtcgtgggtggcaccgggctgtatttgcgcgtgttgcttcacggtgtgctcgaggcgcccggggccttgccggagttgagggcggagctggaggcgctggcggccggtgaggggcgcgaggcggtgcatcggaggctggcggaggtggacccggagacggcggcgaagcttcctccgcaggacctggtccgcgtcatccgggcgctggagattcatgcgcagacaggcgtgcccgcctcggcgttccggaaggcccatgccttcgcgccggaccgctatcccttccaactgtacgttctgtcgccaccgcgcgacgtgctgtacgggctcatcaacacgcgcacgcggatgttgttcgagcgtgggctcgtcgaggagacccgcgagctgctggcgcgggggtacgccgattcggcgcccatgcgcagcgtgggctatgtgcaggcgcgcgccgtcgttgaggggcggatgacgcgcgaagaggccattcacgacaccgcgcaggagacgcgccgctacgccaagcggcagttgacgtggttccggaaggagcccggggctgtcttcctggctcccccgtacgaggcggcgcttccgctcggcggctgttgctcgccctga

SEQ ID NO: 3421 - DNA, 165 bp, Myxococcus xanthus
atgctgctcgtcaatgccctgctgcccgaggcgacgcccgtggggcgaggtgggctgcttggcgcggcgggacggttgctgtcagaggtttcgcccgtgcggttggtgttcgcgcgtgatgcgtccgcggcggcggtgattcagggagcgttggcgaatgggtga

SEQ ID NO: 3422 - DNA, 2964 bp, Myxococcus xanthus
atggacgaagcctccgagctgacggtcgatgtccgcaacaacacctccagtgggtcgccgctcttccggcgcatcaacgaggtgtggttcgcgctgcccagcggctacatcccgctcgcgtccatcccgcccccgggatggacggtggactacatcgccagcgagcggtgggtcatcttctacaatcaggactcctgcaacggcagcggcgactacggcctgggccaggacgagtcggcccggttcgtccttcgcgtggttccgccgacttcgaacaacgaccagaacaacgagcgcttcgtcgcgagtcagacgttcgcccgtgacacgtgcgcggggggcgacttcaccacgtcggtggcgacctcggccgcgagctggagtcgctccggcctgtacacccaggtggacgtgcgtcctcgggtgatgggggttggcggcgacatcgacgcgcggatggtggtggagaaccggacgggcacgaaccacaacaacaccacggttgagggaccctccacgggcgcgggcgccgtcaccttccaggtggtggacaccgagccgacgccgttccgcatgaacatcgccaaccggaacgcgggcgtctattccgcgagagtgcggacgggctcggccggaacgctggtggcgcgggtgcggggcgtcagcgggaacggcaacactgtgtcgccctcgatggacgcgcggatggtcaacgtgggggcgctcccggtggccatggacgtggacaccgacgacgcgttcaacaacgagaccgtgcgggtgcggctcacggtgaccaacccgtcctcgacggacacgttcctgaacgtgacgccgcgcgcgcccgtgttccagggaacggcggccgtgtcgctcgtgtcggggcctgggcccgcgagcgttccccggctggacccgggcgcctccgcgcacttcgtctggacgtaccagctcacgggaaccccgttcgcgaactaccggttccgggggcaggtggatgccacgcgcaacggcgcctccgtgacgtcgaacctggtggactcgaaccaggggcgcatcgtgcagcaccgcgtgcggacgaacatcagcgcgttggccgccaactcgacgaaccggtccgtcatctacaccatccagaaccggggccccatgccgctgcatgaggtccggctgctgcggcccgcgctcaactacttcaccgtcggcggcgtgctgcagacgcccaccgggtggcgcatggcgtccaacaacgccaccacgggcatcacctgggagtcgacgaacgccacgggcatcccggtcaacggcgagcgctccttcacggtggtgtattccaacttcggggcgggcgcgtcgctgtccgggcccaccacgttccgtcatcgtttccacctcatcgacgactacggcgggccgcagattcgcatcgaaacccccatgacgctggcgcagggcaccgttcccgacgtcaaccgcctcacgggtgtggcgcgcgatggcagcgtgacgctcacctgggacaacccggcggtgcacgggggcgtgctgattcttcgcgcggagggcgcgccgccaaacctctgtccgacgcaggggctgaactacgcggtgggggcctatctgggcaacgcccaggtggtgtacgcggacgacgtcggcgccgccacgacgttcaccgatacgtccgtcaccaacggcaccacgtactactaccgcgtcttcaactcggatgacctgcggtggtactcgccgggcaaccagccgacgtcgcaggccctggtggccacgcctcgggcccgcgtgggcgcggcgccgctgtggtgctactcggtgggcctgaatgcctcgcagcagcccatcaccgagctgggtacgggcatcttcagcgccttcaacgactccgtcgtcgccaacctcacccaggtcaccaatccgtcggcggatggcgcggagcggtggcggcctcgaccgctggcgggcctcattggcagccgcttcccggtggtgccactgcatggcctgtccgggcagtacatcctcgtgggtgaccagggtggggtggccagcgcgctcaacgccgccaccgggcaggtgctgtggcgatgggacaatggtggccagcccattggcaccatccagtcgttcccggtcacgcagctcttcgactacgcgaatgccgcataccgggccgcgcaccccaaccgcgacctcgtcttcttcgccacgcggctggcggacgcttcgcgcaaccgggtggtggccctgaatgccgccaccggcgcgctggtctggagctaccagcctgggaatctgggcatggtggcgggcggcatggtggtggactacaccaacaaccggctcttcgtggcgacgcgcgcgcacgcgggctcgccgaacacgcttcgggtgctgaacacgctgacgggacaggtgctggcccagctcccggtgggcgacgtggagctgagcttggttcgcaatgcgtacagcaacctgattctcgtgacggacagcgatggcttcgttcacggcgtggacgccgccacggcgcagctcgtgtggagcctgccagtcaccacgcgcccggcgccgaacacgcctgccttcaccagcttcgtgcggccccagggctcgggcttcgtggccagtctcgcggccggccgggtggcgctgtacgacgtgtcggggcccgcccagtcgccgccggtgctccggtggagcacgccgatcgcgtctccctctggcaccttctccttcaatcggaatggcgccgtgcgcatctacgttggcagctccgacggacaggttcaccaactggagctgctggatggctccgactccggtcaggtctcgattggtggtgcgcagcgtattgggactcccaccatcgaccacacggtgagccgcctccacgtgggctccgaagacggccgcatctgcgcgttcccggtccctttcccttga

SEQ ID NO: 3423 - DNA, 528 bp, Myxococcus xanthus
atgcggacgcgtttggcgttcctggcggcggcggtgatgttggcctcgtgcacggatggcgtggcgccctatgcccccgttcatgcgcccccggcgcaggaaccggtggcgcccacggacgtgttgcctccgcgcgagggttcggaggcccggccgccgcccgcgccggtggaggagccggaagtgcctccgcctccagtggttccgcggggctcggccaccgtcattgacctgggcgaggggagcagggccttgctgtcggtggcgcaggtggacgtggacctgacggtgagcggcgtgcgcggccggcacacggtgtccgtggagttcgtgccgccttccgggctgccgtatgagcggcggtcggcggaagtggattcacgcgtggacgagtcgcgcacggtgcgcttctccctgcccgtggcaggcaccaccgtggcgacgtccggcatgagcgggacgtggcaggcccggttcttcctcgatggggcgccgctgacggcggcttccttcaccctggatccgtga

SEQ ID NO: 3424 - DNA, 993 bp, Myxococcus xanthus
gtgattgcgtttcgcggagtcagcaaggtctacacggcgggcgggcgggaggtcgcggcgctgaggaacgtgtcgctccgggtggaggccggtgaaatccacggcgtgctgggacagagcggcgccggcaaatccacgctcatccgctgcgccaacctcctggagcgccccaccgagggctccgtctccgtcgacggacaggacttgctggccctcagtccggaggcactgcgcaaggcacgccagggcatcgggatgatcttccagcacttcaacctcttcggctcgaagacggtggcggcgaacgtcgcgtacccgctggaagtggcgggcaccccacgcgaggccatccgcgaacgcgtggaggagctgctgtcgctcgtgggactgtccgacaaggcgcaggcctacccctcgcagctctccggcggacagaaccagggggtgggcatcgcgcgggcgctggcgccccggcctcgcgtcctgctttccgacgaggccacctccgcgctggacccggagacgacgcgctcggtgctggggttgctgcgtgacatcaaccagaagctcggcgtgacgctgctcctcatcacccatcagatggacgtggtgaaggccatctgcgactcggtatcggtgctggagcggggacggctcgtggagcagggcaaggtgacggagctgctcgcccatcccagcacccggctgcatcaactgtgctttccggccttcgccgcgccgacggacgcaccctcgggccgccgagtggcgctgacgctcgcgggcgagcacgcccggcggcccctcctgggcaccctggcgcgccaattcgacgtggacgccctgctggtcgaaggcgccatggagcgcgtgggcaacacccgcgtggggaggctcctcgtcgacctccagggttccgccgatgccgtgagccaggcactcgcctacctgcgtgagcagggactgacgctcgaggaggccgcaaatggatag

SEQ ID NO: 3425 - DNA, 297 bp, Myxococcus xanthus
atgagcacggacttcgcggcggaccatgcgccgcgctggcgcgagggcgtctccggccagcgcttcggttcggacttcatcgtcctggatgccgagggcaacaccctgcgtgggctcaacggaacggccattgaaatctgggagttgtgcgacgggacgcgcacggcgcgggccctggtggagcaggtggctcagcgtcacggatgggacgtggagcaggtgctgaccgacacgctcaagttcttctcggagctgacccggctggggctcatcgacgagttggaggaggcgcggtga

SEQ ID NO: 3426 - DNA, 339 bp, Myxococcus xanthus
atgtggccatcgctgcgctcgggcgaccatgccggcgtggagccgctggagggggctccgcgacctggtgacgtcctgctggcgcgcttcgaccatgccctggtgctgcaccggctgcggcggtgggaggccggggcggtggcgctgcgaggcgacaactcaccccaggacgatgctccgctggatccgtcacgggtgctggggcgggtgcggcgcgtccgccggggcggcgtcgtcctggaagcggggtgggaccgggggccccggtggctggggcgggtgcgggtggccgtgaagtggcgcctggctgcgttgctgggccggggaggtgcgcgatga

SEQ ID NO: 3427 - DNA, 1248 bp, Myxococcus xanthus
atgaacgatctcctccctggggagatcgaaatctggcagcacgtggaggcgcaggcccgcgagctgttcggccgcttcggctacggtgagatccgcacgcccatggtggaggacaccgcgctgttcgtgcgcagcgtgggcgaggagaccgacatcgtcgggaaggagatgtacaccttcaacgacaaggcggaccgcagcctgtctctgcgcccggaaggcaccgcgcccgcggcgcgcgcgtacatcgagcactccatcgccaatcaggagccgctcacgcgctggttctatgcggggcccatgttccgctacgagcggatgaagacgggccgctaccgccagttctatcaaatcggcgcggaggcctacggcgcgaaggaaggcgcccaggacgtcgagatgatggacatggtggtgcagttcctggagcggctggggctcaaggacatcaccctgaacatcaactcgctgggggacgaggtctgccggcccacgtaccacgcgaagttggtggagtacctccaggcccaccgcgaggcgctgtgtggggactgccagaagcgcatggagaagaaccctctgcgcgtcctggactgcaagaacgagaagtgccaggccatcgccgcggccggccccaatgtgctggagtccctgtgcgagccctgccgcgcgcacttcgacgacgtgcagcggaagctgacggcgctgggcgtccggcacgtcgtgaatccgcgcatggtgcgtgggttggactactacacgcgcaccgtcttcgagttcattgcctcgcaccccgcgctgggcaccgccagcaccgtgggcgccggtggccgctatgacaagctggtgaagagcctgggcgggccggacgcgcccgcggtgggcttcgcctgtggcctggaccggctggtgctgctgctcaaagagagcggccagcagttcaccgtgcggccggacgtcttcgtcgcggtggcggacgcgggctcgcacgatgctgccctggtgctggccagccgcctgcgccgggagggactgcgcgtggagttcgatacccgcggaggcagcctcaagagccagatgaagcgcgcggacaagagcagcgcggaattcaccctggtgctgggcgaggccgagcgcaccagcggccaggcgaagctgaagcccatggccggaggcgagcccatccccgtcgcgctcgacgaggtcgccagggtggttcgggagcgtaaggtcgtttcggcatag

SEQ ID NO: 3428 - DNA, 843 bp, Myxococcus xanthus
atgaacgaccagactttcatgaagttgatgcaggtgttgcccaagtccgcgctctccaccgtggtggggatggccacgcgactgcccgtgcccgcgccggtgcatcaggccgccatgcgcgccttcgccaaggcctacaacgtggacatggaggaggccgagcactccttcgagcactacccgaccttcgcccagttcttcacccggggcctgaagcccggcctgcgtccggtggacgcgggggagaaggtggtggtgtccccggtggatggccgcgtgtcccaggtgggctattcggattacgggcgctgcctgcaggccaagggcatcgagtacacggtggacgagttgctgggggattccgaggccgccaagcccttctacggcggtgcctggacgaccatctacctgtcgccgcgcgactaccaccgcatccacgcgccgctgggcggcaccatcaccgggtacgcgtacatccccggtgagttctggccggtgaaccccgcgtcggtgaagaacaagcagtccctgttctgcgtgaacgagcggctggtgacgtacctggacaccgtggcgggcaagtgcgcggtggtgaaggtgggtgccacctgcgtgtcgcgcatcaaggcggcctacgacgaggtgacgacgcacaccgggcagcccggcaaggtgcaccgctacggctcggccatgccggtggagaagggtggggagctgggccgcttcgagatgggctccaccgtcatcctcctgttcgagcccaagcgcgtcacctgggacgacagcctccaggaggaagcggtggttcggctgggcaagcgaatcggagtcatcacgtga

SEQ ID NO: 3429 - DNA, 432 bp, Myxococcus xanthus
atggcggtggccgccaatgagcgggacgaggccgtggccagcgcgcgggaactgccgccgggctcctacaccgcgccgtccaccgaggagcaggcgcctcccgcggctccggtggaagcgccggatgccgggcctccggatgccggtgctggcggtggcccccaggctggcacggccgcgtccgaactggtggcgggcttccgggggtgcttccagcggggcacccccatcgatgtgcagggacggggcatgcgggagacctggcagctcgccgaccgcaccgcctgtcgcctggaatacccccagcatcaggattcattcctcctgattgaagaggggaaggtcctcacgctgttacccaagagtgccgtgcagactgtccccgtcactcccgacggcggtccggcacccgcgaccgacgccggtcgctag

SEQ ID NO: 3430 - DNA, 783 bp, Myxococcus xanthus
atgcgtatcgccgtcatctccgacatccactccaacatcgaggcgctcaccgaggtgctccgcgtcgccgagcaccagaaggtggaccggttcgtctcgctgggggacatcgtcggttacggggcgtcgcccaacccgtgttgtgagctggtgcgctcggtggcggaggtgacgctcctgggcaatcacgacgcggcggtggcggggcggatggactactcgtactactacgacgccgcccggcacgcgctggactggtccgccaacgtcctcacggacgagaacatggcctggctgcgcagcctcccgtacacgtaccggattggcgacgtgggcttctgccacggttcgcccatcgacccgaaggcatacgagtacatcttcgcgctggagcaggcccgggagctgacgccctacgtggcggagctgccggaggtgacgttcatcggccacagccacctgtgccgcgccttcgccattggcaatggtgaggtgaacgacgtggtggcccagaagttcggcatccgccggggctacaagtacatcatctccgtgggcagcgtgggccagccgcgcgactatgacaaaccgggcgtgcttcgtcatctgcgacacggacgcgcgcacggtggagtacgtccgcgtcgagtacgacatcgagacgtcggcgcagaagatcttcgatgcggacctggcgctgaacttcggcaagcgcctgttcctgggcgtctgaggcgcgcttccggggcacaaaaggcggacaggcgcggggaaatgacataa

SEQ ID NO: 3431 - DNA, 798 bp, Myxococcus xanthus
gtcgtgtcggtggtgggcgaggacttccccgaagggcacctcaacttccttcgcggacggggaatcgacctggagggcctcacccgggagacgggccgcaccttccgctggaagggccgctacagctacgagctgaacgaggcgcagacgctggacacccagctcaacgtcttccaggccttctccccgaagctgccggagtcgtaccgggatacgccctacgtcttcctgggcaacatccacccggagctccaggcgcaggtgctggaccaggtgaaggcgccgaagctggtggccgccgacaccatgaacttctggatcaagggcagccgggccgcgctactcaagacgctctcccgcgtcaacctcctgttcgtcaacgacgcggaggcccgtcagctggccggcgagcacaacgtggtgaaggccgctcgcgccatcatggccatgggcccgcagcgcgtggtcatcaagcgcggtgagtacggcgcgctcctcttcgaggccgagcacatcttcgcgtgccccgccttccccctggccgaggtcttcgaccccaccggcgcgggggacaccttcgccggcggcttcatgggcgccctggccacctccagtggcgtgttggaccaggcgctgctgcgccgcgccatggtgatgggcagcgtcatggcctccttcacggtggagaagttcagcctggagcgcctgcgcgaggtgacgcggccggagattcacgcccgcttcgccgagttccggaagctgacccacttcgacgacctgggctccctggagcgatga

SEQ ID NO: 3432 - DNA, 252 bp, Myxococcus xanthus
atgtacgcgaagctctcccagcggattggaacccaggtccgcgccgcccggcatcgagtgggcctgtcgcaggcccaggtggccgaggctatccacgtgccgacgctggtgctcagtcgcctggagcgcggcaggttgttgcccagcctccccacgctggtggacctgtgcggcgtccttcgtgtctccgtggacctcctcctgagcggcgagggcctggcgtttcccgcgcccgagggggccggccggtag

SEQ ID NO: 3433 - DNA, 348 bp, Myxococcus xanthus
atgaacgaagaactggcgacccgcattggaagtgccgcccgagaggcccggacgcagctcgggctcacgcaggcggaagtggccgagaagctgggcctggcgcacatggtctacagccgcctggagcgcgggaagatgctgcccagcgtgcagacgctgctgcggatgtgcgcggtgctgcgcatcggctcggacgagctgctggggctcgcggacgcggaggaggggaagggggcgcgaggcccgggcggagcgcccaggctgcggcagctcaccggcctcgcgcgaaagatggacgaggagcaactcgacgccctcgtgaaggtggcccaggtgctgctgcgttga

SEQ ID NO: 3434 - DNA, 672 bp, Myxococcus xanthus
atggatagccagcttccgcgcctgctgggcgtggccaccggtgagacgctctacatgacgtccgtggcctcggcgctcgtcctcctcgcgggactgcccttgggcgtgctgctggtcgtcacggaccggggtggcctgtgggaacgtccggcgctgaaccgggtgctgggcacgctcgtcaacgtgggccgctccatcccgttcatcatcctcatggtggccatcgtcccgctcacccgcctgctggtgggcaccaccatcggcaccaccgccgccatcgttcccctggtcgtggcggccattcccttcatgggccgcgtcgtcgagcagagcctccgcgaagtggacgccgggctggtggaggccgccatcgccatgggctccacccaccgccgcatcgtcttccaggtcctcattccggaggcgctgccgtcgctcgtgcgcggcaccgcgctcgtcatcatcagcctgctgggttacagcgccatggcgggcgcggtgggcggcggcggcctgggcgacctcgcggtgaagtacggctacatgcgcttccgcaccgacgtcatgttgggctgcctggtggtgttgctggtgctggtgcagctcgtccaatggctgggtgacgcgctggcctcccgcttcgaccacaccggcgcgcgctcgtcgcgctga

SEQ ID NO: 3435 - DNA, 864 bp, Myxococcus xanthus
atgttcgcggatctgtggcgctggcaggagatgctcaagcccgccatggcggcgctctcctctctggagcccgggcagatggaggccgcggcgcaagacgtccccgcgcttgtaggccagctctcgggcgagctcgccgcgaccatcgcgaccgtgcgcaagggagccgagaacgtcgcgaagatgctggtgctcaaggatgccatcgaggcgcttaccctgctttcggcgttgaagttctcgctgcccccggtgtctccgtccgctcccgccttgctcggcattggactctcggtgggaggcaacggcgtgatgatgggcacgcgaacggtcgtgtccgccgagtgggtggagatgatgcgccagttggtgcgcgcaggcgtcctctccctgtccgtcgtcagtgccgccgtgcggattcaggcgggccaggtgatgctggcacaggcgcatggcgagttgccgcagggcgtgcgcgaggcgttgggcgacggacccgaagtgcgtgccatgcgcgtgacgggcaaggcgggggctggcatggccgagccaccgcggcaccacgtcctgccaaaagagttccgcgaatggttcgagaagcgcggcttcactggcgacatggacattgaccagttctgcgtcaagctggagcaggctcaccacgaggccatccacggcgggggcgactggaagctgggacgcacatggcccggtgaatggaaccggatgatcatgagccgattgcttgaggccgaggtgttggccggacggatgttgacgcgaaacgagagcctggagatcgtcgcgaagaatatgagggactataagatcccgatgaacttcacccgctggagaggacgatga

SEQ ID NO: 3436 - DNA, 765 bp, Myxococcus xanthus
atgtccacgtccttcgagttcgactccgccctggatccggcgaaggtcgtgctcgaaggcgaagaacgcttttcactcgtggacctcgggcgaagcacgctccggctggtgccctcggagcagctcctacccggcgaacgcctactgctgacggtgcgcttccaggatggctcggtcccccttgatgcggccttcgtcctcgtcgcccaccccgcgcgcggcgagcgcatcgtcgaggtgtggagacaggcgcgcacggcggagtcctaccagcaggaggcgaaggaggcccgagcggaaacccagcagtgccacgaggagaacgcgcggatgagggcggaacagcgggaaccgagcggcatcgcgggcctcctggccaacggtgtcatccaaaaggaggagggcgtcgccgcgaaactcctccgcgtcaacgaagaggttcgtcagcatccaggcaacgcactctgggcacaccgggcttggagctatcgcgcccctgttcgcgtagccgtagcggtggagttcgagaacccggacgccgcgaacccctggaccgcggaaggggcatcgctggtgagcaagccgggcacgtccctgaagatcctgaccgtctggcaaaaggcccccatctctcgctatccgttcggccgcgtcgtggtggaagcagaagcgacgccggatgcggcgcaggggccgttcaccctgaagctgtggggaccgggcgggctgcgcgccatcaccctctccggcgtgacgttcccgtag

SEQ ID NO: 3437 - DNA, 4076 bp, Myxococcus xanthus
atgaccgatgacagcacgccgacccacgaaacgaagttcgaggacccgacgccggagaacagctccgacctggagcgcgcccgacccgggctccggttcaccatcgacaccaccacctacgcggcactccgcacgctggagcggcggggcaatggcgaggtggtgctcctggccgagcgtcacctcccccatggcctcgccgggcatgtcaccatcaaacgcctgcgcaaccccgcatccttcgagcgctgccagcggctcatcgaggaggtccagctcgccttccggctccaccacccggccatcgcccaggtccatcacctgaaaatccacgccgacaggccgcacatcatcgcggagtacgtggacggccccacgctggacaccgtcatcagcctcgccaccatgcgtgagcggccgctctgcgcgcccttcgccctctacatcgccgccgagattgccgacgccctccaccactcgcacacgctgagggattcggagaaccggccgctgggcatcatccaccgcgacgtcgctcctcggaacatccgcgtggcccggagtggcgaggtgaaggtgacggacttcggcgccgcctactcgctcatggtgggccgggaggagaccccgggcctcctgctcaagggcgacgtggcgtacgcctcgcccgagtacctgctccgcaagcccatggatggccggtccgatatcttctccctgggcctcgtcctcatggagatgctgacgtgcaagcacctcttcgacctggaggacgcgcaggcccccatcgccgccctggacgtgaagacggaggaggtgccctccgtgcccctcacgcagatgatcgcgctcgtcagccgctaccgctccgaggacgtggagcacgcgatggcgggcctgccggacgcgctcaaggccatcatccacaaggccctccagcgcaagccctccgagcgctacacctcggccgccgagctgcgcgatgccctgcgggcggcgctcgcggcacaggcccagcccttcggacggaaggaggcggctgaggagctggcacggatgctgtcggacgcctccgtcctgcgcgaccgggtggagctggacgaagcgggaatcttccccgagggactggacgcagacgaagcgacgctcgcgccgaactcgaagtgagcacgggcggccgggcgacgcttcaacgcagcagcacctgggccaccttcacgagggcgtcgagttgctcctcgtccatctttcgcgcgaggccggtgagctgccgcagcctgggcgctccgcccgggcctcgcgcccccttcccctcctccgcgtccgcgagccccagcagctcgtccgagccgatgcgcagcaccgcgcacatccgcagcagcgtctgcacgctgggcagcatcttcccgcgctccaggcggctgtagaccatgtgcgccaggcccagcttctcggccacttccgcctgcgtgagcccgagctgcgtccgggcctctcgggcggcacttccaatgcgggtcgccagttcttcgttcatgcgtcgaggtaccaggaacaccgaggaccccgtctgccgcgggcaggaggctcgcgactcgggaacgcccttcctgccgcatcttggcggccgtgtcgatgcgcgacgagcccctgtcacacagcgccgccccacctaccggccggccccctcgggcgcgggaaacgccaggccctcgccgctcaggaggaggtccacggagacacgaaggacgccgcacaggtccaccagcgtggggaggctgggcaacaacctgccgcgctccaggcgactgagcaccagcgtcggcacgtggatagcctcggccacctgggcctgcgacaggcccactcgatgccgggcggcgcggacctgggttccaatccgctgggagagcttcgcgtacatgaagagacctgggaaaagaggagaatgccgcggggacggcactccgagcatatacctcaacaggttcaaccatggtatccgtccaaggtctatgcccctcccgcgctgcttcgcggggggaaccctcacgagttccattgcccgttgagcgcatgtccaggaacgccgagcccgtacgccccgccgaaggagaggtctcgtgagcccgcgtctgcatcccgtcgtgcccccgggcacggacattggcgggtacctggtggaggagcggctgggggccgggggcttcggcgccgtgtaccgcgctcggcgtggagagcggagctccgcgctcaagctcatcccgctctgggggctggccgagtgggcggagcgcgaggtggccatcctcctgcggctcaagcacgccaacctggtgcgcatccgtggacacggccagtggccggacgaggcgccccagtccttcttcatcgtcatggactacgtggaggggcgccgcctggacgtgtgggccacggaggagaacccctcggcccgtgaggtggtgcgcaaggtgctcggtgtggcgcgcgggctgggcgccgcgcaccgggcgaaggtggtgcaccgggacttgaaggagagcaacgtcgtcgtgcgcgactcgcacggccagctggtggtggtgcacttcggcgcgggcgggtacgagagcgcccccagcatcaccggcggcgtgctcccgccgggcaccctggagtaccgcgcgcccgaggcctggcgcttccagcaggagcacggcgacgagcgtggccgctcctaccagcccggcccctcggatgacctgtacgcgctgggcgtcgtgctctattggctcctgacgggcaggcagcccttcctgccggacgagcccgagggcgtggagcccgtgctcaaccgcgcccccagaccgccccaggcgctcaacccgcgcgtccccggggccctcggcgacgtgtgcatgcgcctgctggccaagacgcccgaggagcgacaccccgacgccgacacgctgtgcgcggagctggagtccctgctcgcccaggcggacgaagcctgggacgtgaagctctgtgacacccatggcgcggacaccgccaccacgctcgcggaggcgccgcaagcggtcgaagacgagctggcgcagtggctgaagcggcgcaaggcccggcctcgtcgcgggcctcgtccgccacgaggtggggacgcgtacgaatccgatgcaaacgcggtggccatcccgttcgagccgccgcccgcggcacgcgccggtcattccaaggccctgcgcgtggcggcctggatggcgctcctggtggtcttgattgtgggcggactggtgctcgcgcgcggactgatgccctcctcccctcctgccgcacgtcacgggatggcgccccattcccatgtcaccgtgggctcgccccccggcggttccgcgttcgttcccacgtcctggagtcccggtcaggaagtggcggcaccctggaggccactggaagctgacgaggccgcaggctcgctcgatggagcatccacccttgcggccgtcgccgttcccgcgacgtattccaaggagaaggcctccgtgaagatgaagaaggacaccggcatgctccccgagcccgagccgcagcgcctccagggcacagccgctggcaaggcgattggcctgggtgtcgcggcctgcctttcgatggcgtgccctggttcccaggtgcgcccgacgccgcctcccgaggactgtcctccaggggccattgaggccatggaacagctcggcctcttcgcccccggactcgagcggccttcaaccacgttcgacctgagccccggcaatggtggcagaaacatcaaggtccgtgagggcacgacgacggttcgcatgggggtccattggggacgcatgccgccgggaaccctgttctccgggcagctcctcgtcggtccagagcgggtctacggacgactcaccgaggcgcgtactcccaagaatgagcgcatccccgtctgcgtgcagttcgttgaaccggaggacggccgcatcggactcctgaagatggagccaacccgagcccccggcacggccaccgtctactccgcgctggatttgaaggccgtgcgccgcttcgagtga

SEQ ID NO: 3438 - DNA, 495 bp, Myxococcus xanthus
ctctacctccactcggagaaccgggaggccatcgcgaaggagttgtgcgtgcgcggcttccaggacctgctggccatgctggagcccgcggcccaggtggaagacccgctggagcggttgcccaagctagcggaggcctacgtccgctttggcctggagcacccggagacgtaccggctgatcttcatggaggacccgaagctctccaccgccctgttcggagaccacccggaaggcccgggcccgagagcattcggggtgctggtgcaggtgttcgtggacctgctggcgaccgggaggctggaggaaggcacgaagccagagcaactcgcggaggtgctgtgggcgggggtgcacggcatcgtgagcttgaggctcacatgcacggggttcccgggcacgcccgcggaggagctgacgcaggtgctggtgacgacgttggtgaagggcttgccgggattgaaggcgggacgggcgcagaaaaagacgcggtga

SEQ ID NO: 3439 - DNA, 933 bp, Myxococcus xanthus
ctggaggcggcgcgccggggggaccatgcggaccctcggctggcctactacgcggggctcgtccatgagcggatgcgccgcttcgccgacgcggcggaggccttcgctggtgtgcccgctgaggcggatgtctacgccgacgcgcgcctgcgccgagcccgcagcctgtcgctcctgggcgagcactcccgggccctcacgctcttccgggccgcgatgcaggagtcgccagcggacgtggaagtccggatgcagttcgcccgggccctggagcgcggcggcacgccgaaccgcgcggagctgctccttcgcgagggcctgtccgccggtccctccgcggcgttgtatgacgccctggccgccacgctccaccgacagggccggggtcgcgaagcactgacactgcttcgcggggcggtggcccgctttccccgggacgaagacctgctgtacgtgctgggcgcggcccatgagcgacagggcgacgtgacgggcgcgctggcccgcatgcgggcggtgctggctgtgtcaccggaccacgccgccgcgctgaacttcctgggctacctgctggcgcaggcggggcagaacctggacgaggccgagcggcgcgtgcggcgggcactggagctgcggccggacaccggggcctacctggactcactgggctgggtgtacttccggcgaggggactacgcccgggccgtggacgcgctggagcgagcctccacgctggctccggatgagcccgtcatcctcgaacacctgggagacgcctatcagcgggtggcgaggacggacgacgccgcggcggtctggcggcgcgccctggaagtgctgacgctggatcctgagtcctgcgagccacccggccagcgcgccgcgttggagcgcaagctcaatgcgctacccacgcgtgcgccagaccgctaa

SEQ ID NO: 3440 - DNA, 840 bp, Myxococcus xanthus
atggcgcgtagcgacgagggcttctttcccggcagggaccggacacgactgtgctggaagcccatccttgcagacgccgagcctgtgccgcatgtggcggtggtgcacgggtatggagaccacttcgggcgctatggcttcgtgacggacgcactgctggcggacggcttcgcggtccacggcttcgactaccggggccacggtaaggccgacgggcgccgggcctactgtgagaagtggccggactacctggaggacctggaggtcttctgggagcgggtgcgcgcggtgtcggagggcaagaaggccttcgtgctggcgcacagccacggcggcctgatgtcggcgacgtgggcttccagccggcgggtggaggggttgacggggctggtgctgtcggcgccgtacctcaagctggccatcacccctccggcctcgaagctgatggccgcgcgcgcggtgggcaagctggtgccatggctgagcatctcctccggactgaaggtggaggacctcacccatgacaccgacgtgcagcgggccacccgggaggacccgctccatcaggccatcgccacgccacggtggttcgtcgaatccacccgggcgcagggtgaggccgtgctgctggcgccgaagattcaagtgccgctgttcgtcctgtgtggcgcggaggatggggtggccgctccggcggcggcgcgggagtacttcgagcgggcggggtcgccggacaagaagttcaaggagtaccccggaatgcggcatgagccgctcaacgaggtgggccgtgcggaggtattccgggatatctccggctggatctccgcgcatctctga

SEQ ID NO: 3441 - DNA, 342 bp, Myxococcus xanthus
atggcaacgggtgaaacgggcatcatcggcaagggcatcgtcatcaagggcaacctcacgggaggtggggacctggtgatcgagggacgtgtggaggggcagattgccctgaagaaccacctcaccatcgagagcaccggcaaggtgcaggcggacatccgcgccgaggagttgaccatcaacggcgaggccagcggcaacatcgacgcctcgtcgcgcgtggccatcaacgcctcggccaaggtggccggcgacatcaaggcacctcgcgtcgtcatcgaggacggggctgtgttcaacggctccatcgagatggacgtacggcttcctgacgacatttga

SEQ ID NO: 3442 - DNA, 324 bp, Myxococcus xanthus
atggcgaatacggtcattggctcgagcatcgtcatcgacggggaaatctccggcgacgaggacctggtcatccagggcaccgtgaaggggaagatttccctcaaggaaagcctctacgtggagggcagcggcgtcgtcgaggccgacatcgagacgcagaacgtggagatcgccggtcgcgtcacgggcaacatcgtcgccagcgacaaggtggagctgaagacggactgccgcgtggtgggagacatcaaggcgcctcgaatcctcatcgccgacggtgcctccttcaagggcaacgtcgacatggacatgaaggagcgctga

SEQ ID NO: 3443 - DNA, 231 bp, Myxococcus xanthus
atgctggagaaggcgctcgccactgaggacacactggcgccggagggcgtcgaagaggagattgacgccgacgagctggcgcaggaagtggcgcagcggcttggggccatcaatcaagacctctcgctgctggcggacgtgttcgccgcgctggatgagtcgcgcaaggcggagctcctgatgcagctccgctactcgtccgagctggtcacctatctggaggggctgtaa

SEQ ID NO: 3444 - DNA, 834 bp, Myxococcus xanthus
atgaagtccccctctcgttccctgctcaccccgctgctgctctccgtgacgctgctgctcacggcctgccagaagcaggaggcgtcctcgggcgagtcttccggcgtccgcacgttgaaggtcggcgtcaacccggttccccacggagacattctccgcgccgccgccgcagtggccctgcgcgagggcgtgcgcgtcgacgtggtggagttcaccgactacgtccagccgaacatcgcgctgtctgacaaacagctcgacgccaactacttccagcacgtgccctacctggagcgcttcgccggagacaggaagctcgcgttgacgagcgccggcccggtgcacctggagcccctggcgctctactccacgaagttccgtcagctcgcggagcttccggagggcgcgcaggtgacgctgcccgccgaccccagcaacctggcgcgggcgctgcgcctgctcgaagcccagggtctgctgcgcctgcgcgaagaagcgggcgccacggcgacggtgcgggacgtggtgggcaacccgcgcaagctcgacctgcgggagattgatgcggagcagcagcctcgcacgctggaggacgtggccgccgccgtcatcaacggcaactacttcctggaggcccagaagcacctgaagctggacgcgaaggtgctggcccgcgaggcggcgcgggagaacccctacgccaatgtgctcgccgtgcgtcagggtgacgagcagcgccccgaggtgcgcacgctggtgaaggcgctccagtccgacgacgtgcgccgctacatcgagtccacctacggcggcgcggtggtgcccgccttctga

SEQ ID NO: 3445 - DNA, 567 bp, Myxococcus xanthus
atggcggaacctctcgtgcgcgaccgtgcccggctgttggagctgctcaccgagcgctccttcgagcagcgccgcgtggtgctctcgtccggcaaggagtcggacttctacatcgactgcaagcgcacggcgctgctggccgagggccactttctcattggccggctgttcctggatgccatccggcgcgaggccccggaggccgtgggcgtgggcggactgacgctgggtgccgacccgctggcgtccgcggtgagcctcactggctacctgtccggcacgccgctggcggccttcatcgtgcgcaaggagcccaaggggcacggcacggggcagtggattgaaggcctgagcgggctggggcagggcgcggcggtggccatcgtggaggacgtcgtcacgacgggagcctccacgctgaaggccatcgagcgggcccagttggagggcctgaaggtgctgggcgccttcgcgctggtggaccggttggagggtgggcgtgaagccgtggaggcctcgggtcaccggctccacacgctcttcacccgcaaggacttcattccgtga

SEQ ID NO: 3446 - DNA, 351 bp, Myxococcus xanthus
atgctcgccgaggagcaggcgaaggccgcgcaggcccacgagttcttcctgggcgtgcacttcaacgacttcgtctacgccgacttcgactacaagcactccatctggcgcctggcgctggtgacgcccgctggcgaggtgacgccctcgcgcatccgccggctgggccgggtgaacatgcagacgcgggcgtactacccgtacacgtcgattttctgggtggggtgggagattcagttccccacgcagatgtctgatgggagccccgtcattccgcccggcacggagacggtgacgttccgcatggcctcgtcgttgggcaaggcggacatgcaggtgagcgcgcagtag

SEQ ID NO: 3447 - DNA, 687 bp, Myxococcus xanthus
atgcgtgcctattccgcgttcctctccgtcgccgtgctggccctgcccttgtcggcgggggcggatgccatctaccggtacgtcgagaaggacggcaccatcatctatacgaacgtgcagccctcgggcagcaagcgggccaagacgctgaagggcacgttcaccaaggcccccgcgaagaacacgccggtggtgggccgcaagcggaccccgccggagttggatccgcacatcaccgccgcggcgctgcgctaccgcatcccgccggcgctcgtgcgcgccgtcatgcacaccgagagcaacttcaaccccaacgcgctcagccacaagggcgccagcgggctgatgcagctcatgccggccacggcgacggacatgtacgtgaaggacatcttcaacgagcgcgacaacatcgagggcggcgtgcgctacctgcgcgtgctcgccaacatgttcgacggcgacatggtgaagatggttgccgcgtacaacgccggccccgaagcggtgaagcgctacggtggcaaggtgcccccctacgaagagacgcaggggtacgtgcgcaaggtgctcaagctctactaccactacaaggagcgcgaggcggccgtctcgagcggccccagcgagcccacatcccagaatgacgacgcgcgcgaaggggcggggggagacgagccccgctga

SEQ ID NO: 3448 - DNA, 1392 bp, Myxococcus xanthus
gaggctcagccgttcctggagcgtgcccaccagctccatccccgcatggagaaggcgcagaacctgctgggcctctgctacttcaagcttggcctgtacgacagggcggccgagctgtacgagatgctggtgcgcgacaacccggtggacccgacactgcgggtcaacctgggactggtgtacctgaagacgtccgcgctccagcgcgcggcgcgcgagttcgagacggccactgacctggcccccgagcaccagaaggcccagaactacctgggcctcaccctggcgcagatgggcgagtacggccgcgctcgcgagcacttcctgctcgccggcagtgacgtcatggcggagaagatgtctcgcgccatcgcgggggagagctacgcgaagccggcctccgccgccgtgccgccgctccgaagcgcgccggtggagccccttgtcgccgagccgccgccgcccgccgccgaaccggaggaagaagaggagattcgcttcgccgaagacgagggccccagtgccctgtccggcgcctcggcgtccgaggcgacggacgccgcggctgacattggcgtggcgcgggaggcgcctcccgagtcggccttcgaagagaccgccgacacggtggccacgagcgtgccgctggcgcccgtgcccctgacgcggttgcatctgcgcaaggtgcccgcgacgtcgctggcgcccacgtctccggcgccggagtcctcacccgttcgggacggcgggcggtcgtcgctggccgaactcgccggctcggtcgtccttcccggcgcggaggcgtcgcggcccttctgcgcggggccgggctgctacaccgtggcggtggagggggagctcctgacgcgtctggatggcctggtggcgctggcggggcagctctccttccagccggagatgaagcggttccggggccgggccacggacaagtcgttcggggaaggggcggcgcggatggtgcgtgcccgggggcagggcgtgctctacctggagccggccgcgacccgtactttcctggcggtggacctgggcgaggactccgcgtacttccgcgacgagtgcgtgttcgccttcgaggagccggtcatgttcgagaacgggcgggttccgtcggacatcgcgccggacctggacctggtgcacctgcgagggcagggccaggtgctcttgagcctcccggggccgctgcgcgcggtggcggtgcaccaggagcagccggtgacggtgccgctgacgcacctggtgggctggcaggggaacctcacgccgcgcatggtgcccgtgctcaagtccccctctggggagccgcttcgggcggcggtggagctgggcggtgaaggttttgccctcatcgccctcggtgtccgctag

SEQ ID NO: 3449 - DNA, 228 bp, Myxococcus xanthus
atggccacggaccgagcggcgcggaaacagcggaagcgagaggagcgcgcccggaagcgcgcggcgcgcaagcccagcgtgttggtgcaggagttctggaacctgcccaacatgctcacgttggggcgcatcctcatcattccgctcttcgtgtggctgacctacgacgcggaccccctcaactctgtggtggaggggctcgtcttcgaggtggctcgccatccctga

SEQ ID NO: 3450 - DNA, 258 bp, Myxococcus xanthus
atggtcatcgcctcgggccacgatgggaagtggaacacgtccctccaactggtgggcatcatctcgctctgcgtccactacgtgcatccactggagttcggcaccttctccgtgccggtggactacaacctggtgggccaggtgctcgtctacctgtctggtgccttctcggtgtggagcgcggtggtctacttccgggcgttcctggccatgttggcgaagcgtgggggggagcccgaccccgcgaaaagtgtttga

SEQ ID NO: 3451 - DNA, 783 bp, Myxococcus xanthus
atgattcggctcgtccgtgaactgtatcagtaccggggcttgctcatcagcctcgtccagcgggaactgaaggcgcgttatcgcggctcgttcctcggcttcctgtggacgttcctgaatccgacgctccacatgctggtgtacgtgctgctgttcaccgtggtgatgcggcagaacatccccaacttcccgttcttcatgttcgtgggcctgctgccgtggatctggttctccacgtcggtcggcggcggggccagcgcgatcagcgaccgacgggacttgctgaccaaggtccgcttcccggcccaggtgctgcccacgtcggtggtggtgacgaacctctgtaacttcgtcttgtcgcttccgctgatgctggtgctgggcatggcgtacggacagtggccaacctggcacgtggtgttgttcccggtggtggtgctcatccagctcaccttcacgctggcgctgacctacatcctggcggccatcaacgtgacattccgggacctgcagcacatcgtcagcaacctgctgacgctgtggttcttcgccacgccggtgctgtatccgctctccaccatccaggatgagagcgcccgctcgttgatgctggccctcaatcccatggtcagcctgatgacgtcgtaccaggccatcttctacgagcaccggcttccggacgcagagcccttgatggcgctggcggccgtctccgtggtgctgctgtgggccgcctcgtccatcttcgaatcccgccgcgaagagttcgcggagtccatctga

SEQ ID NO: 3452 - DNA, 1314 bp, Myxococcus xanthus
atgcctgaatccatggacgccatcatcctgaaggacgtcgtgaagagcttccggaagcggaccatccggggcgagtacacgaccttcaaatccgagctgcttcgctggctgcgcggcaagcgccagtcgcgtgatgccagcctcatcaccgcgctgcgcggcatcaatctcaccatccccaagggtaagacggtgggcatcatcgggcggaacggctcggggaagagcacgctgctcaagctcatcaccggcatctacacgcccacctccggcgacttgcagatcaacggtcgcatctccgccttgctggacctgggcgctggcttccatccggacttctccggacgggagaacatcctcatcaacggcatcatcctgggcatgacgcgcgccgaggtccgggcccggatggatgaaatcatcgccttcagtgagctgggcgagttcatcgacgagccggtgcgcacctactccagtggcatgtacatgcgcctggcgttcgcggtggccacgcacgtggacccggacatcctcatcatcgacgaaatcctcgccgtcggggacgagcacttcagcaagaagagcctcgccaagatgatggacttcaagcgtcaggggaagaccatcgtcctggtgacgcacgagctgggcaccgtggagcgctggtgcgacctggctgcgtggattgatggtggctacgtccgccgcgtgggcaagccctcggaggtcaccgccgagtaccgtgaggccatttccctggcggaggcgcagtccgccgccttcacgcctccggcgctcacggaagggggcggtgcgctgccgcaagtcccctccgaatcgctgcccgccgaagggcccgtccgcatccaccgggtgcagttgttggatgctcggggagagtccctggaagtcctgtcgccggaggagggcctggaggtccgtgcggatttctccgtggaagggccgtgtgaggacgtggacttccacgtgcgactgcaggccgcggacggacgcaccctgtatgagacgagcacccgcagtgaggcggtggtgctctctcggatgccgaacccgggcgtgcttcgtttcgtggtcgagcgcctgggggcgctggggggcgactactccctggtggtgtcggctcgggcctcgaagggtgagtcgtccgggcgctgtgcgttccgggtggtgtcggcgaccgaggaggagggggtgtttcgtcctcctcaccggtggttggtggagccgggtgccaactcccaggcgggcgtcccattcgagccgggcacgtctccgcgtgtggaggtgggatga

SEQ ID NO: 3453 - DNA, 3828 bp, Myxococcus xanthus
atgtggcagaagtgggctgatgtgacgcaggggcacgtggcggcgccggggccgggagatttcgcgcagatggtggctgtcctccggaaggtgctggaggagcgtcagccgtgcgcgcccgaacagtgtgatgagcgcagcgccctggaaggcgcgctgcgcctggcgacggagcacctccaccgcgcgctccccgacggcggccagggcatgtcctctctccaggaagccgcgaggctggcggacccggctgcgttctccatcccggcgtctcatcgggcgcgtgggggcacgctggtgacgtccgccaagcgtgccttcgtcaacgggttggagccgttccacgtcgagatgcttcggcctcaggggaacttcaaccgcgcgctcgtgcgggtgctggagtacctgacggtgcatcgggccctgggcctgcgcgatgacgtgtcctcctgggccgtcgctcaactggagccgctggcggtgcccacccggtgggtggtggggtcgcatcgcggccgcgtggcgggagcgctggtgggcttcgccaagcggggctacctctacacgttggggcccgtgctggaggccgtgcttcaggggcaggcccggtggaacctggccatggtggaggccatccgcgcggcggcgggtgcccaggcgccaggagaagccgaggcccgccgccatgtcgcggacgtcgaagcgctgcgcgagccgctggcgggccggaccctgcccggcgccctccgcgtcacccagccactgtggggcgaggtgctgcggcggcagtcccgtttcaatgccgagtcggtgctcgcgctcgccaacctcctgggcacgcggacggcaccgccacagccgccgtcgctggcggactaccccgcctggtgcgcggcgcgggagccggcgcgtgtcaccgcggcacaggaagccgtcgcgcggctgtcgcggcgcccgctcatctcgctggtcacgccggtccacgatgcctcggaagccttccttcgtgagtgcctcgcctcggtgagctctcaggtgtacgccgactgggaatggctcctggtggatgacgccagcaccgcgccgcacctggcgcgcatcctccgggaagcggcggagcgggagtctcgcatccgcgtcctcaccgcgtcatccgaaggggacacggcccgggccaccaacgaagggttcgcggcgtgccgtggggacttcgtggggttcctgggcgccgaggacacgctctcaccgcatgcactggccgaggtggcgctggcgttcctggcgcagcccgagctcgcgctcctctacacggacgaggacggcttggacgcgcagggccaccgctccgcgccgttcttcaagccggactggtcgcccgacctgttgcgctccgtggactacgtccgtcacttcctggtggtccgtcgcgagacgctggcgcaggtgggcggtctgcgagagggcttcgatggcgctcagggccatgacctgatgctacggctgagcgaggccacctcgtccattggtcacatcacggagccgctgtaccacgcacgtgaggggtcggcggcttcggccagccggggcgctgggctggacacggcgacgaaggcgggcgtgcgggcgctgtcggagcacctggcgcgccagggggagtccgcggaggtgacgagcccggcgcccattcagtaccgggtccgctatccggtgcggggcacgccgaaggtctccatcatcgtcccgttcaaggaccgcccggacctgctgcgcacgctggtggacagcctcctggcgcagacccgctacccccatttcgaggtgttgctcgtctccaacaacagcacccggccagagacattcgcgctgctggagcagtgggtggacccgcggctggtgaagctgacgtgggaccaccccttcaactacccggccatcaacaactgggccgcgaagcaggcctccggggagctgctgctcttcctcaacaacgacatggaggtggtggacccctcctggctggatgagctggtctcccaggcccagcggcccgaggtgggcgcggtggggtgcaagctgctcttccccgagggcaccgtgcagcatgcgggcgtcgtggtggggatgacgggcttcgcgggacatcctttctggcggctgccggaggggcccatctccactccgttcgggcacaccgaatggacgcggaactggctgtccgtcaccagcgcgtgcgtcatcctccgccgcgaggtcttcgagtcgctggggggcttcgacgagcgtttccaggtgtgtggcagtgacgtggagctgggcctgcggctgaatgcccagggcctccgcgtggtgtgcacggcgcagacgcggctcattcatcatgagtcggccagccggcgtgcggacgccattcccgaagcggactactggctgtcctatgctgcctaccggccgtggctggggccgaagggcgacccctactacaacccgcacctcacgctgacggccacggactgcggcctccgccgacatccggaggatggcgagcaactggcggtccggacgctggggcgcgacgttccgagcgcgcgggatgtccggggcgagcagcgtgcgcgggcacagcggcacctcatcgagcacctggaggcgtgggacttcacgcccgaacaggcccagacctcgcgcgagtcggcgccggcggcgctggcggcgctgcgcgcgaaggggcgggtggagacggcaacctggttcgttcccgccttcggccatgtctacgcgggcatccacaccatcttccgcttcgcggacctgatgcagcgccgccacggcgtgcgcagcgacttcgtcatctacgaccagccgaacgtgaggcccggtgacatcgaggcccgcgtggcggccatctgcccgggcgcggtcggggcggtgcgcgtgctgcgtcggccagaggacgtggcgctcctgcccgcatgcgatctggcgctggccaccgcgtggacctccgcctatcgcgtgctgcaccacccgcgggcgggccttcgcggctacttcgtccaggattacgaaccgctgttccatgcggcgggcaccccctccgcgctggccgagcagacgtatggcctgggcttctacggcatcttcaacacgcccgggctctacgaacacgtcgtgggcctgcatgggatggagggcgcctggttcgagcccgccgtggatgggaccttgtttcatccgcgccggccaccgcgccagggtcctgtgcgtgtgttcttctacggacgcccgggcaatgagcgcaacggcttcgagctggggttggccgcgttggcgcagctcaagcgggagctgggccccgccgtcgaggtgctcgcggcgggcgcggagtgggaccccgaggcctacggcgtcagggggcttgtcaccaatctgggaatgttgccggcggaacggacgggggcgctctaccgcgagtgtgatgtcgggttgtgtttcatgttcacccggcatccgtcgtacctgccgttggagatgatggcttgcggtgtcacggtcgtcacgaacgacaatcccaccaatcggtggttgctgacgcacggtgagaactgcctgcttgccgagccgaccccgagtggcgtactggcccggcttcgcgacgccgtctccaacggcgcgctccgggcccggctcggtacgaatgccgcggagcgggtcagccggacgtcgtgggaggccgaggtagaccgggtcatgaagggcttgctgaacacaggtgcgcacccagcggcgacgctggatgaccgggcttcatccttggaacacgccagctga

SEQ ID NO: 3454 - DNA, 1225 bp, Myxococcus xanthus
atgatccgcacgcgccaggacgcgggcaaccccgggtatggccaacaagaggcgctgctcacgaagctgatgcagaccgagcaacgcgcgctggggaggccgctggacgtcctggagtttggctgcggcttcgggcggcatgcctcctatctggcgtccctcgaaggcgttcgctaccacggctacgacttctccgaggcgatgatggagcccctgcggcacgcgccgcccgtggggctggagcccgtggaagagcggctcttctgtgggccggatgccctgacggcggtgggggacaggacgttcgacgtggtgttcaccgtgtccgtcctcatccacaacccgccggagcgcctgcctggcctgctggaatcgctgggcaagctggtgcgtcctggcggattgctgtgcctggtcgaaaaccagcttgttcccttcggtgtttgggagaacgcctggcaccagggctgctggctgcacccgtacgcggaactgacgcccgctggctgggacatgcatcatggcggtggcctcctggccacgcatgacgtctacgtcttcaagcgcaacgcgtcccaaggccgtcgcttcttccagctccagtccgtcgaggagccccgggacgagcgccgggaggtgacgctggagtcgctgaacgtcgagtccctgccccgactgcgggcgtggacggagcacgcgggcgaggtgctccgggaggggaacggcctgacggggatgcaggtctccgagctgacggagcgcctgacggtcgaactgaagcggtcggagcggcggcagcgcttgttgtcgctttcggatgagctggtccgccttcgcgccgagccggtggtgactgctcgggcgccggccgacgcgctggcgccgcggtatgggcatgacaacgcggcggaggccgtcgttgtcgatgcgccgctggatacgacgtgggctcacgtcgacccgcggctctcccgggtggtgcatctcttccaccaggagtggtacggcatccgtgctgcgtctggctacgcgccgggacacaagattggcatcaccgcgaatcgcgcgttgaccgcggcggaccaccagcgcatcgccgaaacgtgtgagcggctgggcgcacggtccgtcatcttccaggggttttcgcccaatgccctggaagtcatgcacatgcttcgccgcgtgttcggcagcacgctcaagctatgctgcgtgtggcacg

SEQ ID NO: 3455 - DNA, 936 bp, Myxococcus xanthus
atggccttgcggttcaagaacctcgatggcagcgggccgcagccgttcagcagcatcttcaagtgggccgtggcggacaagctcgccggccgccgccgcaaggccccagcccgcgccgaggtcccccgcgtggagcctgacctcgcgctgctcgccacgccgcccgcgacgggagaaggcgcgcggctgacgtggctggggcatgcgagctggctcgtgcagttggacggactgtcgctgctcatcgacccggtgctgcgcgacgccatcagcggcgtcatccggcgcaacgtcccgcccggtgtccccctggagaagctgccgcccatcaccgccagcctcgtctcccacaaccactacgaccacctggacctgcccacgctggagaaggtgggcgcgcccatcgtcaccggcctgggccatgcgccggtgttccggggctcgggcctgggcgtcacggagctggactggtggcgctccacgcaggtgggcgctgtcacggtgcacttcgtcccctcgcagcactggagccgccgcggcctcaacgacgtcaacgagatgctctggggcggcttcgtcatcgaaggctccagcgcccgcgtcttccactccggcgacaccgcctacttcgagggcttcaaggagattggcctgcgctacccgggcatcgacgccgcgatgctgcccattggcgcgtatgacccggcctggttcatgcgccgtcagcacatgaaccccgaggaagccgtgcaggccttcgaggacctgggcgccgcgcgcttcctggccatgcactggggcaccttcaagctcaccgacgagccgctcgacgaaccgccccgccgcctggacgcggagtggacccggcggggcctggcgcgtgagcgcgtcgaagtgctgccggtaggtggaacactcaccgtgcgccacggttga

SEQ ID NO: 3456 - DNA, 594 bp, Myxococcus xanthus
atggaagtgcgaagtgtctgtgtgttctgcggctcccggcccggcgcgcgtccggagtacatggacgccgccacacgcatgggcgccgagttggcgcggcgaggactgacgctcgtctacggcggcgcaagcgtggggctcatgggcgcggtggcggacggcgcgctggccgctggtggcaacgtcgtgggcgtgctgcctggcttccttggcgccaaggaactggcccaccggggcctcacggagctgcactccgtcggctccatgcacgagcgcaaggcgctgatggcggagcgctcggatgcgttcatcgccctgcccggaggctttggaacgctggacgagctcttcgaaatcgtgacctgggcccagctcggcctgcaccgcaagcccatgggactgctggacacgcgcggcttcttccagccattgctggccatggcgcggcatcacgcggaggaaggcttcgtccccctggagcaggccgtgcccttcgccgtgagcgcgtcgcccacggccctggtggaccggctgctggcgggcccgacgatgccccccgccgagaagtggctgaagcgctctagccagacgtga

SEQ ID NO: 3457 - DNA, 516 bp, Myxococcus xanthus
ctgggcctgtacggccccttcgtgcaggcgggccagtactggcggctgctaggcgcggtgctggagcacggcagtcccctccacctcctcttcaacatgtccgtggtggtgacgctcggcttcacgctggagcgaggcatcggcagcctgcgcttcttcggactgtcgctggtgacggcactgggcgcgtccaccttctcactcatcttcgacttcgacgtgcccacggtgggcgcgtccggaatgattctcggctgggcgggggccatgctgcccgtcgccacacgcgagggccgccgggacttgttcatctggctggcgcaggtggcggtcctcagcctgctccccttcgtgagctgggcggggcatctgggcggcttcctcttcggcctgccttgcggattggccctgcgcatggggcggcaggtctatgcgcgcgccctgcccatccttctttttctctcgctggtggtggcgctctacgcagcccaccccgagcggcgtggaggcttttga

SEQ ID NO: 3458 - DNA, 1596 bp, Myxococcus xanthus
ctcaccatgccccatcggttcgatttcctcgtcctgggaggcggcgtggcgggtctttcgttcgccctccaggcggcccgccatggcacggtggccatcctcaccaagcgcgaccgtttcgaaagcaacacggcctatgcccagggcggcatcgccagcgtgctcgcgccccctgacaccttcgagtcccacatcgaggacacgctggtggcgggtgcggggctgtgccaccgcgacgcggtggaagtcacggtgaaggaaggccccagccgcgtgcaggagctggcggacctgggcgcggagttcaaccgccgcatcaccggcgaattcgacctcacccgcgagggtggccactccgcgcgccgcatcatccattcgggcgacatcaccggccgcgaggtgcagcgcgcgctgctcgccgcgtgtgacgaagcccccaacatcaccttcttcccgcagacggccgccatcgacctcatccaggaccggcgcgtcccctcccctggggtcagccgctgtctgggggtctacgccctgctggaagacggcgtcatcgagcgcttcctggccaaggtgacggtgctggccaccggcggcgctggcaaggtgtacctctacacatccaacccggacgtggcgacgggtgacggcgtggccatggcgtaccgggcgggcgcgaaggtggcgaacatggagttctaccagttccaccccacgtgcctttaccacccggaggccaagagcttcctcatcagtgaggcgctgcgcggcgagggcggcaagctgaagctcaagagcggcgcgtccttcatggagcgctaccaccccatgggcgcgctcgcgccgcgtgacgtggtggcgcgtgccatcgacgcggagatgaagcgcacgggcgacgactgcgtctacctggacatgacgcacctgggacgcgccttcctcgccgagcgcttccccaacatctacgccacctgcaaggcgttcaacatcgacatggcggtgcagcccatccccgtcgtcccggcggcccactacatgtgcggcggcgtggtgacggacctggagggacgcaccaacgtgcccagcctgtacgccatcggagaagtcacctgtacgggcctgcacggcgccaaccggctcgcgtccaactcgctgctggaagggctcgtcttcggccaccgcgccgtgcaggtggccgccgaagaagtgcgcgcccagccctctccctccgaggacccgccgccctgggattcgggcagcgcggtggagtcggatgagagcgtcgtcgtcacccacaactgggacgagattcgcaggctcatgtggaactacgtcggcattgtccgcacggacaagcggctgatgcgcgcgcggcgccggctggaactgctgcgcgaggagattcgcgactactactggcgcttcaaggtgactcgcgacgtcatcgagctgcggaacatcgccgacgtcgcctacctcatcgtcgactgcgccagccgccgcaaggagagccgcggcctccactacacgctggactacccgcacccggacgaccaccgctggttgcgggacaccgtcgtgtccagggagccgtga

SEQ ID NO: 3459 - DNA, 921 bp, Myxococcus xanthus
atgcagcaggatggcttcgacctgggcggcggcaaggccgagtccctgggcaagctgctcgagggggccctggcgattatcaacacgctggcccagctccagcaggccatgcaggcgggcggcgcggcgggtggcgcgcagggcgcttcgtacggccagggcatttccggtgctcaaggcgcccagggcgcgtcctcgtccaagtgcttcttggacagctccttctcgcctgcgtcggcccgcggtggccgtcctcccgtggagctgaaccccagcgcccagggcccgtctccgttcatgaatgagccggtggagggcctcacgtcggcgcctgccgctggtggccccgcgcccgcgcccgctccggtgagtgacatcgagggtgcgccggtgggcggcatcggcgcggcgccctcggtgggcgcgagcacgggtgccggcggcgcgagcctgggcggcaacctgcctccggcgctggagaagctgcgtccggcgctcgagtccgcggcggccaagacgggcgtgccggtggagatgctggccgcgcaggtgtgggcggagtcgcgcggcaaggtggacgcctcgtccaccaacggcggcaacggcatgacggacacggggttgatgcaggtgaaccccaacaccttcaaggggctgcaggacaagtaccccgagttgcagggcaagaacctgtctgacccggagacgaacatcctcgcgggcgcctgctacatgaaggacatgaaggcgcagttcgggaactgggacctggccctgcgcgcctacaactccggtccgaacggcgtggacaagagcaacccgcatgcgattcccgcgggcctgggcagtgcggactacgtgcgcaacgtgaatcagttcgccagcaccctggcttccggtcagggcgcgctgccggcgtag

SEQ ID NO: 3460 - DNA, 411 bp, Myxococcus xanthus
atgtcccttcgcaaggattacatcgagcggctcatcgaggagttcgccgccgcgctggcccgcatcatcaaggcgcgccgggagaagaagctcgcggacgcccagcgcctcatccaggagacggcgctgtcctcgctgggcatggagtacgccgcgctgctgatggcggacccgggggccaccgcgcggctgctgggctcccccacgcgcgtgaaggtgctcgcgcgcctggtcgccgaggacggagagctgagcgccgagcagggcgacaccgccacggccacttcccgcattcactatgcgctcgcgctgtacgacgaagtccaggccctgggcctcacgccggacgccgacgacacggccaccatcgcccggctgcgcggcctgctggcggtgcctgacgcccgctga

SEQ ID NO: 3461 - DNA, 1437 bp, Myxococcus xanthus
gttggaggaagctggcaggtgccgcccggtgcggcgcaccttgatgtccggagcccctacacgggcaccgtcattggcagggttcccctgacgcccgcatccggagtcgcccaggcggtggaggccgcgaaggcggcggcggctgcctggaagaacacctcgctgcgggagcgcacgcagtacctgtaccgcttccgccagttcctcgagcgtgacctggacgccctggcccagctggccgccagcgaggcggggaagacggtggcggaggcccgcgcgggcctgctcaagggcatggaggtctgcgacttcgcgctgtccctccagaacctcgacacgggcgcgcacctggaggtcagccgcggcatctcctgtgagtaccgccgcgagccgctgggcgtcgtcgccggaatcactccgttcaacttcccggccatggtgccgatgtggatgttccccatcgccgtcacgctgggcaacgccttcatcctcaagccgtcggagaaggtgccgctgaccgcgtgcgcgctgggcgagctcatgtgtgaggctggctaccccgcgggcgtcttctccgtcgtgcacggcggcaaggaggcggtggacgcgctggtggcgcacccggacgtgcaggcggtgggtttcgtcggctcgtccgcggtggcgcgccacctgtacgcggagggctgcaagcgcggcaagcgcgtgctggcgctgggcagcgcgaagaaccacctcatcgtcgtgccggacgcggacccggagttgacgccgcaggcggtggtggactcgttcaccggctgcgcgggccagcgctgcatggcggccagcgtgctgctcgcggtgggcaacgtggagtcccttctccaggaagtcgtccgccgcgcggcgaagctggaattgggccccggcatgggcgcgctcatcgaccggggctcgttggaccgcttggagacggccattgcccgcgcggaggccgagggcgcgcgggtgctgctggacggccgtggccacaagccgcagggcgagccgtggtccggcggcaactggctgggccccacgctgctggacggcgtgcgtccggagatggaggccgcgcggcgcgagctgttcggcccggtgctctccatcgtccgggtgcccacgctgtccgcggcgctggcggtggagaacgcgtcgccctacggcaacgcggcgtccatcttcaccacgaacggtggggtggcgcagacggtggtggagggcgtgcgcgccggcatggtgggcgtcaacgtgggcgtccctgtcccgcgtgagccgttctccttcggtggcacgggcgattcgcgcttcgggcacggggacatcaccgggccgtccagcctcgacttctggacgcaggtgaagaaggtcacccgcaagtggtcggcccggaccgacggctcgtggatgagctga

SEQ ID NO: 3462 - DNA, 1254 bp, Myxococcus xanthus
atggccgagaaaaagaatctcaatcacatccgcctcacctcccacccggatggcgacgtccccagcgtccccatccgctggggagacggcgagccgacgcgccgcggccccgtcgtcgccacgctgacggaagccgggcaccgcaacgtcatcggcacgcatgccggcgcgtatgccgtgtaccgcgcgctcgccgtggccgcgggcatgctgccgcaggaccaccgcgccgacctgaagaacaccgcgcccgccgcgcaggtggggccgcatccgtcgtggagcgacccgcagcgcatcgtctcgctggacccgtggggcgccatcgcgccgcaggcgttccggcccttcgcggagcagggcatcgacttccggccgaccatcgccgtcaccaaggcgcacatcaacttccccgaggtgcgcgacgccatcgatgccgggcgcttgacgccggacggggacctgctgcgcggcaacggcgacatcaaggtgaccaaggccgcggtggacccggtgtggtacctgccgggcatcgcgaagcgcttcggcatgacggagagcgcgctgcgccgtggtctcttcgagcagacgggcggcatgttcccggagctgattacgcgcccggacctgcacgtcttcctgccgcccattggcgggctgacgctgtacgtcttcggcggcatcgagacgctggcggaccgggatgtgccgctgacggtgcgcgtgcatgacgagtgcaacggctccgacgtgttcggcagcgacatttgcacctgtcggccctacctggcgcacggcatcgaggagtgcgtacgcaccgcgcaggcgggcggcgcggggctcatcgtctacctgcgcaaggaaggccgggcgctgggcgaggtgacgaagttcctcgtgtacaacgcgcgcaagcggcaggagggcggcgactccgcggccacctacttccagcgcaccgagtgcgtggccggcgtgcaggacatgcgcttccaggagctgatgccggacgtgctgcactggctgggcatcacccgcatccaccgcttcgtatcgatgagtgacatgaagcacgacgcgattacgcgctcgggcattgaaatcctggagcgcgtccccatccccgacgagctcatccccgccgacgccaaggtggagatggaggcgaagaaggccgcgggttacttcacgcaagggccggtggcggacgcggcggggctggcgcaggtgaaggggcgggacctcgatgtctga

SEQ ID NO: 3463 - DNA, 1170 bp, Myxococcus xanthus
gtggcgtggctgcgcacgccgtccgccatccgcgagcggtgccaccaactgttggacctggggctggcgggcaagctggagcacttccgcgtcgagccgtcgcggctgcccatcgtcgtggacacggtgctgcacgtgacgcgcgagcactaccccacgctggatgtgccgctgcacagccgctggcgccacttcgacgtgggcggcgtggcgcggttggcggagctggaggcgcggctgaaggacgcctctcttcaagagcgggcgcgcgcgaagctggacctggtggtggtgagcgtgctgctggacgcgggcagtggcccgcagtggcgctaccaggaggccggcggaaagacgtgggcgcgctccgagggactggccgtggccagcttccgcatgttcatggaggggcgcttctcgtcggacccggaccggccgctgcgcgtggacgcggaggcgctggggcggctcacgcgcgaggcgctcgcgcagggcatgcaggtgacggatgccaacccggtggatgggctggagggccggctgcacctgctgcacgggctggcgaaggtgctgcctcggccaggggcgctgctggacatcatcaccgcgcagcagcgcagcgtgcgcgccgcggagctgctggggctggtgttggaggtgctgggccccatctggccggggcgggtgatggtggacgcggtgaacctgggcgacgtgtggccacatcccgcgctggggtcggtggagagcctggaggcgctggtgcccttccacaagctgtcgcagtggctgacgtattccctggtggagccgctgtccgaggccggtgtggtggtgacggagctggatggcctcaccggcctgcccgagtaccgcaacggtggcttgctggtggacctgggcgtgctgtctccccgggagccgcgcctcttcacgcagtccttccacccgggtgacgagcccatcgtggagtggcgcgcgctgacggtggccctgctggaccgggtggcggcgctggtgcgtggacggctgggcctgagcgcggaggagctgccgctggggaaggtgctccagggtggcacgtggaccgcgggccggcgcgtggcggcggagcggcgccctggtggcgggccgcccatccgcgtggacagtgacggcacggtgttctga

SEQ ID NO: 3464 - DNA, 636 bp, Myxococcus xanthus
atggagtttccgaactgcacggtggtggaccacccgctggtgaagcacaagctcacgcagatgcgccgggtggagacgagcaccgcctcctttcgggcgctgctccaggaaatctcactgctgctcgcctatgaggcgctgagagacctcaaggtgcgcgaggaggacatccagacgcccatggcacgcacggtggcgccggtgctggatggcaagaagttggtgctggtggccatcatgcgcgcggggcagggcatcctcgacgggatgttgcaactggtgccctccgcgcgcgtggggcacatcggcctgtaccgagacccggagacgctgtcgccggtggagtactactaccgcgtgcccggccagctcgcggaccgggacgtggtggtgtgcgacccgatgctcgccacggggaactcggcggtggccgcgctccagcggctgaagaagagcaagcccggctcattgcgcttcgtctgtctgctggcgtgcccggagggcctgacgaacctgcgcgagcaccacccggacgtccacgtctacaccgccgccatcgacgagcgattggacgagcacggctacatcctcccgggcctgggcgacgcgggcgaccggctcttcgggaccaagtag

SEQ ID NO: 3465 - DNA, 480 bp, Myxococcus xanthus
atgagggtctggctgggctgcgccagtgtgctgggactgtcgggaatcgcccgggcggagtcggagccgtgcgcgtgctccacgtcgaaccagagcgtcgtctccgaggtgccgtgcctcattttccgcgcgtccgtcagctgcggactgagcaacgtgcgcaacgcctgtgcgcagacggtgacgctggtcgactggccgttgtcgagctgtccggacagtgtgtgcacccaggcgctcgcaccaggtgaagaggcgagcttcctcttcggcagggaggagtccgagagagagcgcttcgtcgagcagtcctacacggtgcaggtggacggcgtggaccagcggctcgccatcagcgcggaggtgacgtgctgggacgtccgtgattccgatggttgtgcagcggcgccgggtgcgctgggcgcggcgggggtggcgctgctggtgggcgcggtggctcgccggcgccggggagcgtaa

SEQ ID NO: 3466 - DNA, 1752 bp, Myxococcus xanthus
atgacgctgcatcaggcaccgtcgtccctcaccaccgtctccgaacagagcggctggacgcgcacgggccgctactcggaagtggagtctctctgccgcgccttccccaaggcgtttcccggcaaggtccgctgcgacacggttggcaccacgccggaaggccggccgctgcttgcgctcgtcgccagcgcggatggcaccctcacgcccgccgccgcggcgcgcaagcagcgccccgtcgtcttcttccagggcggcatccactccggtgagattgacggcaaggacgctggcttctggctgctgcgcgacctgctcgccgggaaggagcagcccggcgtcctcaagcgcgtcaccgccgtcttcgtccccgtcttcaacgtggacggccatgagcgcttcggccccaaccaccgtcccaaccagaatggccccgaggagatgggctggcgcgccaccgcgcagaacctcaacctcaaccgcgactacgccaaggcggaggccccggagatggtggccctgctgaagtacctccacgcgtgggacccgctcgtctacgccgacctgcacgccaccaacggcgccaagttcgaacatgacgtgtccgtaggcatcgagccgcagaagtccggaccggccgcgctgcgcgagctgggcgtgaagctgcgcgaggagctcttcaccgagctggagtcccagcagcacctgcccgtgcccttctacccgtccttcatcgaggacgatgatcccagctccggcttcgcctacggcgtgccgccgccgcgcttcagccatgcctactgggccgcgcaccgccgcttcggcgtgctggtggagacacactcatggaagccctatgcggagcgcgtgaaggccacgcggaatatcgtggccagcctgctgcggctggtggcccgtgacggcgccgccctgcgcgcggcggtgaaggcggcggacgcggcggacgcggccggcaagacgcgcgaggtggtgctcacgtggaagaacacggagcagaagcggaccatcgacttccggggctacgcctatgagcggggcgcctccgacgtgtccggccagacgtggattcgctacgacgacacgaagccccaggtctggaaggtgccctacttcgaggagattcagcccgcgctcaccgcctcgctgcccgcggggggctacctggttccgcccgcgcacgccacctgggtggaagcgaagctggccgcgcacggcctgcgctcgcagcgcctcgccaagcccgtggccagcgcggcggtggaaagcttccgcgccaccgaggcgaagtggagcatccagtccgtggagaaccggcagacgctcaacgtgaagggcgcgtgggagccgcaatcacagacgctccccgcgggcacgctgtacgtgccggtggcgcaggagggcgtggagctggtggcgcacctgtttgagcccacggggccggactcgctgctgtcctggggcttcttcaacgcccacttcgagcagaaggagtacgtggaggactacgtgctggagcccttcgcgcgggagctgctcgcgaaggacgcttcggtgaaggcggagtgggaagcgaagttgaaggacccggccttcgccaaggacgcgcgcgcccgcctgcgcttcttctatgagcgccacccggcccgcgacgtccagctccgcgtctaccccgtgctgcgcatccaggccgcgccccaggggttggcggcggtgaagcccgcgaagccgtag

SEQ ID NO: 3467 - DNA, 837 bp, Myxococcus xanthus
atggatgccaccgacgacgtcgccctcctgggcaagctcgcggcgatgggcgagcgcgcgcagctcccggtggtggccgccgtgtccgcgccgctcctgggcgtggcgcaggcggagctggccgtggcgctggaggaggagcgcgagcatgtccccgaggcctggacggagctgcgccaggacgagtccgcgcgctggctgtgcgccgtcatcaaccgcgcggtggtggccagcgagggtcgcggcgcggcccggcgcgtgagcttcaccagccccgcgctggcggtggcggcgatgctggcggccagcttccgggacaccagcgccttcgcgcgcatcatgggccagcagggcggcctgaaggcgcccgccatgtgggagctgcccaccggccgcgataccgggctgagcattcccaccgagcacttcctccccatccgggcgcaggcgcggctggaggagcgcggcatcctgggcctgggcagcgggcgcaacgcggacgcggtgctgctgccccccgcgcccatggtgttcggcgcgaggctacgcggtgccgctgcccgcgcagttgctcaccgggcgcatcgtccgcttccccacctgggtgcggcaccagttgcccgcgggcaccggcggcgacgacgtggacgccatcttctcgcaggccgcggaggtgttcctcttccggggcgccacggagaacggacaactgcgcggccagttggtggccacggacaacggccgcggggtgcacgtcaccgccaccgtccgcccggagcacgcgggcacgcgcttccagctcgccttcaccctgccactgcgcggctgaagtcagtc

SEQ ID NO: 3468 - DNA, 771 bp, Myxococcus xanthus
atgcgagtgaacctcttccagtccatcgcgaggctctcggagacccggacgcagcagagcgtcccgcccgcagcgtccggccccgcccagacccaggccccccagcagccgtccgtccccgacgtggtggcccggtacctcaccgacagcttcgaggccgcgggcgcatcggaagtcatcaagcagaccaaggactccaactgcggcgccgcggtggccaccctgctgtcgcgcaccgcgggcaaggactccgcgtcggcggcgcagaagatggacacgctggagtcgcgcttcaccgacggcggcggcacgaccccggaggagctcgcgaagatgctcgcgcacgagggcctggaggtgaagaagggcacctcgaacttcgacatgccttcggtgaacgaggcgcttgcccgcggtcagcaagtcgtcgtccaactggacaccaaccggctcgccacgggcgtggactccaagatcgccggtgactcgcactgggtcgtcgtcgacggcatggacgacaagggcaactaccaggtgaaggacacgaacacgggcaccaagtactccgtgtccggtcagcagatcgccgactccgtgggctccgcgtgggagctgcaccagggtggcggcatgctcgtcgtcggcgacccgcagagcgccatggacgaaggcacgctggtggagaaaagttccctccacaccagcgtcctgggtaacaccgacggcggtggctcccgggctcgcggcagcttcggccgcgagtcttcctga

SEQ ID NO: 3469 - DNA, 1254 bp, Myxococcus xanthus
atggtgctgtccggccccgagtccggccagagccatgcgctcaccaggcccgagtacgtgcttggcaaggcccccacgtgcgacatcgtcctcaccgacaagacgatttcccgcgagcacctcaagctgacggtccacgacgaacacgtggtggccacggacatgggctcgcgcaacggctcctcgtgtgacggccgccgcttcaccgagttggagctgcacccaggcaccgtcatcaccctgggcaccaccgagctgaagctggtgccagaggagtcggcgaagcgcacgctgctgctctccaaccgcgaccgcttcggcgcgctggtgggcaacagccgccggatgcgcgaggtgttcaccctgctggagcgcctgtccccgggcggcgcggacgtgctcatccagggcgagacgggcaccggcaaggacctgtgcgccgaagccatccaccaggccagccgccgcgccagcgggcccttcgtcatcgtggacctggcgggcgtggccccctcgctcatcgagtccgagctgttcggccacgtgaagggcgccttcaccaacgcccagagcgaccgcgccggcgccttcgagcgcgcccacaacggcaccgtcttcctggatgaagtcggtgagctgccgctggagctccagccccgcctgctgcgggtgctggagcgccgccaggtgaagcgcgtgggcgccaacgactacgtcaccgtcaacatgcgcgtggtgacggccacccaccgggacctggaggacgccgtgcggcaggggaagttccgccgcgacctctaccaccggctcgccgtgctccgcgtgacgatgccctccctgcgcgagcgccccgaggacatccccctgctcatcgacaccatgctcgagcagacgggccgcccgcccagcaccctgtcggaccagacgcgcgccctgctcacccagtacccctggcccggcaacgtgcgcgagctgcgcaacgtggtggagcaggtggtgaacctgggcgaggaggccctcccggagctggagcccgccgacagcgagcggggccacagcgcggccgacctggacctgcccttcaaggaggccaaggagcggctcgtggaaggcttcgagcgcgactacctccgcaacctcctggagcgctgcgaggggaacatctcccgcgcctcccgcgaggccgacatcgaccgcgtctacctccgcaagctcctgaaaaagcacggtatcgaaccgagcggcggcgcttga

SEQ ID NO: 3470 - DNA, 2724 bp, Myxococcus xanthus
gcgggcacgggcaatcgagagggcgatgccttcggcaccggccctgggtcgcggcgcgacgacgcgccacccgttccccaggtggggcgctacttcctcctcaagcgcctgggacagggcggcatgggcgtggtgtacgccgcctatgacccggacctggaccgcaaggtggcgctcaagctgctgcacgcggactcgcggacggactcggaggaggcccgagcccggctgctgcgcgaggcgcaggccatggcgcgcgtctcgcaccccaacgtcatccccatcttcgacgtggacgtgtggggtgaccgcgtcttcctggccatggagctggtggacggcggcaccctggcctcgtgggtgaaggaggggcagcgctcctggcgagagattctggagtccttcctcgccgcgggccgggggctccaggccgcgcacgaagccgggctggtgcaccgcgacttcaagcccgccaacgtgctggtgaacaaggcaggccgcgtcttcgtcaccgacttcggcctggcgcggccggtgggcacgctgcccaaggaggagcccctctccgaggacgcagaggccctcattccctccgagcggcgcatgctggacacgcccctcaccgaggcgggcctcatcatcggcacgcccagctacatgtccccggagcagttccgtggggatgacctggacccgcgctcggaccagttcagcttctgcgtcgcgctgtactgggcgctctaccgtcagcgccccttcgagcccgccaagatggaggcctatgcctcctcgcggaagccccaggcccagcccgtggtcgaggccaccgagccgctgaacgtgacggcgcccctggagcgagaggcccccaagcccctgccgccgcccgtcctcatccaggagccgccgcgcgacgtgaaggtccccgcctgggtgaagcaggcgatgatgcgcggcctgtcgctggacccggccgcgcgcttcgcgtccatggaggcgctgctcggcgcgctgtcacaagagcaccgcttcacgaagcgccggcgctgggtggcgggcgcgagcaccgtggcggcgggcgtggccctggtgggcggcgtcctctaccagcagtcccaggtctgcgcggccgcgggcgcgcgcatggatgacgtctggagcccggcggcgcggcaacaggtggaggcggccttcctcgccactggcaagcccttcgcgcaggagctggccggcaaggtgtcccaggtgctggacggctacgcgagcgcgtggaagcagcagagcaccgaggcctgcgaagccacccacgtccacggcgtgcagacggaggagctgctgacacggcgaacggtgtgtctggcgcggcggcacaaggacgtgcgcgccacggtggcgctgctgtccagcgcggacgcgtcgctggtggagaagtcggtggacgcggtgcacgccctgccctcgctgcacgaatgcgaggacgaggagtccctggccgaacaacagcggctgccctcggacgcggcgaagcgcgccgacatcgagaagctggaggagcagctcgcgggcgtgaaggcgctggtggacgcgggccgctatccgaaagccctggagacggcgcgcgcgctggaggcaccggtgctggccaccggccacctgccgctcacggccgagctgcgcttccacctgggctggctccaggaacagaacggccagtcccccgaggcgtcgaagcagctcttccacgccgtgcgcgacgccgaggcggggcgggcggaccggctgaaggtcgccatcctcaacaagctgctctacgtggaggacggccagcagcacttcacccaggcctcggactggggcgagctggcacacgcgaccctccagcgtctgggcggcgagcccgtgctggaagccgacgtgcggatgaaccaggccaacctcgcggtgtcgcaggagcgcttcgaggatgcgcgcacgctgctggagcaggccaaggcgctccaggcccacgccctgcccctgggccaccccaagcgcgcgcgaaccaccttcctgctgggcggcgtgatgctggacctggggaagcccgaggaggcggtgaagctgctggaggaagcgctgacactgacggaggccgcggtgggcccctggcacccggacatggcccagcgccacggcatgctgtcgctgacgctgcgcgagctgaagcaggacgccaaggccctggcgcacgcgcaggcggcggcccaggtccgcaaggccacgcagggcgagacgagcgtcctgtacgcggagaccctggacgaggtgggcatgtgcctgcacgcgatgaagcgctacgacgaggcgctgaaggcctacgaagaggcgctggtcatcaagcgcgcggcgctacccgcggacgacgagcgcctccagtactcctatgacggcgtgggccaggcgttgctggagctgggcaaggcgaacgaatcggtggcgccgctgcggcaggccgtctccttcgcgtcggccccgcccgacgtgctggccgagtccggcttcgccctggctcgcgccctgtggatgacgcagcagcccccggcggcccgcggggaggcggcccaggcccgggcgcgcttcaccgaggccggcctggatgcgcgggtggcggacgtggacgcctggctctcgacgctgccgcccgagcctgccccccggcccgcgcgacgcaagccccggcggtga

SEQ ID NO: 3471 - DNA, 570 bp, Myxococcus xanthus
atggccaagaagtatttccagctcgccgacaacgtttccattccgggccgttgggagttgggccacccgggagatgcgcgaggtcacgaagtagacgacccttggatgttccgggagggccatccagtggaggtgagccagcgattcacggttcctatcgaggagccgggcaaggccctcgatttttctctcgcgggcttcagcactcccgtggtcagcgccagcgtggccaacatcttcctggagatggctcccaaggacgtgcagctcctccccgtggacatccatggccccctggacccgtacttcatcctggtggccacgaggctcattcgctgcattgacgacgcagcatcggaagaggtgctccactggcgcccggaggatgggcggcccgagaaggtggggcagtaccgggatgtctacggcatgcgcgtcgacctcgcccaggtgggcaacgcccaggtgttccgcacctggggctggtccatcgccctcatcgtctccgaggacatcaagcaggctttggagcgtgcgaaggcgaccggcgtgaagttcacaccggtgtag

SEQ ID NO: 3472 - DNA, 1344 bp, Myxococcus xanthus
atgagagcgcatgcggtcatctggctggtgctggcgcttgccgtcacaggctgttcgaccacgcgactcgtgcgcctggacaccggcgacggacatctcatcgtccacacgcccttcgcggaggaaggcgacgggcctgtggaactggccgacgatgaattcgaggagaccatggtggcgctcgcccggggcgtgcggcccttctccaatcccctgcgcgaggcccgccagcgcttcggcgttcccgagcgaagcggcgtgtacctgtacgaggggcacggcccccggctcatcccccaggatgaagggaaggacccaggcggtccgcatctcctggaagtctacgcggatgacgaactgacgcgcgcctatggccgctggtgcgagcgcaagtcgcagcccggtgactgcctgcgcctgttgtcagaaggcccgctgctggccagcgacggcaagtactcgctggccatggccatcgccatggactcggtgtgggaagagacagcagaggcgctggaggacatggccgacccacaggcactgctggcgacggtgagtgcctcggtcagcatgtacctgctcctctggtcgctgcccgagccagtgagcaagggactggccgccctgctgacggcctcggccattgcctacctgggcgtggataccgtgtggcgcattctggacgggtggatggcgctggtgcgcgaagtggaccgggccaccaccttcgagcaactcagcgaggcgggcgaggcgtacggcgaagtgctcggggagaacgcggcgcgcgtcttcgtcatgctggccacggcggcgataagcaatacggcgggcctggcgacgcagtcctcgagactgccgggctcggcgcaggctgcgctcgcggtggagacgcaggcgggctatcagtacttgactatcggaagcgtgcagtcggtggcgatgacggccgagggcttcactgtcgccctggcgcccaacgcggtcgccatggcggcccaaggcatgagcggcggccgctccgaaaaccaccacctcgcgacgaacaagaacggcgtctccaccgtgcgcggcgggccctggacgccccggttcaagagaatcttcaagaaggcagggatggagctggaagaccctgagaacatcgtgcccgtgaagggccacaagggcccccatccccagaggtatcatgagcgggtctacgcacggctggaggaagcgacgaaaggctgccggaagatgaccgagtgccgggaggccttggtcaacgaactcagacaactcgccaaggaagccggcgccccgggctccggcttgaacaagctcctcactcgaaccgagtga

SEQ ID NO: 3473 - DNA, 1395 bp, Myxococcus xanthus
gctatgggggcgccggaagtcgtcctgcgccgttgcgccctgaaggacggctgctcgtccagctcggtgctggcggaggtggacggcctggcgcggcagggcatgcgcgtgctcgcggtggcataccgggaggtgacggtgtcacacgtcgcgttgcgcatggaggacgtcgagggcggcctgcggctgctcggcctggaggggatgattgacccgcctcgcgaggaggccatggccgcggtgcgcgcctgccacgaggcgggaatcacggtgaagatgattaccggtgaccacccctccacggcggcggccatcggcgcgcagttgggcctgctgaagccgggggaggagggcgtcacaggcgcgcggctggccaccacggatgatgcggcgctggaggaggtggccctgcgctccaacgtcttcgcgcgggtggcgcccgagcacaagctgcggctggtgcgcgcgctccagcgccggcagcacgtggtggccatgacgggggacggcgtcaacgacgcgcccgcgctcaagcaggccaacatcggcgtggccatgggcatcaccggcacggcggtggcgaaggacgcggcggacatcgtgctgacggatgacaacttcgcctccatcgtcgcggcggtggaggaggggcggcgcgtctacgacaacctcatcaagtcgctggccttcgtcctgcccaccaacctggggctggcgctcatcctgctgttcggcgtgtccctcttccccatccaggaggtgggcggacggctggtgccgctgatggccatgctgcccactcagttgctctggataaacctggtggccacggtgtcactggcgctgccgttggccttcgaggcccgggagccggacgtcatgcgcagggcacccagggaccccgaagcgccggtgctcaaccgcttcgtggtgatgcgcaccggactggtggcgttgctgatgaccgcgggcgccatcggcctcttcctgtgggagtaccgccgggacattcctcgcacgggaaacgcgcacgcgctggccgaggcccagacgatggcggtgaacaccgtcatcagcttccagatgttctacctgttcatgtgccgcagcctcatgggctcggtgcgcaaggtgggcctcttcagcaaccgctcggtgttcgtgggcatgggcctgctggtgctgctccaggtggccttcatgtacctgcccttcatgcagcgcgtgttcggcaccgcgcccctgggcttggaggacgtgggcctgtccatcctggtgggcgcggtcgtgctgccggtggtggggctggagaagtggctgcggcagcgcaaggacgacacggacgcttcatcaggacgcggcgccgcgcggctgcgcgagcgtgtgcccacgtga

SEQ ID NO: 3474 - DNA, 1050 bp, Myxococcus xanthus
atggagcctacccccaaggtcatccgtcacttccacccggtgctctccgcccgcgcgctgggcacccggccggtccgcgtggaggtggcgggccgcgcctacgcgctcttccgggacggcacagggcagcccgcggcgctcgcggatgcctgcccccatcgcttcgcgccgctgtccaaggggacggtgcgcgcggacggccggctccagtgtccgtaccacggctggcgcttcgacgcggaggggcgcggcagcaaccccagccagccggagctgcgccactgtgacgcgcgcagcttccaggtggtggagcgctacggctacctgtggctggccgagcgggacacgccgctttcggccatgcccgacatgggcgatgagggctacgtcttcggcggcgcgttctccacgcacttcgcggcgccgctgcacgtgtcgctcgacaacttcagcgaggacgagcacacgccctacgtccacacccggctgggctgggacgacccgaacgcgggccgggtggagttcgaggcgcgcaacctggaggaccgcacggaggtgcactaccgtgccccgcagcggcccgcgcccatcatgacggtgctgggcgtgcgcgacggtgacttcttccagaacgactgggtgacgcgcttcgacccggtgcgcagccagtacaccatccgctgggtggcgccggacggctcgccgcgtcccttcatcacccgggcgaacatcttcttcgtgccggagacggcgcgcaccacgcgcctgcacgtcttctcattcctgcgcaccgaacagcggctgctgcgtccgctgctccccgtggcggcgcgggcggccatggcgctcacctggtgggaggtgcgcgacgacgcgcgcttcatcaccaccgtggcggacacgccctacagtcacaagggcatgcggctggaccgtttcgacgcgccgctggtgcaccagcggcggctcatggagcgcatctactacggcgccggtccgaagatgacgggggccgtggtgccgctctcccgcgaggccccgggcggctga

SEQ ID NO: 3475 - DNA, 384 bp, Myxococcus xanthus
ctcctcttcgagctgatgcacacacacatgcgcaacttccccgcactggcggcggagttcgacctgtcgccggtgcaggcgcacgtgttgcggcagttgggggaagggccgctggccatgagcacgctggccgcctacctgtcgtgcgacgcgtccaacgtcacgggcctggtggaccggatggaggcgcgcggactggtggtgcgccgcagctccgagcaggaccggcgggtgaagatgctggtcctgacggaggacggcgctgcgctgcgcgagcggctgctggagcgcatcttcgagccgccggacgccatctgcggcctgccggaagaggacctgtgcgcgctgcgcgacatcatgcgccgcgcgctgggcgcgcagtag

SEQ ID NO: 3476 - DNA, 1194 bp, Myxococcus xanthus
atggctgccagtgaagaacgccgcttccaggccctggtgctcgcgcccatccggcgtgtgcagcggcgcctcaacgcggtggcatgggcggaggccggcatcgttccgatgtgggccaccgccacggcctgcgtgctggcccggttcctcctgcgcggcgccttcgtgtgggccctgccaccgcttctggcgctggggctgggcgcgtggttcttgcgtgcgcgttcccggcgggtgtcgttggagcaggcggcggtgctcgcggaccggtcggcgaacgcgggcgggctgctcctcacccggctggagcgcccggtgggggagtgggagctggccgtcaatcagttcgcgggtggggtgaagcctcctgacgtgaagtggcggcgcccggccgcggcgctcgcgggcgcggtgctcttcgcggtggcgggcttcctgttgcccctgtccgcgccacaaggccgcgccgtgaatgccgccgccgcggcgaaggtggccgcggtccaggcgcaggcggaggcgctcgccaaggaagaggtgctggaggaggccgtcgaggaggagctgcggcggctggccgaggaagtctccgagggccgcttcgacgccggagattgggaggccgccgacgcgctggagaagcggttggccgagcaggccgcggaggccgccgcgcaattggcccaggccgcggaggccgcgcgggcgttggaggatgcgctaggcgccgcgggaggcgccgaggccgccacgcgtgagcgcgaggccttggagcaggcgctgatggcgctgggaggcggcaaagaaggtggctcgtccgacagcgcggacggaacgggggaggacggggtgccgcacgattccgagaacggcgaagcggcacaggcggatgccacgcgcgcgtccggacaaggaacgcagggcgccgagggacagcagggcacggaaggctcgcggagtgagcgctccggtgaggcgcagagcgctgcccgcgcgcgggcctccggttcaccggaccagattgcccagcctgcgcgaggcgctggagcgcaggcgtcagtcgctggagaaccgcttcgattcgaacagccgcaacggttccaattcgcaggcccgtcgccagggttctggcggccagaactcggggcaggggcgccaagggcaggggcagtcggggcgcggcgccgagggtga

SEQ ID NO: 3477 - DNA, 2733 bp, Myxococcus xanthus
gctctaaagcgcaccggcaccaacccgctcgccccggattcggacggcgacacctgcagcgacggtgacgaggacgtcaaccgcaacggcatcgtggacggcaacgagacggacccgcgcgtggcggactgcgccgcgtcgattccggacgccgacttcgacggcatcccggactcggtggaggttgcgacgggcacggacccgaacaacgccgacacggacggcgacggcatcccggacggtgtcgaggacaagaaccgcaacggccgcgtggacgccggtgagacggacccccgcctggcggacaccgactgcgacggtctccaggacggcccgggccgcaatggcttccgcggtgaggacaccaacggtaacggccgcgtggacccgggcgagacggacccgaccaaccccgacacggacggtgacggcctgctggacggcctggagctgggtgtgacgacggcgcaggcgccgcgtcagaactgtggctacgtgggcgacgcggacccgaccaccaccacgtccccgacgaaccccgacagcgacggtgacggcatccaggacggcgcggaggacgccaaccagaacgggcgcgtggacgcgggcgagctgaacccgaacgactctgccgacggcgcggccaacacgccggcgggccaggcctgccgcacgtccaacctgcgcaccgtcaccttcaaggaagagaacggcgcggacctgcggctggcgctgccctccaccttcacggacgccaacctgcgcaccatccgcgatggcaacaacgcggtgggcatcatcggctgggacgccaccaagcaggtgacgctgattgcgtacaagcgcggccgcgtgggctcgtcgtccaaccccacgaacgacgaggcgggcatccgctccgcgtcgttcaactccgccacgcgtgacttccagcagaccttcaatacctgggacggctacgccgcgctgtcggcgcgttacgccatgtcgggcggcgcggacctgaagacgttcaccaacaccctgacccgctcgctggtgcccggaagcacgggagagctgacgggaacggccggcatcaccgggcccttcaccatgcaggcgcagtacgtgcaccgctccgaccagagcgtggtggtggtgctggccatcaccccgacgtctcgttacaacgaggcgggcagcctcttcacgacggcggacacggcgggtggctcggcgctggcgcagttcggtgacgcggacgcggtgcagtgcgagaagttcaccgtgcggcaggcggtggtggacttcatcttcgtggtggacgacagcggctccatggcctcgtcgcagcagtcgctggccaacgcggccacggccgtggcggacaagctggccaacgcgacgctggattatcggctggcgatggtgagcaccacctatacctatggcagtggttcgaactcggggctgctgcgtggcttcacgccgaacatcaaccagttccgggcgtggctgacgcagaacagcacctgcggcggcaacggccagtgcaccaccgtcaccatccccgcggggacccagcccaccacctgttcgtccaactcgcagtgctgggtggggcagagcggaaacggcacggagcgtccgctggaggccgctcgcgccgtcatcaacctgttggcctcgtccggtggcacggcggagacgcgcttccgcgcgggcgccaaggtcgtggtcgtcatcctgacggacacgcgggaccagtccaacggcaccatcgatacgtacagccagtacttcctgggcacgggcaacgagccggggacgaaccgcaacccgctgaatcagcccatcgacgtgcacggcatcctctgcccgcatgagaacgccaccaacgacaccagcacctggtgccagacccaggaagacccccggaacccgcggcacctggacatcatccaggccaccggcggcgtgtacggcagcatccgggactcgaacgccatcaccaccaccatcaacgccatcatcgacagcgtcatcgcgtcggtgggttaccggacgcagaagccgcccatcggcgcctcgctgaaggtggccatggacgcggtggcgaacgcgtcgcagtgccccacgccgggagacctgccacgcagccgcactcacggcttcgacgtggacggcatcagccgcgcggtgtccttctacggcgggtgccgcccgcagaacgcggggaccacccaggcggcgctgtcctaccgctactggacggaccgcacgacgaacccgaacggcatccccgcgccgtgcgcggcggacccgtaccacgacccgaacgacccggacttctgcgaaggcaagctgacgtgcaaccgcaccacggaccagtgcgagtgcccggcggactgcggcggcggcggtgacccgggccaggtgtgcaacacggaccccgcggtgtgcgccttcacctgcgcgccggactgcggcggcacgtgcggcacctacgagacgtgcaacacggacacctgctcgtgctcgtgtgcccagacggccacctgcgcgccgggcttcacgttcagccaggacgcgtgcggctgcgtgtgtgacacggccgcgctgaactgcggtgaccggtaccaggcggaccccaacacgtgcgcctgtgcctgtaagtcggactgcggcggctgcggtccgaacgcggtctgcaaccagagctactgcgcctgcgaaggcatcatcggctga

SEQ ID NO: 3478 - DNA, 915 bp, Myxococcus xanthus
atgctggaccaggaatccgtcgtcgagcaggtggtggtggcggtgctcgcacgcgggcacgtcctgctggagggcctgcctggcctgggcaagacggagctgtgcaaggcgctggcgcggctgctgtcgctgcccttccgccgcatccaattcactcccgacctgctacccggcgacatcacgggtacctacgtgctggaaggcgatggccgccgcgacttcgtcttccgcgagggcccgctcttcgccagcctggtgctggcggacgaaatcaaccgctccagtccgaagacgcagtccgcgctgctggaggccatgcaggagcgcagcgtcaccgtgctggggcagacgcggccgttgccggaccccttcttcgtgctcgccacgcagaaccccatcgagctggagggcacctatccgctgcccgaggcgcagctcgaccggttcctcttccgcatccaggtgcccccggtgggcgcgaagacgctgcgcgcgctgctcaccacgcgcgtgcgtggcgcgccgccggagctgtcgccggtgctggacgcggagggcctgggccgcctcttcgccgccgcggaccgcgtgcacctgccgggccccgtggcggacttcatcggccggttggtggaggcctcagacccacgccaaccgtcggcgcccgatgccgtgcgccgcttcgtccgttatggcgccagtcctcgtgcggcgctcgcgctcgccgccgccgggcgcgcgctggcgttgctgcaaggcaggcccaacgtgggcttcgatgacgtggtggccgccgcgccttccgccctcaatcaccggttggtgctcgcctacgaggcctcgctggagaaggtcagcgcggcggacgtggtgcgcgcgctgctccaggccgtccccgaggtgccgcgtgcgtag

SEQ ID NO: 3479 - DNA, 927 bp, Myxococcus xanthus
atgctgggggagtccatcccagggcccgtgaatcccgcgggggccgcgcctcggtgggagcgaagcaacctgctcgccgggggcatcacgccgctgctggaccatgccaacacgcccgtggggcggttcctgctgctcatcttcgccttcgtgctggcggtggggccgggcgggctgatgctggcgcggcgccgagggccggtggcggtgctcgtggcggtgcccctggtgtcggtcctcacctgtgtggcgctcgtgacctggtcggtgctcgtggatggtttcgccgtgcactccgcgcgctacagcctcacgtggctggacgcggagcgctcgcgcgcggtgacgctcggcgtctccgcctggtacgccaacgtgtcttcggggccggtgcgcttcccggcgacgagcgcgctgctggcaccggacaacgccgacgagatgctggcggacctggactggacgaatggcctgacggtgacgcatggcttcctgccgccacggacctaccgtgagtggggcgaggtggccgtgctgccttctcgcgcgcggctcgtcgtccggcgggagggcggcaccgtgcgcgtccagaacgcgctgggggcgcggctggtgcagggctacgtccgggtggggagccagagctacgcgttgcccgcgctggaggatggcgcggaagggacgctgggcgaaccgctgcccgcgggcgcgacgccggtgagccagttggtgtccagcgtgggggggccgtcgctcgccgagggacgtctgtcagggggcgaggtgaacttccgcgctccgcttccggagggtggcttcatcgcgcgcctggagggcttggggccggcgccctcgtccgccgttgacgtggagctggaggccggcatgcacctggtgcgaggccagtcggaaggggggcggccatga

SEQ ID NO: 3480 - DNA, 987 bp, Myxococcus xanthus
atgagcctgctggaggtgaagggactgcggcgcgactacggggcgctgcgcgcggtggatgacgtgtcgttctccttggaggccggcagcatcctgggcttcatcgggcccaacggcgcgggcaagagcactacgctgcgcatcctggccacgctggatgtgcccacgtcgggcgaggtgctactggacggacactcgttggtggattcgccggaccgggcgcgtccgctcatcggctacatgccggaccggtacggcacctatgacgacgtcaccgtcttcgagttcctggacttcttcgcgcgcgcctatggactgaagggcgcggcgcgccggcagcgggtggagtcggtgatggcgttcaccggactcacgcccctggcggaccggctcaccaccgcgttgtccaagggcatgcggcagcgcgtggcgctggggcgcacgttgctgcacgacccgtcgctgctgctgctggacgagcccgcggacgggttggacccgcgcgcccgtatcgagctgcgcgagctgttgcgcgccctggcggaccagggcaaggcggtcatcatctccagccacatcctcacggagctggcggagatctgcgacacctgcgccatcatcgagcaggggcgtctactggccaccggcaaggtggcggacctgctccagcagcaggaggtgggcgcggcggtgacgcccgagctgacggtgcggctggccgtgggcgacgcgggcaacgccgtctgggagcgcgcggagcgggtgctcctcgagcagccgcgcgtgaagcgggtggcgcgggagggcgaggcgctgcgcgtgcgcctggagctggatgcgggcgcgggccctgcgcaggtggacgcggcggcggcggtgctgctggcggcgctggtggccgcggggcttcccgtgtgcgccttcagcgcgcgggagcggaacctcgaggatgccttcatgacggtgacgaaggggagggtggcgtga

SEQ ID NO: 3481 - DNA, 582 bp, Myxococcus xanthus
atgctgctggcgtgcctggcggtggcgctggtggcctacgtggacacgcgcgagggcgcctacgcgcggcgcggccagggttacttcttctccttcttcgtctgcctgggcgtcgcgcacttcttcgtcatcccgtacagcgcctaccgctcgctggcgcgtgagcgcgaggacgagacgtgggtgttgctggtgctcactggcctggggccgcgccgcatcctccggggcaaggtggcgtcgttcctcgtgcaggcggccctgtatgcctccgcggcggggcccttcctcctcttcagctacttcctcaatggcatcacgctgcccacgattctggtggtgctggcgctgggcggcgcgtggctcgtcttcctcacggtggccagcgtgtgcgcggcgacgctggccgacggccgcatggggcgtgccttcgtccacttcggactgctgggcgcactgggcctggcgctggtgcacggactgggcgcggcctatgcgatatcggagatgggagaccggttcctgaatgatgtggagctcctctatctggtgggcaccgcgctgatgctgatgctcatggac

SEQ ID NO: 3482 - DNA, 1023 bp, Myxococcus xanthus
atgaccttgggggtaggctccatgagggcccagtataagtcgacgactatccctgcttggaatggactccgagttacgcggggtgaactggagggccgggcagcccccgtccccctgggttatgctcccgcccccgtggccacctcttccgctcctcgccgtcgtccccacgtcttcgccgtgctgctcgccgtggccgcgttgctgggcgcgggaggcgcgcttcatgtccagggcctcttgcccgcgcgcgtgccctcccccgccaccccgttcagctaccacgactacgagaaggtgctgcggcacgtgcgcccggacggtgacgtggacttcgcctcggtggggcgcgagcgcaagacgctggacggcttcgtcgactcgctggcgtcgttctccccccacaaccgcccggacgtctttcccacgccggaggacgcgctggcctactggctcaacgcctacaacgcgctcgtgctccagcaggtggtggacggctacccgtacctcgaaaccgtgcagcagcccctgctgggacgcttcttctggggccgctcctgggcgttgggcggagagcggctgacgctgtgggcactgcacaaccgcgtgctgcgccgcgagttcgccgacccgcgcatccacctggcgctcttccaggccgcgcgcgggggcccccggctggacggctcgcacttccagccggagttcctggactcgcagctcaacgaggccggacgccgcttcgtgggcgaccggcgcaacgtgcggctggagcgggacaccgtctacctgacgtcgctcttcgaggagtaccgcgaggacttcctcgccgcgctgcccgagggccgcggcggcaacgtgctccagttcgtctgggccttcctgccggacacctgcgaggagcgcccgggctgcgacacccgcagtgacctggaccgcgcctgcggcccccggctggaccagtgccgcatcgccttcatggagcgggactggacgctgccggacgccgccgcgcgtccctga

SEQ ID NO: 3483 - DNA, 210 bp, Myxococcus xanthus
atggcggaaggacagtggggcaactgcaagggctgccgatacttcgccaaccagaccccccagagcgccggcgagacgcaccgctgcatgcagccggagctggccgagttcgaattggaagtgtccggagaaagcggctgcaacgcctacgaggcgcgcaccggcgtggccactccggcgcacgaagagccctctccctcattgcactga

SEQ ID NO: 3484 - DNA, 1404 bp, Myxococcus xanthus
atgagttcattcctggcgctgtccctggcggccaccctggccgcggcaccgccgcctacgctgaccctggaggacgcgctcaaccgcgcccgcaaggagaacctggacctcaaggccgcacaggcccgcctcgctcaggcggataccgcgtcgcgcaaggcttgggccggctacctccccaacgtcaccgtcaacggcgccatcacccgcaactccatcgaagcggtgattcccgcgggtccgctcgcgcccgtggaaatcgtcatccagccgcgggtgcagatgcaggcccagggccaggtgcggcaggccctcatcgccccgcagctgtgggccggcatccaggccgcctacaaggcggagcgcgtggcggagctcaacgtggagcaggcgcggcgcgaaatcttcttcggcgtggcgcaggcgtactacggcaccgtggcgcaggcacaggccgtggcggtgcaggagcggctggtggagctcaacagcgcgcgcgccaaggacacgcaggtccgcttcgaggcgggtacggtgacgcgcgtggcgctgctgcgcgccgagcaggacctggcccgtgcggagcaggacctgatccgcgcgcgcaacgcggaggcgtccgccaagctggtgctggccaccctgctggcgctggacaacccgaacttcgacgtggcgccgccaccggagccccaggtgcccgagaagacggacaccggcgtgctcgtcgagcgctcgctcgagcagcgcgcggacgtcgccgcggcgcgtgagtccgtggagctggcgcaaatcaacaagcgcggcgtgtggctcagctacctgcccaacgtgcaggtctccggcacctacaacatcagcaacgcggcgggcctcgtgggctccaaccgcatctggctcatcaccctgggcgccagctggacgttgtgggacggcggcctgcgtgaggccaacctgcaggaggcctcggccgtcatcgcggagaaccgggcgctgcagcgcaaggcggagctcaccgcgcgccaggaagtgaataccgcgcagctcgacctggagagcgccctggccaaccgcctcaaggcctcacaggccgtggagctggcgcgcgagtcccatcgcctcaccgaggtctccttcaaggaaggcgtggccacgtacctggaggtcgcggacgcgaacaccgcgctgacgcaggcggagattggtctggtgggtgagcggctgcaggcctcgctcgccggcctgcgcctgctgcgcgcggtgggcgcgttcggcgcccgtcccctgacgacggacctgaaggtggagacctcggaggcgccgttcctccagccgctgccggagcagacgcagccgacgcagcccacccaggaagggccggcggacgccccccggcagccgtaa

SEQ ID NO: 3485 - DNA, 642 bp, Myxococcus xanthus
atggtgatggtggaagtggtgaagccgcccccgccgccccccgagccgccgaagccggaggagccgcccaagccgccgcctcccaagcccaaggtggtgaagccgccgccggtgaaggtggccgaggcccccaagccgctgccgccgccgcccgtggacgcgccgccgccgcccaacgacaccccgccgccgccggagccgcaggccaagccgccgccgctcgtggtgggcatgacgatgtcctccaccaccagcgcgggctcgttcgccgcgcccgtgggcaacaccgcgtatggcaggacgggccccaccgcgaaggaccccaaggacgtgaaggggtacagcgcgccgaagtacgcgcccatctaccaggtggactccgagcccacggtggcctccgaggtgaagattccctacccggaggaagcgcgccgcgcgggcgtggagggcaccgtcacgctctccatcaccatcgaccacgagggcaaggtggtggcggtgaagattctcaaggggcccggctacggcctcaacgaggcggcgagggatgccatccgccgcttccgcttcaagcccgccatcaagggcggcgagcccgtctccacggagatgaagtactcgtacaccttcctgctggactga

SEQ ID NO: 3486 - DNA, 435 bp, Myxococcus xanthus
atggcgggcggcgcgcaggacaacgacgacgaaatcacaggcatcaacgtcaccccgctggtggacgtggtgctggtgctgctcatcatcttcatggtgacggccaacttcatcgtccgcgaaacggtggaggtggacctgccccgcgccgccaacggcggtgagacggtgcagggcctggtcaacgtggtgctggacaaggagggcaagctcttctttgacggcaccgagatgaccgagaaggacctggagaagcgcgttcaggaagcggtggccaaggacaaggagacgcgcgccatcatcagcgccgaccagtcgctgccctatggccgcgtcatgcgactcatcgacgtggtgaagggccagggcatcgccaagttcgcgctcaacatcgagaaggacgtagcccccgcggccgcgcccgcagccccctga

SEQ ID NO: 3487 - DNA, 723 bp, Myxococcus xanthus
atgacgcccttcctctccctggcccagacgaatcacaccgagctgggctggctcagcagcaagctgctcggcgtgacgctcacctccgccgaatgggtgctctgggtgctcgtcatcctctcggtgctctccatcgccatcatgctggagcgcacggtgtacttcgcccgccaccggctgccggactcggaggccctggcggtgcggctggcccgcggcgagtacgacgtggcccgcaaggccattgaaggcaagacgggcatggaggccgccatcatccgcgaggccctggcctccgccgaccagggcgcggacacggtggagcaggtgattgcctccaccctgtcgcgtgagcgtccccagtacgagcgtttcctgtcgtacctgggcacgctgggcaacaacgcgccgttcatcggtctgttcggcacggtgctgggcatcatcaaggccttcaatgacctggggaagatgaacgcccagggcggcggcggggccatgcagcagaccgtcatggccggcatctctgaagcgctggtcgccacggcggtgggcctggcggtggcgattccggcggtggtggccttcaacgtcttcaaccgccaactcaagacgctcaccagccgcgccaatgccctgggctacgccctggtgggcagcatgcgcgccgagcgccccgcgtccaacacggccactgcgggtcgcgccgcggaggcccgctag

SEQ ID NO: 3488 - DNA, 777 bp, Myxococcus xanthus
atggtgttccagagctacgcgctctacccgcacctggacgtggcacggaacctcgccttcccgctgaaggtggcgggggtggcgaaggcggacatcgacgcgcgcgtgcgcgaggtggcgtcgctgctggggctggagggcctgctgtcgcgcaagccgaaggagctttcgggaggccagcggcagcgcgtggcattggggcgtgccctggtccgccgtcccaaggtgtttctcttcgacgagccgctgtccaacctggacgcggcgttgcgcacgcagatgcggggggaaatcaagaagctgcacgagcagctcaaggccaccttcgtctacgtcacccacgaccaggcggaggcgatgacgctgtcggaccgcgtggtggtgatgaaccagggcgaggtgcagcaggtggccccgccgcgcgagctgtacgacgcgccggcgaacctgttcgtggcgggcttcttcggcgcgccacgcatcaacctggtgaagccccggacgctggggctgccggacgcggacgtggtgttggggcttcgtcccgagcacctggaggtggggcagggcacgccgccaccggaggcgctggagggccacgtgtacctggtggagtccatgggggcggagagctgggtgacggtggacgtggccggggagcgcatggtggcgcgcgccgccggggacttccgtgtgccaacgggcgctccggtgtggctgcggtatgacgcggcgaagctgcggcgcttcgacgcgaagtcgggccgagccctgtag

SEQ ID NO: 3489 - DNA, 999 bp, Myxococcus xanthus
atgcacttccgcaagctcggccgcagcggcctcgtcgtcagtgagatttcctacggcaactggatcacccacggctcccaggtggaggaggaggccgcgctcgcctgcgtgcgcgcggcgctggacgtgggcatcaccaccttcgacaccgcggacgtgtacgcggcaacccgcgccgaggaagtgctcggccgtgccctgaagggcgagcggcgcgccggctatgagctcttcaccaaggtgtactggcccaccggccccggaaagaatgaccgcggcctgtcgcgcaagcacatcctggagagcatcgacggctcgctgcgccggctgcagacggactacgtggacctgtatcaggcccaccgcttcgacgtggagacgccgctggaggagacgatgctcgcgttcgccgacatcgtccgccagggcaaggcgctgtacatcggcgtctccgaatggacggccgaccagattcgccagggcgccgcgctggcccgcgagctgcgcgtgcccttcatctccaaccagccgcagtactccatgctctaccgcgtcatcgagccgcaggtcatcccggcctccgacgaagcaggcctggggcagattgtctggtcccccatcgcccagggcgtcctcaccggcaagtacctgcccggccaggcccccccggcgggcagccgcgccacggaggccaacgccgtgcgctacggcatcacccgcttcatgacggatgacgtgctcacccgcgtgcagcagctcgtcccattggcgaaggatgtcggactctccatggcccagctcgccgtggcctgggtgctccagaatcccagcgtctcctccgccatcgtcggcgcctcccggccggagcaggtgcacgacaacgtgaaggccgcgggcgtgaagctggagccggagctgctgcgccggattgacgcggtgctgggccccgccatcgagcgaaatccagccgtgaccgacgtccccgcccagcgcccctga

SEQ ID NO: 3490 - DNA, 483 bp, Myxococcus xanthus
atgtccttcgccatcctcctgctgtccttcttcctgctgctgcacctgccgccgctgcggcgcatccccgcgctgtccacccccacggcgcgcgccgcggtcgccgcggggctcttcttcgtgggcgcgggcctcatgcacttcctcatgcccgcgcgctacgcggccatgattccgccgcgactcccggcacccgccttctgggtctacctctccggggccgcggaggtcgcgggcgggctggggctgctgctgccacgcacgcgccgactcgcggccctggggctcatcgcgctgctgctggccatcctccccgccaacatccacgaggcccaggccaacaccgccacccatgtgctgcccttcccggactggtacttctggctgcgcatccccttccagctcgtctacgtcgcctgggtggcgtgggctggcggctggtggcccgtccgcggccgtgcgcgactggctgcccacggttag

SEQ ID NO: 3491 - DNA, 696 bp, Myxococcus xanthus
atgcacctggtgctgtgccggcagggcaccctgtccgtccgcgcgcaaggcatgaagaccgccgagcaggcagccggcgtgctcgtgggcccggacattctccacgcgctcgacgcacgagacagcgaggtcatcatcctcttcgtcgaacccgagagcgacgacggcgcgcgactccaggccgcgctcgacggtccgatacgcctgttcgagacgacgcagcgcgatgccctcctcggcgggctgcccactgcgggagcactgacacacgaagcggtcggcggatggatggagtccacgctggccaccctctccgggacgcccgaagccccccgtcacctccacccgcgcgtgcgcaagctgctgtgccacctgcgcgcggaggccgcgccggaagacacatcgctcgaagccctggcccaggttgcgggcctctcgcccggaaggctgatgcacacgttcaccgaatccgtcggtgtgccactgcggccctacctcctgtggctccggctccagcgggccgcgggcgccatcgccgcgggccacaccttgagtgaagccgcccacgcggccggcttctcggatgcggcgcacctgacgcgcaccttccggcggatgttcggcaccacgccgtcctcgcttcagcgccgtggaccgcgcgtccaggcgcagggccgcaacggtgcgacccgctga

SEQ ID NO: 3492 - DNA, 1416 bp, Myxococcus xanthus
atgcccaccaacgcccccgacaccaccgtcgcctatgacagtcctcgcggccggggtgtgctgctcgccagcgtgctgggcagcggcatggcgttcctcgattccaccgccgtcaacgtcgccctgcccgccatgggccgcgagctgcacacgggcctgtccggcctccaatgggccgtggacgcgtacctgctcacgctcggctccctggtgctcaccgggggcgcgctcggcgacgcgaagggccagcgacgcgtcttcctgctgggcatgctcgccttcaccgtcacgtcagtgctgtgcggcctggcgcccaacacctggacgctggccgccttccgcgcggcgcagggtgtgggagccgcgctgctggtgcccgcgagcctcgcattgctgcgcacgtcgttcccgcctcaggaccggcaacgcgccgtgtccgcctgggccggactgtccggcgtcaccacggccgtggggccgctgctgggtgggtggctcgtggacgcaggctcatggcgcttcgtcttcttcctcaacgtgcccctggccgcgctcaccgcgtgggcggcgctgcgccacgtgccggacatcgcgccgaaaacaggggcgcgcgggttggacgtcgcgggctcggtgacggcggcgctcgggctgggtggcctcatctacgcgctcatcgaaggccccgcccacggctggcccctggcggccatcggcgccgcggccggaggcgccgtcctgctggccgcgttcttcgtcctggaggcacggcagcgggagccgatgcttccgctcaccctcttccactcgcgcaccttctccggcgcgaacctcaccacgctcgtcgtgtacttcgcgctcggaggcgccaccttcctggtggtgctcgccctgcagcagcagctcggctattcggcgctcggcgcgggagcagcgctgctccccatcacgctgatgctgcttctgttttcaccttcggtggggcggctcgcggggcacatcggcgcacgtccgttgatgacggcggggccgctgctcgcgggcgtggggctggcgctcctgacgcgcatccagcgcggtggtgactacgtcagcaccgtgctgcctggcatcctggtgctgggactggggctggcgctcaccgtaggcccgctcacggcggtggtgctcggcgccgtcgaggaccgctacgcgggcatcgcctctggcgtgaacaacgccgtggcccgcctcgccggcctgctcgcggtggcgctgctgccgctgctgggcggcctcgctggcgacaccggcatggacttcctggtgggcacacggcgcgcgctctgggtgtccgccggcctgtgcgccgtgggagcgctgtgctcgctgctcacgattccacgcgaggccgggcgcacgacctccgcgcaatag

SEQ ID NO: 3493 - DNA, 2208 bp, Myxococcus xanthus
atgagtcccatcatcaccggcctgttgctagccctcgccattcccatcttcgtgatgaccatgtccggtcgcgtgggcgtcctgctcgcgatgaagaaggagaaccggctcgacaacatccccttccgcgtggcgcagttggtgcgcttcggccttggccagaagcgactggtggatccggaggagttcacgccgggcctgttccacgtcctcatctacgcggccttcatggtgctggccctgcgcaccgtcatgctcttcgccatggggttttcgaccacggcgctggacgtgctgacagacctgggccacccgttctgggcggagcaatccgcgctgctcttcgtctacaaggtctacctgctggccaaggacgtggtcgccgcgctggccctgctgggcgtggcctactacatctgggtccgctggaaggtgaagccggaccgcctgacgccgtcgtgggaggcgtacctcatcctgtgcttcatcggcgggctgatggtctccgagttcctgttcggcggcagccacatggtggccgcgcacgccgcgcaggcgcaggtgggcgccgcgcaggtgccccagtcccccgccgcgctggtgtggtgggagccgttcaccagcctgacgggtctggcgatgatgccgttgggcgccaccgccgcgcacgtggtgggcgcggctggcttctgggttcacctggtcatcatcctggcgttcctgaacttcctgcccatcggcaagcacttccacatcatcaccggcctgcccaccgtcttcttccagcgcacccactccaccggcaagctgcccacgccggacctggagaaggaggagttcggcaccgccacggtgaaggacctgacgtggaagcagggcctggacctctactcctgtacggagtgtggccgctgccagacgcactgtccgacgtacatcaccggcaagccgctcacccacaagggcgtcaaccaggacctgaagcattggatctggggcaatgagcagtgggtggaggaaggctacggccccaatggcatcaaggagccgctgcccgaaatcgtcggcagcgcgctgtcggcggagacggtgtgggcgtgcacgagctgcggctggtgcgagcaggcctgcccggtgttcatcgaaaacgtgccgcgcctcatcgacatgcgccgctaccaggtgcaggtgaaggcggagttcccccccgaaatccagcgcgtgttcgagggcatcgagcgccagggcaacccctggggcctgggccaggaccggcgcgacgagtgggcggaggacctggcgctccccacgtggggtgacgacggcggtccctacgagtacctcttcttcgtgggctgcgcgggcagctacgacgacaagcagaagaaggtcagccgcgcgctggtgaagattctgcgcgaagcgggcgtgagcttcgccacgctgtcgaagcaggagatgtgcaacggcgactccgcgcgccgcatgggcaacgagtacctgttccagacgatggcgaagacgaacgtcgagacgtggaactcgatgggcgtgaaggccgtcatcacccagtgcccgcactgcttcaacaccatcaagaacgagtacccggagttcggcggcgagtaccgcgtcatcaaccacacgcagctcatcaacgagctgctgaaggagaagcgcatcaagctctccgcggtgatgaacagcaagctcacctaccacgacccctgctacctgggccgccacaacggcgtctacgacgccccccgcgaggtgctcaacagcatcccagggctcgaggtggtggagatgcagcgcagcaagcgcgagggcttctgctgcggcgccggcggcggccgcatgtggatggaggagcacattggcacgcgcatcaaccacaaccggttgaacgaggccgcgctcacgctgaagcacgccgaggacccgaacacgccctaccccaacgccgcggacaagaagaagccgggccaggtgggcgactacaaggagaagggcggcagcggcatcgtcgcggtggcgtgcccgttctgctccacgatgctctccgacgcggtgaacgacaccggccgtgaggagaacatcaagatcaaggacatcaccgagctggtcgccgacgcgctggagaccaagagcggcgcggtgggcaccgtggcccccagcgccacggtgagcgccaagccggagtag

SEQ ID NO: 3494 - DNA, 1299 bp, Myxococcus xanthus
ttggtggagcatgagctgctcggcggcgagtgctcatactgggcctgcatccccagcaaggccttgctgcgcccgagcgaagcgcggtggctggcggagcatgccgccggcgtgcgcgagaagctccaggagggcatcgacgcgcgtgcggtgctggcccaccgggattcgatggtcaacaactaccaggacgactcccaggtgaagtgggccgagaatgcgaagctgaaggtggtgcggggcaccggcaagctcactggccctcgcaaggtgcgtgtggaggacaaggacggcgccgtgcgggagctggaggcccgaaaagccgtggtgctggccaccggcagccatccgcgcatcccggacatcccggggctgaaggacgcccagccctgggacaaccgccagggcactgcggcgaggcaggtgcccaagcggctggtggtgctgggcggcggcgcggtcggggtggagctggcccaggcgtggcgctcgctgggctccgaggtgacgctggtgcagcgcggaaagagattgctgtcccgcgcggagcccttcgccggagagcaggtggcccaggcgctgcgagatgccggcgcgcgcgtgctgcttggaatgaacgcgacgcgcgtccagcggcccggcggcaagggcgaggtgacggtgacgctgtccaatggcgagcaggtcgtcgcggacgaaatcctggtggccatgggccgcgtgccccgcacggaaggaatcgggctggagacggtggggctcgtgggcggcaagcccgtggaggtggatgaccagctccgcgcgaagggcgtggacggcggctggctctacgcgtgcggcgacaccaatggccgcaacctcctcacccatatgggcaagtaccaggcccgcatggtgggcgacgtcatcgcgggcaagcaggcaagggcctgggcggacgcgaaggccaccccgcaagtcgtcttcacccacccacaggtggccagcgtgggcctcaccgaggccaaggcacgcgaggccgggctgccggtacgcacggtggagcagcaactccaggacgtgtccggcacctcgctggtgggcaagggcctcactggcaccgtgaagtgggtggtggacgagaagcgccgggtgctcgtgggcgccacgttcaccgggccggaggtgggagagatgctccatgcggccaccatcgccgtggcgggggaggtgccgctcgacacgttgtggcacgcggtgccgtcgttccccaccatgagcgaggtgtggttgaagctgctggaggcgtacggcctctag

SEQ ID NO: 3495 - DNA, 1086 bp, Myxococcus xanthus
atggcggcggagcgcttctgggaagccacggacatctaccgcctgtccgacggccacatgccgttcaagtacgcgcccatcaccgcgccgctgttccttcccttcaccctgctccccgcgcgcgccgccgtggccctgtggaacctgggctccatcgccgcgctcgccgccgtggcccgcctcaccatgcgcgccacgccttcgtcgggggaagccacgccctgggcctgggcgcccgcgctgacgacgctggccctgctgccggccttcaccttcgagctgttctacggccaggtggacgccgtcatcctgttgctcatcctcctgtgcacgctcggcgccgaacgcggacaggtctggggccctggcgccgcctttgacgaagccttcctgctcaaggcgcccgccgccctcgtcggcctcttcttcctgtggcgccggcactggcgcgtcatcggcgccaccgccgtggtgggagggattctcaccctgcccacgctcgcccgctacggctgggacggcacgctggtccaattccaactgtggagcgacacactggcgcgcaccacgccgccctgggcgctccagtccaacacccagggcctgcccaccgtactgctagcgctggtgtacccgcccgacaccgtggtgccccccggtgacatgtcgctggcgcaggccgtggcgatggtcctcttcgtcgccgccgtggtgtgggcaagacccgggccggcggacctcatcgccgtgtgttgcctgggtgtcaccctgctgtcaccgctggcgtggcgcgcgaactacgtgctggcctggccgttgatccgcgccgcggtggagagccgccaccggcccaacctggtgctggtggcgctcatcgccctcacgggtctcctggtctctgactcgggactgggcgcggaatggagccgccacgtcctcctgtggcgccccttcgcgctcgtctacaccgggttgctgatcgtcctgctgtcgcagatgcgccgcatgggcgcaccgcgagcggtggcggacgccgacgccgtgtcacgcctgccacgttgctttggtggcgggctcgcgccgtga

SEQ ID NO: 3496 - DNA, 396 bp, Myxococcus xanthus
atgggcatcgccgccgtcaccgctgccggcaaggtgacggaagtcatcaaagagaagaagggcacggacgtggtgttccgtccgccgccccctcctccgccgccccccgtggtcgaggcgaagccgcctcctccgcccccgcctcctcccaagccaaagctggcgcccaagcccgcgccgcccgccgccgcgaaggcgccgccgccggccgcgcccaccgtggcgcccgcgcccatcgtcgttcccaaggaagtgccgctggagaagccgcccgaggccgcgacggagacggtggccgccgcgcccatcgccgtgggtggcaccggcgcgctcgttcccggcggtgtggtgggcggtgtccccggcggtgacacactcgccggtggtggcggttgc

SEQ ID NO: 3497 - DNA, 243 bp, Myxococcus xanthus
atgaccatggccgacaacaagggcagtccggtacggggcgacgagcggatggacacgacgcgcccggaagaactggagcgcgaggcgcggcaccagaaaggcccggtgcgaggcgacgtgacggacgaagacgtgggcgaagaccgcatcctccagaaggggattggcggctacggcgctcagaagggcaccgagccggcgcgcgaggcacctccgctgagtgacgaccacggacgtcattga

SEQ ID NO: 3498 - DNA, 582 bp, Myxococcus xanthus
atgaagcaggtcttcaccgcactcgcgctgggcacgttactcatcggggcgcccgccctcgccgacgcggaagttggcaagcccgcgccgaccttcacgctgaaggacgagtccggcaaggagcacacgctggcgcagtacaagggcaaggtcgtggtcctggagtggaccaaccccgagtgccccttcgttcagcggcactacaagaacgacacgatggtcaccacgctgaagggcttcgacgcgaagaaggtggtgtggctggcggtggactccaccgcgcacaacaccccggagaagtccgcggcgtggaagaaggatgagggcttcccctacccggttctccaggacgcgagcggcacggtaggcaagtcctatggcgcgaagacgacgccgcacatgtacgtcatcgacgagacgggcgttgtccgctacgcgggcgccatcgacgatgacccgcgcggcaagaacgccaagccggccaaccatgtgaagacggcggtggacgcggtggtgggtggccagcaggtcccggcgagcaccaccacgccctacggctgctcggtgaagtacaagagctag

SEQ ID NO: 3499 - DNA, 276 bp, Myxococcus xanthus
atgaccgtgcggacggcgacaggccatgtcatcgggcgcgtggcgggcatcggggacacgcacttcgaactggagcaggggctggtgcccattccccggcgcgactacctggtggagttctccgacgtggacttcatccgtggccacgacgtctacctggtcaacgcggaccatccgctcctcgcgctggaggtggatgacgacggcggcgcgctcccgcctcgccattccgagggactggagcgcgagcccgtgaatgtcgacgtggagtcttga

SEQ ID NO: 3500 - DNA, 2187 bp, Myxococcus xanthus
ggtgccctcctggtggacgccaccgaggtgaagccgggagacaccttccgcgtgggcgtgcgcttccggttggatccaggctggcacgtctactggaagaacccgggcgactccggcttggagacggaagtggcgtgggacacgcccggcgtcaccgtggggccgctgcagtggcccttcccgcagacgttccgcacgcccgacggcttcatcaccacccatggctatgacggtgaggccatcctcatcgccgacgcgaaggccgtggaagggccctccacgggcctgctgacggtgtccgccgccgtggaagcgctggtgtgcgaggtgcactgcatccccgcggagctgatgctgacgcgctccatccccctgggtccccagacggtgcgcgacgccgagacagcggctgtcttcgacaccgagctggccaaggtgccccgtcccgccaaggacagcggccccgcggcgacggtggcgctggatgcgccgcagctcaccgcgggccaggatttcaccggcaccctcaccctgacggccccgggcggcgcggcggtgcccgcggtggaaggtgacttcttcgtcgccgaccgcatccccggcgtcgtgcgcgtggggttggcctcggacggtccgggccgcttcaaactcaagggcaaggcggagccggacgcgcaggcgtcggcgccggacctgacgggcgtgctgcgcctgggcacggcggccacgggctaccagtacctcgaggtgacggcgccgctggcccccttggtggcggccggtggcgcggctgggacgccgcccgtggtgaagccgccgtcggtgaaggacagcatcgcggcggtgaagccggtgggcgccgccatcgccacgccgcccgcggccgagtcgtccatgggcctggggctggcgctggtgttcgccttcttcggtggcgcgctgctcaacctgatgccgtgcgtgttccccgtgctggcgctcaaggcctacggcttcacgcgcatggtgcagcaggagcagggccgcgtcggcgcgcatgcggcggcctacgcggcgggcatcatcggcaccatgctgctgctggccagcgtcgtgctggcggtgcgcgcgggtggcgcgagcgtgggctggggcttccagttccaggagccgctcttcgtcgcgggtgtgtgcgcggtgttggtcgccttcgcgctcaacctcttcggtgtcttcaacgtgggcctggacggcacggcgctggcgggcaaggtggaccagagccacggcctgatgcacagcgctggcgagggcgtgctggccgtggtgctggccacgccgtgctcggcgccgctgctgggcaccgcggtgggcttcgccttcgcggcgggccccatgacggtgctggccgtcttcaccgcgctgggcctggggctcgcgctgcccttctgtgtgctggtgctggtgcccgggctggcgaagaagctgcccaagccgggcgcgtggatggagcgcttcaagcaggtgctgggcttcgcgctgctggccaccactgtctggctggtgtgggtaatgggcgggctggccggcgtggacggcatggcgcggctgctggcgttcctggtcgcggtggggctcgtcacgtggctgtacggtcaggggcaggcgcaggacggtgtgcgcaagctggccaccgtggcggtggccgcgggcgtgctggtggcgtcagggctgctgacgttgcgtttcgatgaccaggaccccgtggaggcgcctcgggtcgggtccacggtggcgcaggcgcagccgtggagcgcggacgcggtgaacgcggcgctggcggcgggccagccggtgttcatcgacttcactgcggactggtgcctcacctgcaagttcaacgagcgcaccgtgctgtccaccgacgaggtgcgggacgccttcaagaagcaccaggtggccttcttcatcgcggactggacgcgccgggacgcgagcatcaccaccaagctggccgagcacggccgggccggtgtgcccatgtacctggtgctgagcccgggcgcccccgacaagccggaggtgctgccggagttgctcacgccgggcgtggtgacggacgccgtgacgcgcgcggcggcgtgtgcaccctcgaagctgggcaacggcgcgaacgtcctctgcgccgcgggtttcccgagtcactga

SEQ ID NO: 3501 - DNA, 1212 bp, Myxococcus xanthus
gaacatggccgcgaggtgctcctcctcgtcaccctggaagccgacgccgacgccccccgcgcgcccgtggccatcaacctcgctttggatcgcagcgcctccatgcggggcgtgccgctgctcgccgcggtgcaggccgcccaggcgctcgtggagcgcgccagcccacgcgactacctgggcctgctcaccttcgacgccgagcccgagcaggtcctccccatgcgcgccatggaccccaacgcccgggcgcagctcctcaaggtgctcgcgcgcctggagtccggcgaggggaccgccctgcacgaggccgtggagcgcgcctcggagtccgcccgccgcgtgctcgtgcccggcgcccggccccaggtgctgatgcttactgatggcgagccctcggtaggcccgtcgcagctcgcagagttcaagacccagggcgcccgcatcgccgagtccggcgtcatgctccacgcgctggggctgggccgccactacctgcccgacatcctggaggccctcaccagtccctccggcacgggcttcgtgcacgtggatgacccggaaggtttgcccatggccgtgggccaactgggcgccgagctcttcggtgaagtcgtcgccgacgcgcgcgtgcacgtgctgcccacgggcttcgccgacgtccgctgtcgtcaccgctatccctcgcgcgtggagggcgacgccatgagcgccaccctgggcgccatctcccaggccttcccgcgccgcgtcctcttctcgggcatgttgggggatgcggagtggaacctgggcgtgtccacgttctactccgagcgcggggatacgcggcgcatcagcgtgccagtgacgcgtgtgctgcccgacagtgacgcgggccgcttcgtgcgcgccgtgtccgccgagctggacctggtcgccggtgaagccgccgcgtggaaggccctgggccgccgtcaccaggacgccgctgagcgggcgctggaggccgcggacgtcgccctctacaaactcgcgcggctcggctcggcggaggtgcccgcgcaacgccacgtggagcggctggcggacctgcgccgggtgatagagcgccgggcaaacaagctccccgcgctggtgatgcgccgcgcgcactccgaggtctcccgcatcaccatgagccgcgtgggccccgcggcgcccgcgctgctgccctggaagaccgaggactga

SEQ ID NO: 3502 - DNA, 219 bp, Myxococcus xanthus
atgcctcacgcgcgcgcggatgaccaggacctggcccgcacgctgctctccggcctgggcatcactgacttgcgcttggacgcgccgcctccgcaggacaacagcttccgccgcaagctcgcctccgcgggggcgtacgtctccggcaagctgggagacgacggcgccacgaagcggctggagcgcgtcctgcgctcggagaagcagcgcaagccctga

SEQ ID NO: 3503 - DNA, 120 bp, Myxococcus xanthus
atgcgggagcgggaccccgagctgacggacagcatcggcgagtccgcgctcatcatggccgcagcgcacgggcacaccgaggtctgcccagtggctgatgcctcacgcgcgcgcggatga

SEQ ID NO: 3504 - DNA, 417 bp, Myxococcus xanthus
gtgctcgtggattttccggggaacacctcgggcccggtggccgcgcggctcgccgtcgtcgtggaaccgaaggcgctccaggccgccgtcgcccagcggcagaaggcggtgctcctcttcgagaatggagacgcccggttgcccttcgtcatggggctcatccaggagcccagcgcgacgccgctgttggacgcgttgctggaatccccccccccagaagccgcgctgcgcccgacagaggcccatgtcgacggcaagcgcgtcgtcatcgagggccaggacgaagtcgtcctcaagtgcggtgaggccagcatcaccttgcgccgcaacggcaaggtcatcgtgaaaggcacctacctggagtcgcgcgcctccggcacccaccgtatcaagggcggcacggtcgaaatcaactga

SEQ ID NO: 3505 - DNA, 909 bp, Myxococcus xanthus
atgttggggggctgcgagcccctggacgacggtggcggcggcggcatcgggggcgtcctcttcacccgcggcttcgccttcgtgcgcgaggacgaccgcaacgtctacgtggtggacgacggcggcgacgccaatagcccgcagcggctgaccaacgtgggcggcgcctactggccttccgtgtcgcgcgacggccgcagcgtggtgttcgtccagcgcagcggcggcaccaccacgctgctgacggtgcccacctcgggcggcacgccctccacgctgttccgggcgaatgattcgacgtgcgcgcgcggctgctccaacttccgcacgcccaccttcagtccggacgggcgcagcgtcgtcttcgtcttctcgcccggcaacagctcccagacggcgctggcgcgcatcaacacggacggcagcggcttccaggaactcacgcccaacaacgtcatcgcctatggcgcgccgtccttcgtgcccaatgggggcgcggtgctggcgggcgcgggcagcgggctgaaccagctcgaccagcttgcgcacgtgccgctcaacgggggcaccatcacctactcctccctgagcgcgggcgtgcagttcgtggagaaccgcgtggcggtgtctccgaacggctcccaggtggcgctggatggacgcctgtcctccggtggtacgcgcatcttcgtggcgcagttgtcgggctcgaacgtgggggcgctccagcgcgtcaccatcggcggggcgggcgaggagtcgtggccgagctggacgggcgccagtcagttgggcttcctcatcagcgctggcgggagcgacacgggcatctaccgcgcgaacctgagcacgggctcggtgtcgctggcggtgcccagcgccacggaaccgtcctacgggccgatttga

SEQ ID NO: 3506 - DNA, 498 bp, Myxococcus xanthus
gtgggtagcccgccagcctctctcttgagggacttgcaggacccgctggcggcgcaaatgggtgtcgcggccgtggtgtcgaagacggtattgccgacgcccgcctacgccttcaacaaggaccgtggccagtaccactgcaacgccatcatgcggcggctgacgccgatgcaggagcccggccagttcgccgtgttgggcatctccgacgtggacctcttcgtcccggactcgcctttcgtcttcggggaagcggaccgcgagtcgaagacggcggtgatgagcctccatcgcctggcccagggcgccgccagcgaaatgttgcggcgccgcgcgcaggtggaggtggtgcaccaggcaggacacctgctcggtttgtcctactgcgaggaccctcggtgcgtgatgttcttcgcgcagacgccgcaggactgcgaccgcaagcaactgtcgctctgcaacctctgccgcaacgagctccagaagctcaaccgctga

SEQ ID NO: 3507 - DNA, 1131 bp, Myxococcus xanthus
ccgggctgcaggcccatcctcgtctgggcccgagcgctgcctcccggcgcggagaaacaactgcgtcacatcgcctcccagccctatgtcgtggagcacgtggccgccatgccggacctccacgtcgcttccggcatcgcagtgggcaccgtcttcgccacggagcaccacgtcgtaccgggggccctgggcggagacctgggctgcggcgtgagcgcctggcgtttcccgctcacctcgggccttcccggacgggacgtgctggagcgcgtgctgtctcagttggccgagcgcatccccgtaggtgacgccgtccaccggggccgggggctgcccttgcccccggcgctggagtcaccgcccctgtccacccagaagctgcgccatgcctgggagcggctggcgcccaggcacctggcgacgctcgggggcggcaaccacttcctcgaactggaccgggatgcggacggggccctctggctgctgctgcataccggctcgcggggcgtcggcgcggccatcgcggaccaccatgggcgggtggcccgggcgctcggggagggcggcttgccggccctggacatccacaccgccgagggcgccgcctgcctcgccgacacgcagtgggcctgccgcttcgcgctcgccaaccgggaggccatcgccgctcgcgcgctggacgtcctggaggaagccctgggcgtggccgccgaccccacgtcggtcgtggacgtgcaccacaaccacgtcgcccaggaggagcacgggggccgcctgttgtgggtccaccgcaagggcgcggtggggctccaatccggccaacgcgggctcatcccgggttccatggggacggcgtcctacgtcgcggagggccggggcgagccgcgtgccttccgctcctgctcacacggggcgggccgcgtcctcacccgggcggaggcacgggcgcgcatccgcccggcggcgctggagcacgtgctgcgccgcgtggtgtacgacaaggggcgcgccgccgccctggtagaggaggcacccgccgcctaccgcgacatcaccgaggtgctggaggacgaggccgacctcgtccggccgctcctgcgcctgacaccgctcgccgtcctcaagggctga

SEQ ID NO: 3508 - DNA, 2028 bp, Myxococcus xanthus
atgtccactcagcggctggaccatacggccacggtgctgcccaatggccgcgtgctggtcgccggtggccagtcctccacgagcgccgagcaatacgacgtggcgaccgcgcggtggctcagcgcggggagcatgaatgtcatccgccggcgtcacaccgcgacgctgctgcccaatggaaaggtgctggtggtggcgggcgacgtcgccgccgcgaccaccggcaccgcggagctgtacgacgtggccaccgggacctggtcttccaccggcagcctggactcccttcgctcgggacacaccgccacgttgctgctcaacggcaaggtgatggtgatgggcggcgaggacggcacgggaaccgcgttgaggacggcgcgtctgtatgacgccaacacggggacctggagcgccacccacagcatgaccgccccgcgcatgggacacgcggcgacgctgctgcccaatggaaaggtgctggtgtcgggcgggcgctccagttcgtggggcaccgtcctccggaccgcggagctctatgaccccgccacgggaacctggtcctccaccgcctccatgagctcgccgcgcacggggcatgcttcgacggcgctgctgaatggcaaggtgctggtgtccggcgggttggtggatgacatcaccgcgacgcgcagcgcggagctgtacaccgtggagaccggtgtctggggttccgcggggggcctgatgcccgtcgagcgcgcgcaccacaccgcgacggtgctgcactccggcgaggtgttcatcgccggtggctcggacggcagcgagccctacctccagagcgctgcattgtatgaccctgtcaacgcgctctggacctccacggtttcgatgggcaccagccggctgggccataccgccgcgctgctggggacgggggatgtgctggtcgcgggcgggagcccggacggcgtcctgcgcaccgcttccgccgagcgctacgtcccacccacgctcccctggcgcgcggcgaatgccatgctgtccgcgcggtaccaccattcattgacggtgttgtcttcgggcgaggtcctcgcggctggtggcaccgcgaatggcagcacggcttcgacgggcgcggagcgctactccgaggccacgggccactggctgcagacgggcacgctgctcaccgcgcgctatctccacaccgcgacgttactgcccaatggcaaggtgctggcagcgggaggccagagcacgtcgtccagctatcttccctctgcggagctctatgacgcggccacgggcacgtggacttccacgggggcgctggctgcgccgcgtgcgcgccacaccgcgacgctgctgcccaacggcaaggtcctggtggcgggaggccggatgagctccagcttctctggcatgctggccaccgcggagttgtatgacgcggcgaccgggacgtggaccgccaccggggtgatgagccgccgtcggcagtaccacaccgcgacgtcactgccgtccggcaaggtcctggtggtgggaggcaacacgcaggatggagacacgtcctcggcggaactctatgacgtgtccacggggcagtggacgctcaccggctccctgtccggcccgcgttatggccacatggcggtggcgctgccgtcgggcaaggtgctggtggccggaggctggggcgcgcggggggcgctcgccacggccgaactctacgacccggcgacgggcacctggacctcactcacgtccatgcagcactcccgctacggaccgatgtccgcgctgctgccctccggccgcgtgctggtgttgggcggtgatggaggcggcaccgtgggcttgttggcctcggccgaggtgtatgacccggccagcggccaatggcacagcgccggaacgttgcctacggcgctcaccagcgcgggcgtggtgacgctggtgggctctggccgcgtgctggtgtcgggaggtctgggccccaacggctcactgtcctccgccgggttgtattcgcccgcgccctga

SEQ ID NO: 3509 - DNA, 1032 bp, Myxococcus xanthus
aagacgcaattccccgtggtgttcgcgcacggcatgggcgggttcgatgacctgctcggctacgactactgggggaacgacttcggcaccttcgtgggtgaggcctgtgagtcgcgcttcgacacgaactgcaacagcgacctcgacccgggacagcgcgccttcgttgcacaggtggcggcgtttcagtcctcggaggtccgcgggttggacctggcggacgacatcgaaggcttcatggcgacgacgggtgtctcgaaggtgagcatcatcggccactctcaagggggcatcgacgcgcggaaggcggcacgcgtgctgcgggagcgaaggggcgccacgtcggtggccgtgctggccagtgtgtcttcgccgcaccgcggctcgccggtggcgaagtacatcctcgaccagaaaccgggcgtcaccagcgtcatcgcggcgctggcgcgctactacggcgactccgtctatgcgccgggcaatgatgcctatgcggcggcgaagcagctcgtcttcaatgactactcatcctcggacggtgtcgtcacgggcatgaaggccttcaacgagaagtatccggtgagcagcaactacgcggagcgctacgtgtcactcatcaccgcgcagttcgggggaaatgtgaatccggcgctgtacctgttgaaggagttcctcttcgacatcgacggcaatggctactgcgtgggagatggggacaacgacggcgcggccggctgcggcgacggcgtacgtaacgaagcggatgacgatggcatggtgggcatcaactctcagcagatggggcgtcggctgcgctaccacgacgccttcttcggcttcgactcggtgacggatgacgcgtccattcccacgctcaatgatttgaacgcgccatcgcgcctacagagcacgtccatgtccagcgtggtccctcaggaccatgtggatgtggtgggggtcgggccggacgccttcgatgagccggagttctacgccgccctcatccattacatctcactgcatgattga

SEQ ID NO: 3510 - DNA, 256 bp, Myxococcus xanthus
atgctgacggcgctgaatgacttcgcgcgcgagcgagggctcacggatgaccctctgtacgaggtcaagcccgtggacttcttcattcgcatcagcgcgaaggggaagttcatcaagctggagtccctggcgagggaagacgggagaggcaatgcgatgccaatccccaggttgccgcagcgctcggtgaacatcgcggcgggcttcttcgcggacaactcgaagtacgtcctcgcctacgagactttagagcacg

SEQ ID NO: 3511 - DNA, 1068 bp, Myxococcus xanthus
acaccccgcaagctcctgcccttcgtggtgatggagagcgggcgtgtgctggcctcgggcgggcatgacgggagccgaacgctgggcagctgcgaggtgttcgagccggagacgggccggtggcgtgagacgggggccctgcgcacgcgccggcgcaaccacgccgcggtgcggctgacggacggccgagtgctggtgatgggcggctccaacggcctggcgatgggcgcgcttgcggacgcggaggtgtatgcgccggacaccgggacgtggacggaggtgcgccccatgggcgtggcgcgcaatgacccggccgcggtgctgcttgcggatgggcgcgtgctggtggcgggtgggacggatgtggaccagcggccgttgcgctcggcggagttgttcgatcctgcgacggggatgtggagcgccgcgtcgcctccgggcttctcacggggtggggcccagacggcggtggtgctggccaacggcaaggccctgttcgtgagtggcctgcaggcggagttgtatgacccggtgacggggctctgggagaaggcgggactcaccggtggggcggcgggcacgcaccggctggcgcactcggtgacgttgctgccggatgggcgcgtgttggtggtggggggaaccacggcacgcgcggcggccacggcggaggtgtattcgccggagacgggggtgtggacgctggtgggagcgcccaaggtgcctcgtgagcatcatgcgacggtggtgctgccggatggcgcggtgctgatgatgggcggcgagcactacacgacgggggcgctcgcgtcggtggagcgcttcgacttgaagacggagacgtggtcttccgcgcccgcgctggacgagccgcgcgagaagctgggcgccctggcgctgggagatggcgcggtgctggtgatgggcggtggcaacgaggcggcgggcatgctgtccgagagcgagcgctatgtcccggatgcctgtgtcgtggcgccgtgtgctgcgcgagagttgggtggggccgaggcggtgatggagctctccgtggccgggcaggtcgagtga

SEQ ID NO: 3512 - DNA, 1620 bp, Myxococcus xanthus
  unsure (1)..(1620): unsure at all n locations
aacgagctccatagggaggtcgcccggcggcgcaccttcgcgatcatctcccaccccgacgcgggtaagacgaccctcaccgagaagctgctgctctacggcggcgccatccatctggctggaagcgtgaaggccaagcgggcgcggcggcatgccacgtccgactggatggagctggagaaggagcgcggcatctccgtcacctcgtccgtcctccagttcagctaccgcgaccactcggtgaacctgctggacacgccgggccaccaggacttctccgaggacacctaccgcaccctggccgcggcggacgcggcggtgatgctcatcgacgccgccaagggtgtggagccgcagaccaagaagctcttcaaggtctgccgcctgcggggcatccccatcttcaccttcgtcaacaagctggaccgctacggccgcgagccgttggagttgatgaacgagctggagcacgtgctcggcatccgctcctatccgatgaactggcccatcggcatgggcccggacttccgcggcgtctatgaccggcaggcccgcgtcgtccacgtcttctccaccgagggttcccacggcgagtccgaggtgagcgagcgctcggtcgccatcgactcggatgaaatcaagacggtcctcaccgagacggagctggcgaagctgcacgaggaaatcgagctgctggacatcggcggcgacgagttcacccgcgagaagagcgatgcggggcagctcacgcccatgttcttcggcagcgcgatgaccaacttcggcgtgcgcccgttcctggatgccttcctggacctggcccccgcgcccacgtcgcgcctgacgacgcatgggccgcgcgagcccacccacccgaagttcgccggcttcgtcttcaagattcaggcgaacatggaccccgcgcaccgcgaccgcatcgccttcatgcgcgtggtgagcggccggtacgtgaagggcatgagcgccttccactcgcgcctgggcaaggacgtccgtctggccaagccgagccagttcatggccgccgagcgcacctccatcgagnacgcgtggtctggggacgtcatcgccctgttcgacccggggctgtaccgcatcggcgacacgctggcggagggcaccggcgtggagttcgagggcgtgccgcgcttcagcccggagttcttcgccgtcgtccgcagccgggatccgctccgccgcaagcagatggagaagggcctggagcagctctccgaggagggcacggtgcaaatcttccagcagctgcagatgggcatgaaggaccccatcgtcggcgtggtgggcgcgctccagttcgaggtcctccagtaccgcctggagcacgagtacggcgcgaagatcgcgctggaccggctgcccttcagccatgcgcgctgggtggtgggcgccaacttcgacccgaaggcgttcgactgggaaggcaaccgtcagacggtgcaggaccgggacggactgcccctggtgctcttccgggatgactgggcgctccagcacgccgaggacaagcacccggagctgaagttcgtctcggaggccccgcagttgcggcaggccacccccctggcttcgggcggctga

SEQ ID NO: 3513 - DNA, 417 bp, Myxococcus xanthus
atgtcagagcggcaccccctacctcacgaggtcgtgcgtgcctggcgtcaatgccagctgccgcgcccatcctctcccgcgctgttggacctgttcgagcgtggctttcaggcgctgtggcgccgtggccgttcggccctgggggaggtcaccctggtggtcatcctggagcgggtgctccagcgggtggtccaggcccatcctcacttgtcggcgctcgtcgtcacatcggagggtcttcgcttcgaggggctgcatccggtcgtggctgaattcgacccggaacggctggaggagtcgctggtggtcctggtcgaggagtggctgcgcgtcctcggggcgctgacgggcgaggtcctctccgccgcgctccgtgaggagctgctggccgtggaagggacgaggcccccccgatga

SEQ ID NO: 3514 - DNA, 1032 bp, Myxococcus xanthus
atggagtcccctccgtcccaggccgtggcgcatgccgcctccgcgtacgcgtacctcgtgggcctggagcgtgtgacgctgcaagggcgtgacgtcatcgagggcgtgttcaaggcggaaccggcccgggttcccggggtggtcaccctgccgctggtggcgaaggaaggcgtcctgggcgtgctccacgtggagtcggtggggctgggggaggacgggctggtgctgctggacgcggtggcgaaccttctggccgtggccctgccgaaggagcatgtcctgcgccgcgaagttcgccggcgtgagcgcgcggaggcgctgttctttcaggcccaggaggccgtgcgctggcgcgacgagctgctcaccgtcgtctcccatgacatcaagacgccgctgctcgcggtgcggatgaacgcggagatgattctgaatgcgggcacggcgccggagaaggaacaccgccggcgccgctacctggagaacatcgtcctcgccgagcagcagatgagcagcctcatcggcaacctgctggaccgggcgcgtctgcgcggcatgcccattcccctgacgctccagccccttcccgtggacgccttgctggcgcagtcgctggaggtgctccggccgctcgcgctggagaaggggcaggtcctgacggtggcgcaggcgcccgagctgccgccggtgctcgccgaccgcgagcgaatcctccaggtgctggccaacctggtgagcaacgccatcaagttcacgccccctggcggcgtcattgaggtacgggcccgcttggtggagggggcgaaggtgtgcgtcttcgtgaaggactccgggcccggcatccccgccgaggacgcaccgcacctcttcgagcgcttctggcgggccagccattcaccgggacgcggcacggggctggggctgagcatcgcctggagtctggtggccgcgcacggcgggacgctcaacgtggagagccacgaagggcaggggagcaccttctccttcaccctgcccgtggccctgccctga

SEQ ID NO: 3515 - DNA, 1506 bp, Myxococcus xanthus
atgaatccgggcatggatacctggctgctgacccggatgcaggaacttcgcgaccttcagggcctcatcggcctggccacgtgggacatggagacgtacctgccctccaaggccggtcccgcgcgctcccatcagctctccaccctgcaggggctgcaccacgagcgcctggtggacccccggctgggggaggccctggcccaggccgcctcgcaggcggacctgtccgacgacgcccgggccatggtgacggtgctgacgcgggagcgggagcgggaggtgcgcgtccccgcgccgctggtgcgggcgctcgcgggagccatcagcgacgccatccaggcctggcgggaagcccggcaggcaaggcgcttcaccgtcttccagcccgcgctccagcgcctgctgtcgctgcgccgggagcaggcggacgcgtatgggcatgacggggagcgttatgacgcgctgctggaaggccatgagccgggcatgcgcgtggcgcgcctgacgccggtgctgtcggcgctgcgcgagcacctcatccccatggtgggcaagctcaccgcggtgagccggccggtggcgcccttcctgatgggccgtcactacgacaaggacacgcagtgggccttcaccctgcggctgttgaaggacatcgggttcgatttggaggcgggccggcaggacctgagcatccaccccttcacagggggcacgcacccgttggacgtgcggctcaccacgcacgtggacacggccacgccgttcccgtccatcttcagcaccatccacgaagccggccacggcctgtatgagcagggcttcgctcccgagctctaccgcaccccactggccgccgcgccttccatgggactgcacgagtcgcagtcacgcctgtgggagaacatggtgggccgcggcctgccgttctggcggcattacttccccgtgctgcgcgccgccttcccggaggcgctgtccggcaccgacctggagaccttccacgccgcggtgaatgcggtggggccgtcgctcatccgcatcgagtcggacgaggtgacgtacaatctgcacatcgcgctgcgctacgagctggagctgctcctggtgcgcgacgagctgccggtggaggacctgcccgccgcgtggaacgcacgcatggaaaagtacctgggcatcacgccgccggacgacacgcagggcgtgctccaggacatccactgggcctggggcgagctgggctacttccccacgtattcgctgggcaacctgtacgccgcgtcgctctaccgcgccgcgaagcgcgacctgccggagttggaggcgcacctgggccggggggagttgctgcccctgcgtgactggctgcgcacacatgtgcaccagcatggcttccgccactccgcggaggagcgcgtgaagcaggtgacggggcaggggctcaccgacacggacttcctggcgtacctgaaggagaagtacggcgcgctctacggtgtctcgctttga

SEQ ID NO: 3516 - DNA, 573 bp, Myxococcus xanthus
atgctgctgggctggggcgcgggtgccatcggcgtgggcgcctacatcttcttgtccccgtacctgtcgccacccgcggagccagggaacatctcgagtccgacgctggcgaagctgctcaatgagagcatcgacgcggccatcgagaggatgaatcccacgcattcccctgggctgattccggaagcggcggccaattcgcgggcgttcttgaaggaagtctcggaggtggtggctcggtgcagcaaggggcgtttcgagccgggccagaagtacaacaagctggagtatcacctgctccgtaccgacggtgtccgctacgagcgcatctacacgggcattcggtgccacgaggcgacgctcatctaccgggccgtcttcaaggatgggcgtgtcgccgaggccttcacggacgggcgtgagcgtcagtatccggtcggccaggttcgtggcgcggtgggcgagttcgggaagaaggtgacctggtcggacagggattaccacccggcgcgctactacgttccgccacctgcgcagccgactcaggcggacatcgcgaagcagtgggagtag

SEQ ID NO: 3517 - DNA, 1077 bp, Myxococcus xanthus
atgctggaggtgtacgcgggcagcgctgtggtcgacgtcgtggccggcgaggtggtttcggcgggcctcgtgctgcagcgcaacccggtcaactgcccgggcacgaccaatggtggcatcgacatcacgggcgaactggagaccggtgagcccactccggatggtggcagtgatggcggcgtggacccggatgcgggcgtcgtgctgggcggggccgagttcgccttctcctaccaggacgcgacgctgacgcacgatggcgtcatccacttcctggacggcaacgcgaatcgtatccgtcgactcgacctgacgacccggagcttcctgtccgcctacgtcgggacgggtgatgcgacatcgatggcggtcgcttcggacggtcagaccgcatacctggcctacacgggagggcgtatcgacgccttcacttcgacggaggggggcacggcccgcttcttcgccgcggcgcctgcgtcggtgtcgcgcatggtggtggcggaccgatacctgtttaccattgatggctccggggcttggggtacgcatgcgctttatcagcgggccacgggcgctcgggtcgcggcggcggactggaggaacagtgcggtgagcctgctgttctcggaggcgaacaacaccatttacttcgccgacagcggcgtctcgccacaggatctgaaccgggtgcaggtggacatggaggcgggcacgctgggcgctgaaatcgactcgccctaccatggtgcctacaacctgagggcgccgctgcggctgtggccggatggctccgcggtcgtgacggggagtggcctcctcttcaacacggcggacctgacgtaccgcaccagcatcggcctgtcgttcgtggacatcgccttccacggtgagcgcctctacctcatcgacaccgtgggagacaggacgcagctgcgggtgctcaaccaccggttcgacatcctctcggcggcgtactacccgggcgcggcccagcgggtcttcgttcacaacggccaactggtgctgctcacctcgacggggagcaatgggttccaggcgcgcctgctggacctgtag

SEQ ID NO: 3518 - DNA, 903 bp, Myxococcus xanthus
atgggcgttgcctggaaggacaacattgacgtcgcggacgcgctggagcgcgtcgcggacctgctggaggagcaggacgcgatgcccttccgggttggcgcctaccggaaggccgcgggcaccatcgcgcagtggcctcaacccgtggcggagctgctggccgaggaaggtgaagcagggctgcgcaagctccccggcgtggggaagagcatcgccgcggcgatggcggagctgattcgcacaggacagctctccctgctccagcggctggagacagagcactctccggagcaactcctggccagcgtgccgggcatcggcgcggggctggcccgccgcatccatgacgagctgagtgtgcggacgctggaggagttggagcaggccgcacacgacggacggctggagcgcgtggagggcttcggcccccggcgcagcgaacaggtgcgcgagctgctgggcgcacggctgggcagggagcggcgcagcgccgcacgccggagcgaaggacgggatgaaggcccccggccggacgtgggcgtgctgctccaggtggacgaggagtaccggcggcgcgcggacgcaggcgagctgcgccggattgcaccgcgccggttcaatccctctggcgaagcatggctgcccgtgctccgcaagaagctggcgggatggaacttccgcgcgctcttctccaacaccgcgctggcccaccagcagaacgccacccatgactgggtggtgctctacttcgaccaggaaggcgacgagggccaatgcaccatcgtcaccgcgcatggcggtccgctcgacggccgacgtgtggtgcgcggacgcgaggtggagtgcctcgcgtactacggcgtggagtccgaggaagtcgaagccccgcagcccggggcctga

SEQ ID NO: 3519 - DNA, 963 bp, Myxococcus xanthus
atggacgagcgcgccacggtgggcgggtgggtcctcgtggccgccgtcctcttcacgatgctcgcggcgacgctgtccaccttcgccgtcgtccatcccctcctccagcgcctgcgccgtctgcatcgggcggcggggatgctcggggcgagccggtatcactccgcggcggatggccaggacgatgagctgggcgagctgtcacgggtgctcgacgccacccatgcccgtgtccaggaggacgccacccgcatcgaggcccagaaacacgcgctggagcgacacctggcggacgtcgcgcacgacctgaagacgcccattgcctcgcttcaattgtcgctggagctggcctcgacgacgcccaccgagccgaccgcggcgctcctccgccagggcatcgaggacaccgtctatctcacctccctggtggacaacctccatctcgcctgccagctcggagagggcatcgacccgacggcgggcgacccgcgcgtggagctggggctgaccgtggagcgcgtggtgcgcaggctccagcagctcgcgcggttgctggggctgaccgtggagtgctcccggcccgacgaggcgctctgggtgcgctgcaatcccacgatgctggagcaggccctgggcaacctgctccacaacgccgtcacgcacggcgaggcggggggccacgtcgtggcgctcctggaggatgcggaacccgggcgcttccggctcaccgtgctcgacgacgggccaggcctctctgccgaggagctcgagcgcctgggcgagcgcgggtttcgcgcgcaggccacgcggcgccgggcgacccggggcagcgggcttggcctgtccatcgtccgcgagttgtgccaccgcgtcggcttctcactcgccttcgcgcccaacccgccgcgcggcctgaaggtcgtcattgaaggacctcgcgcctccacgagcgagccaggctga

SEQ ID NO: 3520 - DNA, 711 bp, Myxococcus xanthus
acccacctggggaccgtgtccatgaacccatcggcgcgcatcctggtcgttgaggacgatgcccccatcgccgcgggcatcgttcgtggattgaagctcgcgggcttccaggtggtgctcgccacggatggcgtgctcgcgctcgagatggccgagcgcgagcaccccgacctggtggtgctggacctcaacctgcccggacaggacggcttcgagctgctggaagcctggcgcttccggctccgtgtccccgtcatcgtcctcaccgcgagacaggaactggaggcccggctgcgctccttcggcctgggggcggtggactacctccccaagcccttctggatggaggagctggtcgcccgcatccgcgcacggctgcttctccaggaggagcgcccgcgacgcgtgctgcactgggacgacgtgagcctggacctcgacgcccgcgaggcgagccgcgaaggcaccggcgccctgcccttcacgcgccacgagttcgacgtgctcgcctatctcgctgagcgcccgggacgggccctgacacgcgcacagattgcccagcacgcgctgccgcccagcgaggagcgcgatgaccggaccgtggactctcacatcgcgcgcatccgcaagaagctggggccagcgggcgcgcgcatccagacgtcctgggggattggctaccggttcgtccccgacgaggagccgcggtga

SEQ ID NO: 3521 - DNA, 963 bp, Myxococcus xanthus
atgtcgagcatcagcaagtcgttcaagaaagcggtgaagaaggtcaagaagacggcaaagaaggcgggtaacacggtggtggataccgccaacaaggcggccgataccgtcaccgatacggcgggcaccgtgacgaaccaggtgagccgcgaggccgagcagctcgcccgggaggtggacaccctcacccgcgacaccgcgaagctggcggagcaggcgtatgcggagtccctggccgccggggaggccgcctggaacgagatggtggagctgtccacccgcttcctcacggacgcgctgagcgacgtcgccgaggcgctggccgaggacgtctaccgcaagcacctggccctcctcgagagcatggccgagacgggctccgcgctgctgacgaatcccacccgccgcaaggaggtggacttcctcgtgggccagtcctcccagaagaagaaggacgaggacacgaacaagacagtcagctcgctgtctcaggacgagtcggtccagcgcactggtaacgaggcccggagcaaggggctcgggaccctctccatcggcagcggcggcagcgcgaccttcggcctgggccccgagggaaacgtcggcatcgccttcgaccacccagggcagacgcaagtccggggcttcttcggcatcgggggcgtcgcaggcgccaccaagggtatctcgatgaacttccagtttggcgcgtgggccgacatgccctccaagctcgccggccccgtgctcacggtcagcctcggcgccggcgtcggcaagttttgcggcagcgcccaggtcgtcttcaagatgcccatcaccgagaaggaatggacggccttcgccacgagtggcaggctcgacctcgcgggcctcgtcatgtgcctcggcgcggaagtcagcaccttcgccaaagacggcgtgagcgccacggtcggcggcggctacacctgggtgtactga

SEQ ID NO: 3522 - DNA, 375 bp, Myxococcus xanthus
atgaacccgtggaaggcgtcgctggtggtgtgcgtgtggctcgtggcgtgtggtggctcggaggcaccgcagcgctcctacgctggctggtcggagcgcgtggcggcatccgcgtgcgcgtatgaggaacagtgcggaaccctgacggtgtcacgcgagcagtgcgaggcggaccgcatcgcggcctacgcggcggtggagccggacctgtcgcgaaccgaaagtggcgcgaaggcgggctgcgtgcagtgcatgcgcgcgcgcatcgatgaactcgacgcggccaccgcgagcggctgccagcaatccatcgacgaagcccgcttgctcgctgtgtgcggcgtggatggcgcggcctgtgcgggcgtgccctga

SEQ ID NO: 3523 - DNA, 81 bp, Myxococcus xanthus
atggtggaggtcagccgcctcatctcccccgaaatcctggtggagattgaagcggacgccgtcgtcgcggacggcgtctga

SEQ ID NO: 3524 - DNA, 543 bp, Myxococcus xanthus
atggccaacgtcattcagttcttcatgtcccccgacgacgaactcgccttcttccgcttcctggagcgcttcgtcctggaggtgtacccccggcgcgtcccacaggattgggagaccttccgcgcgaacacggagaacctggagcggctgcccccggaggacctctacatggtggcctccgagctgggcgcggccatcgtcgacaaggtgaagcgcggcccggacaagggctactggcgcatcgacgaggtgcgctcgcccgtcatcttcatggagcgctgtcgcaccaacgaagagggcgagctgctcagcggcaagatgtgggcggagctggacatcaccgcgcagacgggccggaagaacgcggcgcccgacaagttccggagcctgttcctcgaggtcgaggagtacatcaagaagacgtaccgcaagggcgatcccaagggcttcttcgtgggccccaagacggcgcggctctgcaaggaagggctcgtgctgcgcgactccgccttccgcggtggcacggtgttgccctacaagtag

SEQ ID NO: 3525 - DNA, 366 bp, Myxococcus xanthus
atgcagttgttggcgctgaaatccatcgccgacggtgtgcgcagccagtccgccatcgcggagcggatgctcgtggacgcaccctcggtgagccggctcgtcgcgcgcctggaggaggacggcctggtgaagcgaagcatcgcggaagatcgccggtgcgcgcgcctggagctgtccccggccgggcagacggagctgaacctgctgcgcgacgcgctcatctggacggacgtggagctgcttcgctacctcacggtgcaggagatggcggagttcaagcgcctcacggtcaagctcctgacgggcctcctccaggcccgggggccggtgccgctggaaggcggctgcggcccgtccgacacctga

SEQ ID NO: 3526 - DNA, 1482 bp, Myxococcus xanthus
atgttgaagacggtgaagcaccgtagcttcctggtgcgtggagccgcgttggcgctcacgctggcgtgcatgacgggttgtggcgacgacgacgagcccactccgacgcctgacgcgggcaccaacacggacgccggtacggacgcgggcacgaacccgacgcctgacgccggcaccggcgcgctggacagcgacatcgcggtggtccgcttcaacgaggacggtacgcacgacacgacgttcggtgcgggcggcgtgacgcacgtggactttggcaccggccgcgacggcacgcgtgactcgctgtgggacgtgcgcgtggacggcacggaccgcatcgtgctgttcggcaacaagcgcgcggacggtacgcgcgtggacaccgaccgcgtggtggcccgcctgacggcgacgggcgcgctggacacgacgttcggctcgaccgagacgcccaacgggttcagcgtcctcaacctgtccaacctgaacgacggcatgcgctacggcttcatccagccggacggcaagatcatgacgtccggctacacctccatgcccacgggcgtgggtgcgcaggcggccaaccgcatcgtgctgcagcgcctgaacgacaacggcaaggcggacgactcgttcggctggaagggcgtcgtgacgtccgcgccgttccaggcccagagcgagaccaaccccgagtggggcatggccgaggcctacgccgcgggcatgcagtccaacggcagctacgtgacgaccggctacggccgctccgcgtcctctggcaaggtggacctggtgtccttccgctacacctcgacgggcgcgctcgacccgacgtggggcaccggcggcgccgtggtgctggacctggtaggtgacgacgaccgcggccgcaacctggtggtcctgaacgacgaccgcgtcctgcacgtgggcagcggctccctgggcgcgcagaacatccaggccctcctcctgatgcagacgcaggacggccagccggacacgaccttcgcgccggaaggctacaagaccttcagcctcgaccgcccggagcaggccttcttcggcgtggccaagtcgtctgacggcaactgggccgccgcggtgggttaccgcgcgggtggcaaccagaacgccgacggcatcctcgccatcatccccacgaacggttcggcggaggaggtcatcatcaaggccacgccgatctccaccacggagaacgaccgcttctggtccgttgccttcgactcgaccaaccgcatctacgcggcgggcttcgtgaccgagggtggcgacaacggggacaaccagatggtggtggcgcgcttcaccaccgagggcaacctcgacacgaccttcggcaccggcggcatcgcgaagatcaacgtcgcgaccgcgggcaccgaggaggccgctcgcggcatcgccatccagtcggatggaaagatcgtcatcggcggtcccattgagaagcggtaa

SEQ ID NO: 3527 - DNA, 2434 bp, Myxococcus xanthus
atggcactgttcgagcagaagctgatgtgggcgcggagctggacacttcctgcgctcttgctggcatgggcctccccggccgcggggcagtccgagccgccccaggacgccgccgccgtggctcccgagccgtcgcaggtgcaggacgccgccgccgttcctgaagcgccgcaggcgcaggacaccgtcgtcgtccctgaagcgccgcaggcgcaggacaccgccgccgaggaggcgcagcaggccgagccggcgcaggcgcccgtgggcgacgcgccgctggccatcgagccccccgcgggcgagccactggtgctggagccttcacccgaggcggtggagaagagattcgagagcgtggtggtgggcacctcggaggcgcgcacgagcggctccatccacgtgctcaagcccgcgcagttggagcgcttcgagcgcgatgacccggccgccatcctccagacggtgcccggtgtgtactcccgcggcgaggacggctttggcctgcggccgaacgtgggcttgcgcggcgtcaatccggaccgcagcaagaaggtcacccttttggaggacggtgtcctcttcggccccgcgccgtactccgcgccggcggcctactacttcccgctggccacgcgcatgcagagcatccgcgtgctcaaggggccctcggccatccagcagggaccgcagacggtgggcggctccgtggagttcatcacccgggacatccccgcgtccgagtccgcctggctggacgtggcgggcggcgagtacctctacggcaaggcccacggcgtcttcggcgccagcaccgagcgcgcgggcttcctgctcgaaggcgtccacctgcgcagtgacggcttcaaggagctggacaccgttggcggcaacacgggcttcacccgcaacgagtggatggccaagggcagctacctgctcgtccccgagggccccgtgcgccagacgctccagctcaagctgggctactcggacgaggactcgaacgagacgtacctgggcctgagcagcgcggacttcgccgccccgccgctgcgccgctacgtcgcgagcgccctggaccacatgaagtggcaccgcacgcaggtggtgctcagccacgagctcgaagcgggcgggctggccgtgacgacgtccgtctaccggcatgacctgagccgggtgtggcgcaaggtgaaccgcttccgcggcgcctccatcgccagcgtgttggcggaccccgcggagcgcgcgcaactccatctactacggcgtgctcacgggcgagctggacacgtcgtcgtcccaggacgcgctgctcatcggccccaacgaccgcacgtacgtgtcccagggactccagagcatcgcgcgttggacggccaccaccgggccgctgagccacaacctcgagctgggcgcgcgcttccactacgacagcatccgccgcctccataccgaggatgccttcctgatgcagggcggccagctcgtgtggaccagcgagcccacgtacacgacggccgacaacaaggactccacgcacgccctcgccctgcacgcgacggacgccatcggctgggggcccctggtgctgacgccgggcgtgcgcatggaaatcatccgctcggcgtcgcggaaccacatgacgggcaccgagtcgagcggcgcgctggaggtgctcatgccgggcatgggcatctacggtgcactgacgcgcgagctgggcctgttcgcgggcgcctatcgcggcttctcgcccccggcgcccggacagccggacgcggtgctgccggagaagagcatcaactacgaggccggcgcgcggtggacccgccgtggcgagcggctggaggcggtgggcttcttcaacgactactcgaacctcaccgacatctgcacgttctccagcggctgtctcaacgacgccctcgaccggcagacggacgcgggcaaggcctacatctacggcctggaagtcttcggtgagaagaccttccgtccgggcgggggcgtgacgttccccgtctcgctgtcctacaccttcacgcgcacgcggctgcgtgaggacttccagtcggcggacccgcagttcggcaacgtgcgtgcgggcgacgagctgccctacgtgccccagcaccagctctacgccaccgcgggcgtggagacgtcctggggcggcctggccctgagcgccttctatgtggacgccatgcgcgagcaggcggggcagggcgaggtgtctccggagctgctgacggacgcgctgctgacgttcgacgtcaacgcgagttggaacttctcccgctgggggcagctgtacctgagcgcgcgcaacatcctggacgagcaggccgtcgtgtcgcgccgtccctacggtgcccggcccaacgcgcctcgggccgtcatcgtgggcgtcaagctgggcatctga

SEQ ID NO: 3528 - DNA, 1059 bp, Myxococcus xanthus
atgggcgacgacatcactgccagacgcaaggacgcgcatctcgacctttgctcgacgggggacgtcgaacccagcggaaacagcaccctgctggagtgcgtcaagctggtccactgcgcgatgccggaaatgtccgtggaggacgtggacctgtccacggccttcctgggcaagcggctgcgctacccgctgctcgtcaccggcatgacgggtgggacggagcgtgcgggtgcggtgaatcgcgacctggcgctgctcgccgagcgccacggcctggccttcggcgtgggcagccagcgcgccatgtcggaggacgcctcgcgggccgcgtccttccaggtgcggcaggtggcgcccacggtggcgctcctgggcaacatcggcatgttccaggccatcgggctgggcgtggatgggacgcgccggctggtggacggcattggcgcggacgggctggcgctgcacctcaacgcgggccaggagctgacgcagccggaaggcgaccgggacttccagggcggctaccgcgtggtggagctgctggtgaaggcctttggcgaccggctgctggtgaaggagacgggctgcggcattggcccggacgtcgcgcggcggttggtggacctgggcgtgcggaacatcgacgtgtccggtctgggcgggacgtcctgggtgcgcgtggaacaacttcgcgcgtcgggcgtacaggcacagttgggggcggagttcagcgcgtggggcattcccacggcggcggcgttggcctccgtgcgccgggccgtgggcccggacgtccacctggtggcgagcggtggcctgcgcacggggctggacgcggccaaggtgctggcgctgggggcgaacctggctggcatggcgctgccgttgttccgggcgcagcaggcgggtgggctcgaggcggcggaggcggcgctggaggtcatcctggcgagtctgcggcaggcgctcgtgctgacgggaagcagaagctgcgctgaactgagacagcggccccgggtggtcaccggagagttgaaggattggttggcggcgctgtag

SEQ ID NO: 3529 - DNA, 689 bp, Myxococcus xanthus
aagtctggaaggaagaacatgtctgacaccgtgacgtcccggcttcccgggttccacaagctgccgatggaggagcgccacgcgcacctctcccgcatgttccggctcacgcccgaggacctgcagcagctgctgggctcggaggcgctccagcctgtcctggcgaaccagatgattgagaacgcggtggggaccttctccctcccgctgggcctgggcctcaacctccaggtcaacggacgtgactacctggtgcccatggcggtggaggagccgtccgtcgtggcggcggtgtccttcgcggcgaagattgtccgggaggcgggcggcttcatcggcgaggcggacccgtcgctgatgattggccaggtgcaggtgtcgcgctacggcgacccgacggtggccaccgagcgcatcctggagcacaaggagcagattctcgcgctggccaacagcttccacccggccatggtggcgcgtggcggcggggcgaaggacgtcgaggttcgcgtgctgccggccccggaagggccgcgcggcgagccgctgctcatcgtccacctcatcattgacgcccaggaggcgatgggggccaacctcatcaacaccatggcggagggcgtggcgccgctcatcgagcaggtgacgggcggcaaggtgtacctgcgcatcctctccaacctggcgga

SEQ ID NO: 3530 - DNA, 3147 bp, Myxococcus xanthus
  unsure (1)..(3147): unsure at all n locations
atgttcgtcgatttcttcatccgtaggcccgtcttcgccatcgtctgctccatcctgctgacgctggtggggctgattgccatccccacgctgcccatcgcccagtacccggacctggcgccgccacaagtcaccgtgacgagcacctacgtgggtgcgagcgccgaggtggtggagagcgccgtcaccatcccgctggagcaggagctcaacggcgtggagggcatgcgctacatcacctccaccagcagcaacgacggcaccagccagatcaccatcaccttcgaggccacgcgcgacatcgaggtggccgccgtcgacgtgcagaaccgcgtcagccgcgccgcggcgcgcctgccctcgcaggtgaaccagacgggcatcgtcgtcaacaaggcctccagccagatgctgctgacggtgggcctgttcagcgaggacaaccgctacgacgccaagttcctcagcaactacgccgacgtgagcctgaaggacgccatcaagcgcgtgcccggcgtgggtgacgtccgcatcttcggcgagcgcaagttctccatgcgcctgtggctggaccccacggagctggcgcggcgcaagctcacgccccaggacgtgacgcgcgcgctccaggagcagaacctccaggtggccgcgggtcagattggccagccgccgtccaccgaggaccagccctaccagatcgcggtgcgggcccggggccgactggtggagccggcggagttcggcgacatcgtcctgatgcgggacacggatggcacgagcatccgggtgaaggacgtgggccgcgtggagctgggcgcggagaactacggctccgtcctgcgcttcaacggcaagacgggcgtgggcctgggcatcttccagttgcccaccgccaacgcgctggacgtgcgcgacggcgtgtacgcggagctcgagcggctgtcgaagcagttcccgcccggcatgcagttccagacgggcaccgacaccaccctggccgtccgcgcctccatcaacgaggtcatcaaaacgctggtggaagccatcgtcctcgtcatcctcgtcatcttcctgttcctgcacggctggcgcagcgtgctcatcaccgccttcaccctccccgtctcactgattggcaccttcgccttcgtccacctgatgggcttctccatcaacaccctcaccctcttcggcctcacgctggccacgggcctggtggtggacgacgccatcgtcgtcatcgagaacatcgagcggttgatggtggagcggcgcctgtcccccgtacaggccgcgcgcgagggcatgaaggaggtgaccggcgcggtcatcgccatctccgtggtgctggtggcggtgtttgtcccggtggcgctcttcccgggcaccactggcgccatctaccggcagttcgcgctgaccatcgccgcctccgtggcgctgtccaccttctgcgccctcaccctcaccccggcgctcagcgcgaagatgctgaagcaccacgagggaccgaagtgggtcttcttccgctgggtggacacggtgctggacgggacaaaggcgctctacggccggggcctgcgcaagctgctgaagcatccggtcctggtcctgctcgccttcctggcgtgcatcggcggcacggcgctgctgttccgcgccgcgcccacgggcttcatccccgacgaggaccagggctatctcatcatctccatccagggccccgagggcatgtcgctcgcccagacggagaaggtgctggcagaggcggaggccgtcctacaggcgcagcccgaggtgcgcgccatgttcgccattggcggcttctccatgatgggcagcggccccaacatgggcaccatcttctcgtcgctgacgtcctgggaggagcgcaagggcaaggaccagtcggtggccgcgctggtggagcggctgcgtgccccgctgagccgcatcggcggagcgcgcgtgatgcccttccagccgcccgccatccgaggcgtcggcagcgtgggcggcttccagtacatcgtcgaggacatcgacggcaccagctcgctggatgacctggccgcggccacgcagatgctggtggcgaaggccaacgagcacgagcaactgcgcggtgccttcagcaccttcaacgcggacacgccgctgctcgacgtggaggtggaccggcagaaggcgaaggcgctcggcgtgccgattgagcaggtgttcggcaccatgcaggtctacatgggcagccagtacgtcaacgacttcaactacgccaaccgcacctaccgggtgtacgtccaggcggagcagcaattccgcgacagcccgtcggacatcggcgccttctacgtgcgcagcgacaccggggacatgattccgctggagtcgctggtgaaggtggagcccaccgtgtccgcncaggtcatccgccactacaacctgttccgctcggcggagatcaacgggcagccggcgccggacgtgtcctccggacaggcgctggaggccatggaaacgctggccacgcagcacctgcctcagggcatgagcgcggagtggacgggcatcagcctggaacagaaggagagcggcgggcagacggccatcatcttcgcgctgggtctgctgttcgtcttcctggtgctcgcggcgcagtacgagagcttcagcctgccgctggtcatcatcttctccgtgcccctggccatcatgggcgcgttggggctgcagttggcgcgcgggttcgccaacgacgtgttctgccaggtgggactggtgatgctggtcggcctggccagcaagaacgccatcctcatcgtggagttcgccgagcagctccgggagggcgggaagagcgccatcgacgcggtggtggaggcggcggaggtccgcctgcgccccatcctgatgacgtccatcgccttcctcctgggcgtggtgccgctgatgacggcctccggcgccggcgcggcgtcccgcaactccctggggacggcggtgttcggcggcatgctggtgtccacggtggtgaacttcgtgttcatccccgggctctacgtgctgatgcagaagctccgcggcgacgcgaagcgggccaccggtgaggacgaagcggtgcccacgcccgccgcgtcccactga

SEQ ID NO: 3531 - DNA, 1143 bp, Myxococcus xanthus
atgaaggcgatgtggggtgtcaccctgctggcggtggtggcgggctgttcggcccagaaggccgccccgccggcccctccgccccgcgaggtggaaatcgtgacgctcaccccgcgcgaggtgcgcgaaacgggggagtacctgggctcgctgatgtcgcggcagagcgtcaacgtgctgccccaggtcgcgggctacgtgcgcaagattcacgtgcgtcccggtgacaaggtggaggccggcgccgcgctcatcgaggtggactcgcgcgaaggcaccgccgcgctcgacagcgcgcaggcgcagctcagctccacccaggtgagcctggagctggcgcgccgcacgctggagcgcaccgaggcgctctacaaggaagggctcgcgagcgcgcaggagctggagcagggccgcgcgcaggtggaggcagcccaggccgcggcgcgttcatccgccgcgcaggtgacgcagcgccaggtgcagctccagtaccacgtggtgcgcgcgcccttcgccggcacgatgggcgacgtgctggtgcggctgggtgactacgtgggcatgacgacgccgctcaccagcgtggcgcagtcggacgtgctcgaggtgagcgtgtcggtgccgtcgccgcgcgcccggtcgatgaagcccgacaccgcgctcgaaatcctcgacagcacgggcaaggtgctgatcaccagcaacgtcttctacatcgcgccccaggcggacccccgtacccagttggtggaggtgaaggccgccttccgcaacaccgtgggcctgcggcccagcgagctggtgcgcgcgcggctcgtgtactcggcccgggatgcgctgcagattcccgcgctcgccatcgtgcggcagagcggtcagcccttcgcgctggtggtcctggcgaaggacgggaagacggtggtggagcgccgccccatcacgctcggcgcgctgggcgagatggcctacgtggtggagagcgggctccagtcgggcgaccaggtcgccgtgtcctcgctgcaagcgctgcgtgacggcatggcggtgaaacccaagcaggccaacgcccccaacgcccccactggcagcggcccgccccgggcctctggcaatggtggcggcactgtcggcgggagccgctga

SEQ ID NO: 3532 - DNA, 1407 bp, Myxococcus xanthus
atgcgcactcggaccctgttgcttgccccgttgctgctctccacttcctgcgccaccgtctctccgaaggcacaggcaccggacgccaccaccgccgaggcgaagtccccggcacccgagcgtcccttcggcaccctgcgtgagcaggcgaagcgccagcaggcgtggctggccgagcgcgtggagaaggccctgccccagctcatgcgccagtacggcgtggacatgtgggtcatccccatgcgcgagtacaacgaggaccccgtcttcaaggcgctcgtgtcgcccacgtcgttcgccgcgcgccgccggaccatctacgtgttcttcgaccgtggccccgagcagggcgtggagcggcttgcgctgggcggtggttcgcagggaggcctctacacgccgcgccgcgcgcagcggcaggtggacggaggcggtgtgagccgcgaggccgagctgtggggccccgagcagtggcaggtgctcaagcaggtggtggaggaacggcagcccaagcgcatcgccctcaacgtgtcgcgcaccttcgcgttcgcggacggcctcagccatggtgagtacgagggcatgtcggaggcgctcgggccggactgggtgaagcgcttcacgtcggtggacgggctggcggtggacttcatcgcctggcgcagcgcggacgaggcccgcttctacgaggagcagacgaagctcgcgtggaacatcatcgagacggccttctccaatcaggtcattaccccgggcgtcaccaccacccgtgacgtggagtggtggatgcggcagcgcctggcggacctggggctggagacgtggttccagccgtcggtggacctccagcgacagggcgtcacggagaaggagctgggcgaggacccgatcatccaacgcggcgacgtgctgcactgcgactacggcgtcaccgcactgggcctcaacaccgacacccagcacatgggctacgtgctgcgcgagggggagacggacgtccccgcagggctgaaggccgcgctgaagacgtccaaccggctgcaggacatcgtcttcgaggagctgcgtcccggtcgcacgggcaacgacatcctccgcacctcccgcgagcggatgcgcgccgagggcatcgacggcaccgtgtactcgcatcccatcggcctgcacggccacggcgccggccccatggtggggctgtgggaccggcaggagggcgtgcccggcaatggagaccacaaggtgattgcgaaccagtggtactccatcgaactccaggccacgtcagtggtgccggagtggaacggccagcaggtgcgctcggcacaggaagaggacatcaccatcgacgccgagggccgcgtgcactgggcctggaagcgccagacggacttccacctggtgcgctga

SEQ ID NO: 3533 - DNA, 543 bp, Myxococcus xanthus
atgaacgagcggacggacctcgtggcctcgcgcgcgcagttggagtccgcgcgtgacagccgccaacaagccaccgccggatacctgcccacgctgggcctgtcgagcaccgcagtgggcctcaccacggaccccggcttcggccgcgtggccatctggagtgtgtccgcggtgctctccgtccccatctgggaaggtggcctgcgcggcggcttgattcgcgagcgagaggggctcgagcgccaggcggcggaggcgctggagagcacccgccgcgacgtgtcgattcaggtggcccaggcccggcgcgccgtggaggtggccgaggccctggtgacgacggcggtggcgtcccgcgacctcgcggaccggaccgaccgcctcacccgccgttcttttgaagtgggccgcggcagcagcctcgagctggtgcagagcggagcggccctgcgccaggcggagctgaccctggtgctgcgtgaattcgagctcgtccaggcgcgcctggacgcattcctgacggaggcgcggtgcgactggtga

SEQ ID NO: 3534 - DNA, 1050 bp, Myxococcus xanthus
gtgacggacacccaggcgcgtgccaaggccgaggcggagctgcagcgcaagcagaaggagctggacgagcagcgcactcaacttcaggacgtgaaggagcagctgaagcaggccaagcgcaagctctacgagcagaaggagtccgacaagagcgcgcaggacctggccaaggcgcgcgccgaggtggagcgcaacgcctccacgcagctcgagcggacccgtgaggagctgtcccacgcgctggtggagaaccagcggctgaaggcggagatggagtccaagggccgccgcccgcagcccgcgccggccgcccccatcgcagcgcccgccacgcaggtcgccgcgcccgcccaggagggcgaggccgtcatcgccgcggtggtgccggtggtgcccacggcgacggagacggtgccgcaggagcgtggccagcgccgctaccgcgagctgaacgacgccgaccgcgagaagatggagcggctggagcaggcggcgaacaaggaccgcctccgcgcagtggagctggagaaggagctgcgccgggtgaagggccgcaacgagacgcagcagcgcgtctatgccgccaccaagcacgacctggacctgagccgcgacaagtacaaggccctggagaagcgcctcaaccgcacgctcctggagcgcgacctgattcgccgggccatcaaggacctggaaaagaagacgggcatgctcgcagaccgcacggagctgacgcccgaggaggtcgccgccagcgaccagcgcaccgaggagacgtcgcgcgtgcgcgccgaggccgaggcccaggccacgcccaagacggaggccccggccgacaccgagcagcaggcgcccgagagcgctccggccgacgcggagtccaagcccgcgcaggcctgacgcacccgccctcccatgggcacattgaagggctcggcatcctggaggacctccagggccgggcccttcgtcatttccacatcaggtgtcggacgggccgcagccgccttccagcggcaccggcccccgggcctggaggaggcccgtcag

SEQ ID NO: 3535 - DNA, 798 bp, Myxococcus xanthus
cttttcgcggtggtgatgaacttcggctcctactggttcagcgaccggattgccttggccatccacggcgccaggccgttgccctacgagcaggcgccctggctgcacgacatggtggcgcggctggcctcccgcgcgggcatgccgaagcccaaggtctacatcctccccacggcggcgcccaacgcgttcgccacgggccgcaacccgagccacgccgccatcgcggtgacggcgggcctgatggagctgctcgaccggcgcgagctggaaggcgtgctggcccatgaactggggcacgttcgcaaccgggacaccctcatcggcacggtggcggcgaccctggccggcatcatcagctacgccgcgcagatgctcttctggttcggcggctccatgctcagccggggcgacaacgacgagcgcggcggactgggcagcgccttcgccaacctgggtctgctgctggtggcccccatcgccgccacgctgctccagctcgccgtcagccgctcacgggagtacggagcggaccagacgggcgccgagctggcgggcgacccggacgcgctcgccaatgccctgctgaagttggaacgcagcgcggaggccattccctacgacaaggccccggccacctcccacctcttcatcgtcaacccgctccaccgaggcggagtcatggccctgttctccacccacccgcccatccccgagcgggtccgccggctgcgggagctgggcgcccgcctgggagcccgcaccggtgggcgcggcggctgggagtacgcgtactga

SEQ ID NO: 3536 - DNA, 669 bp, Myxococcus xanthus
atgttccccttcatcatggtcaccggggccctggtcttcttcgaagcctcctggccacggcggctgttccacgggctgcgcgcccgcctcgcgcggacgtccgtcgcgacttcggccgcctcggaaacgcccgcgacgcccgccccgagcgctcccggctggaagggacaggtggcgctcggactggccctgacctacgccgtcgtgcaggtcgccattccgctgcgcacccacctctacggcggcaacgtcctgtggcacgagcagggcatgcgcttctcctggcgagtgatggcgcgcgagaagaacggcagcgtgacattcatcgtccgcgacccggcgtcggaccgggaatggcacgtcgcgcccagccagtacctcacccgcctccaggagcgggagatgtcggtgcagccggacctcatcctccagttggcgcggcacatcgcccgggacttcgaggcgcagggcaagggccgcgtccaggtccacgtcgacgcccaggtgtccctcaatggccgccccgcggagctgctggtggacccggacgtggacctcgctcgagaggtggacagcctcgcgcccaagcggtggatccgccccgcgccggagtcgccgcccatccgcttgcgcgctccgctgcgcggcgcgacggccgagcgcccgtag

SEQ ID NO: 3537 - DNA, 1239 bp, Myxococcus xanthus
atgaacaccgagtcatcgcgccccctctccgtcctgcgtgcgcgcgccatcgcgctcgcggtgcccgccctcctctcgctgtccgcgtgcaagtcggacaaggtgaccccgccggacgcagggacggacaatccgggcgacacggtggccgcgacgcgcgccgcgctgctggagtcgtccggagcctgtgtgctgcagacggcacgtgagttccagaccgcggccaccgcgctggagagcgccgtcgcggcccacgcggccacgccggatgccaccacgcgagacaccgcgcgcgaggcctaccaccaggccatggacgtgtggcagatggcggaggtgatgcagttcggtcccgccgcgccccgcagcctcccgggcggcgcggagattcgcgacaacatctactcgtggcccctggtcagccggtgcgccatcgaggagcagctcgtcaaccgaagctatgagtcggagagcttcgacagctcactggtgagccgccgcggcctgtacgcgctggagtacctgctcttcttcgagggcaacgacaccgcctgccctggcacctccgtcatcgtgtcccagggcacgtgggcggcgctgtccgcggacgagcgggccgcgcgcaagcgggcgtacgccgccgtggtggccgccgacgtccaccgccgcgcggacgcgctggtgaacgcgtgggccccggaccaggagaatttcggccggacgttgacgacggcgggctccggcaatgccgtgtacccctccacgcaggcggcgctgaactccgtgagcgacgccatcttctacttcgagcgcgaggtgaaggacctcaaggtggcacggccgctggcgctgcgtgactgcgccacgtcgacgtgccccgaacacctggagtcacagttcgccgcgcgctcgaaggcgaacatccgggccaacctggtgggctaccggcgcatcacggaaggctgcggcgagaacttctccggcacgggcttcgacgacctgctggaggcctcgggcgccgacgcgctggcggcgaagctgcgcgagcgcaacgcggcggcggcagcgggcatcgacgctgttccgggtgaagacctggcgacggtcctggctcaggacaaggccgcgatgcgtacgatgtacgacgtcatcaagagcgtgacggacgtgctcaagacggagctcgtcaccgtgctggacctggagctgccccagtccgtcgagggggacaatgactga

SEQ ID NO: 3538 - DNA, 231 bp, Myxococcus xanthus
atgggtcgcgatgacgtcaccaaccgcttcgagtcgcgtgggatgcccacgttgcgtgccctcctcacacacctgaccgattcaggacgcttcacgctggccgggtgcacgggctcgctgggcgccctgggagcggaagcgcgggcggatgccagtggcatcgccctgtggctgggctggagcgccatcctccagcgcaccgcgggcgtgacggaccgcttctatctctag

SEQ ID NO: 3539 - DNA, 1002 bp, Myxococcus xanthus
ggtgaactcctgggactgagctccgtggcgcccaccgacagcttcttcgaactgggaggccattcgctcctcgccgtcacgctcatctcgcgcatctccgcgaagctggacatcgaggtgcccctcaacgaggtgttcgaccggccctccgtggagtccctggcgcactggattgacgaacactccagcaaggtcaccgcgctgattcgccagcttcccgcctgtgtggtggcgctgaagcccctgggacacaaaccgccgctgttccttgccccgccgtccgctggcagtccggccgtctacgtcaccctggcccgccacctggacgcggagcagcccgtgttcggcttccagatgcctggcgtcatggacgaccaactgccacccgagaccatcgaggacaccgccgcgctgtatgtggcggccctgcggcaggtccagccgcgcgggccgtaccggatcgcgggctggtcctacggaggactcgtcgtctgtgaaatggcgcggcagctcgaagcgctcggggaacaggtggcgctgctcggcttgattgacggcgcggcgttggaccggttgtccgcgcacgacggtaccccgcaggagattcccgcgggctcccagctcatcaaggtgctgggggaagcccagatgccgcgggactatgccagcctgagattgataggcgaatggatgggaatcagcctgcccgaggcatgggcagacctgcttcgtcgggatacagatgggcagtattcatacctgtggcgtttcttgcgagacagcgcgctgacggcccggaatttcctggcaacacgccgctcggagcaactctatacgttctcttcgtatggaggctccgccacacttttcaggacgggtccggtgacgattggaggcgatccgctcgtcgacagtgtgcgcagattcgcgctcgcggggacggaagtgataccggttccgggcaatcacatgacgctcatcatggatgaacggaatctgtag

SEQ ID NO: 3540 - DNA, 1458 bp, Myxococcus xanthus
atgaccgccaggctggacccgttcgtccccgcagcttcgccgcaggccgtgcccacgcccgagctcaccgctccgtcgtcagacgcggccgcgaagcgtgaagcccgccggctcgcgcacgaagcgttgctcgtccgcgcgaaggccatcgacgaagcgggcggcgccgacgactgggtgcaggcgcagctcgtctccaagggcctcgcggtggaggacctggacttctccagcgcctccgagaaggacaagaaggcctggaaggagaagaagaaggccgaggccaccgagcgccgcgcgctgaagcgtcaggcgcacgaggcgtggaaggccacgcacgtgggccacctgggcgcgggcgtgcactgggcggaggaccgcctggccgacgcgttcgacgtgccccaccgcgaggagcgcgcccgggccaacggcctgacggagctggactcggcggaggcgctggccaaggcgctggggctgagcgtgtccaagctgcgctggttcgcgttccaccgcgaggtggacacggccacgcactacgtgagctggacgattccgaagcgggacggcagcaagcgcacgattacgtcccccaagcctgagctgaaggcagcgcagcgctgggtgctgtccaacgtcgtggagcggctgccggtgcacggcgcggcgcacggcttcgtggcgggacgctccatcctcaccaacgcgctggcccaccagggcgcggacgtggtggtgaaggtggacctcaaggacttcttcccctccgtcacctggcgccgggtgaagggcctgttgcgcaagggcggcctgccggagggcacgtccacgctgctgtcgctgctctccacggaagcgccgcgggaggcggtgcagttccggggcaagctgctgcacgtggccaagggcccgcgcgcgctgccccagggcgcgcccacgtcgccgggcatcaccaacgcgctgtgcctgaagctggacaagcggctgtccgcgctcgcgaagcggctgggcttcacgtacacgcgctacgcggacgacctgaccttctcgtggacgaaggcgaagcagcccaagccgcggcggacgcagcgtcccccggtggcggtgctgctgtctcgcgtgcaggaagtggtggaggcggagggcttccgcgtgcacccggacaagacgcgcgtggcgcgcaagggcacgcggcagcgggtgacggggctggtcgtgaatgcggcgggcaaggacgcgccggcggcccgagtcccgcgcgacgtggtgcgccagctccgcgccgccatccacaaccggaagaagggcaagccgggccgcgagggcgagtcgctggagcagctcaagggcatggccgccttcatccacatgacggacccggccaagggccgcgccttcctggctcagctcacggagctggagtccacggcgagcgcggctccgcaggcggagtga

SEQ ID NO: 3541 - DNA, 1458 bp, Myxococcus xanthus
gccaagcagctgacggaagcaggcttgcgtgtcctggtgctcgaagcgggccgaggcatgggcgcggaccggatgctgtggatgctccaccgcatgcgccaatcccttggctacctggcggagacggacgaccagcgcaaggtgcgccagtcggtgcagagcaccaccttcgcgtggcccttccacccgcacgccttcgtcgacgacgtggacaatccctacaccacgccggaggaccagcccttcacgtggattcgtgcgcggcaggtgggcgggcgcacgtccgtgaaggcacacgggcgccagttctaccggctgtctgacttcaacttcaaagcaggcacgcaggatggacagggaccggactggccgctgacgctggcggacctggcgccgcactacgagacggtggagcggtggatgggcatccacggcaacgcggatggcctggacattctgccggactccgtcttcgcgggttccatcaccatgacgcccgcggagcagcgcctgaaggaacaggtggagcgccgctggccggaacgccgcgtcatcgtccgccgcaccgcgggagcgcccgtgacgatgcccgccgcgttgaagacgggccggctcgcgctgcgcacgaacgcggtggtggaccaggtgctgtacgacgcggcgacagggcgtgccacgggggtgcactacctcgacgcgaggtcgggcaagtcctacgaagcccacgcgcgggtggtggtgctggcggcgggcgcgattgaatccacgcggctgctgctgaactcgcgatgcagcgcgttcccggacggattggcgaacacgtcggggcagttgggccgcaacctgatggaccacacgtacatgctgggcatcgaggcgaagatgaacctgcctcccgaagcccagcggcaggagcatagctgggcgtacatcccccagttccgcaacgtggccacgaaggagcaggacttcgcgcgcggctacggcgtgcaggtcttcacctttggagacaactgccacttcgtgcccttcggggagatggtgccgcgcgcggagaaccgcgtgacgctcagtccgacggtgaaggaccgctggggcatccccgccgcgcacatcgaatgccgacactccgccaacgagctgaagatggccgaggacgcgctggcggcttgcaaggagatgatggaagcagccggcttcaccgtcgagaaggccaacgccacgttgtccacgccgggcatggccatccacgaggtgggcacggcgcgcatgggcacggacgcgaagacgtcggtgctcaatccccacaaccagagctgggacgtgcccaacctcttcatcaacgacggtgcctgcttcccgtcccagggaccgcagaaccccacgctgacgatgatggccatcgccgtgcgcgccagtgcgcacatcgtgaaggagttcaaggccgggcggctgtga

SEQ ID NO: 3542 - DNA, 102 bp, Myxococcus xanthus
atggcggtgctcgccgagcagttggctcagcgcggccacacggtctccatcgagagcctcactcgctcggtgcgcgccatgctcggtgcgcgcctcgcgtag

SEQ ID NO: 3543 - DNA, 369 bp, Myxococcus xanthus
atggaagcccatccgggcgcgtcgctcgcgcggtacccgcccgagcgactgcacgcgctggcggaccggctcgccacgctggcgcgccttccggagctgacggcgctccagattgacttcgatgcccgcgcgtccgaatacgacgcctacgtcgcgctgctccaggcgctccgtcagaagctgcccccatcgatggcgctgtccatcaccggtctcgcctcatggtgcacgcccggaagctggctgacgcacgcgcccgtggacgaggtggtgccccagctcttccgcatgggcccggaagcccccacgtggcgggcccacttcgcgcgcggcctgcccgccccttgccggggcagcgggggctcttta

SEQ ID NO: 3544 - DNA, 717 bp, Myxococcus xanthus
atgcagcccgtgcccatcgtcgtcgggctggtgctgcgagtcgtgctaccgctcgcgttcgtctccgcgctgcgccgcagccgccgggccatcgtcgccgtggacacccaccagtggaccctgacgctgcgcggcggcgcccggatggagattcccttcgaagccgtgagcgcggtgcgcccctggcggctgccgctcccgggccccggcctggcgctgcggatgcggtcaggccgcgctttcagccacgcgctggaggtggaggacgccctgcccctgctgaactcgctgggccagcacggagcaccaggcgccgcgcaatcccacacactgattcgttacgcccatgcgcgccatgccctgtggcgccgccgctggtaccacctgctggtgaagttcgtgttcttcccgctggtgcccacggccatcctcttctactcgtaccaggtcatctcgtttggcggcgcgctgggtgagtacaggatgtacggattggacgcgtacctgcgttcgttcggccggtactacgcgccaatctcgttgtgcctgctgctcttcgcctgcttctggcgcgtcgtcgcagagggcgcgtcgctcctggcggcgtggcttctgccagcctgggcgcgcggcgtgcggcgtgcggcggagtggttctgctggctcgtctactacgtcggcacgcttgggttgatcggcgcgcgcttcatgatgtga

SEQ ID NO: 3545 - DNA, 1275 bp, Myxococcus xanthus
ctgatgcagtggctgctcctgggtgggctggtgggcgtcgtctgcggcgtggcatccgcggtcttcttgtacctgttggacgaagcgacgcacttccgggaggggcacccgtggctggtgtacgcgctgccggtggcggggctggtgctgggggcggtgtacgggaagtggggtaggcccattcgcgggggcaacaacctggtgctggacacggtgcacgcgagcgacgcgcaggtgccggtgcgcatggcgcccatggtgctggtggggaccgtgctgacgcacctgttcggcggcagtgcgggccgcgagggcacagcggtgcagatgggcggcagtctggcggacctggtggcgcgacgcttccgggtgggcccggacacacgccgcgagctgctggccgcgggcatcgcgggtgggttcggttcggtgttcggcacgccggtggcgggggcggtgttcgggctggaggtcgtggtggtggggcgcatgggctacgaggccctgctgcccgcgctggtggcatccgtggtgggagacatggtgacgcgggggctgggcatccaccacacgccgtatccggcgccgggggcgctgccgctgacagtggcggtgctggcgaagtggctggtgttcgcggtggcggtggccgtggtggcggtggtgttcgtggagttgatgcaccggctgaagaagctgctggagcagcgcgtgcaggtgttgccgctgcggatggcgttgggcggtctggccgtgctgctgctgtggctgctggccggtacggatgactacctgggcctgggggtaccgggcatccagcgagccttcgaggacccggcgctgcccgtgtcggcgttcgcgtggaagcttgccttcacggtggtgacgctggccgcgggattcctgggcggcgaggtgacgccgctgttcttcatcggcgcatcgctgggcaacgtcctggcgcggctgttgggcctgccgttggatttgggcgcggcggtgggcatggcggccctgttcgcggcggcggcgaatacgccgctggcgctgtccatcatggccgtggagctgttgggggcgaatgtgttgccccacgtggcgattgtggccacggtggcgtacctgctcacggggcaacggggcatctatccatcacagcggattgcccggatgaaacacggagggccgctgctggagaaactcgtggccctgcgggagctggcccgcgaggaccgcgccccgccctcagggcctgagggacggggcggcggctga

SEQ ID NO: 3546 - DNA, 891 bp, Myxococcus xanthus
atgaagtggcggtggctgctgggtggagcgctcgcgctggggctgctggccgcgctggcggtgttcggtagggcgctgcgtcattccgaggcctacttccactacccacgtcccaaggccgagcgccccgctgatttcgccgaggcaaaggacgtttcgcttcagacgtcggatgggctgacgctgcggggctggtacgtgccgtcccgcaaccgcgccgccgtggtgctggcgcacggcctgtcccagacgcgcgcggacctgctgcccgaagcgcgaatcctgcgggccgcgggctatggcgtgctgctcttcgacctgcgcgcccacggtgaaagcgagggtggtttctccacctggggagacctggagcgccgggacgtgcgggccgcgctggacttcgtgcgcgcccagccggacgtggacccggagcgggtaggggcgctcggcttctcgattggctccgcggccgtggcggaggtggcggcggaggacccggcggtgcgcgcggtggtgctgctgtccccgttcaacacgctgtggctggccgccacgtatgacttccgccgctttggcttcgtgtcgcagtccggggcgctggtgcccttctggcggcgcggcatcgccctggaagaggtgcgcaccatcgacgcggtggagcgcatccgcccccggccgctgctcatcgtcatggggacggaggagtcaggacagccgctcgccgacgagctcttcgccaaggtgcgcgagtatgcccagacatggcgcatccagggcgccgggcacgggaacttcagcgccaccgagccagaggcgtacccgcgccggctgacggacttcctcaatgccgcgttgctggcgcgcggcacctcggcgacggacgcgcgctga

SEQ ID NO: 3547 - DNA, 1491 bp, Myxococcus xanthus
atggtgccctggctcgcggcgttggaccgggcccgctcggcacgcgaggcgctgagcctgggcgtgctgctcagtgtgacgttcaccgccgccgtctttcactggttcccgggcgcgctccaggcgtactcgcgggcgcccacggtggttggttgggcgctgttcctgctggtggcgccgctgctccagctccagttcgtcgccgccgcgctggcccggtacgcggcgcggcgtctggcgcgggaggggcagggctggttgccgcccctggtggggacgctcgtatacgtgggtgtggagggcgtcacgcccaagctcttcgcggacacgttggggcatgggctctatgcctctgagtggctacgccagggcgcggacgtggcgggcgcgccgggactcacgctggtgttgctgctgggcaatgagtgcgtgctcgcggcgcttcgtcagtcacagcggggtttgcgtgctgcctggcggcccgtggcagggctcgcggcgctggtgctcgtgttgtcggggtacggcgccttccggcatgcgcaggtgcgcgaggcaacccggcgtgagggcgggctggtggtgggcgcggtgcaggcgaacatcacccgctacgagaagctgaaggcggagatgggcgcctacgaagtcgtgcggatggtgctcgacacgcactacgcgatgtcggacgcgctgctgcgcgacggaccggtggacctgttggtgtggccggagacggtgtaccccactccttttggagcgccgcgcagcgagacgggcgcggcgctggacgcggagatcgccggctacgtctccgagcgcggggtgccgcttgtgttcggcacgtatgacctggagggcgagcgcgagttcaacgcggccatgttcctggggccgtcgtcacctggaggcgcgttcgagcgcgccgcgtaccgcaagacgatgctcttcccgctgacggagtgggtgccggacgccatcgacacccccacgcttcgcgagtggctgccgtggacaggacgctggaagcgagggcccgggcctcgggcggtgagcttcacgctgcgcgacggacgccagctccgggtggcgccgctcatctgctacgagaccatcttccccgagtatgtcgcgcagggcgtgcggcagggcgcggagctgctgctcacgctgtccaacgactcgtggttcaccggcacgcccgcgccccggttgcacctgatgcacgcggccttccgcagcatcgagacgcggcggccacaggtccgggtgacgaactcgggtgtgaccgcgctcatcgacatcacgggcgcggtggtggccgaggtggacgacaaccagcgcgcgggcctcaccatgcgcgtgccggagacgaccgcgctgacgacactcgccctggcgtggggagactggctgagcccaattgcgctggtgtcatcggtggtgggcctcgcgggtgcggcactggcgcggcggagggctcggccctga

SEQ ID NO: 3548 - DNA, 309 bp, Myxococcus xanthus
atggactccgaactgacgggcatgcagctctaccggcccgggacgaagcccatcaagaaaggcctcgtcgtccccgatgacttcgagctgccgcccgggtacgtgcgtcatttccagtacaaggactcgggtgaaatcgtggcggccgtgctgatgttccatcccgaccatcagcccgtggatgcgaacgggcagccgattcccaagcccgccgacgggctggtgcccgaggagctggcccctccgggaatgcctatccaacggttggagctgcccgagggcgcggagagtggggcgccctcgccgtga

SEQ ID NO: 3549 - DNA, 984 bp, Myxococcus xanthus
atggcgagcaccctcaaccagaacacgtcgtggaccatcgaccagccgtcgacgtcgacgaagtaccgcgtggtggcctacggcgactctatctacgccggctacaacggttccgtcttcttctggaacgtggctcgccgcgcggcgccggtggtgcagggcgaggacctggcgcggaagtggaacgcggacgtggaggtcatccgccgcaccaagtccggcgcgaaggcggacgacatctacaacaacaagattgtctctgagcgctcgtacatgcaggcggcgaacacccgcgtcgtcatgttcgagatgtgtggcaacgactacctccaggcgcgcagcgccttctctgggcagacgggcacctgtaactactcgggcctggaggccgcgctggcgacctgcaccacgtacatggagcgggcgatgcagaccatcaaccagtacgcgcccgccaccgcgacgaagatcatctccaacatctactacccgggcttcaacgcggacaacgtgaacacccagtgccgggactccgccacgggccaggtggtgaacaagcgggagaagttcctgccgctgctggcgaggagcaactggcgtgcgtgcagcctggcggctcgccacggcttcaagtgcgcggactcgttcgcggagtacatggccgcggattacgactccaacggtgatggcaaggtggactccgaggccatccgctacatcgagggcgagtccgaggcggcgtacgtccagcgcatctccgtcacgctgcgctccacgctgcgcgactcgaacacgcacttcgtcaacgcgagcaccagctacgactacctccagtctgacgacacccacccgacctacaccggtggcaccatttccagctctggcggcaccggcgcgctgcccaccgatacctcgacctggaacaagactggccacgaccgcatgggctgggagagcgcgaagttcaaccccgccaggccgtag

SEQ ID NO: 3550 - DNA, 1506 bp, Myxococcus xanthus
atggaaacgggtttcgtcaacagggtctggtacctggaccgcgaccgcgacagcttcggacgcaatgggcccggcacggaggcctgtgacccgccgagtgaacttcatgtcgaggtgacgggggactgtgacgacgagcgggccgacatccatccaaacgccgtggaggcatgcaacagcgtggatgacaactgcgacgggcgcgccgacgagctgttcacggaggggccgggtgccctggggacggcgtgcacggagttctgcaacgggacgtatgcatgcaacgacacgcagacggggacggtctgcgtcggcacgcctccgacgctgctctactcggacgcggacagcgatggagagggcgagaaggacagtgcgccggtgggagagctgtgccctgacgcgcctatgccttcgatgatggcggacaacacgcgggactgtgatgacgctgaccctggcacgaacaccctggcgacggaggtttgcgacgggctggacaacgactgcgacgggcaggtggatgaggagatgtcctgcggctcgctgaagaaggtggtggaccccgtgctggcagggggcaattggaggacggtggccgtgcacccgagtggttacccggtgtgggtggcgggattggggggcaggctggcggtgaagatggacgcgacttcagcgttcgtgagtcacagcggggatacgacgaaccggtgtgggccggccggaaacaagctggactggcacgcggcgtgggtcaatcccaataatagtaatcttgttgtggtcggcgaggacggccatataggcgagcacaccgggagcacctgctaccctatccagttcgacctccctggcaagaacgactacttctcaggtgttgtcgggatcggaaatccagctcaggtattcgcagcctccaccctgggccacttgtatgagattacaggggcggcccagcgccacgactcacccggccggtactgggggctccatgcgctcggccaggacgcactgtttgcggtgggttcgacaggagagtcgtcaccgctgacgccggtggtgaatctctacacccgcccgcccccccccgagaccccctggggcactccggcagtgcacaacctccaggggaccgcgggctacaacggcggcttgcgagcggtatgggctgcggacgcgacgctcatctacgcggtgggcgacggcggcttggtggtgaaaggcagtggccagtcgagggactgggagcgggtgctcccgcaggcgggacccgtgctcaactacgtcagtgtggctgccccgcccgggaccatgaatgcctacgtcattggcaacgagggcaatgcaggacggctgcagcggttgaccccacacggctgggccaaggctccagccttcaccccaagcgcgccgaacgtgccgctccgcgacatcgccatgacctcctcaagcaacttctggatcgtcggcgacgacggaaacgtctaccacttcccggagccgtaa

SEQ ID NO: 3551 - DNA, 1116 bp, Myxococcus xanthus
gctctaaagctgcgcacggcggacgtgggcgtcgtgaatctggagacgcccgtcaccgacaacacgaaggcggtcgcgcgggagctcttgttcaacgcgccgtcggccatggtgcacgcgctggcctcggccggggtgaaggtggtgtccaccgcgaacaaccacgcgagggaccagcaccccgcgggcatgttggagacgctgcggcacctggatgcggcgggcatccgtcatacgggcacgggcgcgacgaaggacgccgcgtgggagcccgccttcgtggacgtgcgaggcgtgaaggtggggttcctgtccttcacgcgcatgctgaatggcttcagcaatccgaaggatgcgcaggcgccgcacgtcgcgctggtgccctattcggggcacgaaacgcaccgggggattcagcccgaacaggccgtggaagccgtgcgcgccgcggcggcgcaatgtgacgcgctcatcgtgctggcgcactgggggacggagtacaagggggagccacggcccgaggaccgtgagctgggacgcgcgctgctggacgcgggggcgagggcggtcatcgggcaccatccgcacgtgctccagccgctggagtcgtaccagacggtggatgggcgcaaggggcttatcgcgtactcgctgggcaacctggtggcgaaccaggaccgcttctaccagcacgcagcggggacgaagagctcggggggcgaccggcgggactcgatgttgctgcggctgtcgctggtgcggcccatgcccggtgtgtcggtggctctggaggaagtggcggtgctgccggtgtggattgagaacaacgcggtggggcgggcgcgaaatgagtcgcggaacatccagccagtgctcatcgaccgggaggtggaggaggtgacggcgcggctggcgttgctggcggcgcgccccgcgcctctggacaaggagacacgcgcgcagaaggccttgctggagcggcggctggaaggctccaagcaccggcgtgagcgcattctccggatgttgccggaagggttcgcggtggcgtcgccggagttgcgtcagcgcgggacggcggccgtgcctccagggcggttggcctcacagccgtga

SEQ ID NO: 3552 - DNA, 1155 bp, Myxococcus xanthus
atgaatgactcgctagagaccctcctggccgatggcatcatcgaagccatcatcggccagttgaagacgggcaaggaggccgaggtatggctggtccagcatgccggccaggtggtcgcggccaagctgtacaaggagcgccacgagcgcaacttccgcaacaacgcgggctaccgggaaggccgcgaggtgcgcaactcgcgcacgcgccgcgccatggagaagggcagccgcttcggccagaacgccgccgaggacgcctggaagagcgcggagtcggactcgctctacaaactgcacgcccagggggtgcgcgtccccaccccggtgctgttctacgagggcatcctcctcatggaggtggtgctggatccagagggccaccccgccccgcgcatggtggaagccccccccagcacccccgaggacgcgcacgccctctacgtggacctgcgagcgcaggtcatcaacatgctgtgcgccgacctcatccacggcgacctgtccccgtacaacatcctcatgagctatgcggggccggtcatcatcgacttcccgcagacggtggcggctgctcgcaacaaccgcgcggagttctatttccggcgcgacctggacaacgtccgcaacttcctcgcgagcaccgcgccctggctgcacagcatcgcgagcgacacgagcgaaatctggaatgcctacgtgcgccgggagctcacccaggacttcgtgccgtcgggcaatttccgggaggggcctcgccatcacggtcgcggaggtcctcggaaccaggggttccagccccagggtgacgagcgcagaggcgggttccgtccgccgccgcccgcaccggtcgagcaagccgccgccccccagcgcgacatgacgcccgaagaggccgccgaggccgagctccgggaactggaggcgctggtgctcaggcagggtggcggtgagcgtggcaagcccgcggtggcggcacctccgcctcggggcgggcgcaaccggggttttggaggaggtcggcctccgccgaggggtggaggcaacggagcacggccgccccagagtgggcagcggacgggcggcggtgcgcctgggcgcccaaacgaaccgcgtgcgagtggtggcgtccagggccggcccgcgcgcgaatga

SEQ ID NO: 3553 - DNA, 630 bp, Myxococcus xanthus
atgccctgtgcgggctgtcaccagttcggcttccccgtgctgacgagcgcgggccagcgggtgcggctgtcccccacgcagcttcaacaggacacggtgggagagtggcgccgctggcagacccagagcggtgacacgcgccattgcacgtcctgccacatgccccagggagaccacggcttcggaggcacgcgacgcaccgagtccctcaaggccgcgctccgggtcgtacaggcgagcgcatttctccgcatctccacgcgcgaggtgggccatgcctttccctcgggtgacgtcatgcgctgggtgagcgtggaagtctccgagggccccctcttcgaaacctcccgcaccgtggccacgttcggccgcagcctggaggtccgggagtggccccacgagcccctgccccacctgggcgcggtgaaggacacgcgcttgctgcccggagagacacgccaggtgctgctccccaagggggcacgctacgcgcgcgtcgtctaccacctcgtgtcccgcgagcaggaagactccgggctctacccgccgggcctgtcccagctcgtgctctgggccgagccccttcaaccttttccgtcgtcacacaccccgaaggaacgcacgccatga

SEQ ID NO: 3554 - DNA, 633 bp, Myxococcus xanthus
atgaagcacatcatggccctcttgcagccggaccggggcaccgtcctggtggatggcgaggacatcgcgcggatgaacgaggccgcgctcgaccagatgcgccgcaagcagggcatcctcttccaggcgaacgccctcttcgactcgctcaccgtgttcgacaacgtggccttccccctgcgcgagcgcacccgcatgcccgaggcggaaatcgccgagacggtgaacaagacgctggagcgcgtgggcctgtcgcacgcgacgcagcgcttccccggcgagctgtccggcggcatgcagaagcgcgtgggcttcgcgcgcgccaccatcctccagccgaagattctcctctacgacgaccccaccgccggactggatccactcaccaccgcggcggtgaatgaaatcatcaccaccggcaagcagcagctcggcgccacctcgctggtgattacgccggacgtggcctccgcctttggcatggcggaccacctggccctgatgcacgaaggccgcatcgtggagtacggcccgccagacgccttccgtgagtcacagcaccccgcggtgatggccttcctccgcaactggctccggcgccgcgcccagaacaagcgcgcggcccaggcctga

SEQ ID NO: 3555 - DNA, 585 bp, Myxococcus xanthus
atggagagcgacggcatcgtgcgcatcgcggggctgctccacctgggagacgcgtccttcttcgaggcggatgccagccaggcgcagatgctggcgagcatcgagaagctggacaagaaggaggcccagcagaccaaggcctgcatcagcaagtgcgagaagcgccgcgcggggacccgcgaggacagctacgattgctcctgcgcggacgagtgcatgggctgcgacgaccccaacctccccgcgtcggagaagctcaagcaccaggtcactggcggcgacttcctcctgggctcactcgcccgccccacggcattcctgcgtggcaagtccgagctctccgggagccgtgagtcctggtacgccttccgtcagacgctcgtcacctacgcgggcgagaaagcagatgtcgtgctcacgaacgaccacacagacatgatgatggagggcaccgtcgccctgcgcatccatgtcatcgactggggcgagtcgaacggcaaggcgagcccgaccaccatcaccagcttcctcgtctccgagacccgggtccaggtgctgcgctaccgcccggcgcctcgggcctga

SEQ ID NO: 3556 - DNA, 1248 bp, Myxococcus xanthus
accttcgacaatctgggcctctcgcgggagacgctgggcgccctgcgccgcgcgcgtttcacgcagcccacgcccatccagcagcaggccatccctccagcgctcgccgggagggatgtcatcggctgcgcggccaccggaacgggcaagacggccgcgtatgtcctccccctggtggaacggctcgcggggaagaagggcacgctcgcgctggtgctggcccccacgcgtgagctggtccagcaaatcgcggagccggtgcgcttcttcgcggaaccccgccgcctcacgcacgccaccgtcattggcggtgaggacatgggcgcgcaggtcaacgccctgaagacgctgccttccttcgtcatcgccacgcccgggcggctggtggacctgatggagaacaccgccatccgcttcccacacctggaagcgctcgtgctggatgaagcggaccggatgctcgacatgggcttcctgccgcagctcgaacgcatcgtcgcccacctgcctcgccgccggcagacgctgctgttctccgcgacgctcgggcccgacgtcacccgcttcgccaagagccggctgtacaagcccgtgcgcctggaggtcacccgcagcggcacgcccgccgagcgcgccgagcaacggctgtacttcctccgtcccgaggagaagacgccgctgctgctcaccctgctggcccaggactcggcgacggcgctggtgttcacccgggcgaaggagcgcgtggacaaggtccagcgggcgctccagcgcgcgggacaccggaccgcggtgttgcacgcggaccgcacgcagaaccagcgcaagcaggccatggagggcttccggaacggcacctaccgctgcctcgtggccaccgacatcgcggcgcgtgggctcgacgtggaggacgtgggccacgtcatcaactacgacctgccccatgcagccgaggactacgtgcaccgcatcggccgcacggcccgagccgccgccagcggtgtcgcgtcgaccttcgccaccacgcgcgaggggcaggtcatcacgcgcatcgagcacctgatgcgctcggagattccccgcgtccaggtgccgcgcgaggaccccgtcttcaaggaggcgtgggaggccttcctcgccgcgcagaaggacccgggtcctccgcagaaggaccacgggcagtcgaagcgcgcgccggacctggcaccgggacggcacgcgcgctcgcacggaaagcgccgctcgtag

SEQ ID NO: 3557 - DNA, 1308 bp, Myxococcus xanthus
atcggacatctacgtgccctgagaaaggacccgctccacttcctgcaagcccaggcgcgggaatacggcgacgtggtgcgcctccccatggggcccgccgacctcgtcctggtggcgcacccggatggcgtgcgccacgtcctccaagaccatgcgcgcaactacagcaaacagtcacgcggattcagggtgcttcaagaactgctgggccatggcctgctcaccagcgacggtgaccattggctgcggcaacgccgactcgcgcagcccgctttccatcgccaacgggtcgcgggcttcacgaggaccatggtggacgcggctgcggacctccccgccacgatggaggcccgcgccgacacgggcgccgcgttcaatgtggccgaggacttcacccgcctgacgcttcgcatcgccagctcgacgctgttcggcgccgatgtcagcagcgccacgcatgacatcgcgacggtgatgagccggctgcaagtgtttgtctacaagcggctcacacaacccgtgccgctttccttgcgccttccgcttcccgcccatcggcagttcgagcgagacgtcggcagcctcaaccgcgtggtgcacggcatcatcgcgaagcgacgacgcgagagcggcgagcaccacgacctgctgcagatgatgatggaggcacacgatgatgacacgggcgagcggatgagcgactcgcagctccgcgacgaggtcctgaccctgctgctcgccggccatgaaacgacggcgagcgcgctggcatggaccatcatgctgttgtcccagcacccgggcgtgcgaagggacatggagtcggagctggcacgtgaactgggtggccgcaaccccacgcacgaggacctgccccggctggaactcacccaccgcgtggtggacgaatccttgcggctctatccaccggcatgggccctctctcgaatcgccaccaaggaggacctcgtgggcggattccggattcccaaaggcgcccatctattgatcgccccctgggtgacacaccggcacccgagcatctgggacaatcctgaaggcttcgacccggatcgcttccttcccgaacgggagcaggcgcgtccacgcttcgcctggttccctttcggcggtgggccacgtcagtgcatcggcaaccagttcgcgctgatggagttggtgttggtgctggccaccctgctccaacgcgtccggctgaacctgacgccgggccaagtcatccaccccacgcccgccatcaccctgcgccccaggcccggcgtctgggtcaccgcctcgcggccctga

SEQ ID NO: 3558 - DNA, 388 bp, Myxococcus xanthus
atgacgtcctctcctcccccgcccccgggcgcggtcgccttcgtggaccgctggcgcgagctgttcgatgcccgtgactggtctggcctgcgggcgcacgagcatcccgactttccggaggccggccctccccgtcagaacgacagcttcatccggggactcggcacgagcggctttcgagtcacgagcgcgacgctgaagcccttcgtgcagccccggtggtccatcttccgcacgcagcgcctgcacccgcaaccgacgtactggtgtgacctggtgttgaagaacgcgaagggccacgagaccgaggccttcatcgccctggctccgtgggagggcaccgagggtgccttccgcgcctcgtactacgtcgcgattccccttagac

SEQ ID NO: 3559 - DNA, 867 bp, Myxococcus xanthus
tccgagcgctatctcttcaagctcattcgcgaatgccaccgaggagagtcaaaacgcatggcccgatacgacttcgacctgttcaccattggcggcggctctggcggtgtggcggccagccgcagggccggggcacacggggccggggtggcgctgtgtgaggaccgcgacgtgggcggcacgtgtgtccaccgtggttgcgtgcccaagaagctcctggtgtacggagcacacttccgggaggagttccaggacgcggagggctatggctggacggtccaggagccgttgttcacctggagcaagctgctggccgccaaggacaaggagttggaccggctgcgtggcgtgtatgcgcgcttgttgcgcgactcgggcgtgacgctgctggaagggcgcgggcgcgtggtggacccgcacacggtggaggtggccggaaagctgtacacggccgagcgcatcctgattgccacgggctcgcggccctacctgccgcccgacatcaccggcatcgagcacgccatcacctccgatgaggcgctgtccttccccgagctgcctcggcggctggccgtcgtcggggccgggtacatcggcgtggagctggcgggcgtcttccacgggctgggctccaaggtgacgatgttgattcgcggcgccagcgtgctgggtgggttcgatgacgacgtccgctccttcctcacggacgagatgcgcaagaagggcatcgagctgatgacggacaccttcatccgggacatcgaaaagcgagccgagggtggggtgagcctgctgacgggcgggggcgagacggtggaggcggacgcggtgctgttcgccaccgggcgcttgagagcacacgaggag

SEQ ID NO: 3560 - DNA, 2457 bp, Myxococcus xanthus
  unsure (1)..(2457): unsure at all n locations
atgacggcccgcctggaggtggaggcctcgctccggcagcagaaggagttcttcgaggcggtggtcatcaacagcccggtggccatcatcaccatcacccgccagttccgcgtgctgtcgtggaaccccgaggccacgcgcctgttcgggtattcgccggcagaagcgctcggcaagcacatcttcgaactggtcgccaccgagcccaccgtcctcccggaagcggagcaggcgtcgcgcgaggtcgtgcagcgcgggcggctgcgctccgtcacccggcgggtccgcaaggatggcagcgtggtggacgtggagctgcgggcgctgccggtgtcggtgggcgggcggcagcttggcttcatcgccatctaccacgacatcaccgacctcgaacgggcacgcaaggcggcggaggcggccaatcaggccaagagcctgttcctggccaccatgagccacgaaatccgcacgccgatgaacgccatcatcggcatgacgggcctgctcctggaccgggcgctgacggaagagcagcgcgacttcgtcgccaccatccggcagagcagcgaggcgctgctgacgttgctcaacgacgtgctggacttctccaagatcgaggccggtcgcttcgaggcggagctgcggcccttcgacctgcgccagtgcgtggagtccgtcctggacctgatggccgtgcgcgccagcgagaaggggctggacctggggtgtgacctcgcgccgccgctgccgcagatgttggtgggcgatgcgtcgcgcctccgccaggtgctgctcaacctggtgggcaacgcgctcaagttcaccgaacacngcggcgcggtggtgagcgtgcagggattggccctgggcggcacggagggcgcggcggactgggagctgaccttcagcgtgcaggacaccggcctggggattcccgacgaccggcgcaccgggctgttccagccgttcaaccaactggatgcctccgtgtcgcggcgctttggtggcacggggctggggttggccatctccaagcggctggtggaggccatggccggcaccatctgggtggagagtgagggcgtgcccggacaaggcaccaccttccgcttcaccctgcgcgcccaggctgcgccacaagcctacgcggtgcagccgcgccaggagcaggggctgctccagggccggcgcgtgctcgtcgtggatgacaacgctctgtttcgaaggttgctgggccggcagctccaggcgtggggcctggtgcccgtggagtccgcgtcggggatggacgcgctcgcccaactcgaggcgggggcttcgttcgacgcggtgctcattgaccatcacatgccggggctggatggcaccgcgctggccgagcgcatccggcagcgcgaggagacgcgggcccttcccctggtgctggtgtcgacgccgggccggcggggcaatccccccgagggcctgttcgcgggcgtgttgtcgcgtccgctgaaggactcgcagctctacgacgcgctggtgtcgtgcttctcgcagcaccttccccagctcccggagccccggcagacgcggccctcgcgagcggggccctttccgggggagcggccgggggacaccgtgccgctggacatcctcctggtggaggacaacgccaccaatcagaagctggcgctgctggtgctggagcggctcggctaccgcgctgacgtggcgctgaacggacgccaggcgctgcaggcgttgtcccagaagcgctacgacgcggtcctcatggacctgcagatgccggagatggacggcctggaggccacgcgccgcatccgccaggaactgccgcccaaggcgcagccctgggtcatcgcgatgacggccaacgccatggactccgaccggactcagtgcttctcggcgggcatggatgacttcctgggcaagcccatccgcgtggaggcgctgatggcggcgctcatgcgctgccagccccggcgttcgtaggtggcaccggagcggcgggtctccagcggcgcggtcgagctcacgccgcagcactcggtcatgagagtcgtgctggacgtggcgcgcatcccgggcctggagtctgccgcgctcgcccggctgtgggcggagctgggggcgcaggcggcgcagattctccccgaactcatcgacaccgcgctgcacagcatgccggcgctcctggaggacgcgtactcggccctggggcgtgggcacgcggacgacctgggccgggcggcgcatacgctcaagtcgaacgcggcctggttcggcgccagcgcgctggagtcccaggcccgcgacatcgagttgcaggcggactccgggctgctggaggacatgcccgagcggctcgagcggtgccgggcggagctggaagtgacgcggctcttgctgggccgcctgcgggacagcgtcctggccctgtccggcgcctga

SEQ ID NO: 3561 - DNA, 597 bp, Myxococcus xanthus
atggcgacgaagtcacgcaagacggctgttgcgaagaagtcatcccggcgtaccgcgacggcgaagaaggccacgccgaagaaggcggctggcaaggcgcacggcgcgaagaagaccaccacgaagaagaagacgacggcgaagaagacgacggcgaagaaggcggctgcgaagaaggcccccgcgaagaagacgacggcgaagaaggcagcggccaagaagaccaccgcgaagaaggccaccacgcgcaaggcggcgacgcggcggacctccaagtctcggcgtgagcggcccacgacaggggtgcccttcgtcgagcaggtggagacgacgtccgcggggctccagcccctggcgcccacccacgccgcggtggacgagttcaccagttccggcgacgaggtgctcgacatcttccagcggtacgaccgcgaccggaccggcaccatcgaccgtgcggagttcgcgcgcttgctggaggcgctggggcagaacatctccgacgaggagctggaaatcgccgtcgacatcgtcgacacggaccgcaccgggaagatttcctggaacgagttcaaggcctggtggaacagccgctga

SEQ ID NO: 3562 - DNA, 984 bp, Myxococcus xanthus
gggttggacaagctggtgcaggtcgagcggccggacccgactccaggccccatgcaggtgcgggtgcgcgtgaaggccacgagcctcaactcccgtgacttgatgatggtggagggtcgttacaacccccggcagaagctgccactcattcccaactcggacgcggcgggcgtcgtggatgcggtaggcccgggtgtgacgcgggtgaagcctggtgaccgggtgatgagcctcttttcccaggcctggagcgccggagagcccacgcgggcggcgcaggtgagcacgctgggaggaccgttggacggtgccctcgcggacacggtgctgttgcacgaggacggcgcggtgcctacgcccgcctatctctccgatgaagaggctgcgacgctgccgtgcgcggccgtgacggcgtggagcgcgctggtcacccatggggcactcaaggcgggggacaccgtcttgcttcagggcaccggtggcgtgtccatcttcgcgttgcagattgccaggctgctgggcgcgcgaatcatcatcacctccagcagtgacgccaagctggcgcgagcccggacgctcggcgcgcatgaaggcatcaactacgggacgacgccggactgggacaaggcggcgcgcgcgctgacgggaggcgtgggcgtggaccacgtggtggaagtgggtggggcggggaccttcgagaagtcgctgcgcgcggtccggcccggcggcacggtgtctgtgattggcgtgctcagcggtggtgcggggacggtgccgctgacgcccatcctcatgcagaacctgcgggtgcagggcatcttcgtgggccaccggcagagcttcgacgcgctcaaccgggccttcgcgttgcacaccgttcgcccggtggtggaccgcgtcttcgagttctccgaggcacgcgctgctttcgagcacctcaagagaggggcgcacttcgggaaggtggtcgtccgggtggggtga

SEQ ID NO: 3563 - DNA, 276 bp, Myxococcus xanthus
atggcctgtccgggaggcacgtccgtgttcatctcggacgtggtgcagagctacacgccagcgtggaccacggccgggtgtacggcgcgagcaagccagttgatggcggagcagtgggccttccgcctctgggacgaggacctggcgtccgacgacaccatcactgatgtcctgggcatgcgcttcaccgagcagcacttcgccgcgggcaccgtcacgatcggtgcttctggcggcatgacgtcgctgacggtgcagctccagaagcagccctga

SEQ ID NO: 3564 - DNA, 198 bp, Myxococcus xanthus
atgttgctggaactgtccgccgtggaggcgcgcgacgtgaagcaagcgctggacacagcgctgcgcgcgctcttggaagagatggcccatgcggacccgcacgcccatcgcgacctgctgcgcgagcgatatgagcggctggaccaactcaaccgccggctcgacatgagcctggagggagaacaggtctacgcctga

SEQ ID NO: 3565 - DNA, 453 bp, Myxococcus xanthus
atgcccttcacaccgctgccggtggtcctggataccaacgtggtcctggacctcttcgtgttcgatgacccctacacacgcccgctggccgaggccctggcggcgaggacgctgacggcctggacggacgcggacacgctggcggagctgggctacgtgctggcctcgcgcaactttcaacccggcctgggggcgccccatcggaccgctgcgttcgagcgctaccgggcccaggtccacatggcgccgtccgccgagtccgtgcccacgccgtcattgccccgctgccgggaccgggacgaccagaagttcctgagcctggccgcgcgagccggagcggcgtggctggtgagcaaggacaagcgggtgctctccatggcggaccgtgcgggcctgtctttcgccatcctcacgcctcggcaggccgtggcccgcctaccacccagggggtag

SEQ ID NO: 3566 - DNA, 882 bp, Myxococcus xanthus
atggcgttttcaccgcacaagggccgttcgctggcccacaaggcccgtcagcgctcccccggccaccactacaacgcgagcttcatgtccgccgccgaccgcgcggaggccctgagctggctcgcgacgctccacccgctgtgggaagagcgctactccaagcacttccccccgccaccggggcagtcccagcggcggctgctgcggccggtgtattggctcggcaactggcagttcgcgtgcctcgactactaccacccgcccaagggcatcctgaaccggtgcgtccaggccgagccctttccggcggtgctccagcgccaggtgacgaaaatcgaggagctggcgcggcggatgtaccgcgggccggacatgcctccccgctggcacctcaacacctgcctggtgaacttctacgggagccggttggaggacgggcgctgggtggacaccgcccgagtgggcgagcacaaggacttcgagccgggccccgtggcctcgctgtccttcggtgagcgtgccctcatccagttcgtcacgtcctcccgcccaggcgaacgtgacgcggtggtgttggagcagtggctggatgacggctcgctccagctcttcggcggcgcgcgctggaaggaccagacgttccaccgcgtgcagcgggtggacacgcgcacgggcaagacgctggctccggagctgccggacttccgcacccgccgcatcaacctgacgttccgctacgtgccggacgaacacgtcattccgttcgccgcgctctctcccgaggcgcgcgaggacgtgcggccctacatggcgcagctcgcccggggcagcgccttcttccgcgatgccctcgcacgtgaggcgccgggcacgccggcctga

SEQ ID NO: 3567 - DNA, 1128 bp, Myxococcus xanthus
atgcgccctcacaagagccaccagaacggccgtgacgtggacgtgggcttctactacccgacggtggaccccatccggacccgcgcgcgcgagcacgtcatcgacgtgcgcatgaactgggagttcatccgctcggtgctcgtgaagacggacgtgcagatgattctcgtcgaccgtcgcgtgcggaaggtcatctacgaccacgccgtgcgcgcgggcgaggacaaggcgtggttggactcgattttcaatgacggccccatgggcatcgtccggcatgcccgcggccaccgcgaccacttccacatccgcttccacaatccgcgtgcccaggagctgggtcgtcgggtgcagccgttcctggcgctccagccggagcacaatgtgacgacgcaccgcatccggaacggtgacacgctgggcggcatcgcgctcaagtacgggtcgtcggtggcgatgatcaagaaggccaaccggatgcggaacaacttcctgcgcgcggggaaccggctgtccgtgcccctgcgcgggccctgcacgcactgcccggtgccgccgccgctcgtgctgcccacccggcgcctgcccccgaacgtggtggcgccggcgatggttgccgccgctcccgcggcgaaggcggagaatggttgtgttcggactgagggggctgtggcgcagggggcggccaccgtcgttcccgcggtgggcgcggcctccgtcgaggcggcatcgactgtgttggcctccgctcccgttggggagtcggctcccgtggtgacgtcggctgtggggaactccgtggatgcggctgcggtgaagcctgcggccggtggggctctggacgtggctgcggtgaagcctgctggagggacgtccgtcaatgtggcttcgccggtgaagcccgcgaacgccgtcaacgtggcgtcgacggtggttcccgtcgcggcggaaggtgccctggcgacgacgcctgccgccacggataccgcggtggcgcagcccgcttccgtcaaggcggctccggcggagcagaccgctgcgtccagcccggctccggccatgcagcccactgtcgtaccgacgcgcgagaagggcgagggcgccgcgggcatcactcacggccgctga

SEQ ID NO: 3568 - DNA, 744 bp, Myxococcus xanthus
atggcgactcctcatatctccgctgcccctggtgacttcgctgacgtggtcctcatgcctggcgacccgctccgcgctcgttacatctccgaccgcttcctggaaggtgcccgcgaggtcacctccgtgcgcaacatgctcggcttcaccgggaccttccggggccggcgcgtgtcggtgatggggcacggcatgggcgttccctccatctccatctacgccaccgagctcatcaagacgtatggggtgcgcgtgatcatccgcgtgggcagctgcggcgcgctgagcaccgacgtgaaggtccgggaggtcatcgtcgcgacgggggccggcacggactccaacgtgaatcggatgcggctgatggggcatgacttcgccgcggtggcggacttcacgctcgcgcgccgggccatggaggcggcggagcggcgcaacaagcctgtgcgcgccggccccgtcttcacctccgacctcttctaccacccgcaggagcagctcaacgccaccctggcgcggatgggtgtcctggccgtcgagatggaggtcgccggcctctacggcgtggccgcggagtcgggcgcccgcgcgctggggctgctcacggtgtcggaccacatcatcaccggggagagtctcacgccgcaggagcggcagacgacgttcgacgagatgattgaactcgccctggacgtcgcacacgccgaacccacgccgtagcgccttgttggtgggcaggcgggc

SEQ ID NO: 3569 - DNA, 348 bp, Myxococcus xanthus
atggccctggccgccgcgggcagtccgcaactccaggccttcttccagcaggacctgaccagcgctgactaccagcagaaggtctactcgcgcgtcgcggggaagtggcggcaacccggtgccaagggcacgcccggtttggggaagaagacggtggtccgggccgtgattggcagggacggcaagctcctctccgccgatgtgtccacggagtccggttcgaagacgtgggatgccgccgcgctgttggccgtgaagaaggcggcgcccttcccgccgctgccggcgaatttccccggtgccacgctggacgcccacttccacgtggcctgggtggccgggccctga

SEQ ID NO: 3570 - DNA, 1155 bp, Myxococcus xanthus
ctaaagggcgcgcaagggctaggtgaaggcgcccatcgtcatcggccgggaccacctggactgcggctcggtggcatcgcccaaccgcgagacggaggcgatgaaggacggcacggacgcggtggcggactggcccatcctcaacgcgctggtgaacgcggtgaacggcgcgtcgtgggtgtccttccaccacggcggcggcgtgggcatgggctactcgctgcacgccggtcaggtcatcgtcgcggacggaacgccggaggccgcgcgccgcatcgagcgcgtgctcaccagcgaccccggcatgggcgtgttgcgccacgcggacgcgggctacccggaggccatcgaggtggcgaaagagcgcggcgtgaagattcccggcatcaccacctgaagatgaagcaggaggccgcagtgaagcgcttgtgcgcggcaggggtcggactgtggggcgccgccgtcgtgggactgacggggtgcgcccccacggcgatgggccccatggtgatgcggatggggcccggggcgccggaccgcaacgtcatgcagatcggcatgcgctccggcccccggctgagcgcgcccatcgcggggacgcagggcggcctcggaacgggaaacagctttcggggaaacgagtcgagcttctccacgcagcagtggggcgtggcgttcgacgcggccctgaccgtgcccgtgtccgagcggctgcacctgcacaccgggcttcagggtgagttcctcctgcccatcccgctgcccgggtacgggctgtacgccggggcctcgtactacgtgggctcggagcggctgggcctggccccggcgttgtcgctgcgaggcgccagtgatttcggggtgggcaccccgcgcggcgggccgggcaccatcttcggcgcggaggtgtcgtgcgcgctcacgatgcagccggagaagaacgtgtccattggcctggtgcccttcgcgtcgtggcacacggtggcgtcgcacgggcgcaacgagcaagcgttgtattacggcggcgtggtggcggcgcgcgtctcctggggcggaaagaacgacttcgagctgtcgggcgggttcggccgcgcgaaggttggcaagggtgtgagctggaacgtgcccatcatgggcgcacgcggaggacgttga

SEQ ID NO: 3571 - DNA, 1266 bp, Myxococcus xanthus
atggacgtgctggacctgctggtgcgcaacacctccgaagtgctgacggtggaaggctcgcaccgcgagcgcgcggaggacgccctcaccccacgaccaggtgcggttgtgggtgtccgtgaaggacgcatcgcctacgtgggccccgaggccggtctccccacgggcgcggtgggccctggcaccgaggtggtggacgcccagggtggcttcgtgggccccggcttcgtggacccccacacgcacctcgtcttcgccggtgagcgctccgcggagttcgacctgcgcaaccagggcgccacctacctggagattgccaaggcgggcggtggcatcgccagcacggtgcaggcaacgcgggccgcgagcgaggaggagctggtgcggctcgccctcccccgcacgaagcgcctgttggagcagggcgtcacaacggcggaggtgaagagcggctacgggctcgacctggcgacggagctgaagatgctgcgcgcggtgcggcggctcggaacgctgacgccgctggagctggtccccacactgctgtgcgcgcacgccgtgccggaggagtaccgcggcaagcgcgaggactacgtgcggctgtgcatcgaggagattcttcccgccgtcgcgcgcgaggggctggcgcgcttctgtgacgttttcgtggaagacagcgccttcaccgtggacgaggcgcgccgcatcttgagcgcgggccgggcactgggaatggtgccgcggctgcatgcagaccaactcaccgtgtgtggtgcctccgagctcgccgcggagctgggggccgccacggcggaccacctggagcaggtgacggacgcgggactcaaggcgctggcggacgccaacgtcacggcggtgctcgttcccacctccacgctgttcctgcgcatgcggccctacgcgcctggacgccgcatccgcgatgcggggctcaacgtcgctttgggcaccaacgtcaaccccggttccgccatgagtgaaaacacagcactggcgctgggacttgcgtgtctggaaaacgggcttactgcggcagaggcgtattggggagccacccgtggcgcggcgatgtccttggggctgcaacagcacggaaggctgaccgtgggtgacgcgggcgacctggtggtcttcagctgtgcttcgtaccgccacctgccctaccatctaggggtagcgcacgcgcgagtggtcgtgaaggccggacgcatcgctgtccggcagcagatggaaggctgcgcgtga

SEQ ID NO: 3572 - DNA, 852 bp, Myxococcus xanthus
atgtgccgactatttggatttcgttcagcgattcccgccgccgtacacccctcgctggtgacggagaagaactcgctcctcatccagtcgcgcgagcacaaggatggatggggcatcgcggcctacggcgccgagcaggcgccggtggtggcgcacggtgtgggacccgcgcacagcgacccggacttcgagcgggtgagcagccgggtgtcctcccacacggtggtggcgcacatccgcctggcctcggtgggcgcggtggagctgcgcaactcgcaccccttcctgcatggccgctggtcgttcgtgcataacggtacgctgcgggagttcgcgcagcaccgggctgccgtggaagcgctcatctgcccgagcctgcggacgaacatcaggggcaccacggacagcgagcggtgcttctacctgttcctcacccgcttgcatgcccgtcatccgattgaccggaaggtccccgtggaggccgtggcgcgcgcgctggcggagacgatgtcgttggtggccgccatcacggatgccgtgggacaggatggccgctcggcaatgaacttcctcgtgtccgacggcgagttgatggtggcctcgcggcgcaaccgaacgctgttcgtgtccacgggcccgtcgcgcgacgacgtgtcgacgctgccagcgccagggacgaagctggagcagctcgtcgtggccagtgagtcgctgtgtggcggtccgtactgggcaccggtggccgaagaggacgtcatcggcgtggacgcgaacctcgtgttccaccactggcgcgtgccggagctcgcgggcccggacctcttccccgcgtgaagccggccacgtcaccca

SEQ ID NO: 3573 - DNA, 423 bp, Myxococcus xanthus
ttgggcgccatggtgggtggcaccgccgcgctccactaccaatggaccgcgccctgggcgaacctgctgaccgctggggtggacgtgcggcatgggcggcacccttccggcaacctccggcagaacgaccacacactgcggctgggcgtgggacatgacgcacgcgtctggcggaacctgcggcttcacggcgcggtggaggtcggcgccaccctgtcccagcagtggcagcccagcaatggggagaaggcgctcgccctgcagcccaccgtgggcgcagtgggaggtgcgtggctccccgtgtacggagccttcgggatgtcgctgctcgtgaacgcgggacacacttgggtgcgtgaggaggcgggcaccgcgtccgcgctgtcgcttgggggcagtctcggaatcggcttcatgcgctga

SEQ ID NO: 3574 - DNA, 882 bp, Myxococcus xanthus
atggacctcaacgagctgctcgtcttcgcacgcgtcgtacaggcaggcagcttcaccgccgcggcgcgtgggctgcggatgcccaagtccacggtgagccggaaggtgtcggagctggagacgcgggtcggcgcgcagttgctccagcgcaccacgcgcaagctgcgcctcaccgacgtgggccggacgtactacgagcactgcgcgcgcatcgtcgcggaggcggagcaggccgaactggccgtgacgcggatgcaggccgccccccatggcctgctgcgtgtgacgacgccgctgacgttcagcttcatcgggccactggtgtccaccttcatcaagcagtaccccgaggtccagctcgagatggtgtgtaccgaccgcaacgtggacctggtggcggaaggcttcgacttggcgattcgcgccgggcggctggcggactcgtcactcatggcgcggcggctgggcatcgtggagcgcgtcgtcatcgccgcgcccagctatctcaaggcgcgcgggacgcccaaggctccgaaggatttggagaagcatgactgcctcctcttcggcgcgggcctggagaacaacgtctggacgctccactccggcaaccgctcggtggacatcaaggtgcccgcccgaatcgtcgtgaatgagccggacatgctctacgcggtggcgcgggcgggctccggcatcgccctgctccccaacctccacttcacctcggagctggccgccgggcgcttgcagcgcatcctgccggactggagctccacgggcgcgcccgtccacgccgtctacccaagcacgcggcaccactcccccaaggtgatggccttcgtggagtgcctgcgcgagcactggcccatccccggctga

SEQ ID NO: 3575 - DNA, 696 bp, Myxococcus xanthus
atgattgccattcgcccctcggaagcccgcggtcacgccaaccacggttggctggactcccaccacaccttctccttcgccggttactacgacccggacttcatgggcttccgagccctgcgcgtcatcaacgaggaccgcgtcgcgccccatgagggcttcggtacgcaccctcaccgggacatggaaatcatcacctacccgctgagcggcgccattgcccaccgcgacagcacgggcggcgagggcctgctgcgcgccggtgaaatccagcggatgacggccggcaccggtgtgctgcacagcgagatgaacggcgcggatgagaacctccacttcctgcagatctggatcatcccggaccgcaagggcctgacgcctggctacgagcagaaggccttcccggaggccgagcgccagggccgctggcgggtggtggccagcccggacgcccgcgacggcagcctcacggtgcaccaggacgtggtgcttcacgcgacgctgctgggcacgggcgagcaggcgacgtacacgctcgctccgggccgccacgcctggctgcagttggcgcggggcaaggccacgctcaacggcgttgagttgaaggcgggggacggcgccgcggtggcggacgagtcgcagctcgtcctctccgccacggagccggtggaagcgctgctgttcgacctggcctga

SEQ ID NO: 3576 - DNA, 885 bp, Myxococcus xanthus
atggagacactcatcgtcgcaccctcacgcgacctgggcgacgggttcgaggtgcggcgcgcgctgccctcggcccgccgccggatggtgggacccttcatctttctggaccagatgggccccgccggcttccaacccggccacggcctggatgtgcggccccatccgcacatcgggctggccaccgtcacctacctcttcgacggagaagtcatgcaccgggacagcctgggcaccgtgcagcccatccgccccggcgcggtgaactggatgacggcgggcaacggcatcgtccactcggagcgcaccggccccggcccacgcgccgcgggcagcaagctctttggcatgcaggcgtgggtggcgctgcccaagcgccacgaggagacggccccagcgttcgtccaccaccccgaggaccagatgccctgccacgagggcgagggcgcgcggatgcgcgtcatcaccggcaccgtgcacggtcagcgctcgccggtgcagacgctgtcggacatgttctacgcggacgtggcgctggaggccggcgcgcgcttcgtggttccggccgagcacgaggagcgggcgatgtacctcgtccagggcaccgtggaggtggacggcatggccttcgagccgggagagctgctcgtcttccggcccggcggcgccgtcaccctccacgccaccgcggcggcgcggctgctggtgctcggcggggagcccatggacgggccgcgctacatcttctggaacttcgtctccagttcgaaggagcggctggagcaggcgaaggaggactggaaggccggccgcttcgccgccgtcccggatgagacggagttcatccccctgcccgaggcccccctcccagtgcgctacccgtag

SEQ ID NO: 3577 - DNA, 204 bp, Myxococcus xanthus
atggcaggcaccgacaagcgcaagcagtcgctgtacttccccgaggagatgctgaaggagatccaggaagaggcgacccgccaggaccgctccctttcctgggtcgtgcagcaggcgtggaagatcgcccgcgagcgcatcaagtcgttccccgccgtgaatgatgtgactggcgacgagcgccaggaccctcgggaggagtaa

SEQ ID NO: 3578 - DNA, 213 bp, Myxococcus xanthus
atgctggaggagatccagcgtgaggcgacgaggcaggaccgctcgctgtcctggattgtccagcaagcgtggaaggtggcgcgcggggacatccggaagatgccgtcggtcaacgacgtgctcagcccgcctcctcgtcccgcggcccccgcgcccgcccccgcccagccggtgacggccgtggcggtggcgccctccgaagagcccaagtag

SEQ ID NO: 3579 - DNA, 486 bp, Myxococcus xanthus
atgagcacggaagcgtcggctgcgcgtgtgcggacggtacggctggagtctcccgaagagacacaccggctgggggtgcgcctgggggagttgctggagcccggtgacttcgtggggctgattggcgacctgggcgcgggaaagacgcacctggtgcgcggagtggcggacggggcgaacgttcctcgctccgaggtggcgagccccacgttcgcgattgtgtatccgtattcgggacgcatcccgctgtaccacgcggacctgtaccggctgacggactacgacgacctgtacgccacgggcttcctggacctggaaggcaccgagagcgcgatgctggtggagtggttggacaagattccgcaggccgcgccgcgcgactacctgcgcgtcacgctgaagcacgcgggcggcgaggcacgcgtgctgatggcggaggcgtttggtgtacggcccgcggcgttgctcgatgcgtggatgggctga

SEQ ID NO: 3580 - DNA, 1536 bp, Myxococcus xanthus
atgttgcgcgtcctcaccgccgcccagatgcgtcaggccgagcaggccgccgaagcccgccacggcatgccctccgcgttgctgatggagaatgccgggcgggggctcgcggaggtggctcgggggctcatcggctcgggtgggcgcttcgtggtggtgtgtggaccgggcaacaatggaggggacgggctggtggccgcgcgcttcctccgggagggcggcgcctgcgtgtcggtggtgatggtgggcgacgccgcgaagctgacgcccgaggcgcgccggaacgtggaggcggtgaagggcttcggtgtgacgccgcgcacgctggaggccgtggagccggccaggcgcggtgacgtggtggtggacgcgctctttggcacgggcttgagtcgtgcgcccgcgggggccttcgcggacgccgtgtcggcgattcgcggctggcgggcagcaggggccaaggtcgtggcggcggatgtgccgtccgggcttcagagcgacacgggagcgccgttctcgccgtgtgtggaggcggatgccaccgtggcgttcggcttcctcaagccggggcaggtgctggagccgggggcctcgctgtgtggccgcgtgcaccgggtggacatcggcatggggggcgagtcctcgaaggaggtctccggtcccgagttcttcgtggtggaggagtcggacgcgcgccgcacattgccagtgcggaaggcggactctcataaggggacctttggccacgtgctggtggtggcgggcagccggggaaagacgggggccgcggcgctggtggcgaaggcggcgctgcgctctggggcggggctcgtgacagtggccgctcgcgcggatgcgctggacaccatccaggcgcattcagcggaaatcatgggcatcccgctggaggcttccgggccgttgggcatgggtgacctggacgcgctggtggcggcggcggaagggaaggatgcgctcgtcatcgggccggggattcctcggggcccggagacgggggcgctgattggcgagctgttgtcgcgcgtggaggcgcccgcggtgctggacgcggacgcgctcaatgcggtggccacggacttgtcggtgctgcgccgggcgaaggggccggtggtgatgacgccgcacccgggagagatggcccggctgacgggcaagtccacgaaggaagtccaagcacaccggctggacgtggcgcggcagttctccgtgggtttgaaggtgacgctcgtgctgaagggagaccggacgctgacgagtgacgcggacgggcgcgtgtacctcaacaccacgggcaacccgggcatggcgacggggggctcgggggatgtcctgtccgggatttgtggcgcgttcctggctcagtcgcttccggttccctcggccgtctggacggcggtgtacgcgcacgggctcgctggggacctggcggcggcgaagcgcgggcaactgggattggttgcaggggacatcgtggagcaggggctgtgcgaggtgtggctgcggtgggaacgatga

SEQ ID NO: 3581 - DNA, 381 bp, Myxococcus xanthus
atgggaatccgcggcctgggcctggacatctgctccatctcccgcatccagcgcatcctggacgggcctcgcgcggagccctttctgaaccgcgtctacaccgaggcggagcgggccctctgcggccggcgcagtgacgcggccagtgcctatgccgcgcgcttcgccgccaaggaggccctggtgaaggcgctgggcgccccgccgggcatccgctggaaggacatggaggtccggcggcagggcggagcgccttatttcgcactgtccggcgtggccctggaggtcatggaggcgcgagggctggaggccttcctcgcgctgacccacgatgcggacgtcgccgccgccacggtggtgctccaatcgaagggggattga

SEQ ID NO: 3582 - DNA, 726 bp, Myxococcus xanthus
atgggacagcgactgggtgtcaacgtggaccatgtggcgacgctgcgtcaggcgaggcgcaccacgtatccggatccggtgacggccgcggcgcttgcggagcttgccggcgcgcagcaaatcaccatccacctgcgcgaggaccggcgtcacatccaggaccgggatttgcgcatcctccgtgagacggtgcagacgctcctgaacctggagatggccgccaccgcggagatggtgaagctcgcctacgagcacaagccggacgtggtgacgctggtgcccgagcgccgcgaggagctcaccacggagggcggcctggaggtcgccaaccagcgcgagcacatcgcgaagatcatcaagaacctgaaggacggcgagattgccgtctcgctcttcatcgacccggacctggaccaggtgcgggcggcgcacaaggtgaacgcggaccgcatcgagctgcacacgggccgctactgcgaggcgcgcaacgagaaggagcgggcccgggagctggcgcgcatcatcgacgcggccaaggcgggcaccaagctgggcctgggcgtggccgcgggccatgggctcaactacgacaacgtgcaccccattgcccgcatctccgagatcgacgagctgaacatcgggcacgccatcgtcggtcgcgcggtgctggtgggcttcgagcgggcggtgcgtgagatgctcgaaatcatgcgcaacccggggtag

SEQ ID NO: 3583 - DNA, 1377 bp, Myxococcus xanthus
atgcctccgaaggaggcgcaggcttcgcagaagctgttcggcacggatggtgttcgcgggaaggcgaacgtctatcccatgactgccgaggtcgcgatgcagctcgggcgggcgctcgcgttcctcatccgcaacggcccgcaccgccaccgcgtcatcgttggcaaggacacgcggctgtccggctacatgttggagcaggcgctggcctccggcctcacctccatgggcgtggacgtggagctcgtcgggccgctgccgaccccgggcatctccaacatcaccacctccatgcgggcggacgcgggcgccgtcatctccgcgtcccacaacccctacgaggacaacggcatcaagttcttctggcgcgacggtttcaagctgccggacgagacggaaggcaagattgaggagctggtgtccagcggctccatcgactccatccggcccacggccacgaagattggccgggccttccgcatggaggacgcgcggggccgctacatcgtcttcctgaaggccaccttcccgcgcgagctgacgctggaggggatgaccatcgtcgtcgactgcgccaacggcgcggcctacaagacggcgcccgccgtgctggaggagctgggcgccaaggtgattgcgctcggcgtttcgccggacggcaagaacatcaaccacaagtgtggcgccctctatccggagaacctggccaagacggtggtgaagcacggcgcgcacctgggcatcgccctggacggtgacgccgaccgcctcatcgtcgtggacgagaagggcaaggtcgtcgacggcgacgccatcatggccatctgcacgggcgagctggtggcccgcaagcaactgaagaagaagatgttggtctccacggtgatgagcaacatcggcctggagcgcgcggtggcgcgctggggcgtgaaggtggctcgcacgcgcgtgggtgaccgctacgtcgtcgatgagatgcgccgcaatggctacaacctgggcggcgagcagagcggccacctcatcttcctggatcacaccaccacgggtgacggaaccctggcggcgctccagttgctggcggtgatgtgccgggcgggcaagcccctgagcgagctggcctccatcttcgagcccgtgccccagacgctggtcaacgtcgtcgtgaagcagaagaaggagctgggcgagctcccgacggtgatgaaggtcatcaagagcgtggagcagcggctgggcaacaccggccgggtgctggtgcgcttctctggcaccgagcccaaggcccgcgtcctcatcgagggcgaggacgccgcccgcaaccaggcctacgcgaaggaaatcgcggacgcgctgtccaaggccctcagcgtctga

SEQ ID NO: 3584 - DNA, 957 bp, Myxococcus xanthus
gacctggagctggtggaaggcaccaccctggcggagtggatgaaggagcggcgtccctggaaggaggtgctccgggtcttccttgaagccggcaaaggactggccgccgcgcacgccgcgggactggtccaccgcgacttcaagcccgccaacgccctcattgggaaggacgggcgggtcttcgtgacggacttcggcatcgcccggctcctccagcaggaagaaggcgcgtcgcaccaggagcacattgaggcccctgtcactcccacgggtcggctcacccggacgggccagttgctgggcacgcccgcctacatcgccccggagctggtgcgaggtcagcgcgcggatgcccgctccgacgagttcagcttctgcgtggcgcttcacgaggccctctttggggcgcgccctttccaaggggagacgctgcaggaggtggtcctggccgcgcagcaagggaggatgagccctccgaagcgcgaggtgaaggtcccgacccgagttcgacgcgccgtcttccgggggctcagcgcgaagcccgaggatcgcttccccaccatgcagtccctgctggcggccctcgctcccccgccgcaccggagacttgtgccgcttctcgtcacgacgaccgtggccggagcgatgggcatcctcgcggcctacgggacgacggcgcaacggcgcgatgccagctgtgcgcgggaagcggagaagctcgcggtggcatggagccccgcgcggcgcgaacggatccggacagccttcctcgccaccggcatgacctacgcagcccaggcctggacgcagttcgcggcggtgatggacgaccacaccgctcaatggcaggcgcttcgcacggaggcctgcctggccgcaacgggcgacaccgcggaccaggccaggcagaccgccgcgtgcctcgatgcgcggctctggcaaatcgccgccgtcacc

SEQ ID NO: 3585 - DNA, 1151 bp, Myxococcus xanthus
atggggctgacggagtccacgcaacgggccctgctggagacgctgccattcactcggctcctcctcaccgggttgagtccccaggacgaggccttcctccagacgctgtctgaggcgttccccgagtggcttcccggggacgtccattcccgttcggggacggggctgctgacggggcgcgcagcgcagttccagcggatggtgacggctgctcgcaccgacgcccggggcttgtccgcgttggcatcggcggtggcgtccgcgctggccgcgggcgtggcgccggcggcgttgacgctgggcgcccggcgcttcgagtggggctcccgcacctacgtcatgggcgtggtgaacgtgacgccggacagcttctcggatggcgggcgccatgccgggacggacgccgccatcgcccacgggttggccttggccgaatcgggggcggacctgctcgacgtgggcggcgagtccagcggcccggctctctgccggtcagtgccgacgaggagctggcgcgggtgattcccgtcatcgagggcctccgggcccggaccgatgtgcctctttccgtggacaccaccaaggccgcggtggcgcgcgaggcgttgaaggccggtgcgcacctcatcaatgacatcaccggcttcagctctgatgccggcctgtcccgcgtggtggccgaggccggcgccgcctgctgcctgatgcacatccagggcaccccggccacgatgcagcaggcgccgcgctacgacgacgtcgtcgaggacgtgctggctttcctggaggccgctatcctccgggccgagtcggcgggcatcccccgggggcgcatcctcctggacccgggcatcggcttcgggaagaccttcgagcacaacctcttcctgctgcgccgcctcccggagctgcgcgtgctggggctaccgttgctggtgggtacgagccgcaagggcttcctcggccggttggcgggcggcaagcctgcctccgaacggctggcggcgacgttgggctcggtggcctccatggcggcgctgggcggggccgacgtggcccgcgtccatgacgtgaccgaggcccgggacgcgctggccgtcgcggacgccatccggcggtgcgaagacggaggaacgttctacgcccggtaa

SEQ ID NO: 3586 - DNA, 405 bp, Myxococcus xanthus
atgacgacccacagccagaccgagaagcccggagcgtttcgccaggtcctgaagaccggcacccataccctgcatgcggacgtggcccccgcgttgggtggagaggactccgcgcccggtccacacgactacttcgacgccgcgctggcggcatgcaaggccctgacggccacgtggtacgcgaagcgtcacggcctggccctggagcgtgtggagacgcacgtcgaacgggatgattcgcgggagcggcagggcacctacacgctgaaggtgaagctggcgttccacggggcgctgtcgccggcggacaagcagcggctgtacaacgccgtcgcgcagtgccccatccacaagctgatgacgacgtccacggtggacatcgtgaccgagccgctcgaagcctga

SEQ ID NO: 3587 - DNA, 537 bp, Myxococcus xanthus
acctggaacatcgacaccacccactccgccatccacttctccgtccgccacatggtcatcgcgaaggttcgcggcagcttccgcaagtacagcggcgccatttcgctggacgagcaggacatcacgaagtcctccgtcgccgtcaccatcgagacggccagcatcgactccggtgtcgagcagcgtgacacccacctgcgctcgccggacttcttcgacgtggagaagttccccagcatcacgttcaagagcacgaaggtggagaaggcgtccggcaacgggctgaaggtgacgggcaacctgaccatccgcgacatcacccgcgaggtggtgctggacgccgagcagctcggcggggccaaggacccgtggggcaacgtcaagaccgcgttcgaggcgaagacgtcggtggaccgccgcgacttcggcctgacgtggaaccaggcgctggaggccggcggcgtgctcgtcggtgagaagattgaaatcgccatcgaggtccaggcggtgaaggcgcaggccgagcaggcggcctga

SEQ ID NO: 3588 - DNA, 1917 bp, Myxococcus xanthus
gtgcgttcgacttacaagaccatcgggctctgggtcatcctgatcgtcctcttcgtcgccttctacaatttcttctcccagggcaacgaccaggtccaggaaccgtccttcacccagttgctgacgaaggtggaggagaagaaggtccaggaggttgccgtcaagggcaacacctattccggcaagttcaccgacacgtcggagaagttccgcacgacggggccggcgccggatgcggccatgctgaaccagctccgcagcaacggcgtggacgtgaagtacgagcgggaggagcagaacagcctctggctgaccatcctcggtcagtggatgccggtcgtcttcctgttcctgttcttcatcttcttcatgcgccagctccagggtggcagcggcaaggccatgaccttcgggaagtcgaaggccaagctcctcagcgagagccacaacaaggtcaccttcgcggacgtggccggcgcggacgagtgcaaggaagagctcgaggagattgtcgccttcctcaaggacccgaagaagttcaccaagctgggcggccgcattcccaagggcgtgctgatgatgggctcgccgggaacgggcaagacgctgctcgcccgcgcggtggccggcgaggccggcgtgccgttcttctccatctccggctcggacttcgtggagatgttcgtgggcgtcggcgccagccgcgtccgtgacctcttcgagcagggcaagaagaacgccccctgtatcatcttcatcgacgaaatcgacgccgtgggccgtcaccgtggcgcgggcctgggcggcggacacgacgagcgcgagcagacgctcaaccagctcctcgtggagatggacggcttcgagtccaacgacggcgtcatcctgattgccgccaccaaccgtccggacgtgttggatccggcgctccagcgtcccggccgcttcgaccggcgcatcgtggtgccgcgtcccgacgtgaagggccgcctgggcgtgctgaaggtgcacacccgccgcgtgccgctggcgccggaagtggacctggaggtcatcgctcgcggtacgccgggcatgacgggcgcggacctggagaacctcgtcaacgagtcggcgctgatggccgcgcggcagaacaaggagcgcgtggacctgagcgacttcgaggccgccaaggacaaggtcttcatgggccccgagcggcgctccatgatcatgaccgagaaggagaagaagaacaccgccgtccacgaggcgggccacgcgctgctggccaagctcctcccgggctgcgaccctctccacaaggtcaccatcatcccgcgcggccaggccctgggcgtcacctggagcctgcccaccgaggacaaggtcaacggctacaagaagcagatgctggaccagatctccatggccatgggcgggcgcatcgccgaagagctcatgttcaacgagatgagcagcggcgccgccaacgacatcgagcgtgccaccgagacggcccgcgccatggtgtgccgctggggcatgagcgagaagatgggccccctggcgttcggcaagagcgacggtgaggtgttcctgggccgcgacttcaactcgtccaaggactactccgaggactccgcccggcagattgacgccgaggtccgcaacatcgtcgtgggctgctacgagcgcggcaagaacctgctgacggagaacatcgaggctctgcgccgcgtgtccgacgcgctggtggagtacgagacgctggacgccgaggacgtcaacatcctcctccagggtgggcagctgacccgtgagcgtccgcccccgcgcgtgaatgcgcccccgaaggcgacggagaagaaggacaagcggaagattctcgacgcgctcgagggcctgccggcgatggagccgaagaaggcctga

SEQ ID NO: 3589 - DNA, 765 bp, Myxococcus xanthus
tcggtgctgctcgccgtttccggcggcgcggactccacggccctcctgatgggaaccgtgctcgtcgccgagcgactccggcttcgcgtggaggtggcctcgctggaccatggcctgcgtcccgaagcggcggaggaggcccgccaggtgtcggtcctggcggccgcgcgggggctgccctgccacgtccaggcgctgcggctgcatccaggggtcggcatcgaggcgcgcgcgagggaggctcgctacgcggcgctggaggcactccgcctcgagcggggcctggacgtggtggccaccgcgcacaccgccacggaccaggcggagacgctgctcatgcgcctggcacgaggcaccgccctgcgcggcgcggtgggcatccacgaagcgcgccccggactggtgcgccccctgctgtcgtgcacgcgggaggaggtggtgcccttcctggcggagcagggtgtcgcctatgtgacagacccgatgaacaccgaccctgtccacttccggacgcgcgttcgccttggagtgctacccgccctgtcgcgcgccgctggcttcgtggtgaacgtgcacctgccccgccttcgctcgggtggtcccgcaggcaaagtctcagctggcgtccatgcggtacgtggccttctgtcgcctgcggttgcaggatggtcccctgcatcaggtgggcgtgcgcgcgctggagcccgcgctgcgccggcgggtgctcgcccggctggtggccggcacggaggccgcggtggatga

SEQ ID NO: 3590 - DNA, 171 bp, Myxococcus xanthus
  unsure (1)..(171): unsure at all n locations
cagaacccggaccgcaacccggtgcaggctcggaagctggncggtacggaagccaacctcgcttcggcgtacatgaaggccaagcacccaacgcccgtgcaggcgctgcgcgaggagtcgcgagtcgtcttccagaactgcgccctgcccgcgaggcccgcgggcaggtga

SEQ ID NO: 3591 - DNA, 2487 bp, Myxococcus xanthus
gatcccctgctccggaagatcggggcagacgtgaagctgttccccgcgcggctcggcgaggcgctccagaagctgccccgcatgcaggggggcgagagcgcgatgctgggccagcggctgctcaagactttcgacaaggccgaggacgaggccaagtccctcaaggacgagttcatctcctcggagcacctgctgctcgcgctcacgcacgacaagggcgcggtgggcgaggtgatgaagtcctcgggcgtcacgagggagcgcgtgctgtccggactcaaggaggtccggggctccgggcgcgtgacgagccaggacgccgaggcgacctaccaggcgctggagaagtacggccgcgacctcacagaggcggcgcgctccggcaagctcgaccccgtcatcggccgtgacgaggagatccgccggtgcgtccaggtgctgagccggcgcaccaagaacaacccggtgctcatcggcgagcccggcgtgggcaagacggccatcgcggaaggactggcgcggcgcatcgtcgatggcgacgtgccggagggcctgaagaacaagcgcctggtgtccctggatttgggcgccatggtggccggcgcgaagtaccgcggcgagttcgaggagcgcctcaaggccgtcctcaaggagattgccgacgccgcgggcgaggtcatcctcttcatcgacgagctccacacgctggtgggcgcgggcaaggccgaaggggccatggacgcgggcaacatgctcaagccggcgctggcgcgcggcgagctgcactgcatcggcgccaccacgctggacgagtaccgcaagcacatcgagaaggacgccgcgctggagcggcgcttccagcccgtcctggtgggcgagccgagcgtgcacgacaccatcagcatcctccgcggcctgaaggagcgctacgaggtgcaccacggcgtgcgcatccaggacaacgccctggtggccgccgccacgctgagccaccgctacatcgcggaccggttcctgccggacaaggccatcgacctggtcgacgaggcctccagccgcctgcgcatcgaaatcgactccatgcccacggagctggacgacgtgcgccggaagatgacgcagctccagattgagcgggagggcttgcgcaaggagacggacccgcactcgcaggagcgcctgggccagattgagaaggagctggccaacctgagcgagaagttcaacgcgctcaaggtgcactgggacgcggagaagacggccattggcgccatccgcagcctgaaggagaagcaggagaaggcgaagaacgaccaggctgcggccgagcgtcagggcgacctgaaccgcgcggcggagctgaagttcggcgtcatcccctcgctcgacaaggagctgaaggcgcagaacgagaagctggccgagctgcagaagaaccagaagttcctcaaggaggaggtcgacgcggaggacatcgcccaggtggtggccaagtggacgggcatccccgtctcgcggctgatggagggcgaggtccagaagctggtccacatggaggaccggttggcgaaccgggtgattggccagcgcagcgccatcgaggcggtgtccaacgccgtgcgccgcgcgcgcagcggactgcaggaccccaaccgccccatcggttcgttcatcttcctgggccccacgggcgtgggcaagacggagacggccaaggcgctggcggagttcctcttcgatgatgactcggccatggtccgcatcgacatgtccgagtacatggagaagcactccgtggcccggctggtcggcgcgcctccggggtacgtcggctacgaggagggcggccagctcaccgaggcggtgcgccggcggccgtacacggtggtcctcttcgacgaaatcgagaaggcgcaccacgacgtcttcaatgtgctgctccagattctcgacgagggccggctgacggacagccagggccgcacggtggacttcaagaacacggtgctcatcctgacgtccaacatcggctcgcaggacatccaggccggcatggcgggcaaggaggagctggacgagcgcacgcgcaacgaggtgatggacgcgctgcgcgcgcacttccggccggagttcctcaaccgcgtggacgagatcgtcatcttcgagccgctgcggaagaaggacatctaccgcatcgtggacctgcagttggcgcggctgtccaagctgctggccgacaagcggctgacgctggagctgacggagaaggcgcgcgagctgctcgccgagcgcggctacgacccgacgtacggcgcgcggcccctgaagcgcgcggtacagaagaacctgttggacccgctggccctcaaggtcctgggcggcgagttcgtcccgggcgaccacatccaggcggatgcgggcccggacgggctcaccttcgccaaggtgctggtggacacctcgaaggacgtgaagcgctcggcctag

SEQ ID NO: 3592 - DNA, 696 bp, Myxococcus xanthus
aagagcccggccatgaagccctgggagacgctggagcgcgcagaagtcccggacgtgggggaagtcaccctggcccggcgcggggacgagtacgtcttccgcgtgcggggccagacgctgatgtccagccggcagcacggctccgaggaagcgctggcggaggccggctgtgaagggctggcgggccgaagcggcgtccgggtgctcgtgggtgggctgggctttggctacaccacccgcgcggtgctggaccggctgggtcccgacgcgcgtgtcacggtggcggagctgctccccgtggtggtgacgtggaaccgggggctgctcgcgccgctggccggggcgcctctggaggacccgcgcgtcaccgtggtggagctcgacgtgggcaagcacatggcccggcagtccgggacctatgacgccatcctgctggacgtggacaacggccccaccgccctcacccaccccgacaaccacggtctctatgggcgcgtggggctggcgcacgccgtccaggcgctgcggccaggaggcgtactgggcgtgtggagcgccgggccctcccccgccttcgaacgccgcatggagcaagcgggcttcaccgtccaggtgctgcacccggcggcgcatggcaccaaggggacgcggcatactctgttcatgggcaagcggaggccccaggggcggcgttag

SEQ ID NO: 3593 - DNA, 1017 bp, Myxococcus xanthus
atgattcctttctccgtcctcgacctctcgcccgtcacgcagggctccaccgcggccgacgcgctccggaacacgctggacctggcacggcacgcggaggactggggcttcaagcgcttctggctggccgagcaccacaacatgacgggcatcgccagcgcggcgacgtccgtggtcatcggctacgtggccggagggacgaagcgcatccgcgtgggttcgggcggcgtcatgctgccgaatcacgcgccgctgatcatcgcggagcagttcggcacgctggagacgctctacccggggcgcatcgacctggggctcggccgggcgccgggcacggacatgctgacggcgcgcgccctgcggcgggacctggcggcgagcgcggacaccttcccccaggacgtcgtggagctgaagtcgtacttcgagcccaccgagccggggcagctcatccaggcggtgccgggcgcgggtttgaaggtgcccatctggctactcggctccagcctgttcagcgcgcagctcgcggcgatgctgggcatgccgttcgccttcgcctcccacttcgcgcccgatgccctgcttcaggccctggacatctaccgggagcgcttcaagccgtccgagtcgctcgagcggccctacgccatggcctgtgtgaatgtcttcgcggcggatacggatgcggaggcacagcgcctcttcacttcggtgcagcagcagttcatccgcctgcgccgcggcacgcccggtcagctcccgcccccggtcgatgacatcgactccgtggcttcgcccttggaccgcgcgagcgccgaccacgcgttgaagtactccatcatcggcgcgcccgacaccgttcaacagggtctggcggcgttcattcgactcacgggagtcgatgagctgatggtgacgggaatggtctacgaccacgccgcacggctgcgctccttcgagctgactgcgcaggcgcaccagcggctcgccgaggcagaagcggcgcagccggcctga

SEQ ID NO: 3594 - DNA, 335 bp, Myxococcus xanthus
atggctgactccagccttccgcagtccgagcggcgcgcggataccgtcatggtcgtggaagccggtggagcgcgcttcgcggtggacgtcgaaattcaggcacaggcggacccgcacttcgcggcgcggctgctggactacacggtccgcatccaccaccgggagaagctacccgtactgcccgtcgccatctacctcgtgccagaagccgagggcgcaccaccgccatacggctttgagtgttcggggctgcgcgtcctcaccttcgacttccaggtggtccgcctctgggaagtggactacctccagccggccttacgagcgggcacccttag

SEQ ID NO: 3595 - DNA, 1278 bp, Myxococcus xanthus
cccgccacgacggagcctggagaggagctgtctggcggacggggctccgtgccggacccgggacgcaacgcctttggacgcgcgcccatgaacatgccgcggacgcgctgggaggacttccacgcgggcaagcgcgtcttcggtcgcgattggacggacgtggacggccccatccaagtggggccgttgttcaacgccccctcgtgcatgacctgccacgtgaaggatggacgcggccagccccccgcctctccgagcgagacgcccatctccctcgcgttccagctgagcgggccagacggccgtgggccacatccgatttatggcgcgcagctcgacgttcgccatgtcgacggaaccggcgcggaaggcagcgtcgaggtgacgcacgaagaagtcaccggccggttcgcctcgggcgagacctacgtcctccaccggccccgctaccgattcacccagctgtcgaaggggcccctcggggaggagacccgcttctcccctcgtgtcgcgcccgcgaacttcggcctcggactgctcgaggccatccccgaggcggcggtactggcccacgaggattccgaggaccgtgaccagaatggcatctccggccgggccaaccgtgtgcgggacgcggcgacgggacagacgcggatggggcgcttcggctggaaggccaaccaacccacgctgcaccagcaggtggcacacgcgctcgtcaccgacatgggactgacgacggagctgtatccccgcgagcagggacgcgaggccggcgaggccgccccacccgaggtcagccccaaggaactggacgcgctgctcatctacgcgcgcttggtcgccgtgcccaagcgccgggactgggaagccgccgacgtcctgcccggcaaggcggtgttcggcaccatcggctgcgcggggtgccacgtgggcacggtcttcgagacggaagacgtgcccggcttccccgaactgtccggccagcacatccgcccctacacggacctgctgctccacgacatgggcgaagggctcgcggatgaccgtccggacgggctcgccaccggcaccgaatggcgcaccccgccgctgtggggcgtgggcctcgtgaaagcggtgaacggccacacccgcttcctgcatgacgggcgggctcgcgacctggaagaggccgtgctgtggcatggcggcgaggccgcgccggcccaggagcgctacacgcgcctgccgctcgcagaccggcaggcgctgctcgcgttcctcaactcactctga

SEQ ID NO: 3596 - DNA, 1231 bp, Myxococcus xanthus
gtcctgggtggcctcgatgccatctacccagagctcgacgcgctctaccgcgacctgcaccagacgccggagttgtccaaccaggaagccaagacggcggcgaagctggccgaccggctgcgcaagctcggcttcgaggtgacgtccaaggtgggcgggcacggcgtcgtggccctgctccgcaacggccagggccccacggtgatgctgcgcgcggacatggacgcgctacccgtggaggagaagacgggcctaccctatgcgagcaagcagaaggcgaaggacgccgcgggcgcgacccacccggtcatgcacgcgtgtggccatgacgtgcacatgacgtcgttgttgggaacggccgcgctgctggcccgttcgaaggaccggtggcgaggcacactgctgctggtgggccagccggcggaagaggtgggggcgggcgcccggcagatgctccaggacggcctcttcaagcgcttccccaagccggacttcgcggtggcgctccacgtcaacaccgccgcggcgggcacggtggagttcactcccgggtatgcgatggcgagcgtggacggcgttgaaatcaccctgcatggcaaggggggacatggcgcgtatccccacaccaccgtggacccggtggtgatggccggcgcgcgtcgtgctgtcgctccagacgctcgtcagccgcgaaaagaacccgctggagcccgcggtggtgacggtcggctccattcatggcggcgccaagcacaacatcatccccgatgacgtgaagctccacctcaccgtgcgctcgtacaagccagaggtccgcaaggccctgctggacggcatcgagcgcatcgccaaggcggaggccatggcctccggcgcgccccgtccacccgacatcgccatcaccgagggcacgccctccaccttcaacgacccggcactcaccaagcggctggtgggcgcggtgtcccgcgtcctgggcgaaaagaacctccaggaggcgcctcccgtcatgggcggcgaggacttctccgagtacgggcgcgcgggcgttcccgccgtgatgctctggctcggctccaccgagccgcggcaatacgcccaggcgatgtccgcggggacagcgctgccttcgatgcattcgcccctcttcgcgccggaccgcgagcgcacgctgcgcacgggcgtcaccacgctgaccaccgccgccctggagctgctcggcaagccgtga

SEQ ID NO: 3597 - DNA, 1305 bp, Myxococcus xanthus
atggtcgcggtgggcaccgcgggcctcatcgccagctccatggacggccagcgctggaccgatgagagcatcaacagcgcctatgacgtcgtgacgctggtgcccggtcagagcagcttcctcgctgtggccaacccgatggcgggcgcgccctcccagcatcctgtcctcgtgcggccccagggcgctggcgccgcctgggaggtgttccagcccgccacgctgtccgggctcaccatcgcccggctcatcgccggaaatgggcgcttcctcgccttcgcccggcccaaccaaccgtcccctctggcgccccaggcggtggaaccgacgagcggattcttcctctccgaggacctcggcggcacctggacgcgcgtggagagcctccggcttcccgcggacgctccgctacccaccccgctcatgacgttcgtggaccagagcttcgtcgtcagctggacggccgtcgacccgcaagtcgtgggagtgctgccctcgttcgagctgcaggtgtcggcggatggcaaggaatggacggcgcacccgacgggcgcgggcggcaactatgcgtccacggccttcgccacgggcgacacctccgtggtcgcggtgagccagcggcgtctgctggtggcctcgcgccggccctggccgctgccggagctcctcacggagacgctgcccccgttccggctgggcacggccgccaacgtggaactgagcacgcgcggctcgggcaccctgacgttcgagctggagggcacgctgccctcgggcctgacgttcgcccccacgacgggtaccttcaccggcacgcccgcgcagtccggtagcaccgccgtcaccgtccgggttcgcgacgcgcgcggcggtgtggcggcgcgcacgtacagcgtggacgtggtgggcaccctgagcatctccagcggcgcgattgcgtccgcgacccagggcaccgcgtatgaggcgcgcttcacggtccagggcggccgggcgccgtatacgtggagcctggacggcggcaccgtgcccggaggcttgacgattcagcagcgcgacggcgcctacgtgctgagcgggattccgaccgccagcggcaccttcccgctgacggtgagggtgacggactcggcgaaccagacggcggcgcggagcgtgtcgctgcagatcgcgcccacgccgcccccgattgacgacaagggcgacgcgcccagcggctgtggttgcagcggcagcggcgcgggcgtccaggcactggggctggcggcgctggcactgatgggccgagcccgccgcaagcgctga

SEQ ID NO: 3598 - DNA, 861 bp, Myxococcus xanthus
aaccccatgattcttgtgactgcggcaacgggtaagctgggccgtctggtcgtcgcgggcctgctcgaaaaggtccctgccaaggacatcgccatcgccgtgcgcgacccgagcaaggcctccgacctggcggccaaaggcgtccaggtccgtcaggcggactacagcaagccggagacgctcggacccgcgttggccggagcggacaaggtgctcctgatttcgtccagcgaggtcggccagcgcgcggcgcagcaccaggccgcggtggacgccgcgaagaaggcaggcgtccggctgcttgcgtacaccagcatcttgcacgcggatacctcgggccttctgctcgccggcgagcacaaggcgaccgaggaggcgattcgagcgtccagcatccccttcgtcttcctgcgcaacggctggtacacggagaactacacggagaacctggcaccggcgctggcacacggcgcactcatcggcagctcaggtcagggccgttccgccgccgccacccgggcggactacgccgccgccgcggtggccgtgctcaccggcacgggccatgagaacaaaatctacgaactggccggcgacactgctttcaccgccgcggagctggccgccgaggtgtcccgccaggtgggcacgacggtcgtctacaaggacctgtcacaggccgaccatgccggcgcgctcatcggcgtgggcgtccccgcccccttcgccgagttgctggcggactccgatgcgggcgtggcgcgcggtgagatgaacgacagttccggcgacttgcggcggctcatcgggcggcccacgacgccgctcgcggacgcggtggcggcggccgtcaagcgctga

SEQ ID NO: 3599 - DNA, 810 bp, Myxococcus xanthus
atgaagccgctgctgtccgccctgctgccgttgctgtgtcttgcctcctccgcctccgcagcgccgcaagcgcccgtcgccgtgcagtccgacctggccttcctgtccgggccgcccacgctgaccttcgccgcggactggagcgtcaccctcagcggccagccggaggcgggcggcgcgctggacatcgcctatgacacctcgcgcctgccgctgtgccggggcaccgggtggaccatcaccgggttcgccatgtcgaaccggggcccggtgcagggcttccccgtggcggatgccaccacggtgggcgccatcgcgcagacgcaactggccctggctcagggcggcacgttggagctgtggttccagaacacggacgccaccggctgctcccactgggattcgaacctccagtacaacttccacacgtgggtgacgcagaacccgacgatttcgttccaccccgcgccagcgtggacgtacacggtccacggcacgctccagggcggcaccacgctgatggtggactacgacctcggccgcatcgcccagtgccgggcgcagtacctgaattacaaggcctggggcaccacggcgcactaccgcatcaacggcggcccggtgacgatgctcagcctgacggcgagctggggtgaatgggacgccgagttctggaggcagatccccgccttcattccgctgccgcccggcccggcgacgctggagctgtggttctcctcccaggaccgcaagggttgccagcagtgggactcgcgccacggacagaactacgtcttcgccatccagtga

SEQ ID NO: 3600 - DNA, 1008 bp, Myxococcus xanthus
atgaagcacgtcacgcacatcaaggatctggggcccgagggcgtggaggcggtgctcgcgcaggcagccgcgtggaagcagaagggaccggagcacgcgctcttcgccaacacgctgctggggatggtgttcttcaacccgtcgctgcgcacacgcacctcgttcgaggccgtcatgctgcgcggcggtggcaacgccatcatcctggacgtgggctccggcgtctggaagctggagcaccgcgagggcgcggtgatgaacgcggaccgggctgagcacctcaaggaggccgcgcctgtcctgtcgcgcttcgtggacatgctcggcgtgcgcaccttctcgcaaggcggcggtgacgaggaggacgaactcgaccccgtcatcaacgcgttccgcaagtggtccaccgtgccggtggtgagcatggagtccgcgcgcgagcacccctgccagggtctggcggacatgctgacgctgcgcgagacgttcggcaacacgaagaagctgccggtgacgctgacgtgggcgccgcacatcaagccgctgcccaaggccgtgcccaactccttcctgctgagcgcggcggcggcgggctgcgagattcgcgtagcccaccctcccgggttcgacctgcacccggccgtccgcgccgaggcggaggcgtacgccaaggccacgggcggcagcgtcacctatacgcacgaccaggacgaggccctggccggcagccgcgccgtctacgccaagtcgtggggccccacggccgctgcggcgttttcgcccaatgacgtctccgcgctgctcgcgtcctactccggttggatgcccacccgcctgacgatgtcgcgcgcgcaaaaggacgcagccttcctccactgcctgcccgtgcgccgcaacgtcgaagtggccgatgaggttctggaccacccgagcagccgcgtcgtagacgaggccggcaatcgctaccacgtccagcgggcgctgctgcactggatgcgttcgcgctga

SEQ ID NO: 3601 - DNA, 918 bp, Myxococcus xanthus
tcgcccgacccctactccgcgcttcgccacgcggcgaagtacgtgcagcagttccgccgcaagacgttcgtggtgaagctcggcggcgccatgctcagcgacccgcgtctgcgccgcgccgcctgcgagcagattgcccttctgtggaccttctccatccgccccgtcgtggtacacggcggcggtccggagctggacacgctgtgtgacgccctccaccttccggtggagaaggtggccggccgccgcgtcacctccgcgcccgtgctggacgcggcgaagatggtgctcgcgggcaagctgcacacggacctgctggcggacctccaggcggcgggcgtgcccgcggtgggcctgagcggcgtggacgccggcctcatcaaggcacgcaagcgcccgcccgtcatggtgacggaagccggtgccaccgagggcaagctggtggactacggcctggtgggtgacatcgagcaggtggacacccgcgtggtggagcacctgcgctcggccgactacgtgcccgtcatcgcccccctgtcgggtggcacggacggcgccgtgtacaacaccaacgcggacaccgtggccgcggcgctggcggtggcgctgtccgccgagaagctcttcttcctggtccaggttccgggcctgctgaagaacgtgagcgacccgtcgtcgctcgtcacgctggccaacctcacggacctggccaccatggagagcaccggcgccatcgcgggcggcatgaagcccaaggcgcacgccatccgccacgcgctcgtgggcggcgtgggcagcgtgcacctggtcagcggcgtgcagcccaacgcgctcctggaggaggtcttcaccaacgagggcagcggcaccatggtcgtgcgggagaacgcgcagaagcccgcgggggcggtgggatga

SEQ ID NO: 3602 - DNA, 1062 bp, Myxococcus xanthus
atgacggcggcggagctgctccaggcgctggtggccatccccagcgtgtcaggtgacgagggccgcatcgcggacacggtgtccgggtgggcggaaggctggggcgcgcgcgtccagcggcagggccacaacgtgtggttctccgtggggagcgggccgcgccggctgctcatcaactcgcacctggacacggtaaagccgtgcgccggatggacgtacgagccccacgcgcccgtgtggcgcgaggaccgcctgtacggcctgggcagcaatgacgccaaggggtgcgtgacgggcatgctgctcgccgcgcggaccctgctgaccgaaggcgcgcccacgggcgctgaagtcgtgttcgcgttcaccgcggaggaagagacgggaggccaggggctgggaacgctgttgcccaagctgggcccgctggacgccgccatcgtcggcgagcccaccagcctcaagccctgcaccgcccagcgcggcatgctgctgcttcgctgcaccgcgcacggcaagagcgcgcacgtcgcgcacgcgcacgccacggaggccgtcaacgccatccacctggccgcgacggacatcgcggtgctggccgagctgcgctttccgtcccacccgctcctgggcgaggcccgggcgcaggtgacgcaggtgtcgggtggcctggcgcgcaaccaggtgccggaccggtgtgagttcttcgtggacctgcgcaccacgccgggcatggagcacgcgatggtggcccggcaggtggcgggcgcgttgaagagcgaagtgaaggtccattcggagcgctacctaccgaaggcgacgtcggcggagcagcccatcgtccgcgcggcggtggccgcgtcgggcgcgcagccggtgggctccagcacggcgtcggactgggccttcctgggggacatccccgcggtgaaggtgggccctggcgacacgctgcgcagccacctggcggacgaattcatcacccgggcggagctggaagccggtgccggcttctacacgcaactggttcggggttacttcgaggaggcggctcgtggctga

SEQ ID NO: 3603 - DNA, 1338 bp, Myxococcus xanthus
ctgtggggcaagggccttcccctggacgcggccatccatcgattcacggtgggcaacgacccggtggtggacttggcgctggcgccgcattacgcgctcggctcgaccgcgcacgcgcggatgctggcgcgcgtgggcctgctgaaggacgcggaggccaagtccctggtgacggcgctcaaggcgctgcacgacgaggcccgcgcgggcacgttcgtcatccgtcccgagcaggaggacggccacaccgccctggaggcggcgctggtggagcgcgtgggcgacccgggcaagcgcatccacctggggcgttctcgcaacgaccaggtgcagttggccctgcgcctgctgctgcgtgaagaagtgctcacgctgggcgcgcgggcggcggagctggcgggggccttcctggacttcgcgcaggcgcacaaggacgtggcgctgccgggctacacgcacctgcgccgggccatgccttccaccttcggtctgtggggcatggcgttcgcggaagggctgctggaggaactcgaggcgctgcgcggcgtgtgggctcggctggaccgctgcccgctgggcgcggcggcgggcttcggcgtgccgctgcccatcgaccgggagtacgtggcggcgctgctgggtttctcgcgcgtgcagcgcagccccatcgacgtgcagaacggacgcggccgtcacgagtccgcggtgctgggctgggcctgctcggtggcgggcacgctggagaagtggctgtgggacgtgcagctctacagcatggacgagttcggcttcctcggactgccggacgcgtacaccacgggctcgtccatcatgccgcagaagaagaacccggacgtcgtggagctggcccggggccgctgccgcgagctgcgcggactggcgcatcaggtggaggccgtcgcgggcggactgccctccagctaccaccgcgacttccaactgctgaagtcccccaccctgacggcgctgggctccacgcgggagctgctggacgtgctcacccggttggtgcccgcgctccaggtgaaggcggacgcggcggcgcgtgccagcgacgacacgctgtacgcggcgcaccatgcctatgcgctggtggcccagggacaggccttccgtgacgcctacaagcaggtgggccgcgagctggtggaaggaacgttccgtccagaccgcggcgccctgacggccacccacctgggtggcgccggcaacctgggcctgccccaggcccgggaagagctggccgcctcgcgcgcctggctcgatgagacgcaccgcctggtggccgatgccgccgggcgcgtctggacggtttga

SEQ ID NO: 3604 - DNA, 132 bp, Myxococcus xanthus
gtgctgctcccgatggagcgcgcctcgccccgcgccatccagggcgagggcgagggcgtcatgaagtcgctccaggtctggcagaacgtcaccgaggccctggagctgttgcgctccatgctgcggcgctga

SEQ ID NO: 3605 - DNA, 749 bp, Myxococcus xanthus
atgagcaacaagaagaacgtggtgctggccttctccggcggactcgataccgctttctgtgccgtctacctgcgagagcagggctacgacgtcaccaccgtcacggtggacaccggcggcttcccgcccgagcagttggagcgcatcgccgcgctgtccaagcagttgggcgcggtggagcacgtgacggtggacgcgcgcgagacgctcttccagggctacctgcgctacctcatcgcgggcaacgtgctgcgcggccaggtctaccccctgagcgtgtccgcggagcgcgcgtgccaggcggcggaggtcgtccgcgtggcgcgcgagaagggcacccaggcgctggcgcacggcagcacgggcgcgggaaatgaccaggtgcgcttcgacgtggccttccgctcgctggcgccggagctggagctgctcacgcccatccgcacgctgtccctgagccggcagcaggagctgacctacctggccgagcgcggcgtccacatgccgccgaagctgggctcctactccgtcaacgagggcatgtggggcacctccgtgggcggcgccgagacgctggactcctggaaggcgctgcccgaggcggccttccccggcggcgagctgtcgcaggacctcaagccccgtcccctcacggtgtccttcgagaagggcgtcccggtggcgctggacggcgagaagctgggccccgtgaagctggtggaagcgctcaacgcgctggggcgcaccta

SEQ ID NO: 3606 - DNA, 1329 bp, Myxococcus xanthus
atgtcccaatctggttctcccgtggcggacgacctgcccgtggcgcgtccagtggatgcctccgagcgagtcgtcttgctggacgccctccgtggcttcgcactctggggcgtcttcgtgtccaacagcctcatgtggctgagtggacgggccttcatgccccgtgaggctgcgtccgcgctggatgcccccctgctggagcaggtgatcggctccatctatcagctcttcgtgacgcagaagttcatctccatcttctcgttcctcttcggcctgggcttcgcactccagttctcgcgggccgagtcacgtggcgtctccgccgcgccgctctaccgccggcggctgctgatgctcttcggcatcggcctggcgcacgcccttctgttgtggacgggcgatatcctccacacctacgcgatggtgggcttcctgctgatggccttccgggctcgctccaaccgcacggtgctgttctgggcgctggggctcgtcaccgtgatgccgttcctggtgcccgccgccattcgctacacgcccatcctgctgcacggcgcggaggccgcggccgaggcggcgaaggccagtcatgccagggatatggccttgagagccgacaccctggtggcgttgtcgagcgagtcgttctggacggcgcaggtgggcaacgcacgcttcttcctggagaacctcggcggcggcttccggcgcgtgctctggatgagcctcatcctggggcgcttcctgctggggttgctggcggggcgtctgctcctgttgcaggacgtggagcgtcaccgggcgttgctgcgccggattcttggctgggggctgagcgtgggcctcgtcctcaatggcggtgggttgctgctgttccgcctgcgcaaagccggcgtgctggagtgggacccgaaggggccctggatgatgatcgtcaacggcttccaggagcccggctacatcgccatgggcgcggcatatgtggcggccttcgcgctgctcttccagcgggagcgctggagccgctggctgggcgtgctgacgcccgtggggcgcatggccctgacgaactacctgatgcagtccgcggtgagcatctggatttatagcggttggggcctgggcttcatcggcaagctgccggcgtcgcgcatcgtcgtcatctgctgcgtcatcttcgcggcgcaggtggtgttcagccgtctgtggttggcgcgcttccgcttcggtcccgcggagtggctgtggcgctcgctcacgtatggaagggtccagcccatgcggcggctcgctggcgacggaggtgtccccggcgtcagcgcttcttga

SEQ ID NO: 3607 - DNA, 378 bp, Myxococcus xanthus
atggcgaagttggcggtggagcggggcaacctgtacgtgccctcatgtccttcgcgaggcgtgctggaccacgtgacgagccgttggggcgtcctggtcttgattgcgctgctggaaggcacgcgtcgcttcagtgagctgcgccggagggtggcgggcgtgagcgagaagatgctgtcgcagacgctccaggccctggaacaggacggcttcgtgctccgtgaagtccacccggtgattccgccgcacgtggactacagcctcacgccgctgggggaggaagtcgccgcgcgcgtggaggcgctcgcggattggattgaggacagcatgccccgcatcgccgcggcgcgggccgtgtataccccaaggaagggatag

SEQ ID NO: 3608 - DNA, 552 bp, Myxococcus xanthus
atgtcggagctgacagagctactggaccacgcgcgcaagggcgagcagggcgcgcgggatgcgttgatggcggcggcctaccaggagctgcgggacatggttcagcgggccatgtccgatgcggcgtcgacgccgtcacttcaacccgcggtgttggtgaaggaggcctggctgcgcctgttcagcgcgggggctccggtggaggcgcggcgtcacttcttcagcgccgcggcgcaggccatgcggcgggtgatggtggaccgggtgcggctgcgcagggcgcaggtccgagaggcccggctggagcgggtgagcctgggggacgtggaggcggatgtcccggcgggtttgagcctggaggtgctggagttggaccgagcactctcggagctggacacgttccagccgcggctcgcgcgcatgctggagctgcgctacttcgtgggcctggacctgctggacaccgccgcggtgctgagcgtgtcgcccgtcacggtcaagcgcgactgggcctacgtccgggagtggctgctgacgcggctgggcaactga

SEQ ID NO: 3609 - DNA, 423 bp, Myxococcus xanthus
atgaacctggacgaggccatcctgcggctcatcgccgagcgggagatcggcgatcagaccgtgctgcagcagctcctggaggcggaaggccagtcgccgagccagtcgacgctgtcgcggcgcctgaagaagctggggatcttgaaggtgggtgggcgctatcagcgcgcgccggccacgcccgcggtgatgccagagcggccccgtgtcaccatcctggaagcgccgcccaacctgctggtgattcgaacggcgccggggttcgcgccggtgctcgcgctggcgttggacaaggagcgggagctgccggggctcgcggggacggtggcgggggatgacaccatcttcgtcgcggtgacggacccggcgctgctgcgcgacgtgcgcgcggcggtggagcggctcctgtcgctgggggcgtga

SEQ ID NO: 3610 - DNA, 582 bp, Myxococcus xanthus
atgtccgatggcaatcaaaagacggtgcgcccgagccacgtccgccggacgtacatcctggaccggcctttccagctcaaatacatcctgctgttggcggggattggtgccggcagcatcctcgtgttcggactgttggcgcaccgcgtccacgtgtcgtccacggccctgggactggacggcgggcagacgctgctgtggctgacggcggtgggcgcgctgggcacggcggtggcgatgggtctcttcggcctcgtcttcacccaccgggtggcgggccccgtccacgtcatgagcctgtatgtggcggcgctggcggccggccgctatccccggatgcggccgctgcggcgcggggacgagctcaagcagttcttcgaccgcttcaccgaagcggtgacgcgcatccgggagcgtgaggcggatgaggcctacgcgctggagaccgtgctggaggccctgcgaccggtggccaccacgcccgaggccctggaggcgctgggcaccctgagcgccctgcacacgcgcaaacgtcaggcggtggacactcccaccgggagcaccttcaagtccgtggcctga

SEQ ID NO: 3611 - DNA, 927 bp, Myxococcus xanthus
cgcatcgttttcatgggcacccccgagttcgcggtgtcctcactggccgcctgcttcgaactgggagacgtggtggccgtcgtcacccaacccgacaagccgaagggccgcggcaacacggtgacggcgccgccggtgaaggagctggccctgtcgcgcggcgtgcccgtgctccagcccaccaagctgcgtacgccgcccttcgcggaggagctgcgccagtacgcgcccgacgtctgcgtggtgacggcctatggccgcatcctccccaaggatttgctggagctgcccacccacggctgcgtcaacgtgcacggctcgctgctgccgcgcttccggggcgccgcgcccatccagtgggccattgcccacggcgacacggagacgggtgtgtcgctgatggtgatggatgaaggattggacaccggtccggtgttggcgatgaagcgcatggccattgccccggacgagacgagcgcgtcgctgtacccgaagctggccgcgctgggcggcgaggtgctgcgcgagttcctgccggcctacctgagcggggagctgaagccggtgccgcagccttccgagggcatggtgctggcccccatcatcgagaaggaccagggccggttggatttcacgaagcccgcggtggagctggagcggcgcctgcgggccttcacgccgtggcccggggccttcaccacgctgggcggaaagctgctgaaggtccaccgcgcgcaggccaggggtggtagtggggctcccggcacggtgctggcgtccggcccggacggcatcgaggtggcatgcggcgaaggctcgctggtgctgctggacctccagccagaaggcaagcgggtgatgcgcgccgcggacttcctgcaggggcacaagctggcgccgggcagccagcccttcgtcgcgggctga

SEQ ID NO: 3612 - DNA, 924 bp, Myxococcus xanthus
atgagactgctggtactgcacggacccaacctgaacctgctgggcgtgcgggatggctcgtccggggggcggctggaggacctggacgcggcgctgcacgcgcgggcggaggagctggggcaggcgctgacggtggtgcagtccaaccacgagggcgacctgctggacacgctcggcgcggagttggaggagctggacggcatcatcatcaacccggccgggctgttcggctcctattgcctgaaggaggggctggaggccgccgggctgcccgccatcgaggtgctgttcaagcccccggcccgcgaatccgtggtgggggaggcctgcgtgctccagattcacggcgggcccggcttcgagccctacctgcaggccctggagaccttcggcagcggcgtcttcacgacggagaagccggagtcgaagaaggccctggggaagaagaaggggagcagctccaagggggcgaaggtcacccccatcaccgtgctcgagcgcgccgcgcgcaaggagggctcgtcggagacggccaggtccctgtcccgcgcggcgaagacggcggggcccacgaagacgctgggccgcaagctggcgcccgtggaggacctgcgcgcggcccgtcaggcgaagacgctggggcgcggcggcggcaaggggctcacccccgcggcggacctgctcacgcgcgcgctggtgcgccagaagatttcagaccggctttcgggccggctctccgcctccgagctggccgcctgggcgcgttcccagtatcaggcggtgcagcgtggcgctccggcggagaatggccaccgtgagctgctggaggagagcctccagagcctcaccctctccaacctgcccgcgacgcggctctcggatgagcagctcgtggacctcttgacccggctcgacgaaggatga

SEQ ID NO: 3613 - DNA, 1317 bp, Myxococcus xanthus
atgaacgcccgcgcactcgccatccaggtcctcgcgcgtgtccgcgcgacggatgcctacctcaacgtcgtattggacacgcagttgtccgagtcgccgccgaaggacccgcgcgacgcggcgctcgtcaccgagctgacctacggcgccacccggcggcagctcgcgctggactacgcgattacccgcttcgccgaccgcaagctggacgcgctggaggacaaggtgctggcggccctccgcatcggcgcctaccagatattccacacccgcgtgccggcccgcgccgcggtggcggagacggtgcaggcgctgaaggaagtggggctgacgcgcgcggcgggcttcaccaacgccatcctccgcaagctggcggccctgcccgcgccgccgctgccgcccgcgtccgacgtggcattgcacctgtcggtgcgggagagccatccccagtggctggtggagcgttggctgcgccagttcggccgcgagcgcgccgaagccatgctggtggccgacaaccaggcgcccgcggtggtggtgcgcgccaacaccgcgaaggtgacgcgcgacgcgctgctcgcccaactccaggagatgggcgtggacgcgaaggcgaccaccgtgtcgccggtgggcatcacgctgccgtccgtgggccgcgtggaggacgtgtacggctacgcggagggcctgtggcaggtgcaggacgaggccgcgcagctcgtgggcgtctacggggcgattccggagacggcgcgcgtgctggacgcgtgcgccgcgccgggcggcaagtcctgccaccaggcgcagtcacatgacgtggtggcggtggatctccacgcgcacaagctgcggaagattgaagcggaggcccggcgcctgggcctgcagccgcgcctgaaggcctacgcgcacgacgccgcggagcccttcccggaggagtggggagagttccacgcgttcctggtggatgcgccgtgttcggggctgggcacgctgcgccgccacccggagctgcgctaccgccgcaaggaggaggacatctcccggctggccacgctccagcggcgcatcctggagaactgccaggatgcggtgccgcccggggggctgctcgtgtacgcggtgtgcaccatggagccgcaggaggggcaggaccaggtggagatgttcctgcgcagccacccggagtggacggccgagccacccgtgctgcccggcctcaagctgccgatgtcccaggcgtacctgcgcacgctgccgggaccggagggcttcgacgggttcttcgccgcgcgcctccggaagctctactga

SEQ ID NO: 3614 - DNA, 1110 bp, Myxococcus xanthus
atgctgccgggcatgcgaatcctctacggtgtcgtcggcgaaggcatgggccatgcgacgcgctcccgcgtcctcctcgaggaactgacgaaggagcacgaggtccacatcgtcgtctccggccgggcccaggactatctggccaaacgcttccagaacgtgcacggcatctgggggctgacgctcgcgtacgagggcaactcggtgaagaagtggcagacggtgctgcagaacctcacgggcgccgtgaagggctggccacagaacatccgccagtacttcgagctggtggacggcttccgcccggacgtggtggtgagcgacttcgagtcgttcagctacatgttcgcccggaatcaccggctgcccgtcatcagcgtggacaacatgcaggtcatcaaccggtgcaagcacgagccggcgctgctggcgggccacgaggacagcttcgagacgtcgcgcgccatcgtgaaggcgaagctgccgggggccttccactacctggtcaccacgttcttctacccggagctccgcaagcggcgcaccacgttggccccgtcgattctgcgccccgaaatcctggaggcgaagtccgagcccggtgagcacctgctcgtgtaccagacgtcgacgacgaacacggcgctgccggacatcctcaaggccgcgggcatcccctgccgcgtgtacgggctgcgccgtgacatcaccgaggacctggtggacggcaacctcacgtaccggcccttcagtgaaaagggcttcatcgatgacctgcgcaccgcgcggggcgtggtggccagcggcggcttcacgttgatgagcgaggcggtgtacctgcgcaagccggtgctgagcgtgccgctggaggggcagttcgagcaggtcatcaacgcgctgtacctggagcaactggggtacggcatgtacgtgaaggcgctgacggtggacgcggtgaaggagttcctcacgcgcgtgccccgctgccagcaggcgctccagggctacgagcaggacggcaacacgcggatgctggccgccctgcgcgaacagctggccctggcctacgagcaccgtggccactgggccatggagcgggcgcaggactag

SEQ ID NO: 3615 - DNA, 437 bp, Myxococcus xanthus
atggccgactttcttcctcgcttctatcgactcgccgtccgcgtggacgcgcactatgacgcgctgagccgcaagcttcgccagaagctgggaatcgcgccgccgctgcgcatccttccctaccggggctacggcacgcccgagcgcgccgtcatcaaggcccgcgtgttggaggaccggcacgtgcgcccgccgcaggagcgctacacgctggtgggcagtgcggtggcctcctacaagcgctacatgacgcgcgaggtgccgggtgcacacgtcgcggtgcgctggggtgacaagcgctgggagggcaccaccgacgaggagggcttcctggagctgtgggtgcctccgccggacggggtgcgctcgggctggcacatggtggagctggagctgctgtcgccggacgcggagggcgtgtcccgccttgagagcac

SEQ ID NO: 3616 - DNA, 666 bp, Myxococcus xanthus
atggagctgctcatcttcggccactcgggcgagccggtgctcctgctgccgaccagcaagggccgcttcttccaggccgaggacttcggcctcatcggcgccatcgccgaccgcgtccagtccggccggtacatcgtggtgtgcccggactcagtggacgaggagtcctggttcaacaccgccatccacccggcggaccgcgtccggcgccaccagcagtgggaggagtacctcctccacgaggtggtgcccctgctcaagagccgcagcaccggcgggcgcctcaccctggccgggtgcagcttcggcggcttccacgcgtacaacgtcggcctgcggcacccgcacgtcttccggcgcctgctgtccatgggcggcaagttcgagacgaacgagttcctcgacggacaccacgacgcggacgtctacttccattcgtgcacagagtggctgccgaacctcacggaccccgcgcagctctccgccctccagcgtgtggagatggtgctggcggtgggggagcacgacttctgccgcccctccaacgagcacctctccaacctgctttggaagaaggacatcggcaaccacctggccgtgtggcagggcggcacgcacgactggcccgtgtggcggcagatgattcagcagtacctgccctggtag

SEQ ID NO: 3617 - DNA, 291 bp, Myxococcus xanthus
atgcagcccgtggatccggagaagaagccccgcgtccacgagacgccgctcaaccacgtgggcctctgggtggacgacctgcccgtggccgtgcagtggctggagtcccagggccttcgcttcgcccccggcggcatccgcaagggggctgcgggcttcgacatctgcttcatccaccccaagggcagtgagcagttccccttcggaggagagggcgtgctcatcgagctggtgcaggcgccgaaggaggtcatcgccgccttcgagtcgctatccaccgcgggtcactga

SEQ ID NO: 3618 - DNA, 1122 bp, Myxococcus xanthus
atgcgcatccccgacttcaagctggagcggtacttcgcgcgctgggagttcgcggcgccgtacctgctgtgttcctcggacatcgagggctggcggatggcggacttgctggcgctcgccggcccggacgagcgggcccgctgggaggggctgacgctgggctacaccgaatccaccggcctgcccgcgctgcgcgaggagattgccgccctgtaccccgggctctccccggagcaggtgctcaccttcgccggcgcggaggaggcgctcttcgtcctggtcaacgtcctgctgggccccggggaccacgccgtcgtcacctggccgggctaccagtccctgcacgaggtggcacgcgccacgggcgcggacgtgacactgctgcgcctgcgcgaggaggacggatgggcattggatttggatgcgctgcgccgcgcgctgacgccccggacgcggctgctgctggtgaacttcccccacaaccccacgggcgcgttgttggaccgggccgccttcgacgcgctgtgcgaactgtcgcgcgagcgtggcatccacctgctgtccgatgaggtgtaccggttgctggagtacgacacgcgcgacacgttgccgcccgcggccagccacacgccgcacggcatcagcctgggggtgatgtccaaggccttcggactggcggggctgcgcgtggggtggctggcctgccgtgacgtggagctcttgcggcgctgcgcggcctacaaggactacacgaccatctgcaacagcgcgcccagcgaggtgctgtcactcatcgcgctgcgcgcgaaggcgcgggtgctggcgcgcagccgggagttgctcgcggcgaacctctccctgttggatggcttcttcgcgcggcacccggacactttccagtgggtgcgcccgcgcgcgggcagcgtggcttttcccaggctgctgcgtgagacgcccgtggcccgcttcaccgaggaattgcgcgagcgcgaaggcgtgctgctgctgcccggagacgtctacgacttccccggcaaccacttccgcctggggctgggccgcacgaatctgcccgacgcgctggaacgattggagcgctacgtggtcgacacatcgcgttga

SEQ ID NO: 3619 - DNA, 888 bp, Myxococcus xanthus
atgaagaagttcttcggtacggtcattgtcgccgcaacgatgctggcgggcacggaggctgccgcagccaactacacactgtggattcatggccgcaacggcggcacgacgcagcccggcaactacaatgacttcagttactggggctcggcgagcgtcgaggcgggcgtgaacaagaaggccgtcaactgggacggccgtcagcgcatcggctcgcagaactaccgcatccgcgacgcgctggactgcttctgcacgggggacaactggtgctacgtcgccgcgcacagcgcggggaacctccagattggctacgcgctgtcgatgtatggcggctcgcagcgcgaggtgaagaacgcgtcccccagcgccagcggcgtgtgtggcaacgtgagcagcggcgcgaagcagacgggctggaacatccgctgggtgaacgtggcgtcgggcgcgggcggtggcagcgagctggccgacattggcgagtgggcgatgaatgagccgctggtgagcgacctggtcaccaccaccgcgcgcgccatgtacaaccacaacaccacgcgcaacgtgtggttctacatgttcgcgggtgccaagggcacgctgtactccggcgtgctccccggccaggacgatgaggcggtgtcgtaccactcgacgggaggcgtgtcgggcagcgcgggcagctcgcagtgcaaccctggtgactggttctgtggcggcaccctgaacctgggcacggccgcgaccagcgacgggcgcgcgaagtggagctaccacacggtggagttgcgtgacgaccgggaggcgtacaaccactacgccggaggcaactggggtggcatcatcgcgccggtccgccaggacgtggtcaattacgcgtactga

SEQ ID NO: 3620 - DNA, 1254 bp, Myxococcus xanthus
atgcgccgcgccctgtgggccatccccctcattccgttggtgctggggggcgtggggtggtggtggatggaagcaggtgccggcccggagtcctccggcgaggacggcgcatgggaagcgtcctcgccgtctggaatgccgaaccccgcgccgcggaagtcgggaggcggcatgggcaggccgacggggagcgtgccacgagtggccgtgcaggacccggctcgcagcccggaggaagcggagcgtgacgcgcggcgccagttgtgggagcagcggctggcgcgcgcgaagcagatgctggagtcgtacatgaaggcgacgcgctatccgccggagtcgcgtcccgccagtgagcacccggaccagatggagatggcggagccggagcgcacgcgtccgctgaacaaggacggctccgacatccagctccggctgaagcaggaccgcgtcttcgtcgtcggcgacgaggtggtgcacttcttcgtcggctgcgaggacgcgcgccgcatgcccaggccctgccaggtggtgtccgcctccgcgcacgaggccgagcacatgcccggcgcggggggcatgccggcggtccccctccacttctccgacgacggcgccgcgggcgacgcgctctccggagacggcaccttcaccgggcgcttccagccgtcgaagcaggggttccccatctattcgggcacgctgcgcgtggacgtgcaggtgcgctcgggaggcgaggagggcaccgcgttcttcgacatcatgtacacgccgtcgcctccggcgctcttcacgggccgggtgcgggaggtgctggagcaaggctcgcttcagctctacctcgggattcaggtccagaaggccggacggtacgtggtggcgggccgcgtggatgacgagagcggcatgcccttcgcgcacgtgtccttcaacgaggagctcaagcgcggcgagcaggaggtgaagctcaccatcgctggcaacctggtgctggacgaagtgcccaccttccccctgaagctgcgcgacgtggagggcttcctcctcaaggagcggggagacccggatcgcgagctgatgacgagcttgcgcgggtacgtgcacaccacgagtgactatccccccacgtccttctccgccgcggagtggcagagtccggagcggcggcgctatctggacgagctgaaccgggaggtcatcgaggcgcagacatacctcgacggcatcgaccaggaagaagcaccgcccaggccgtga

SEQ ID NO: 3621 - DNA, 744 bp, Myxococcus xanthus
atgagaatggacagcgcgggacagacccacatcggtcggcggccgcacaacgaggatgcgttctgcgtcgcaccggagctggggctgttcgtcgtggcggatgggctgggcggacaagaggggggagaagtcgccagccggtgtgtcgtggacaccttcgtgggctttggcctgcgcctgggacaggaccgggattcgacgtggcccacggtgccggaccctcgccgcagccgtgaagagaacctgttggcggcgtgctcggcgctggcgcagcgcaacctccaggcgcagcgcgtgggccggctgcgggagatggcgtccaccgtcgtggcgttggcggtgagcgagcacggcgcggcggtggcgcacgtgggtgacagccgcttgtaccggctgcgtggcggaaagctggagtcgctcacgcgcgaccactcgctcatcgaggaactgcgggacgcgggcatggagccgccgggaggctcgggcaacttgcgccacctcatcacccgcgcgctgggcactgagaatgcggagcccaccgtgcagcggctccagacggagccgggtgatgtgttcctgctgtgctcggacgggctctatgagccgctgggcgtggagggcctgatgaagcgcctgacgatgtcctccgcgcgcgaggtctgtgacgcgctggtcgcggacgcctacgaggcgggcggcaaggacaacatcaccgcggtggtgctgcgcgtcgcggaagcgtga

SEQ ID NO: 3622 - DNA, 1521 bp, Myxococcus xanthus
atggaggccctggtgaaggagggcggcgcgcgcatcatcctggtggatgaggtgccccatcaggctgtggcgcagcccgtgatgacggccgagggccgcaccgtggggtacgtggtgctggggcgggtcctgggagaggtggagcttcaggcgctgcgtgacgagcgcggtgtggagggcgtgttgaccgtgggcgggaagccggtggcgcacgcgctgagcgtggtgcctgatgatgccttgctcgcggcactggaggggaaggggcggccggacgaggtgtcggtgaatggcgtgtcgttgcggctgcgccgggtggagatggggccgggcgtggagctgctgctcacgcgtgacggtgggaaggaagcggagcagttccgtgcgtcgatgctgctcgtggtgctgctgggcctcatcgtcacggcggcggcgggcacggccatcttcctgctggtgcggcggatgatggagcctctgcgcgagctgaccgtggccaccacgcggatggtgtcggagggtgatttccgaggggcgctggcggtgcgctcgaaggatgagattggtcagctcgccagttcgttctcggagttgatgtcgcagctgcgcgagctgttgatggcgctgcgccattcggccgagcagctcgaaacggcgtccacgcacctcaccgagtccgcgtccgtccagaacgaggcggtgtcgcagcaggcggtggcgctgcatgagacgcaggttgcggcgcagcagctccaggaagcctcgcgcgcggcggcgcggcgcgtggaggtcatcctgcgggaggcggacaaggccagtggctttggcgaggcgggcgaggccgcggtgtccggcagcgtgggtgggctcacgcacatccggtcgcatgtggagcagattggccgcaccgtcgcggagctgcaccagcgcacgcggcaggtgggtgacatcacccgcacggtgaaggacctggcggaccagtcgaacgtgctggcgctcaatgcttccatcgaggcggcgcgcgcgggagtgcacggcaagggcttcgcggtggtggccacggagatgcggcggctcgcgcagcagtccgtccgggcggcggggcaggtgagcggcatcctggacaccgcgcaccagtcgatccagcacgtcgtggagctctccctggtgggggcggagcggatggcgcgggacatcgaggtggtgcgcgcgtcgggagagcgcctgcgggggctgtccaccgtgctgcgcaccagcacggagggcgtgcagcagatttcagtggcggtggcgcgacaggccgcgggcgtggcgcggatctccggcgcggtggatgagctgtccgcgatgatgaaacagacgctggggcgtgtcgaacagacgaccaccgccgcccagacgcttcgcgtggtgacgggccgtgtccatggcgtcatcgacacctatcaaggcaccaggacggatgaggtgccgccagcgaacgatgcgggccgggtgattgcgttcagacgggacgcttaa

SEQ ID NO: 3623 - DNA, 1272 bp, Myxococcus xanthus
atggacgagcgtttcctgcccatgctccacgggcagctcggcaccgagcgcaagccggaggtgcgcgccgcgctggcccgcgcgttgggagacttgaagcatgcctcttcggtggagccgctgacgaaggccctggacccggcggcgggcgacatgcccgcgcagttggcgaacaaggccattgtcgcgacgctgggggccattggtgaccgccgcgccatccccgcgctggtgccgctgctgcgcgcgaaggacaactacacgcgcatcgaggcggtgcaggtgctgggcgacatgaaggcgaaggaagcggtggagccgctcatcaccctggccacggacgacaccgtggagcccttcctcaacaagaaggccattgaggccctgggtgacatcggtgacggccgcgcggcgcccgcgctggtgcggatgctgaccaaggagcgcaagggcaagtccttctacgtggagagctccttcgcgctgtaccaactgggcgcgcccgcggcggacgcgctgcttcaggcgttggagggccaggacgcggacctgctgaagtgggcgcggtcgaacggcgtcaacccggccagctacgcgatgaaggcggcgacggtgctgggcgacctgcgggagaagcgggcggtggccacgctgttgaagcaactggccttcaccaacacggacccgcagattcaggcgctggtgcggatgcaggccgcggacgcgctggcgcgcatgcgcgcacaggaggcggtgaagccactggccgggctcgtgtcggagacggacgccaccgtgagggattcctacgtgagcgccctggtgcgcctgggcggacgcgacgcactgcccgcgctggagaaggccgcgggcaccggagactggtacgcgcgcgagttggcggtgaagggcatcgccatgctgggcgacgcgcgcgagctgcccttgttgcagaagctcgccgcggccgagccggcgcggacggcggcggactgcaagcaggcggaggacgaaggctgcgatgacgcggccgcgctgggcaagcagcgcgcggaccagattgcgggccagtccaagctgctggaggccgcgcaggcgtgcgggggcaacgcgggctgctgggtgcagcgcatggagaaggcggagccgcgaatgctggagcgcgcggcgctggaggtcggccgttcgggcgcggccgagcacgcgggcgcgctggcctctcgactgggagagcgcgacaccgaggcccgtcttgcgctcgtcctcccggtg

SEQ ID NO: 3624 - DNA, 909 bp, Myxococcus xanthus
atgcagctcgaatccttgaagatgttctgcgacgtggtcgagacaggctcattctcccgcgccgcgcagctcaaccacgtcacgcaatccgcggtgagccagcagattcgcgcgctggagaaccggtacgagcagaagctgctgtcgcgcagcgcgcgccaggtgacgccgacgccggccggggagcggctgttccgcgggtgcaaggaaatcctcgcccgcttcgccgaagtggagcaggagattcgtgagcaggccaccgaggtggcgggtaccaccacggtctccaccatctactcggtggggttgcacgagctgaactcggtgcagaagcaactgctcaagtcgcaccccaaggtgaacatgcgcctgaactaccggcgcaacgaccaggtgtacgacgacgtgattctgggcgcggcggagattggcatcgtcgcctatccgcagccccgcgcgggcgtggacatcctccccttccgcgacgacaagctgtcggtcgtctgtgcccccgaccaccccttcgccacgaagcagaaggtgagcctcaccgcgctgtcgggcgtgcccttcatcgcgttcgaccgcgaggcgcccacgcgcaaggcgctggaccggctcttccgcgagaagagcatcgacatcaacccggtgatggagatggacaacgtggagaccatcaagcgggcggtggagatgggcctgggcgtggccatcctccccatgtccacggcgcagggcgaggtgaagggcggctccctggtcgccaagcccttcgcggaggggccggtgtcgcgccccattggcctgctcatccgcaagggcaagtacctggaccgcgcgtccgccgcggtgctggaggcgttcaaggccgcctccaacgtgccgccgcccaccgagaacgcctga

SEQ ID NO: 3625 - DNA, 309 bp, Myxococcus xanthus
atgccctcctctccggagccctcctccccccagcggccgtccctgggccgctccgcggcgacgggcctgctgggcggcttcctcctgggcggcctgggcctgctcgccgtgggcctgagcaacagcttcgccgccccgagctgcgatggcctcaccggccccgaatgccagctgttgacggacgccactcgggaggtcggtcgcacccagttgctcgccgggggcgccctcaccgcgctcgccgcctccctcttcgtcctgttccgcccgcgccctccggccccacccgaggggcccgagcagtcctga

SEQ ID NO: 3626 - DNA, 1047 bp, Myxococcus xanthus
atgccagctcaccgcaaggattctgactcgtcccgcatctcgctcggcaccgtggccgcggccggcatcggcgcggcgctgggactgcgccgcatcctccgctcccgattccaattcaaggacagcaccgtcctcatcactggcggctctcgcggcctgggcctggtgctggcgcgacagctcctgaaggaagaggcccgggtggccatctgcggccgggacgagcagacgctggagcgggcccgcgaggagctggagcgcactggcggcgaggtctacgccatcccctgcgacgtgcgagatccggtgcaggtggaggccatggtctccgccatccacgagcgctggggcacggtggacgtgctcatcaacaacgccggcgtcatccaggtggggccactggagtccatgacgctggaggacttccaggaagccatcgacacacacctgtgggcgccgctgtacaccacgctggccgtgctgccggagatgaagcggcgcggaaaggggcgcatcgtcaacatcgcctccgtgggcggaaaggtgagcatcccccacctggtaccgtattcggccagcaagttcgcgctggtgggcctgtcggacggccttcgcgcggagttgcgccaggacggcatcgtcgtcaccacggtgtgcccggggctgatgcgcacgggcagcccacgcaacgcgtacttcaagggcaaccacgaggcggagtacgcgtggttcgccaccggggactccctgcccctcacctcactgagcgccgaacaggccgcgcgcaagattctggacgcgtgccggcggggtgacgccgaggcgctgctgggcgcaccggcgaagctggccgccgtgggccgcacgctggcccccaacctgacggccaccctcacctcctgggccaaccgattcatgccccaggacagcagccaggaccgctacagcggcagccagagcgaaacgccgctgacccagtcctggctcaccgagctgacgcggcgcgcggccgagcgcaacaacgaggccgaagtgccgctgcactga

SEQ ID NO: 3627 - DNA, 168 bp, Myxococcus xanthus
atggcgcgggcctacgacgtggcggacacgcccgcgtggctcgtgttcgacgcggactccggccggctgcgccaccacttctccggaaagaacgcgtccccccacgtgcggcaggtgctggagcgcttcatccaggccagcgccgcggccccctctcccgccccctga

SEQ ID NO: 3628 - DNA, 1773 bp, Myxococcus xanthus
atggtgctgcccgccttcctggggtgtgcccaggattcgcaagtgacacgcgaggcgcccacgcccgccgagtctcccgccgccgcgtcgcagccctcgccggcagaggcgaaggccttcgcggagaaggtgaacgcggacctcaagagcctgtggacgaagcaagccaccgcggagtggatcaagtccacgtacatcaccgatgacaccgagcagaacgccgccttcgtcaacgaagaggtgctggcctacgtcaacggcgccatcaaggaggcgcggcgcttcgagggcctgacgttggacgcggacaccgcgcgcatgctgcacctgctcaaggtgtcccaggcgctgccggcgccgtcggacgcggagcggcggtccgagctggccgccacggcggcgaagctggagggcctctacggcaagggcaagtactgcgggccggacgggaaggggaagtgccgcgacctggaggtgctgtccgacgtcatcgcggagagccgcaactttgacgaactgctggacgcgtggcagggctggcactccgtggcccgtcccatgcggccgctgtacgagcgcctggtgtccatctccaacgagggcgcgaaggacatcggcttcaacgacctgggcacgctctggcgctccgcgtatgacatgtcgccgggcgagttcgaggtcgaggcccagcgcctgtggggccaggtgaagccgctctatgacgacctgcactgctacgtgcgcggccgtctggcgaagcagtacggcgccgacaaggtacccgacggcaagccgattcccgcgcacctgctgggcaacatgtgggcgcaggagtggaacaacatctacccgctggtggagcccttccccggacaggccagcctggacgtggacgcggcgctgaagcagcagaagtatgacgcgatgcgcatggtgaagctgggtgagaagttcttcacctcgctgggtctcaaggagctgccgccgagcttcttcgagcgctcgcagttcaccaagccggaaggccgcgacgtcgtctgccacgccagcgcctgggacgtgaacttcagcaacgacctgcgcatcaagatgtgcatcaagcccacggaggaggacctcgtcaccatccaccacgagctgggccacaactactactacacgtactactaccagctcccggtgctctatcaggccggcgcgaacgacggcttccacgaggccattggtgacgcgctcacgctgtccatcaccccgggctacctgcagcaggcggggttgctgaaggccgttccgaagaacgagaagaacctcatcaaccttcagatgaaggacgcgctggagaagattgccttcctgccgttcggtctgctcgtggaccagtggcgctgggaggtgttctccggccgcgtgcagccggcggactacaacaagtcctggtggacgctgcgggagaagtaccagggcgtcgccgcgccggtggcccgttcggagcaggacttcgacccgggggccaagtaccacgtgcctgcaaacgttccgtatacgcggtatttcctggcgcgcatcctccagttccagttccacaaggcgctctgcgaggcgtctggctacaagggcgccctccacgagtgctccatctatgggaacaaggatgccggcaagcggctccaggccatgttggagctgggtgcgagcaagccgtggcccgacgcgctccaggccatgacgggaacccggcagatggatgccacgccgctgctcgactacttcagc

SEQ ID NO: 3629 - DNA, 741 bp, Myxococcus xanthus
atgggcagcgacctgctctcgccagaggccgccgcgtgggagttgcagaaccgggacacctccaccgcgcccacgcccatggaagcggaggacgtgctgttcatgctgaatggccccggcgccgcggccgacctggagccgccgctggagctgggactcgaggacatcttcgaggaagccccgcgactgcacgccgcggaagacgcgctcttcatggctggagccgatgacgcttcagcggccagctccgacaccacggaaatccagcagccgagcctcgccgccgctcgctccggcgcaccggtgaacttcgcgaccgaggccgcgggcatcgatgccgttcccgccgacatgatgacggccgcggccggtgacgcgcgcgtggatgatgcgcccgcgggctacgcgctgggcagcgcctacgcggccacctacgggcagcagttcgccgtgaggcaagcgctggacccggcggtcagccccgcgggaccggacgagttcctcgcggacccgaatgacttgaacatgctgctgccggaggagccgtccctggacgatgccgccgtggcaggcgtcctgggctccatctccgccaaccccgcggcagccagcgcgccggtggcagcggccttcgcttcacagggcgtggaagtggtcgcggaggcgttggagccggagctgcggcccgaggcgaaccccagcatcaccgaggcacccgcgcccgagaatccgcgggcctga

SEQ ID NO: 3630 - DNA, 600 bp, Myxococcus xanthus
atgcgctcaacctccattccagcggcactgaccctgcttgccctcacgcccagcggacttcgcgcggaggaggccgccggagaggcgcgcgcgaaggccgagccgcctcgcacgacgcgcaacttcggcaacctgcgcgtgggtggctccacggcgaacggcaatggccgacccgacctgtgtctggagttgtcccccgtggcgttcctgtccgtggagagctgtggcacggggagcggcttcctgcacagcgaccccgagccggaggtggcacacttccgcgccaagctgcggctggccagcttcgacgtggagcgctggggcaccttccagcccttcctcgccgggggcttcgcggaggcccaggtaggccgcgacgaccctgggttccagttcaaggggaccgaccgacgccgcgtggccacggcagggcccgaggcgggactcgggctgcgcttcctccgcccgctggccgcgggcttcgagctggtgggcgacttcaacttcagcctggcgtggatgccccacgctcccgagctcatccagcccgggaacacgtggctgccgtccgccagcctctccttcggcgtgggcttctga

SEQ ID NO: 3631 - DNA, 663 bp, Myxococcus xanthus
cgctccctgcccaccgtgccccagcgctacatcttcacgctgacgcgcaagcacggcgcgcagacgaataccgccaacggcatgtccacgaaccggtgcccacagtgcaacgcgccgctgacgaacagcgccgccacggactgcgaatactgcggcacgccgctggccaccggtgagcgggattgggtgctcgcggcggcgcgcacgttcgaggcgtggaacgcggccgaggacgcgcggttccgggccctccctccacgccagtccgcgccgcaacagcgcatgggtggccatgaccacacgccgcagcccgaggacgcggtgatggacgtccaggagcggcagcgcctgctgtacatgatggccgccatcgccgccgccgacggcgaggtgacgtccgcggagcgcaagctgctgaagctgtgctcggagcgctggggcgtggtgtgggacaacgtggagctggcgctgagcatggggccacagctcttcgaccgcctcgtggagaagggcagccccgaagcggaggtgttcctgcgcaacatcgtggagatggcgctggtggacggccgcatcgaccgcaaggagcggcggatgctggtgagtgcagccgcccacctcggacttcaggaccggctggagtccatgctcgacggacactga

SEQ ID NO: 3632 - DNA, 366 bp, Myxococcus xanthus
accgccatggccatcggccagctcgttcccctgctcaacacgctcgcccacggaaccacgcggtggcagttcgcgggcatggcctccgccacgctgcgactggagcgcctccagcacaaggagtacatggccgcgctcaaccgcttccctgccaccgtcaaacagggcctggcgaggctcgaggcggaccccagactcctgagcgtgccgatgaccaccctggccgcgtcctaccggatgcccgacatcggggcctacgtgatgacgctcaccgccgcggcctacgccacgttcgtgacggagctgaagaagctgctggatgaaggtgtgtcgctcgacgaggcgttcctggcgctgcggagctga

SEQ ID NO: 3633 - DNA, 4521 bp, Myxococcus xanthus
atgattaccaagccgattgcggatccgctggccaacgagcatgtgctccgcgtggagccacgcatggcgcccttcggcgtggacgccgagtggaggaggagggcccacttcttcacgggacgcgccgtgtcggcggacgcgctcgcgctggaacaggaacatcgcgcggggaggctcgcgctcctgggccagcacctcacgccgggcatcgtcgccgggctggaggttcatctggagcgggcgggcacgcagaccttcattcatgtccggcccggcagcggcatcgccgtgacaggcgaggacgtcatcgtccgccggcagctccgcgccccgctgggagcgattcccctcttcccaggacaccgggacccttccacgttctccctggaggcactcgccaacgaggagccccccgtggacccgctgccatttcccaaagccgcggtgctggtgctggtccccaccacgtccgtgttgacgccaccggcctcgcagaccgacgcctgcgaggtggacccggagtcccatgcattcgaggacgcggtgcgcacggagggcgcggcgctggtgctctggggctggcccgagggctggtacatgccgcaggactactcgctgcgctggcgcagccggctggtgtacagcctcttcgaacgggaacgccgtcgccggggtggactgctcgccccctgggagcacgcgggcgttccacttggactgttgggcttcgggcagggtccggacggtccggaggcgttgttcgtcgaccggcatgcggtggcgcgggcgggtggactgccacgcgcgcgcacgccgttgctgaagtcccgcggctcgcccgtgctgtggcaggcgcgcatcctccagttcaacgaccacctggcggagcttcccccggagcggctcgcccaggacaaggccatcctctacttccgccgcctgccgcccgtgggcgtgctgcctccggacgccgtggactaccgcgcctggacgcggcgcttcttccccgaccggttcgagctggaggcggtccccattccactggagcagctcgacacggtggcgatggccagcgcggccctggagccgctggacatcacccgcgaggagcgcgttcgcatcctcgtccccgtgcctggcgccgtctatgagccggggctgctgcacgacgcaccgctggaccccgccttcctcgccgccatcgaagaaggacttcagcgcctgggcggatggctgaaacggcgcatcgtcgtgcgcgcccggatgagcaccctcaaggacaacctgtacggcgccaccggcaagcactatcccctggtggacccggaagccgacccggacgaggcgcgctacatccccgccgccgacccgatgaatcccaccgaagaggactacggcacgtcgggtgagacggtgccctcggccgaggcctacctgcagaaccacttcgagccgtcctgggggttggccgtcgatgcgcgctccgatttgctgcctcggccccagggagacccgacgccccggctggagttcgcaggacagctcacctccgcgcccgtggtcatctccaccgaggaccgggcgcatgtgttgttccggggaccgttctggacgctgggctaccggaccttcgatggccgggcgtggagcaaggtgacgcccgtgctccagggcaaggtcaggtcacgctccgtgcccgtcgcggcgatgtggccgcgcgggcggctggacgtctacttccgggacgaccagggcaacctgcacaacacctacctggacacccgggtcagcaatcagccctggagcagccctcgcatcctggcgagcgacgtcatgggagacgccgccgcggtgtctccctccgagggacgcacggacgtcttctaccaggccctccgagggcaggtcctctcgctctggtggatgaccgtcaccgcctcgcgcgtcatccggccgaagccctttgagacgccgctcgcgttcaagggcgagcccatctcggcggtggtgtcgcgtggccagctcatggccttcctcctggacgcccagcgcaacatccagcaggtcaccgtctccccggaccccacgcacggcgcggtggtctggacgaaccactcgctgggacgggaggtccgctggctcaaggcctgcgcctcaccggatgacggcaccgtggatctggtcgtgctcacgggcagctccctgctgcaccggcgattcaacggtttggtgtggagcgagtggaaggacctgggcaacagccattcactcaccgccgcgctgtccgcgccaggcaagggcgtgctggatgtcctgtcccgagcggtcaacggacgcatccggtacgcccgattcgatggcaccacctggacgccctggaagacgctcggcaccgaggtggcacgctccgcgcccgcggccatccggcgcggcgaccaactcgatgtgattgtcagggcgcgtgagaacctcctgtggcatcggccggtgcgctcgcccctccacaccacccagcgaaccctgggcctgcgtgggctgatgcgcgacctgtccaaccggatccagcaagtcgacgaggccgtggacgccgccttccttcaggtccagtcggaaatccatcgcgtccgccagctcatgctgggcagcaccacctccgccgtgatgacggcgtctcccgtactgaccgacgtcgcgcaggccgagacgcgtgtcgccacgttgacggacgtggagaagttcatcggggtcctgaacgcgaagcgcaaggtgagctggtccacggtccgctacctggatcaaaccaacctccgggaccggctcctcaaggtatcgcccgtcatcggcacgcttcactcggcgatggccatcaagcgagaggtgctcgggaagctgttcacgctgctctccggcatggagttcaacctcgaggccgtgcaggtccccaacgtgaaggtccccccgtggcgacggtcacgtgtgcctccggtggacggacagccaccgcccatccccaccccggagccgggcatcgacattccgttgagcgagctgcgtgccctgaccgcggaggattggaaccaggtgttcaccggttacgtggcgcccaaggtgcccacgcgggcggaagaggccacctacttctccatgtccgtggcccagctcgaagacgtgctggccgtgctgcggaacctcgaggaccgtgtcatgcaataccgggaggccctggaggaaggcgggcgcctggtgagcgtgctccgggcccatgaggcacgaggaggcgagcgcctgacagtgattggcacggaagtctccgagtcccgccaggacgtcatggtggctcgcgcactcctggccgaggagcagacccggctgcaacgcatcaacgaacgacgcgccctggtgctgcgcgagcacgttcgcttcctcgtctaccaccggccgagagagcaggtcctggaccgcgccacgcccgtccgcgcgttggacaccggtatctacgagtcggagctgcccgcggcgctcgcggagacacgcgccgcgcctccagaactctgggccctcatccagctcctgcgagacgccccgctggactggttcgcgcaggggccatcgctgttccagcgcctggaccggctggacctcgtccaccggaccctggaaggcgcacggcagcgcgccacggtgcgcgttcctcccgccctcccccagatcacccgcgcgcccagccgctcgggtgaaggcgtgaaccgtgtcttcaccgcgcagagccaggttgtctcccaggccagggtcgtcaccgcgacgctggagctggccagcctcgtccaccgcggctgggcagagctggtgaagattgcgttgcccatcacctcgttcggcgacctgatggacaccgcgcacgggcggccggacgtcgcacgagccgcggcccgtgagctggaaaacaccgccaaagtggccacgtacctctacttcctcttcggcgaggtgcctccacgcgtccgaatggaatgggcgtcgatgctcagcgagtatgacgcgccgtgggacctgagggacctggcccggctgccccagtggaacacgctggaggtcacgagccggcgccagcttcaagagctggtggactggctcttcgcgcagatgaacccgtcacgcacccaggccgtggcgctgatgaacgacctggtgcgctcggcgctgctgctcgcgagccacgcccccgtgggagaaatcgtcgccgggcacctgccgaagccagcccccgccagggtgggaacggtgctggacctgcaagtggacccatcgcgcatccgcgtgggcacccatgtgctgctcgcatccggcgttcacacggtccaggccgtggtggaggacctgggcaccggcacggcacgggcgcgcgtcttctccacgagcgcggccagcgtgaacctcgcggagaagacggtggcgaagttctccgagcccgagcagcgaggcggcctgctcccgacgccgcggcggacactgctccggtga

SEQ ID NO: 3634 - DNA, 246 bp, Myxococcus xanthus
atgctgcgcgcggccctcctcgcggtgggccgcgtcacgcgacggctggcacacatgggactgcgagcgctcgtcctccgtcccggctgcctcgtcgcgacccgcacgcatctggacatcgtcttcgccgcctcgctggcggacatccgcatccgccgcgcggggctcgacatcaatccgggctgggttccctggctcgcccgcgtcatccagtaccactaccaatacgacgagaccggagaatga

SEQ ID NO: 3635 - DNA, 1425 bp, Myxococcus xanthus
atggacgcaccgctgcctccctccatcatggatggcgtgcgccggcatgcgcgctttctcgcaggctcgcctcggtcgatgctcgtgctgcgcggcacgtcggtttctgaaacccgcaccgtggcggcggcggtcgccatgacgctcggacgagcccccctcttcctcggagcggagctccagcggggattggggcccttcctgattcagcgagggctgctccccattcatgtccacgacctcgcgcccggcgaacgaaaggtgcttcccaacgtgccgtactacgacggccccgtgctggccatcaccggacccgagggcacgctcgacgcgacggaccgcaccgtgttgcgctggtccgttccacgacctcccagcgaggaacggcgggccctgtgggagtcctcactgggcgcaccgaacctcgccgaggagctggcccgacggcaccgtcagggagcagggcgcattgcccagcttggccggctggcccggcagaaggcggagctggacgggcgaccggcgcccgagctgcaagacgtgctcgcagcggcctgggaggcggaatccgagggcatgggcacactcgcggagcccttgatggacgccataggcgacgacgccatcgtcctcgtgccccaggtgaaacgagaactggagcttctcctggcgcggtgccgtgctcgggacgatctggtccacggcctgggcccctccgcgacggtgcgctatcgcgcgggtgtccgggcactcttcatgggcgcgtcgggcacgggcaagacgctcgccgcgggatggctggccacgaaactcggactgccgctctaccgcgtggatctggcatccgtgacgagcaagtacatcggtgagacggagaagaacctctcgcagctcttcgcgcgggccgagcacgccgacctggtactgctcttcgatgaggcggactcgctcttcgccaagcgcaccgacgtgaaggactcgaacgaccggttcgccaacgcacagacgaactacctgctccaacgaatcgaggccttcgacggcgtggccatcctgaccagcaacagcaagagccggttcgattcagcctttacgcgccgcctcgatgccatcatcgacttcaccctgcccgggcccgccgagcggcgcgcgctctggaccacgcatctgggcatggcgcacgaacttcccgccaaggaattgaaccgactggcggcgacggcggacctggccggagggcagattcgcaacgtggtgctgacggccgcgctcatcgcgcgtgaggcgggccgctccatccaaccaccggacatcatcgaggcgctcgtgcatgagtaccggaagcagggccgcgagcccccctccgagctccgcaccacgcccctgggctccgctgacggcgcccgtgacacatggcgccgctaa

SEQ ID NO: 3636 - DNA, 696 bp, Myxococcus xanthus
aagcgcccgtacgtgatttgccacatggtgccctccatcgatgggcgcattgtcacgaggaactggaagctctcgtcgcgcgccctgtccgagtacgagcggacggcggagacgttcgacgccgatggctggatgattgggcggatttcgatggaaccctacgcggggaaggcgaaggtcccggtacgcaagtcaggccagccgattccaaggacggacttcatcgcgaggcgtgacgcggagtcctacgccatcgcgctggaccccacgggcaagctcacctggaagtttggctccatcgatgacgagcacgtcatcaccattctcacggagcaggtctctgacgactacctggccttcctccagtcgaagggcgtctcttacctgtttggcggcaagacggagctgaacttgacgagggtgctcgaaaagctccgtaaggacttcggcatcaagcggttgctcctggagggcggtgggaagatcaacggctccttcctggcagaggacctcatcgacgagctgagtgtcttggtggcgcccatcgcggatggttccatcggaacgccttctctgttcgatgcgggcgagggaaggggcccggcccgtcatctcaagctggtctcctgcgagccgcggaagagcgacatgctctggctgaagtacaaggtgcgcaaatcagaatcgaaaaggtga

SEQ ID NO: 3637 - DNA, 2031 bp, Myxococcus xanthus
atggacctcggccagaagcagctctccctggcggaggaacggaggacctatgagcagcggctcgctagcttgcaggagcgcatcgcggaggaggagaagctggagcagcaggcggcgctccgggagaaggacgtcgagcgtcagcgaaaagagtggcaggcgctggaccagaagcagcgagagcttctcgcgctccagcagaaggtggtccagcaggaggacctgctggctcgcaacgagccggccttgcaggaggcccagggactcgtccggcgcgccgaagacggggctcgcgaagcacgcgagcgacacaaggctcagcagggggaggtggagctggcggagcagcgcgtggaacgaggacgactcctcgaagatgcgcgcgcttccctggcggagcagcggaagttggacgggctcgtcaagcaggggacgcgggtggagaccgcagtggagaatgcccgacgcaagactgcggcgctgaaggcgcttccagacgcagaggtaaagcgcgccgaggaggtgcagcgcaagctgaatcaggccctggacaggctggacgcacagggggtcgaggtctccttcactgccgagagcccgcagcgtatcgagtgggaggcccagggtcacaccacaccgcacaagctcacaagggaggagcagaaggtcttctcgggggtgcgtgctggtgcactgcgcatcaagggagtgggtgaagtccgcgtgcgcactgcggccgaggagattggcaagctcgaagcggaggtcgagaagcaccggaaggacctggcgcgccgcctccatgagcacggagtcgatgatgtggtgggtctgcgcgcggagtgggcgtcccagcaggtcgtgcttcaggagctgtcgaagtacgaggaggcacggagccagttcttggaggacaacaaagtcgagagcgtcgaggtgctcaaggaacagcagcgtgagcaggcacggaagacgggggcactgagcgcccagctcaacctttcgcgggaggagctacagacccacccatttcccgagctgaaggcgctgacggaggaactcaaggcccgcaggcaggaggtgaaggcccgggacaaggcgcgggaggaggtggaaggagctctccggaaggcagagcagcacctcaaggtcgtcactcaggggcgcagctccgcgcaggctgcggcccaggcgctgggcttggagctgaagacccagctcaacaccctgggcttgtccctcgaagggctgggcgcggaggtagagcgggcggaggcggagctgagccgtctggagaacatggtcagggggctccgagcgcaacttcccaggctggaagcacgcgccacggtcgagcgtaagaagctgcaggacacgttggagcggatcggagacgaggagaagaagaaccaggagaagcgcatccgggcgcaggcgctgctggagcaggcggcagcggacggtctgtactcgcggctctgcgaggcggaggagaagctggccctggcggaagccgcgtaccagcgactggagacacgggcccgggccgcggagagcctccgcacgatgtcccaggcctggcaggaccaagtgaaccagacgttcctggcgcccatcgagcaggagctccactcccgccttgcgtatatccgtggaggagggcggctcgagcaactcttgctggacgcagagttcagcgaggcacggttgcagacggcggggggcccctggccgctggagggcttttcgtgggggatgcgggagcagaccctgttcgctttgaggctggcgctcggggagctgctggccaagaaagggccgcggccggagccacagctcgtcgtcctcgacgacgcactggtgaacacggacgcggcccggcaccagcgcgccctggaggtcatcgagagcgcgggggacacgttgcagattctcatcctcacggccttcccggagcgctaccggactctccggggagtgaaggagttcgacctgagggccctggctcaggcgtcctcgccgtcttcttga

SEQ ID NO: 3638 - DNA, 1125 bp, Myxococcus xanthus
gtcaggattcttcattcagcggattggcagatgggcctccgagcccgtcatgtggctcatgtcgcggaggacgtccggaaggcgagactggaggccgcgagcaacgtcatcagcgcggccaaccggtcgaaggtggatgccgtcgtcctggcgggtgacatcttcgagcacaatgtcgtcgaggaccgcgtcgtccatgcggtcatcaaggtgctcgcgggctctctcgcgcccgtgtacgtcctgcccggcaaccacgatgcgctgacgccggatgccgtcttccgccgggcctcctggaatcagcgcccggatcacatcaccgtgctggatgggaatgcggcggtgcccatcccgcacaccgatgccgtgttgctccccgcgccactccgccagaagaagggtatgaaggaccccaccgccggctgggagatggcgtccggcctggacgtgattcgcatcggcgtggcgcatggctccctgcgcatcgaaggcaagcacgccgcggacgacttccccatcgcactggacgcggcggtccgcgctggcctcgactacctggccttgggtcactggcatgggcagtacgtccatgacggtcgtacggcctactcgggagcccacgagacgacgaagttcggtgaggtgggctcggggcaggcactgctggtggaactctcgtcgcggggcgccgtgccccggctggagccgattgcaacaggggcgctgacctggaggacggtggagctggacctgagtcagggccacgagccggaggtggctcgggctcgggagctcgtggcgcagctggcgcgccccgaaagggcgctgctgcgcattcacacgacgggattttcttccgaggacgcctcatcagggttggaggcgttccgtgaggagcttcaggggggagggctccttcatgtctgcatcgagcgcgaggacataccacgcgcgaaggcagaggggcgcctcgcggacatcgcaggttcgagcagtctggtctcctcgttgctggatgggctgaacaaaccggccgcagttggaccaggtgccacgccggagcccgtcaggaccgcggccagacagttgctgtcagagctggtgatggaggtgtggaaatga

SEQ ID NO: 3639 - DNA, 573 bp, Myxococcus xanthus
ggcatcgccaccttctacaatgccaccggctccggcaattgcagctacgagccaacaggtgacttgatggtggccgccatgaacacgccccagtacgccaacagcgcggcctgtggacagtgcgtggacatcaccggccccaagggctcggtccgcgtgcgcatcgtggaccgctgcccggagtgtgaatccggccacctggacctgagccgggaagccttcgcccgcatcgcggagatgcagcagggccgggtcaacatcacctggacgccggtgtcctgcgacgtggcggggaacatcgagtaccacttcaagaacggcagcaatccctggtggactgccatccaggtccgcaaccaccgcctgcccatccagaagctggagtggcgacgcggcaccggtggatggcaggacgtcccgcgcgagagctacaactacttcgtcaacttgagtggaatgggcgacggccccttctccgtgcgcgtcaccgccgtggacggccagcaactggaagacacgctggacagagtcctcgacaaccgcagtgccgagggctctggccagttccgctag

SEQ ID NO: 3640 - DNA, 102 bp, Myxococcus xanthus
atgagcgcgcggttcatctccaagctcaactacggcgcggacttccgccgggccacctcgccgctcatcgccatgctcgacgaggtcccagccagtacatga

SEQ ID NO: 3641 - DNA, 411 bp, Myxococcus xanthus
atggccggacaggagttcccgacacagcgggaggtgaatggcttcgacaaattgtcgagcaccgtccacctggtcgtctacgtggagcacgggcccgtggcgaccgtgcggatactgctgccgaatcccgaggtggcatccgcgaccggcggcgtgctgggcgtcgagatggagcatcgcttggacctgacgggtctggttgaaccaggacaggtggtggcggaagcagcgcgcttctgcgtgcaccggcagtggcggcactccgatgcggtggtgctgctgcaggctgccttctacgctgagagccggcggcgcggcgtcaccactggcttgccagggcgaatctggagacggactcggaggtggatgcgcgcctcatccagcaggccattgcccaccacggctggctga

SEQ ID NO: 3642 - DNA, 1301 bp, Myxococcus xanthus
atgacggttgctggcaagcgccccaacttcctcatcatcaccacggacgaggaatgatctccgcctccgtacgagaacgaagaggcccgtctgcttcgtgtcgagaatgaccaggttggccaggagctccgcaagcatggcatcgagttcctccggcaccacacggcctccacggcctgcgcgcccagccgcaccacgctctacacggggcaatgtccgtcgtttcatggcgtgagtcagacgctcggcatcgggaagtcctcgttcgatccggacatgtactggctggcgcccaacaccgttcccacgttgggggagtacttccgcaagcggggaagctgccggacgttgccccttcgccaacggcaggtgagtcgctcgaaagcaagccgcgctgtcagaaggactacgtctacacgtatccgcgcatgtacctgccgcagcgcgataccgcgtcgtaccggcagttctattacttcctcatggcggaggtgagtaaacacagccaacgggtttacgaacatctcaaaaagacctccttcttagagaacaccatcgtcgtcctcacgtccgaccatggtgagatgctcggggctcacggcggcatgatgcagaagtggtacaatgcctatcaggagacgctgcacgtgccgtgcgtcatttcaaatccaaggctgtttccggagccccggaagacggaggtggtgacgtcgcacgtggacctggtgccgacgctgctggggctcgcgggaatcgacgcggatgcggcccggcgagagctggcacgggaccactcggaggcgcagctgctggtgggcagggacctgtccggtctggtgctgggccgggagtccgagcggcatgagcccatctatttcatgaccgacgacaacgtcgagtcagggctccagatgaccaacaacctcaccggccaggcgttcgcgggcgtcatccagcccaagcacatcgagacggtggtcacccgccttcccgagctcacgggagacacgccctggaagtacagttgctattcggacaacccgcgcttcttcgtgggcgcggcggggaacacggacgaggtcgccacggcgcggttcattcctcgtgagtacgagtgttacgacctcacggaggacccgctggagacccggaaccggtgcagcgcggtggcggcgcagcccttgtcgcaagacatccgtgacgcgctcgacaaggtcctgaaggagcagtgggagaagaagcggttgctgccccagaacctgaatcggaacgcgccgacaaagggcccgctgcgggactga

SEQ ID NO: 3643 - DNA, 1038 bp, Myxococcus xanthus
ttcgagcgggagcattcggacatcgacgtggacatcgtgttcgacgcgaagctggacctctatgacctggacgacggaggcaccctgaaccagcttcttgggcctggagcaggggccgcgcaggtggtggagatcgacacgctcatcatgggtgagctcgtgtcgaagggctgggtgcagcccgtcgccctggaggcgggggccgcgcatccggcggcggaagaagccgtctccatcgctggccagagctacggggtgccgacctatctgtgcagctacgtcgtctactcgaacagcccctacctgtcgtcggccacggatggcgattccctggtccagatcctcacggatgtggcaccggggatgcgcccgttggcggccaattacagcggaagctggacgctgccctcgtcctacttggacgcgtgggccgacacgaatcccacgggcgtgttgtcccaggcgttgtcgctgccgctggacgcgtcggcgctggcttcgttcgaggacgtggtgaagagctgtgagctggaggcaggcgtcaacccatgcctcgacggcacctacgcggatagttccctggcggaagaggcgttcgccttggggcaggccaacggcttcatgggctacacggagcgcctgttcttcgtccggaaggccagcccgggcatggcgctgccagaagtcatctccgttccgctgggcacgggctccgcgcccgcggtgttcgtggatgcgctggtggtcagtgcggagtgcacggggacgtgtgccgaggacgcccacgccttcaccgacttcatgaaggacccagacgtgcgcagcctcatcgccttcagcggggacgcgccgcagggcacgacgccgcgctatctgctacaggccacccaggctttctatcagcaggagcccgcgcgttctgatccgatgtatcagaagtatgtgcagttcttgagcggggctcggccctatcccaatcagggcttcccgcagaaccggaagacgctccagtcggcgctgatggacgcgctgcagtag

SEQ ID NO: 3644 - DNA, 930 bp, Myxococcus xanthus
atggaggcgctggggcgtggctgcgtggacaccggactggtgttctccgtgggagctcacctcttcgcctgcgtgatgcccatcctggagagcggggatgacgcgcagaagtcccggtacctgccccgcctgtgctcgggggaatgggtgggcgccaacgccatctccgaacccgaagcgggctcggatgtgtttgccctgaagacgcgcgcggtgcgggacggcgacagctacgtgctcgatggtggcaagagctacgtcaccaatggcccctccgcggacgtcttcctcgtctacgccgccacgcagccggcccatgggtacatgggcctgagcgccttcctcgtcgagaaggacacgccgggactgtccgtcgggcgcgccttcgagaagatggggctgtccacgtcgcccatcgcccccatctacctggaggggtgccgtgtcccggagtccgcgcggctgggtgcggagggccagggcgcggcgatgttcaagcgctccatgcagtgggagcgcgcgtgcctcttcgccgcctacgtgggcgtgatggagcgggtgctcgaacagacggcggacttcgcccggacccgcaagcagttcaagaaggccctggggaagaaccaggccatctcccacaagctggcggacatgaagcagcggctggaggcatcccggctgctgctgtaccaggcctgctggaagatggaccgaggccaggacgccgtcatggaagtgtccctggccaagctggccatcagcgaggccgccatccagagcggcctggacgccatccagattcacggcggcatgggctacgtggccgaaacgggcatcgagcgcgtgctgcgtgacgccattcccagcgccatcttctccggcacctccgaaatccaacgcgacatcatcgccaaccagctcggcctatga

SEQ ID NO: 3645 - DNA, 1515 bp, Myxococcus xanthus
atgacactcgaccaaatcgtcatccgtgcagcggcgaaggctcccgagtccatcgccatcaagggtcccgacgggaccctcacctacggccagttggacgcgctcgccaaccgcatcgcccgcgcgctccaggagctgggcgtgaagcagggagaccgcgtggggctgtggacggaaaagtccgtgcgcgccgtcgccgcgatgcagggcattgcccggctgggcgccgcctacgtccccttggacccgctgaaccccgcgacgcgaacgcggctcatcctcgacgactgcggcattgacgtgatggtgaccaccaccacgcgcgcgtccgagctccacaacgccggcgtgagccggctgcgctacctgctggtggacgacaaggggcccgagatctgctggaaccggctgtccggtttttcatctgagccgctgccgccgcacggcgcgggcgaccacgacctggcgtacatcctctacacgtcaggctccacgggaacgcccaagggcgtgtgcatcagccagcggaacgcgatggccttcatcgagtggtgccatgcgctcctgggcaccacaccggaggaccgcttcagcaaccacgcgccgttcttcttcgacctctcggtgctggacctgtatgcggccttcatgggcggcgcgtccgtcacgctcatcccggaggcgctggccttcgcgccggagaagctggtggagctggtcctccgcgagcggttcacctgttggtactcggtgccgtcggcgctgatgctgatgatgcaggaaggcggcctgctgaagcatggggcgctgcccttccgcgccgtgctcttcgccggcgagccgttccccatccggcacctgcgcccgcttcgtgagcacctgccacaggcgcggttcttcaacctctatggacccacggagaccaacgtctgcaccttccatgaggtgacggacatttcgccccaccgcaccgagccggtgcccattggccgagcgagctgtggcaaccgcgtgtggttggcccggccgccgccgggctcagaggaagcgcgggaggaaggcgacggcgtgggcgagctgatggtggaaggccccacggtgatgctgggctactggggccagccccgccatgggagcgggccgtatgccacgggggaccgctgccgcgaggtgccggacggcacgttcgaatacctgggccgccgcgacaacatgctgaaggtgcgcgggcgccgcatcgaagcgggcgaaatcgaagcggcgctgctcacgcacccggacatccgcgaggcaggcgtgattgccaccggctccggcctggaagcgcggctggtggccttcgtggtcagcggcgccagcaagcccccttccctgctcaaggtgaagaagcactgcgcggagcggttgcctcgctacatgattgtcgacgaggtccgcgtgctgcccgagctgccccggactcccaacggcaagctcaaccggcgcgcgctcagggaactgacgcaggcgccttga

SEQ ID NO: 3646 - DNA, 2826 bp, Myxococcus xanthus
atgacggagatccagcaggcctacagcgtgggccggcaggccgagctcgagatgaacgcggcgatgcacgcgtacaacgagattgactgccacgcgctcgacctggcccgcttcgaggacgcctggaacctgctcatcgcccgccacgagatgcttcgggtggtggcgctcccgggcttccagcagcgcatcctccccgacgtgccgcgctacgtcctgcccgtggaggacctgcgcgggcgcgaacaggaggagacggaggctcgcttccaggccatccgcgagcggctgtcgcagcaggtgctggcgctcgaccagtggccgttgttcgagctccgcgtgtgccagctcgacgggggccgctcgcgcctcttcatgagcatcgatggaaccttcatcgatggttacagcttccagattctctaccgggagctcgtccacctctacaaacacctgggcggggcgcccgcgcttccccaactggacctgtccttccgggactacgcgctggcggtgcagcatgcgcgcggtgctcgtcatgcgcgttcgctcgagtactggcgctcccgccttccgaacctcccgcccgcgccggacctcccgctggacaaggacccgggttcgctccggcgtcctcgtttcgggcgcgtgttcgaacggctggggccggatatctggcagccgctcaagcagcgagcccgcgcgcgcaagctgacggagccggagctgctgctggcggcgtacgcggaggtcatggcgcgctggagccgcagccctcgcttcacgctcaacgtcccgcacttcaaccggctgccccttcatccccaggtcaacgagattgtcggcaccttcgccagcttcacgctgattgaggtggaccaccggccggagcggacgttcacggagcgggcccttgccatccgggaccagctcttcctggcgctggagcaccgtgaggtcagcggcgtcgagctgctgcgggagctgttcagggcccaggggcgtatcgcgggcgccatcatgccggtggtgatgacgagcttcgcgtctcactccaagagcaaggactcgcactgggtcgacttcctggcggaggagttcggcgagctcatcgaggcgctgacgcagacgccccaggtgtggatcgacctgcagattgtctaccagcggggcggcgtcttcctgaactgggacgtggcggaggagctgttcccgtccggcatgattgaagacatgttctccagcttctgcgcgctgctacggcgcctggcggaggacgacgccgcgtgggaccagcaggggctggacacccgtccggtccggcaggtggaactgctggcccgcgtcaacgacacggcgcgcccgcggagcggggagctgctccacacgggcttctaccgccacgccgcggcacgcccggacgccctggcgctggcctcgtcgagcgtcaggctgagctatggcgagctcgcccggcgctccagccggctcggacatgcgctgcgcgagcgtggcgccgcgcccaaccgcatcgtcgcgattgtgatggagaaggggtgggagcaggtcgtggccgcgctgggggttctcagctcgggagcggcgtacctgcccatcgacgcggggctgccgcacgagcggcgcgtcttcatgatgcggaacggcggggccgagctggcggtgacgcagccgaagttcgcccaggagtcctggcccgaaggggtgcaggtgctggtcgtcacgccggacgccttcagtgagtacagcgaggcgccactggcgcccgtgcagaagcccgaggacctggcgcacatcctctacacctccggctccacgggccagcccaacggggccatgctcacccacgccgggatggtcaatggcgtggagtggacgaaccggaagttcggcgtcgggccggaagaccgcgtcatcgcgctcagcgcgctccaccacgacttctccgtctacgacgtcttcggcaccctgagcgcgggcgcggccctggtcatgccggacgcctcctcgcgcagggacccctcccactgggccgagctgatgtcccgtcatggcgtctccatctggagcaccgtgccggcgatgatggagatgctgctgacgtatctcgaaggcagcaacgcccggctgacctgcccgttgcgtctggtgatgctcggaggagattggctccccgtcaccatgcccgcacggctgcgggcgaagttcggcgacgtgaagctgatgagcgtcggcggcccgacggagacgtccctgtggaacatctcccatccggtcgtcgaagccgacgagcggcgccgcagcattccgtacggaaagcccatctcgaacacgaagtactacgtgctggacgagcacctggacgagcgtcccatctgggtgcccggcgagctgtgctgcgcgggcgtgggcgtggcgctgggctacgtgggcgcgggagcgggctcgaagaagttcaccgtgcaccctcggacgggtgagcgcctctaccgcacgggggaccaggcccgcttcctgccggacggcacgctggagttcctcggacgccgtgatggacaggtgaagctgcgcggctatcgcatcgagctgggcgaaatcgaagccaccctccgccagcacgcgtccgtgcgggacgcggtcgtcatcgtgcgcgaagacttccctggggaccagcggctggccgcctacgtcatcccgcacgcagacacggcagcggatacggccggcgtgcgcgccttcctccaacagcggctgcccgagcacatggtgcccgccgccctggtcgcgctggagaccctgccgctcaca

SEQ ID NO: 3647 - DNA, 4245 bp, Myxococcus xanthus
atggcggagttgtcgccactccagcaggcgttgctgaccatcgagaagctgcagaagaagctggccacggcctcgaatggtgagcgggaaccgattgccatcatcggcatggcctgccgctttccggggggcgccaccagccccgcgaagttccgtgacctgctgtggggggcacgggaggcgctgacggagattcccagcgaccggcaggcgctccaggggctctatgacccggacccctccaggcccgggaagctggccatgcgccgcgccggcttcgtggacgaggtggaccggttcgacgcggagttcttccacatctcccggcgtgaagccgagggcatggacccgcagcagcgcttcttcctggaggtgagctgggaggccctggaggacgctggcattcccccacaccagctccaggggacgcggaccggtgtcttcgcgggcgtccacgcgaaggactacgcgttcgtcacggggggcgggctggagaaggtgagcgcccactactccacgggtgtggacgccagctatgtggcgggccggctgtcgtacctcctcgggctcgaagggccgagcatggcggtggacaccgcgtgctcgtcctctttgtccgctgtgcacctggcgtgtcagagcctgcggacagaagagtcgacgctcgccatcgccggaggcgtgaagctcatcctggcgccgcaactcagcgtgttcctgtccaaggcgggagccctctcccccagcggccattgccgcacgttcgaccgggacgcggacggcatggtgcagggggagggctgtggcgtggtcgtcctgaagcggctgcgggacgccgttcgggatggtgaccgcatcctcgcgaccttgcgtggcacgggcatgaaccacgacggcgccagcggtggtctcacggtgccgaacgtcggggcacaggaagcgctgtaccggcgcgtgttgcagcgcgcgggcatcgagcccgggcaggtggactacctggaagcgcacgggacgggaacgcggctgggagatcccatcgagctggacggcgtgtcgcgcgtctacggcgcagcgcggacttcggagcgcccgctgtggattggctccgtcaagccgaacatcggtcacacggaggccgcggccggcatcgcgggactcatcaaggccgtcctggtgctccaggcgggcgaggtgcctccctccatcaacttcgagcacccgaccccggagttcgcgtgggagggctcagggctcgcggtgcctcgagcgcgcacggccctggcggagaaggacggccctcatcgcgtcgccgtgagctcgtttgggatgagcggtgtgaacgcgcatgcgctcgtcgaggcgtacgcggaggccgcccatgccgccgtggacgccgggccgtatgtgttgcccctctccgcgcgctcggagcccgcgctgcgcacactggcggcgtcatggctccagtacgtgtcggaggccggtcctggggcgcggctccaggatgcgtgcttcatggcgggcgctggacgctcacaccatgcgcaccgtgcggtgctcgtggcgaggacgcccgaggcgcttcgagcggcccttcacgctgtcacggagggacgcgatgcgccgggtgtcaatcgaggttcaggcgagggcgagcccgtcttcctcttcggtggcacggagcccgaggccagccggttgatgcgtgagctgctgggccgggacgtcttccgcgcccacgcggagaaggtggatgcggtcttccggcaggtggcaggtgggtccgtcatcgaacaggtggcgggagcgcaggcgggcgaaggacacccggtgggcactctcctcgtgctccagctcgcattggcggagctctggcgcgcgtgcggtctgacccccgcagctgtttccggcttcggcgtgggagcgctctccgcgggagtggtcgcgggagcactcagcgtggaagacgccgtgcggctcgccttgcagttgacgccagcgcagcccgtgcgtcctcaacccgtgaagtacccattcttctccaccgtcgatggcgcctgggtcgaagcgggcgccacggtaccgggcgcgtactgggagagacagcgcgccgcggtgatcgacccggcgtcgtccgtggcgaacctgtgtgcgcggaacgcctcggctttcatccaggtctcttgtgaggcttccgttggggcggcgttggaggccactgcacgcagccgtggaagcaaggccgtcatcctgcgtgccagcaggcccggagatgatgcctggacgggtgtcctgggcgtcatcgcgggtgggtactcctcgggtggctccattcgtttcgaggggctcttcacgggggcgcgcaagacggtggtgccgacgtacccgtggcagcgtgagcgctactggtgggacggagcggtcgctccagcaccgagcagcgtgcagcccgtccgggatgcatccccccgggacctcttctgcgaactcacgtggcatgcgcgtacggtggggcaggggcccgtggacgcggagggccgctggctcatcgtgagcacgcagccggctgcctcggagtcgctgcggcaatccctgtccaccgccggaggcacggtgcgcgtggccatcgtgggctccgagcaggcgtcggtgctccgggagtggctgtccgagagcccggcgccccgaggcgtcatctacctgtcgggttcggagcatcccgaatcactggaagggctgcacacatcggttcagcgagaggtccacgcggcggcgtcgctcgtgcagaccctggcgcggcactcggcgccaacgctgcctcggctgttcctcgtcacccagggctcgcaagccgctgacggagcggctggacccacggcgattgctggcgcgccactgtggggcctgggacgggttgtcgcctacgagcacccggagcttgcctgcaagcgcatcgacatcgaacccgcggccttcggtgcgctggtgacggagctggcgcgcaaggtctctgcttccgctgacgacgacgaggtcgtgctgcgcggcgagcagcggctggtgccctcgctcacgcagacccaaacgattccggaaggcacgggagcgtttcgtccccggcaagaccgcacgtatctgattacgggcgggctcggtggaatcggactgcggctcgcctcctggctggtggagcgcggcgcgcggcaccttgccctctgtggaagaaaaggtgagaccgacgaggcccgccaggccctggcgccgctgcgtgcggcgggcgcgcgggtggagaccttccgcgtcgatgtgagccgcccggagtcggtggcggagatgctggctgccgtccgccgaggcggagcgccgctggggggcatcttccacagcgcgggtgtgctggcggacagctcgttgttgcagtgggagccccagggcttcgagacggtcatgggccccaaggtcgacggtgcgtggaacctccatgcgctggccaccgacaccaccctcgagcacttcgtcctgttctcctcgacggcgtcgctgattggctcgccggggcaggccagctatgccgcggccaatgcattcctcgatgcgttggcgcacttccgtcgcgcacggggtctgccggccatcagtctcaactgggggagctggggcgaggtcggcatggccgtcgcggatgctcggcgtggcgaccggctggcggagcggggcatgtcgcccatgtccgtggatgaagccctggcggccatggcgctggtgctcgcggagaaccgcgtcacccggggcatcgcgcgcttcgatgtgacgcgttggactgccagccatccttccatcgtggcttcgtcgctgttccggaccgagtccgtcaccgatgccgtccctgacgtcatggaggcgccgcgcaagctgcgcgaggtgttgctcgcgttggaaggctccgctcgccgcggcgtcctggaggcgcggctcaaggagatgatcagcgaggttggaaagattccgacgacgaagctctcgtccacggactcgttcgacgcgctggggttcgactccatcatggcgctcgagttgcgggacatggtgctgggcgaactcgacgtgagcatgcctctcaagagtttcgttgatgaaagttccattgagcaggtgacggctgagcttctcggaaagctcgctgtggccagtgtgctcggcgctgcctcctcggagcgcgatgattcgaagcgggtcctgctatga

SEQ ID NO: 3648 - DNA, 2211 bp, Myxococcus xanthus
atgttgtgtgaacccattgctgtgattggactgggcctgcgtctgcccatgtcggactgcccgcgtacgctctggcaaatgctatgtgatgggattgatgcgacgggggacatcccggccgggcgctggcctttgtcttcgctcttcgacgcggcacctgatcgccctgggacgattcgcaaccgcaaggccggactgattgaaggcgtggagctggccgaccccgcggcgttccggctgacgaagcgggagctgcggcagatggacccgcagcaccgtctcctcttcgagtgtgcatggcatgcgctggaggatgcgggcctgcccttcgacgccgtgcgagggagccgcacgggcgtcttcatgggcgtcaacttcagcgacttccagcggatgctggcgagggactggtcctcgctggatggctattccgtcctgggaacgacggcgtccttcgcggccaaccggctctcctacgcctttgatttccggggacccagcaccgtgtcgagcgtggggtgtgcctcctcgacggtggccctccatgaggcgtgccgcagcttgacgctgggcgaggtggagatggccctcgccgggggcgtcgagctgatgctgtctccggacagcagcatcatgctgtcccaggccggcgtgttctccgagcgggggcagtgccggaccctggatgcgcaggcggacggctacgtgcgcggggagggcgctggcgtcgtcgtcctcaagcgcctgtccaaggttgagcccggtgaccgcgtgtacgcggtgattcggggcagcgccgtcaatcacaacggccggaacgagtggatcatggcgcccagcgcctcggcgcaggcggacgtcatccggcaggcgtgtgagcagggcggggtggctccggcgagcatcgactacatcgagatgcacggctcgtcgttcctcaagggcgacgcggccgaagcggaggccatcggggaggcgctcgggacgcagcggccggtgccctgcaggctcggcgccatcagcaacaacgtgggttacctgggcgccgcggcgggcatcgcgcagttcatcaaggtgtgcctgtcgctgcaccaccggacgttggcgccgacgattcacgtggatgcgcccaacccgctggtttcgttcgacgcgctcgggctgagcatccagacggagctggagccctgggccgcgcgggagcctggcgtgccgctgcgagcgggcatcgtctccacgtccctgggcggtgccaacggcttcgtggtcctggaggcagctccggctgcggtgctggagcggacgcccgcgccggtccatttcctggcgctctcggcgctctctcaggacgcgctccgtcagcgggcgctccagcttcgggacttcctcgccacgacgccggactcggtggcgacgctggaggacgtctgcttcacggcggcgctcaagcgtcagcaccaccggcaccgtgccgtggtgattgcgggcgaccgggctgggctcgtggcgctcctggattcgctcgcgacgtcgagtgggacggcgctcctggttcaggagggcatgccgctggagcaggtggaggccgggcgtgtcttcgtcgcggatgggacggtgccgcccgaggtgttcccggtgcgtgcagggcgctgcgtgagcctgccggtctaccccttccagcgtcagcgcctgtggcccgagtggctttcacccgatgaagtctgccgctcacccaaggacgcgcggccggacgccgccaccctgcttcaggccgccgcggtggccgccggggatgcttcccgcgttcccgacgtgcatggggaggcccagatgcgggcgttcctgcgggggcacctcgcggacgtgctggaggtcgagcccgcgacgctcgatgtgcaggggcggaccttcttcgaactgggcctgaactccattggggccacgttgttgaaggagcgcatctcgcgggcgctcgagctcccgctgtcgacgacgctcttcttcgagctgccccggctggagtcgctggcgaagcggctgctgtccctgctggaggcgcggcgtggccgcctgccgtcggacccgggcgaggtgagtacgcccgagcaggaggagcagggcctgatggaacgcattgccgggctgtccgaggacgaagcgcgcgagcagatcgcccggacgttggccgaactcagcctcgaggtcgcgtga

SEQ ID NO: 3649 - DNA, 1398 bp, Myxococcus xanthus
gagtccaaaccacaagacgccgctcccgcgggcggcaacaccttcgaggcctggaaggccaacgccttcgtcgagacggccaaggacccgctctccacgttcgccgcggacgtagacaccgcgtcgtacacggtgtcacgccgttacctcgtcaacggccagctcccgcccgcctccgccgtccgcgtggaggagttcgtcaactacttcaagttccgctacgcgcccccggagacgggcgccttcgcggtgcatctggagggcgcgccctcgcccttcgacgccaagcgccacttcctgcgcgtgggcgtgcagggcaaggtggtctcgcgctcgcagcgcaagcccgcgcacctcgtgttcctcgtggacacgagcggctccatgcactcggaggacaagctgccgctcgcgagggaggccatcaaggtcgccgtcaagaacctcaacgagaacgacaccgtcgccatcgtcacctacgcgggcaacacccgggacgtgctgccgccgacgcccgccaccgacgcgaagagcatccacgccgcgctcgactcgctcacggccggtggtggcacggcgatgggctccggcatggaactggcctaccgccacgccgtgaagaaggcctccggcagcgtggtgtcccgcgtcgtcgtcctcaccgacggtgacgccaacatcggccggaacgtgagcgccaacgccatgctggacagcatccacaagtacacggccgagggcgtcaccctcaccaccgtgggcttcggcatgggcaactaccgcgacgacctgatggagaagctcgcggacaagggcaacggcaactgcttctacgtggacagcctgcgcgaggcgaagaaggtgttcgagactcagctcaccggcacgctggaggtcatcgccaaggacgtgaagttccaggtggagttcaaccccgccgccgtccgccgctaccggctggtgggctatgagaaccgcgacgtcgctgaccacgacttccgcaacgacaaggtggacgcgggcgagattggcgccggccacaacgtcaccgccgtgtacgaggtggagctgacgggtgaagccaccgaggcgctggccaccgtccgcgtccgcgccaaggcgcccaacggcaccgaggcctccgagcgcgaattccgcttcgagcgcacgaagctgcgtgacacgctggcgcaggcgtcgccggacttccgcttcgccgtcgccgtggccgccaccgccgacgtcctccgcgacagcccctccgcggagggttggagcctggccacggccgagaagctggccgagggcgccaccgagggtgacgccgaccgcaaggagttcgtgcggctggtgacgcaggcccgcgccctcaagggcgcctccgtccggggccgctga

SEQ ID NO: 3650 - DNA, 1836 bp, Myxococcus xanthus
atgctgggcgtggaaggcaatcgctggattgtgtccttgttcggctacgaaggacaccacccgccccgcgacgaggacggattcgtggagttcgcccgcagcctccgcgagccggacatctacgaagccatcaaggacgcgaagcccgtctcggacgtcggggtgtaccgggtgccggacgtgagatggcgccacttcgagcgcatccgggacttccccgcggggttgctcgtcctgggggatgcgtggtgctacttcgaccctgtcttcggccagggcatgtcggtggcgatgctggaggcgaacctcctcaacgaggcgctgcaccaactcgacagcctggaggcggtgacccaggcctggacggcgtcctacctccgcacgggcgcgcagtggctccagggcctctggttcttcgtgacggcggaggccatgcggcatccccacgtccccggtgagcggacgcggctcatcaagctggcccagtggtacgtcgaggagctctacgcgctgaaccacgagcatccggagatctaccaggagttcctcaagctgatgcacgtccaggcggggccggagttcctcctgcgcccggacatcgccttgaggctcgcgaagcgcgcctggcagcagaagtccgagaagggcttgggcaccgaggcactgtggcccgccagccgggtggcgctgggagcgcgctacgcgggacggatgctggccaacctggtggttcctcaacgggtcggcccgcgtgatcgcatctgccacttcgacacggaagtgctgtggaagccggacaagacgctggggtggttcgtccgggatgccctgcgcgcccaaggtctgctgagcgaggcctccgaggtgcggcggttcctggagtactggctcccggtgcagggcctgggcatcgcgaagaaggcgttgattgagttctcctataacgcggacgagcccggcctgggcttcatgctctacggcgacaatgggacggtcacgcgggccttccgggagtacacgcggcagctcggcatcaccaacgagggcgtcgagcggtccgtggccatctgcgagacgttccggccttcggacctgggcctggtgcgcgcggagttcaagcccggaggccccacccggtattccattgccgccagctggcacttcgaccccatgcgcgggcactccggtttcgatgaggcgatgagccgcctgccggagcgcttccgggcagggcccttcgcggagcgggtgaagacccatgcttccgcgctgcggaccgaatactacccgctgttcctggggttgagcttcctggaggacggaacactcgaatccaagatgtacctggtgcgcttcgacgcgaatcggcctccattccagcctggctcggagctgtggcgcttcctccaggaaatgggtgtgtccgccccggagctggagcgggttcgccagctgaacgcgctgctctgggagcactccgcggataagatgacccaggtcgccatcgaggcctccgagttccaatcccagcccaagcgcgtcaacctcatctactgcgggatccagacctctgtggttctggaagccatctcccggttcgggtatcccgtgtcctcgaagcaatccgttcgggacttcgagcggatgatgcagaccgatcgcgcgaagttcgtcgcggtgcgggtggggcccgaaggattgagtccgcgtctcaagctgtacaagcacgccctttttgattttggcgatctgtccgtggtggaggacggaggcctcgggccgcgtgatgccacgccggccgcagtgaaagacgtttcggacgtatgtctttattga

SEQ ID NO: 3651 - DNA, 1059 bp, Myxococcus xanthus
atgaacatgtattcgaaggcggactacgccatcacgccgcagccgtccttcaccgcggacgggcgggtggtgcctgacgtgttcacggagccgctccacctgcgcaagccgctcgtcgaggcgctggggaacttccccgcgtatgactactggggaccccgctacagcatccgctcctcggagtggatcgccgacgtcgccatgtggctggagcagcggcacagccccacgctctcactcgtcttccttccgcacctggactacacgccgcacacgtttggaccgaacgcgaaggagatccacaagagcctccgggagatcgacgacgtcgtcgggaagctgattggcttctacgagtcgcgcggcgtgcgcgtcatcatcctctcggagttcggcgcggtccccgtgtcccgggccgtccacctgaaccgcctcttccgccgccgagggtggctggcgatccgggaagagggcggccgtgacgtcgtctatcccagcggcagtgaggcgttcgccgtcgcggacatgcaaatcgcgcacatctatgtccggaacccggcgctcctggacgaggtcaaggcgctggtcgaggcggagcccggggtggcccaggtgctcgatgccgagggcaagcgcgcccaccatctggaccacccacgctcgggcgagctggtggccctggcggaaccggatgcctggttcacgtacttctactggctcgatgacgcgcgtgcgccggactacgcgcgcaccgtcgatatctaccgcaagccgggctacgacccgctggagatgttcgtggacccgaagctgggtctgcgcatgctggaactggggggcagtgtcgtgaaggagaagctgggcgtacgctcgcgactggaggtcgtctcgatggacggctccctcctcaaaggggcgcatggcctgcccaccggcccggaggatgggccggtgctgatgacacgacatggcgagctgatcgaggcagagacactccacgctacgcaagtccacgacctcatcctggcgcacctgaccggacagcaggcggcggcctga

SEQ ID NO: 3652 - DNA, 1611 bp, Myxococcus xanthus
gggacgcacgtgggcaccacgcaggggtacctccacgcgctgggcacgggctccttccgcacgggggatgacccctgcacgccaggccgcgtggagtaccagggctacttcggccgggccggcaactgcgccagtggccaggactacggcgcgggcaacgagctgttcgcctacctgcccttcaagatgctgccctactacgtggagaactaccgccgcgccaatgacgcgtactccaccgagcgcgccacgatggacgccacgccctccgtggcggacgtggacctgcggagcgatgactaccgcccggacaccggccatgaccctcgggagaccgacgaggcctggcgtccccgccccccccggaacgaaggcgcgaagacggtgctggccagcgccacaggccccaagcagagcatcttcttcgcgctcgacgtcaccaaccccacggactcgagctaccccacgcccttgtgggagttcgacatgaagcgggaccgcttcacgtcagcgggcattccatgcacgagcagcggcaacggctgcaacccactgccggcgctcttcaccggcgccacgcccaagcccgacacacgcggttcgcgccatgccccctcactggtgcgcatggacttcggccaggcgggcggcaagaagtgggtgtccatgttcggcacggactactcgcctgagtccggcacggtgggcaccgtctacctgatggacctcaagacgggcctgcccgcgcaggtgacgggcaacagcgcgaaggcgcggctggcgggcgtcgtcacgctgggcaccaccgcggacgcaaatgaaggcatcggcggagagcccatcccgctggacgtgaatggcgacggcaacgtcgacgtcatctacgtcccgtccacctcggggaagatctaccgcatcaaccccacctactcgaacaccgggacgaacacaccgctgggcaaggtgctggcctcctgtgtcgtcgcggacgcgcaggccgtgcccggcatccgcaaccccaccagccagcgcatctactccaccatctccgcgtcggtggtgcctgacagcggctcccgccgggtgcggctgtacttcggcaccgccaacaacccggacatcgccaacgagccggacgacaccgccaatccgcggccccgctatcacctgatggccttcgaggaccgcgacccggtgcccgccacgcgtccaggcgccaactgccccgcgcacctcgaatggacacgcgagctgggcgagggccaggtcgtctggggcggcgtctccaccacccaggatggcgtcttcaccaccagcgccgtgggccgcgccgccagcgcgtgcgacctggacagcaccaccagcggcagggtctacgcctacagcacctcgggtaatgcgctcgcgggcaacgacacccccatcgacggacacggcacgcacgcgcccgtgctctatgacaatcacctgctcatcgtgaagaacggtcaggtgcgcgcgctggggaacgggacgtacaacaaccccaccgcggagtcgccgcgaagcagctcccgggtcctcatctgggacgtgcagtccggctcacgcgtccaggaggtggtgccatga

SEQ ID NO: 3653 - DNA, 537 bp, Myxococcus xanthus
atgaaccggcgcaggttccacacccatccgcgcggcctcagcatcctggagaccatcgccaccgccgcggtgctcatgctcggcatcctgggcatcatgctcacgctgggcgccgcgtcccgtcacaaccgccgcaacaacaacctgagccaggcgagcctcatcgccgaacaggaactggagcgcgtggtcaacctccgctgcgtgggcgagccgctgaacgacccctgcgtcaacatcaagcagctcgacaacacgaggcgcgacgtgtggtggtccgccaatggccgcatgacggagacgccgccccttccgggcgcgacgccgcaaatggcctacacgctgacgctggacgtggacccacccttcgagggcgccgagacaggcgagcccgcgctgaaccgcgccatcccgcttccccacgccagcaacctggccctgcaccaggtcgtcaacgtccgcgtcaccgtgagctggatggaagagcccggtgcgccccgccgcgcggtggccctgcagacccggatggcgccatga

SEQ ID NO: 3654 - DNA, 1206 bp, Myxococcus xanthus
atgaagcaacttcgttcgacgacgccgcgcggcttcacgctcatcgagctgatggtggccgcatcgatgtccatggtggtgctcgccaccgccattggcgtgagcgtccatctccagcgccggggcctgctggaagagcgcatcatggagacacagaacaagggccgggccgcgcgtgacttgatggcgttcggcgtgcaacgggcgggcgcgggcatcggcagcgtctccctcaccggcggccggactcccgccggcgaagcagacctgttctacgccgtgtgggcccggccccaggccaccttcccggatgacgccaccttcgtcccacccaccaacgccgcgctgctgtcggatgccctggaggtctgggagacggacccggcgcgcatggtgctgctggagcagtgtcccttgcctgcgaccgcgtcctggttcgaggacacgctgtgcgtcggaggcctgccgcccgcctttctggacaacgcggtcatcgccgtcgtgttcccgggcacgaaagacgagcggggctgggcctgcgtggggcaggtgacgaacctcgttgcggaaggcgtggagtggacgcccgccatcccaggccggcccgcgcccgccgacggcaactgtcatcccgatgccgtgacgcttcccgagtcgccctggcttggcacacgggaaccgcgcgaagggggcatgtacctgctcccgctcaccagccgcagctaccgggtgaactggcccggcggcacgcccgtgctggagatggacgcggatgggcccatggggcccgcgggctacaccgcggtgtcccaggacatcgagcagttacaggtccggctgggcgtgaatgcacccaacgcgctccccggcgcccccgtacgcttcttcccggacgcggagaccgggcgcccctcgctggccacctgcacccaggccacctgcgccgcgcacatctcctgggcctgggatgcgggtgtgcccgttccgccggaccgcggcccgggcagcgcgggtgacgagctgatgcggcacatgcgcgtggtggagctgtccatcaccgcgcgctcgcagcgcgccgagctgacggggaacgaagcacccggagcgcgagacgacgaaggcaacctccgggatggctacaagcgccggcacagcgtcatccgcctggcgcctcgcaacttcgcgttcgtgggaacggggggctga

SEQ ID NO: 3655 - DNA, 624 bp, Myxococcus xanthus
atgacgctgctggaggtgatggtcgtggtggccctggttggcctcttcgccaccctctccgtgtccagcttccagggcatgacggagcgccagcgcctcagcgccgcgcagcgcgagttggtgctgatgatgcaggaggcccgtcagaaagcacgcgcgacccaccagcccgtgcggctgggcacgcgcgtcatggatgagcagggcgtccaggtgacgcgcatgcgctgggaggcactggcatgcagtgatgcctggggcacggtgtgtcccatgcccgcgtgccaggagaacgcctgcggcgtgggcggctgcgaatgcgcggagctggggccggagctggtcatcccgccgaagctcgacgtggagctgctggtgggcctgtgctggctgggcaaccccagcgccggcgcgcccgtcgtggctccgccggcgcccggcggaagggtgtgcgaacagaacgccccgctgcccccgacggagcggctcatcctcctgcgcaacagggggacgctcgaagcgccggactggaaaccggagctggtattccaggcggatggcctgacggcggccatacgccccttggattgtgacaagcacgcctccacgccaggctgccaatag

SEQ ID NO: 3656 - DNA, 321 bp, Myxococcus xanthus
atgaagcggctggtcctgagcctgggtggagccaccggcgcccacgcggacgccgtggccgacgtgtggaaggcgaagtgcaccgtgtgtcacggcggtgacggcaaggcgcagacgaagatgggccagaaggagtccatcggcgacatgagccggcccgcctggcagcagtcccggacggacgccgacatccgcaaggtgattgccgacggcgatccgcggaacagcaagatgaagcccttcaaggacaagcttaccccagcgcagattgacgcactggtgggatacatccgcaccatgaaggcgccgacggccccttga

SEQ ID NO: 3657 - DNA, 318 bp, Myxococcus xanthus
atgaagaacctcaccgttgccgttgtcttctgcctctccatggccagcctgttcacctccctgcgcgcggacgcgctctcgtcggtgcacatcgagaaggggctgtccccggcgcagtcgctgtccctccgcccggatgacggcaagggcggcggtgacgacaagggcgacaagggcggcggtgaggaggacgaggaggagtaccgcaagcgccgctacgccggcctgtcccagaaggcggcgatggagctggtggacccgggcgcgctgacggacgtcatccgcctgcaggccgccgtgaagttcggccagcgctag

SEQ ID NO: 3658 - DNA, 3595 bp, Myxococcus xanthus
attaccctggggccctcagggtccactcatggacactcccttcatacagacgcaggacggcggcgcggcgggcgaccccttcgcccaggtggttgacgaacttcgggcggggcagcgcgtccggacgcaagggctcaagggggcggcgcgcggacatgtgctcgcccgcctgcatggcgcgctgagagcgccgctggtctgcgtggcggtggacgaggaggccgccgacgcgctcgccgccgacctgtccttcttcctgggcggccagggcagcctgctggcgccgcgcgtgctgcggctgcccgcggacgaggtgctgccctacgacgaggtgtctcccgacgcggcggccgtcacggagcggctgggcgccctcttccatctggggcagggcacgcgcttccccgcgctggtgctgtcggtgcgcgcgctgcaccgcaaggtgctgccgctggcggtgatgcgcgcgctggccgcgcgggtggccgtggggcaggacttcgaccgggactcgctggcgcgccggctggtgcgcatgggctaccagaacagccccttggtggaggacgtgggcacgttcagcgtgcgcggtgacctgctggacgtcttcagccccctctacgacaagcccgtccgcctggagttcttcggcgacaccatcgagtccatccgcgccttcgacccgcagtcccagcgcacggtggacgcgctgaaggaagtggacctggtccccgcgcgcgaggtgctgctcaccgacgagacgcgcccgcgcgccgagtccgccgcccgcgcggtggccgaccgcatcaacctgcccaccatcaagctgcgcgagcagttggacgccctgcgcgaaggcctgcccggcttcgggatggagggcctgctgcccggcttcttcgaggacgggctgtccacggtgttcgacttcctgcgcgactggagccccgaggcgcccgtcatctacctggacgacccgctgggccaggaccgcgcggcggacacgctgtgggaggagttggagcgctcacacggcgcggccgaggcccggcaggagctcatctgtccgccgctggagcacttcctctcccgtgaggacgtgaaccagcggatgcagtccttccgcgtgctggagggcggtggtctgtcgctggcgcagacggagcgcccgccggtgcacttcagcttcggcggcacccaggacctgcgcgaggccatcctggcgcaccacggtgaagaaggcgcgctgtccccgttggtggagcggctggagcgctggcgcgagctgcgcgtggcctgcgtggtggcgtgcggcacgctgagccaggcggaccggctgaagcggctgctaatggaccgcaacgtgatggtgaaggtccacacggagccgctggaagacgctgtggcgctgtacgagccgtccatccgcgcgcacctcttcacgggcgaggtgagccacggcttcgtggatggtcctggcgggctcgcggtcctggcggacgaggagattttcggcgcgcgcgcgcgccggcgtcccaagcgcagcaagaagctggacgcgttcggctccggcttcggggacctgaaggaaggcgacctcatcgtccataccgacttcggtatcggccgttatgcgggcctgacgaagatggaggtcaacggcgtgcccggggacttcctcgtcctggagtacgcgggccgggacaaaatctacctgccggtgggccgcatgcggctcatccagaagttctccggcggcgaccccacgcaggtgcagctggacaagctgggcaccacgagctgggagaagacgaagaagcgcgtcaaggagcagctgctcaagatggcggcggagctcctccagattgccgccgcgcgcaaggcgcaccccggccatgccttcagcgcgccggaccggtacttcgcccagttcgaagcggacttcgagttcgaggagactccggaccaggccaaggcgattgaagacgtgctggcggacatgcagaagccagagcccatggaccggctcgtctgcggcgacgtcggctacggcaagacggaggtggccatgcgggccgccttcaaggccgcgctggaccgcaagcaggtggcggtgctggtgcccaccacggtgctggcgcagcagcacttcttttccttcaagaagcgcttcgcggactaccccgtcacggtggaggtcatctccgggctgaagaaggcgccggaggtgcgggaaatcctcaagcgcgccaagaagggcaaggtcgacatcttcatcggcacgcacaagctgctgggcggcgaggtgaccttcaaggaactgggcctgatgattgtcgacgaggagcagcgcttcggcgtgaagcagaaggagtcgctgaagaagtggcgctcccagattgacgtgctcacgctgacggccacgcccattccccgcacgctgcacatgagcatgtcgggcgtgcgcgacatgagcatcatcgccacgccgccgcaggaccgccgggccatccgcaccttcgtgatgaagtacgaggacacggtggtgaaggaggcgattgagcgcgaggtggcgcgcggcggacaggtgttcttcgtccacaaccgcgtggagtcgctgccctccatcgagacgcagctgcgcgcgctggttccccaggtcagcatcggcgtggcgcacgggcagatgggcgaagggcagctggagaaggtgatgctcgccttcacggagaagaagtaccaggtgctgctgtgcaccagcatcatcgagagcggcatcgacatctccagcgccaacacgatgattgtgaaccgggcggaccagttcggcctggcgcagctctaccagctccgtggccgagtgggccggtccaaggagcgcgcgtatgcgtacctgctggtgccgtcacggcgcgcggtaacgaaggacgcgcagcggcgcctggaggtgctccagaacttcaccgagctgggcgcgggcttctccatcgccagccatgacctggagattcgcggcgcgggcaacctgctgggcgacaagcagtcgggcgccatcgcagagattggcttcgacatgtacgcgcagctcctggaggaagccgtcgcggagatgcagggccagccgcccaaggtgcaaatcgaacccgacgtcacgctgcccatgccggcgctcatcccggacgactacgtcagcgacgtccaccagcggctcgtcttctacaagcgcttcagccaggccagccacccggacgaagtcacggacctgcgcgccgagctggtggaccggtacggcgaagccccggacgaggtggaccacctgtccgagctgacgctgctgaaaatcgacatgcgcgacctgcgcctacgcgggctggaggtgggcaccacccggctggtggtcacgctgggcgcggacgcgctgctggatggccccaaggtggcggggctggtgcagcgctccaagggcgtctaccgcctcaccccggacatgaagctcatcgcccgcgcgccacagggcgccagtggccaggacctcatctccgaggccaagaaggtgctgagggatttgagccactgcgcactgccgcaggcgtag

SEQ ID NO: 3659 - DNA, 1543 bp, Myxococcus xanthus
gtggctcacaacggcagcatcgggggccacgccgacatgtcatctggccgtggaatcaacaggtgccagggcaccgaaggggacgaacctctttccgaggcggtggtcgtcttgcggagcgtgcgctccgcggtcggcggcatcgtcgacttcgagtgtgtctccgccaacgtgcaggcggagcgctggctcggcggagaagagggcagcctggtgcacaaccggctgctggaggaagcgccgtgggcgtgggacggcggcctcttcagtgcgtgtgtccgcgtggtgacacgccgcgcgccagaaatcgcgcgggtgtctcggcagtcgcccatgggcaccgtgtggctcctggcgcgcgtatccccgtgtgacgatggcgtggtgctcttcctggaggacctcaccgagcgcatggccgcggaagaagccctgcggcgcgaccatgacctgctgcacgccgtcatcgagagcgccaccgacgccatctacgtgaaggacgtgtcgggccggtacatcctcatcaatcccgccaccgcgagcgccttccaccgggccccgcgcgaaatcctgggccgcacggacgcggagctgctgggcgccgaccgggccgcgccgacgctggcgcacgaccgcgaggtgatgagctccgggcacacggccacgtacgaaggggcggaaggcggcccggggacggaccgcatctggcacaccacgaagggcgtgcttcgccgcgagagacggcaccgtgtacggcctgttcgccatctgccgggacgtcaccgcgcggcggcgccaggaactggagcgcgaggaggaggcgcgcttccaggagcgcttcatcggcgtgctgggccacgacctgggcaatccattggccgcggtgcggctgtcctccgcggccctcctggcccgggacacgctgcccccggaggtccggcgcgtggtggctcgcatcgacgggagcgccgagcggatggcgcggctggtgaaacagttgctcgacttcacgcgcgcacgcatggcgggtggcatcccgctgcgtccccatgaggtgtgcatggaggacgtgtgccggcgcatcatctccgagttggagcccgcgcatccggagtgctgcgtccggctggaggtggacggcgagtcacgcggcatctgggacgaggagcgcctgggacaggtgctgtcgaacctgctgggcaacgcgcttcaacacagtccggaggggagctcggtgcgggtgcggctggcggcgaaggactcgctcttccagcgcgtggaggtccacaacggtgggccgcccatccccgagtcgttgcgcccgcggctcttctcaccgttccacggggtgccccccgagccgggtcagccgaagccgaagcaccagggcctggggttggggctctacatcgtgtcgcaaatcgtcacggcgcacggaggctggctggacgtggcgtcgtcggcggacacggggacgtgcttctcggtgacgctgcctcgcgtcacccggccgttgggtgggccgccaggcaagactgcctga

SEQ ID NO: 3660 - DNA, 900 bp, Myxococcus xanthus
atggtccgcagcgccgccagcggcgtgctccgcgagcgcgtccaccgcaacctccgccgcgctggcgaggtgctcgcggtggccaccctggtcaactgggcgtggttccccctgctgcgcgagccccagtggctcttccgcatggacatcctccagtgcgtgggcctgtgcctgctcatcgtcctgccggtggccgcactgctctccgcgcgccccaaggtgctgagcgtcggcgccttcatgctggccatggccacgttcgccgtgtcgcccctgggtgaacaggtggatggcccctgggccacgctgacggagaagtcctccttcgcgcccttcccgctcctgccctggctgggctacgcgtggctgggcgtcttcgcgggaacggtggcgggcgcctggggccgcgccgggctcatcaaagcgctgctggtgctgatggggctgggcttcacgggcgcggtgctcggtgacttcctctacgacctctacccgccccaccgcttcttcgtcgccaatccctccaacgcggcggcgcgcttcggctgggtgagcacggtgctgctcgtgttgacgtggctggaggcccgggttcccgtgaacgcagcgccgtctcggctgcggcgcttcgtggaggtgttcggcacgtcgtcgctgtccgcgtacttcttccacgagatgctgctcttctatcggctgggcggcgtcttctccttccagcgcttctggggagaccgcagtggctggctccagtactgggtgctgacggccgtcatcatcggcctcaccttcgtgctgtgcgtcgccctggaccggctggagcgcgtgctgcggcccgcgctccgtaatctctcgggacggctgttccggcagggccagcacgcccccgccgggcgctga

SEQ ID NO: 3661 - DNA, 1143 bp, Myxococcus xanthus
atgagtgacacgctgcccgcgctgcgggccaccctgacggagttggtggcgatggacaccacgtccttccgccccaacgttccgctcatcgactacgcgcaggcgcgcctggaggccgcgggcttcagcgcggagcgccagaagttcctggacgacgcgggcgtggagaaggtgaacctcgtcgcggtgaagggcggttccggctccggccgcgccgcgctggccctggtggggcactccgactgcgtgccgtacgacgcggcctggacggacgcgctgcggctgacggagaaggacgggcggctctacgcgcgcggcgcgtgtgacacgaagggcttcatcgcctgcgcgctgcacgcggcgttgaacgccgagcagttgaaggccccgctgatggtggtcctcaccgcggacgaggaagtcggcctgacgggcgcgaagaagctggtggaggcgggactgggccgcgcgcggcacgcgattgtcggcgagcccacgcgcctcattccggtgcgcgccaacaagggctactgcctgacggaggtggaggtgcgggggaaggaagggcacagcgcgtacccggactcgggcgcgtcggccatcttccgcgcgggccgcttcctccagcgcctggagcacctggcgctgacggtgctgcgcgaggacctcgacgagggcttccagccgcccttcaccaccgtgaacgtgggcgtcatccagggcggcaaggcgaagaacgtcatccccggcgcctgccgattcgtcgtggagtggcggcccattcccgggcagccgccggagcgcgtgtctcagttgctggagaccatccgccaggagctggtgcgtgacgagcccgccttcgaggcgcagattcgcgtggtgcgcacggaccggggtgtgaatacccgggcgtacgcggaggtggtgcgcttccttgcggaggccagtggcaacgcgccggagacggtgtccttcgggacggaggccccgcagattacggaactgggcccggaggcggtggtgttcggccccggcgacatccgcgtggcgcaccaaacgggcgaatacgtgcccgtggaagacctggtgcgctgcgaggccgtcctggctcgcgccgtggcccacttctgcggcgggcgctga

SEQ ID NO: 3662 - DNA, 1266 bp, Myxococcus xanthus
atggtgctgggaaagcgcgagacgccgacgaagagcaagctgtggatcatccgcatcaccaagagcgccagtaccgcgctgagtcctccgggccgtgagattgattggggatccagccgtgtcgtgggaggacggctgggccacggggaccgcgttaaagacgtcaacgcgggctcgggtgctgtctcttccgaccccatcctcagcgcggaggactgggaggcccgcatcgccgcgccgcggggagagaactccttctacgcgggttcgggtcagggctcgcgggacctggtcatggagtggcgggtgttccgctccatcgcgcccaagctgatgaaggaagagaacgcgcccaagccggtgcaggtggcgacgacgcccagtgcgaacgcgggcgcggaggccatggcctttgaatgtggcctgcccatcctggggctgggcaagcaggtgaagccaggtggcacgttgctgctgggggagatgcacggcacgcaggaagtgccgcgtttcgtggcgcaggcgtcgtgccaggtggcggtggccggcatgccggtgacggtggggctggagctgccgctggagagccagacgcgcgtgggggcgttcctggagagcgcgggggcggaggatgactggctgaagttgatggaggcgccgttctggcgcagcccgtacccggacggccgcagcagcgaggcggtggcaaacatgctggagcagttgcgccagctgcgctcgcgcgggctggacgtggatgtgttcgtcttcgaccacccgacgatgcaggggcaggcgagggagactgcgatggcggcgacggttcggcaccatgtggagtcgggcccggggcgcttccacatcgtcctgtcgggcaacatccactcgcgcacgaagaagggcctgccgtgggacaagtccttccggccgatggggctggtgctgaaggacgagctcgacagcgtggtggcgctggacatggcgtacaacagcgggtcggcgtggatttgcgcggtggaccgcaacggcgtgaaggaccggctggattgcggcgtgcgtgacgcgaaggggcgggacaacggcgaccgcttcttcgtgcacacgtggggcggaacgaacgatgacggctaccacggtgtcttctacgtgggggcggtgaacgcggcggcgcccgcggtgcacaagggcctgggacggcctggggcgggggataactcgctgtctccgttggaggaggccgcgccccaggtggcgtccgttcgctga

SEQ ID NO: 3663 - DNA, 1389 bp, Myxococcus xanthus
gtgagcgacatcactgtctatcagccggagctcctgtacacgggcggccggttccacgaagggcgcgggctcgcggtgagcgccgacggccgcatcctggccccggaatgcgtccccgcgggcgcgcgcaccgtcgcgctgccgggaagggccttgctgccggggctcgtcaacggacactcccacgcgttccagcggctcatccgcgggcgtacggagtacgtggcatcgggccgggaggcggacgacttctggagttggcgcgaggcgatgtaccgcgctgccgagtcgctgagcccggaggacctctacgtcgcctcgcggcaggccttcgtggagatggcgctcgcgggcatcaccaccgtgggggagttccactacgtccaccaccagtccgacggcacgccgtacgcggaccgcaacacgttggcgcacgcggtgattcgcgccgcgcgggatgtggggttgcgcatctgcctgctgcgcgtggggtacgcccgtgcgggcttcggcgtggcggcgaatccgcggcagcgccgcttcatcgacccggacgtggagacgttcctgggttcggttgaggcgctggcccgcgaggtgcgcgccgacggggcggtcagcgtggggctcgcgccgcacagcgtgcgcgcggtgcctcgggagtggctggcggcgctcgcgagtgcgtccgtgcggagcctgcccgtccacatgcacgtggcggagcagccgaaggaaatcgaagcctgtctggcggagcatggccgcaggccggtggagttgctggcggacctgggcctgctggggcccggcttcacggcggtccacggggtgcacctgacggacgaggaggtgtcgctgttgggccgggccgaggccacggtgtgcgcgtgtccttccacggagcggaacctgggcgacggcatcgtccccgcggatgcgctggtgacggcgggcgcgcgcatcagcctgggctcggacagccaggccacggtggacctgctggatgaggcgcgacagctggaagggcacctgcggctgtctcggctgcggcgcgccgtgctggacccgggcgggggcgccatggatgggctggcggcgcggctgctggacatggccaccgtggacggcgcgcggagtctggggctcgccactggcgccctggaggcgggcgcgcccgcggacttcttcacggtggacctgcaccatccgtcgctcgtgggcgctttgccggcatcgctgctgcccgccatcgtgctgggcgcggagaaggcggcggtgcgcgatgtggtggtgggcggacgcgaggtcgtccgtgagggcaggcatgcgctcgcggaggagagtggccgcgcgttccaggtgttgtctcgcgcgctgtacgcctga

SEQ ID NO: 3664 - DNA, 1446 bp, Myxococcus xanthus
atgacgggctgtgcccatcaggctggcacctatagcgacctcttcatcccggatggggaggccatctacgagcggccggtggaggagatgtggccggaggtgcgccagtacttcacggaggccaacctgcccttccgcgaagaccggggcagcatggtgctggagacggagtggcgccaggagttcggtggctcgaaggtgtccggcttcttccaccgctacatggtgatgggcaagcgcgaatcccccacccagagcaagctgtggatcatccgcatcaccaagagccgcaacaaggcgctggccccggcgggccgtgagctggactggggagtggcgcgcgtcatcggtgaccaggggggaggtggctccgcggccccgggcctctccgtggaggattgggaggatcggctggatgcgccggtgggggagaactccttcttcgcggagtccgggcaggggtcgcgggacctggtcatggagtggcgggtgttccgcaccatctctcccaagctgatgaaggaggagaacgcgcccaagccggtgaaggtggcgatggcgcctgacgcggagggaagcgcggcggccatggacttcgaatgcggcctgccgattctgggcctgggcaagcaggtgaagccgggtggggtgctgctgctgggggagatgcacggcacgcaggaagtgccgcgtttcatcgcgcaggcgtcctgccagacggcggtggccggcacgccggtgacggtggggctggagctgccgctggagagccagacgcgggtggacaccttcctggacagcgcggggacggaggatgactggctgaagctgatggaggcgcccttctggcgcagcccgtatccggatggccgcagcagcgaggcggtggcgaacatgctggagcaactgcgtcagttgcgctctcgcgggatggacgtggatgtgttcgtcttcgaccacccgaaggcccaggggcaggcgcgcgaggacgcgatggcggcgacggtccggcaccaggtggagtcgggcccggggcgcttccacgtcatcctgtcgggcaacatccactcgcgcacgaagaagggcctgccctgggacaagtcgttcaagcccatggggttggtgctgaaggacgaactcgacagcgtggtggcgctggacatggcgtacaacagcgggtcggcgtggatttgcgcggtggacagtaagggcgtgaaggaccagttggcctgtggcatccgcgaggcgaagggccgggacaacggcgaccgcttcttcctgcacacgtgggggggcaccaatggtgacggctaccacggtgtcttctacgtgggggcggtgaacgcgtcggcgccggcggtgcacaaggggctgggacgtccgggtgggggagacaactcgggtgttccgacggaagaccggactccgacgctcgcgctccactga

SEQ ID NO: 3665 - DNA, 486 bp, Myxococcus xanthus
atggccgacaaatcggaagtggcccggctgcgcagcctggcccagctcgacgcggatgccgtgggtgcctacgacgcggccctggcccggattccggaacagttggtccgcgagcggctcaacggattccgaatcgaccacgtccggcacgtacaggacctgaacgccctcatccacgaggcgggcgggacgccgctggagttgcgcctggacctcaagggaacggcgatggtgggcctgacggcgatgtccagcatgatgggcaccgaggccgcgctggtggccatgcttggcaacgaggagttctccaaccgcgcctacgacgtcgccctgcgcttcgactggcgccccgaggtccgtgagctgatcgaaaagcaccgggaggacgagcggcgccacgtgatgtggattcgcgacgccgtccggacacgcccctgggagcgggcacgcgccatcgccgaggaaggctccgaagcccccgcctga

SEQ ID NO: 3666 - DNA, 186 bp, Myxococcus xanthus
atgacggcctccgtggggttcacgctctacagttggaaggtcggcaactgggtcttcgtggtgacgaacgcgctgatgctgttgagcgcggtgctgggggccgtgattgtcctcaagcaccgccgggtcgcgcggaggaagcacgccacccagccgcgcgcgccctctgacgccgtgcacgcctga

SEQ ID NO: 3667 - DNA, 279 bp, Myxococcus xanthus
atggcggacgcgcagcgcttctacctggccgcggacatcacggactcgcacctcagtccggagtcgcgccgctatctggtggaccacgcgcaggcgggctggttcctgggcgtcgtctacatcggcgcggcgatggagcagaaggccaccaccaagagcctcatggtgggcgcgatgctgagcggcgggatgcggctcgacacggcctacgtggattcggccgaagaggcgcgggcatggattgcgcgacaccgcgaggcggcggcgcggacaggctga

SEQ ID NO: 3668 - DNA, 858 bp, Myxococcus xanthus
atggaggtgttcctgggccgcgcgcccgaggacgcgtcgctggcgaagctgagcatgatgtgtgagcccatctacacgatgccgtccatggacattcaaacgttcgcgccggtgtcgttgggcgacctcaacggtgatggctgtgacgagctggcctggcgctacgcggaagggtcgcggtcaggcgtggccatcctgctgggcttcgacgcgggcggcgcgcgctgcggcgggcgcagtacggccacgctgtggcgcatcgccggtgacagcgaggtgcagctcaccaacatgggcctgggcctgagcatgacgcgcgcgggccggttcctgggcgacacgcgtgacttcgtggccatcagcgccaccagtgtgcccttcaacggcgtgacgcagccggtggtgctgctcttcgacaagacggtgctggtgaaccggatgcaggcgctccagtccgcgggctcgccgctggtggtgggcgcgctgggcgacggcctcaaccccattgtcctggtccaccgtcaccgcgctgtgaacttcggcgcgcggttggtgggcggtacggacctcacgggcgacaacatccccgacctgctggtgagcgcgccgggcgcctccgaggcgtccgacggcggtggcgcggtgtttctctatgctggcggggttggccagcagggcgcgctttcaccgttcttcatggtggtgggagatggctcggagcgctcggcgctggggcaggcgatgtcgatgatgccgggcagcggcagctcgccgcccatgctcgtcatcggcgcgccgcgcagctaccggacggggacgcagaacggcacggccttcgtgttgccgctcggcttctga

SEQ ID NO: 3669 - DNA, 1281 bp, Myxococcus xanthus
atggccatctccgtcttcctggcacgcgcgcaaggcgcgcgcttccgggcatcgccggacgtgtacgtgctgccggccaacacggcggacagcaacgagggcacgtggcggctgggcgtcatccccgccgagggcacgcggcctccgctgctgctggcggtggcggaccgggcggactcgccggacctgcgctcgagcgggggcctgcagtccggcagtgattcgggtggtgcgctgctgttcgatttgacgggctactccgccaccggcgagcccgccaaccggccgccccaggtgacgcgcgaggcggccttcgcccgcatctacggcgaggccagcggcatcaacgcgggccggagctgggcggtgatggacgtcgacggcgagccgggcctggagctgctcctgggcgcgccgtacgcgtccgcgccatcgggtgtggggagcggcacgctgcgctggagcggcaagattctcgtctatcccctggccacgctcacgcagggcagcatcctcaaccggccgctgacggtcatcaacgggacggcggtgtcggacacgctgggctcggggctggcgacctggggccccgcggcgaacccgtcgctggtggccttcgcgggccggtcctcttcggctcagggggccttcaccggcagcgtggagctgtaccaccgtcaaggcgcgtcggtgacggagtggacgcgcaccagcgtccgggtgcctgcgaagccgagcgtggagcgcttcggcgaggcggtagcgattgctcagggcccgcagggccgtccgctggtgctcacgggcacaccgggctggtccagccccagcaccagctatgacaggaactccctgaccattggccgtgcctacgtgcacgacgtgtcggcgcccgcccaggccaccgtggtggaggagggcctgccctcgtcgaagcacgcggtgcgcaacttgagcgtggacgtggccattctcgaatttacggcgacgggcgtccagacctggtggtgggcgcgtccaacttctacgtgccgggcacgggcaccacgagctccaacaacgagctcaacaacacgtacacgtcggtgcccgccgcgtgtgtcaccagtggcacccagtcggtgggcggtgccctggtgtcactgggacagccggacggcagcttcaagccggcgtaccggctgttcgcgccgaacgtcatcgcggactgcacgttggagccggaggccctctgccggcgtaccggcatcgggcgcggcgtggtgggcgggtttgatttga

SEQ ID NO: 3670 - DNA, 1176 bp, Myxococcus xanthus
tcccccgtctaccgcatctacagccctagccggcaggagcacttctggaccatcgatgaggccgagcggaacgacctcatgcagaacgggggctacacgacggacgagaacgtcggcttctacgcgtcgaagacggccgcctcatgcctcgttccggtgtaccgcttctccaacaccacgctgcgcaagcaccgcttcgccatcaccgaggcccagcgcgacgcgctcgcctccaccggctgggtcaaccagggcatcaaattctacgccgccccggagtccgcgccgccggtcgacacgaagttcaccttcgccgtcatccccgacacacagaacgaggtcctcaccacgccacccacgcgactcacgcaccggctccagtggctggtggacaaccggagctcgctcgacctgcgcttcgtgctgcacacgggcgacgtcgtgaactgggacacgccggaccacatccagtacgtgcgcgccagcgaggccacggagattctggacgccgccggcctgccctacgtctacgccattggcaaccatgacaccgcggccgtgtgccccggcggcagcgcctgcccgggcaacgtcaacgccaacttgcgcgacaccaccaccttcaacgcgcacttcccgctcacgcgcttcaccgcgctggggggcgtctacgagccggggaagatcgacaactcctaccacacgttctccgctggcgacctggactggctcgtgctcaacctggagctgtgggcccgcacgggcgccgtggactgggcgaagacggtgctggcgcaacatccgcgtcacaacgtcatcatcaacacccactcccacctgaatggcagcggcgccatcgagcagagcaacggcggctatggcaacaacagcccgcaatacgtgttcgaccagctcatcaagcagtacgccaacgtgcggttcgtcttctccgggcacacgggcaatgccgcgtaccggaccagcacgggggtccacggcaacaccatccaccaaatcctgacgtcgtaccacgagaacacatcgaacctgacgcggttggtggaggtggacacggcggccaacactttctccacgcgggtgtactcgccgatgacgaacgcggagaaacaggacggctctaaattcgccatcagtaacgtgagctgggtccgctga

SEQ ID NO: 3671 - DNA, 1176 bp, Myxococcus xanthus
atggcggagtcggggtggctcatcgcgccgccctggcgggacgcgctggggcagggcgtcatcgccaccgcgcagtccgcggacggcgcggtgtggctggcgcacacgcgcggcctgttccgcctgcaggaaggcacgctggcggagctgaaggtggacggcgcgtcggtgaaggccatcacctcgctggcggcggcgccctcaccggagaacctgcccggcgtgtggttcctgcacgaaggcgggctgagcgtcgcggtggccctcagcaccgcccactaccgggtgcacaccacgagcgcgcccctggcggaaggcgagtcgctgcaagcgctggccggaatcgggcccgcggtgggcacctctggcgagctgtgggcgctcaccaaccaggccctgctgcgccggggcaaggacggctggcgccgcgtggagctgccgcagcagccgcagaagttgatcggttcgggccgcttcttgtgggcgaagacgggcggttcgctgctccagtacgatgcggacgcgaatgtctggcgcgcggccacggacgccggcgccggggacttccatttcctcgccgcggacgagagcggcagcgtctgggtgcagcagggcggggtgtccgtcgcgctgagccacgtgctggtgccgcgcctccgggggctctaccagggcatgcagttggtgaatgacggcctggtggtgcgcgcggtgatgccgccgggcggagcgcccgagagcgtcgtctacaagctgggcaactcggagattcccacggaggggccggactacagcctgggcggtctggaggccgacgggacgcaccgcgcctactccttcgcgtcgctggaggccggccgctacgtcctgtcggtggtggcgcgctacgcggatggttcggaggcgcagcgctcggtgccgttcgactatgcgcccctggcgtcggggccgctgagctgggacaaggacatccgccccatccacgaggcgcggtgccgcaactgccacaacagctccagcgcggcgcgctcgctcgacagctatgagctgtggcgggccaacgcgcccatcatcactggagccgtgagagaccagcggatgcccgccgatggtcccatggaccccgagctcatctcccgcatccagcgctgggcctcctctggcgccaggccctga

SEQ ID NO: 3672 - DNA, 1041 bp, Myxococcus xanthus
cactacgatttaatggccgtggtgcgcggcatcaacatgaacacgttgggccacgaggtgggctaccgctacttcctcaccgggaagatgcccattggcagcgcggcgcgtggctcctccacggcgactgaaatcgtggggcagatgaagccgcgcgtgcccattgcctccatctcctacaacgtggagtcgtacaacgaccggtacggcggctatgccaacgcgctgcgcgtcagccgccgggacgacctgatcctgacgctgaagggcagcgcggacgcgctggacagtgaactcgagaagcagctgctcgacttccgcggccagcccgtcaactgcgagcaggcggcctatggcgcgcgtggggtgggcaccacctactccaacagccaggagcagatgcggctcatccagtccaagggactggacaagtcgttcgacttcctcgttggagccaaccagccgcacagcgcggagatggcggtcatccgcacgaagtacaacctgaccagcgccaacgacgtgaacggcgagcgcggccgcgccgccacggtggcgaccgcgctgaagaagggcatcgcccagtgcgtcaccatcaacctcacgggcggcctggacacccacttcggcagccagctcacgcaggccaacaatcagcggcgcggcttcgacgccctggccatgctggtgaaggacctgcgtgagagcgaccatcccgcgggtggcaccttcatggaccacaccaccatcatggtgttctccgagttctcccgcacgccgctcatcaacagctccggtggccgtgaccaccacctgagcaactccgcgctgctgatgggggccggcatcaagcacaacttcgtgttcggccgcagcggtgacattggcatggcgccgggcaccttcgacctgcgcaacggcgcgtcggacccgaacggcgagaacatcctccccgagcacgtcatcgccacggtgctggcgtccgcggggctggactacagcatcacccgcgtcgaaccgctgcgccccattctcgcctga

SEQ ID NO: 3673 - DNA, 1161 bp, Myxococcus xanthus
atggggttgctggccgacgccgtgaagtccggcgagccggtggacttcgagggacagcgctgggacgtcctcagccacctccgcgagcgactggtggcgcccacgccgttcgccactcccgcgcacgaggacttcttcgaccgcttcacccgcagcggcctgcgtacccaggttctcctggccgcgggacagagcgggttgttggcggcgctcgccgaggacgtccgcacggagcaggcgctgggcgagtccacgtccacgcgtgcccccggggtgctgctggaagcgctggccgtgctgggaatgacgcggcgtcaggaggatgggtgggcgctgacacctgaggcgaagacactgctggaaggaaaggccctggcctacctggtgcgctcgctgtccgtgtccgcgcggtactgggaggccctcggacgcctggacgagacggtgcgtcacgagcgctacgtgctcgacctgaaggaccccgaggtgagcgggcgcttctacgcggacaactcccagcaaatcaccgccgtgttcgccacccacttccaactcagccgccgcgccgcggccacgctcgcgggcgtgcgtccgctggagggcgccgcggtgctggacatcggcaccggctcgggcgtgtggggcgcggccttcgcgcgcacgtcgtcctccacacacgtcacgtacttcgaccaggccatcgtgctggagcaggtgcgccgcaacgtcgcgaagctggaggtcgcggaccgggcgcgcttctggccagggaacctcttcacccaggacttcggcgccgcggacttcgacgtcatcatcctcccccaggtgctcaacgtgctgagcccgaaggacgtcccagacatcttcgcgcgcgtggcccgggcactgcgtccggacggcatcctcgtcatcgccgagtacgtgctcaacgagcgccgcgacggccccctggaccacctctacttcggcttccgtcgcttcatgacgaacgagggcgacctgctgtccgcgtccgagtacgcgaagctgctcgcggacgtgggcctcaccacctccgtctgcatcccccttcccacccaggaactggtgttcgccgcgcgagacggcgtggccctgcccaccgcgctggccccaccgccccgaccgccttctgtctga

SEQ ID NO: 3674 - DNA, 735 bp, Myxococcus xanthus
gcctggctcgtgtacccgctgctggccttcctcatcgcgacgcgctttcgcgcggtgggcaacatgctccatgaggcgtgtcacggcatgctcgtgcgcggcaagcgccacaaccggaacctgggacacctgctggcggtgctcgacctgacggccctggacccgtatcgcagggaccacttcagtcaccatctccacctgggtgacgcggagaaggacctggacttccagccgcgccgccgcttcggcttcgcggacccggaccagcccttcgtgaagtcacacctgctgcgccccctgctgctcatccacctgcccgccttcatccgcccggtgttattccaccgcgaggacccggtctgggtgacgctgctgcgctggagcttcatcggcggcctgctcgccgtggcgcacttcgtcgtgggctgggacgtgttcctgcgcgcctacgtcatcccctacttcgtcgcctaccaggtcatccgctactggtcggacgcggtggaccacgcgggcatcatctcctccgcggatgagttccaccgttcccgcaatcacgtcttcgcgtggggctggctcaaccggctcgtcttcccgcgcaacgacgagtaccacctcacgcaccacctcttccccgcggtgcccacgcccttccaggggcgcgtgcaccaactgctgctgcgcgacgcggactatgccgcgcgcgagcatgccttcgcgtccctgacgcggtag

SEQ ID NO: 3675 - DNA, 765 bp, Myxococcus xanthus
gaatacggcgtcgacccgtacggcatctccaagtctcacgtgaaacatgcgctgcgcgtctttggcgccatctaccgctactacttccgcgtgcgctgttacggggtagagcacatccccccgcggggccgcggaatgctggtgggcaaccactccggcggcgtggcggtggacggggccatggtcctgacgtccaccatgttggagatggacccgccccggctggcgcagggcatggtggagcgcttcctccacaacttccccgtgtcctcgctgtgggccagccgcaccggacagttcatcgggctgcccgagcacgccaagcggctgctggaggatgaccggctgctgatgatcttccccgagggcgcgcgcggcacggccaagctctacaacgagcgctactcgctggtggacttcggcaccggcttcgtccgcttggcgttgcagacgcgctcgcccatcatccccttcgcgttcctgggcggcggctcggccgtccccacggtgttcaacgcgtacacgctggggaagctgctcggcgtgccctacgtcccgttgacgccctacctgttgccgctgccgttgccggtgcagttggaaatccattacggcgagccgctcgtcttccatggcacgggggacgaagaggaccacgtcatcgagggctatgtggagaaggtgaagcagcgcatcgcggggctcatcgagcgcggccgcgcgcagcggcacagccggcggattgggaggaacctgttgccatga

SEQ ID NO: 3676 - DNA, 948 bp, Myxococcus xanthus
atgagggtgctgattccaggcatctccggaggcattgcccgccagctcgcgctgcacctgcacgcgcgcgggcatcaggtggcgggcatcgacacccgcccctgggccgaggccaaagaggccggcatccaggtctaccggggcgatgtgcgcaagcgcgccgcggaggacgtcttccgccgctggcgtcccgaagccgtggtgcacatggccaccgtcaccgccttcacggtgccgggcaaggagcgcgggcgaatcaacctggacggcaccaaggcggtgttcgaccactgcgcggcccatggcgtgaagcagatgctcttcgtggggcggcacaccttctacggcgcggcgccggactcgccgctgtaccactccgaggacgagccgcctcgcgcgctggaggccattccggagctggcggacctggtggccgccgacctgtacgcggccaccgcgctgtggcgcctgccgaagatgacgacggccgtgctgcggctgccctacaccctgggggcccccggcaccggcacgctgtcctccttcctcaagggccgtcgcgtgccgctggtgctcgggtacgaccccctgttccacgtcctccaggaggaagacgtggtgacagcgttgacgctggcgctggagaagcaggtccggggactcttcaacgtggcgggccctccgccgattccgctgtccgtcatcgtccgggagacagggcgcagggcggtgcctttgcccgcgccgctgctatcgatgctgctgggccgggccggcctcccccgcctgtcaatgggcgctttggaccacctgcgcttccccatcgtcgtggacaaccgccgcttcctggacgccacgggcttcgaataccgccacagcgtggcggactcgctgcgcatcttccgcgaatcctcgcccatcctccccgcggggggccaaggacgttag

SEQ ID NO: 3677 - DNA, 1578 bp, Myxococcus xanthus
atgtcggccgacatcgaggaagtggatgtggtcatcgcgggaggcgggccggtgggtgtgctcaccgccaacctcctgggactccagggcgtgcgcgtgctcgtcctcgaacgggaggccgcgccgcatggccaaccccgggccttctcctgtgacgacgaggccctgcgcatctaccaggccgcggggctgctcgacgtgctgaagcccgacctgcgccagggccgccacgtcaccttcaccggcgtgggcggccaacccattgcccaggtccaactgggtcaggtggacttcggctacggccacgcgcccatctggttcttccaccagccgctcctggagaaggcgctgcgcgaggggctctcccgcttccccgccgctgagctgcgcacgggcaccgaggtggaatcactggaacaggacggcgcgggcgtcaccgtgcggtacctcacgtccggagtccggcacggggtgcgcgcccgctacctggtggcctgtgacggtgggcggagcacggtgcgcgcgctgttgggcatccccatggaaggccgcggcggccaggagccgtggattgccatctccggcaccgtggccgaggaagacgcccccgccgaatgtcatgtcgtctgcgacccggtccgccccggcttcgtcgggcgtggtcccgtggggcggttccgctgggagttccgcctgcgcctgggcgagacgggcgaggagatgacgcagcccggcacgattcgccgtctgattgggccttatgtgaatccagaccgggtgacggtggagcgagcgcagctctatagctttcattcggtggtggcgcagcgctggcgcgtgggccgcaccttcctggcgggagacgcggcccacctgttgccgcccttcctgggtcagggcctggtgtccgggctgcgcgacgcggcgaacctcgcgtggaagctggcgtgggtcctccagggccgcgcccccgaggcgctgctggacacctacgccgtggagcgccgtccgcacgtgcgcgccttgctggaagccaccgcgcggctgggctccgtgttcaccgcgcgcagcacgcccatggcctgggtacgtgacaccgtgctccggggcctccaggccgttccggccgcgcgccgcttcgtggagggattccgcttcaagccggcgcccgccatcgaggaaggctggatgctgggcggccgccgctcgggtcggaaggccgctgaaggcagctaccttccccaaccgcgcgtgcgtcgtgcgtccggtgaggaacacctgttggatgacagcctgggctccggcttcgccgtgctgagccggggcggcagcccggggacggaggtggcccgtgagctggccgaatccctgggggcccgcgccgtcaccgtgcgctccgcgggtgtcccgggcctgggcgacaacagcgtggaggaccacaccggcaggctgtccgagtggttccgagagcacggcgccgacgtggccgtggtgcggccggaccgcttcgtcttcggcgcggtgcccctggcccggatgcccgagctgcgcgcggcgctgggcgtggaagaggcctga

SEQ ID NO: 3678 - DNA, 993 bp, Myxococcus xanthus
atgggtgacgcggaggtgttcgtcgttcgctcccagccccagaaccaggcacggacgctccagttccaaggcaagacggcgcaccagcggcgcgtgttgctggaaggcctgacgcccccgcagggacagtccgccacctgggagctgtgccgagccctgctggagagcccggccccgccgccgtccggtgtgcttccagacgcggtgagccaggccattgcgcgcgcgccgctgccggccctccaaacgctgatggcattggtccccgccggaagcacgccggccctgcgcgtgcgggccggtccctctgacttccgggcgctccgcaccgccgcggccctgtgcaccgcggcccccgcgctcacgacgggctgcgtgctcaccgccgaggggctcgccgagcacctccggagggaggagtcccacatcctcgccatgctgcgggaaggccggctggacctagccgagccggagctcgacgaagacacccgcgagttccccgaggccgcggtggcgtccacgcgcgcccggctccggcaggaaggctcgtccgaacaggtcgtcgcgctctacgactcggcggtgcgcaccatcgcctcggcctaccgggacgccaatggccgcgcccggagcgaggcggagaagttcctgcacgcccggctccaggaccatgcctccactcgaggcctcttcgtcctcaatggccatgtggatccggtcggaggtggccggaggctggaagtggacctgctctgcacggagctgaagctggctgtggaaatcgacggctacttccacttccgcagccccgacggcttccgccgagaccggcgcaaagacgttgcgctccagtgctcgggctactgggtggtccgcttcctcgcggacgacgtggtgacgcgactggaagagattcttgaaaccctcgacacgttgattgccacccgcaggggtgagctcagcgggaaggaagcatcgaatgggaagcgctga

SEQ ID NO: 3679 - DNA, 954 bp, Myxococcus xanthus
atgacgcgcagcgagcggcgcggtacgcgcaaggagttggaggatgcactccggcccttcgtggagcatcagctcagccgtgcggaatggaagctccgtttcgaggcgctcatggaggcgctgctgggcggaggaaccgtggcggtgcgcgggcgcagcggcttggagctgacgcccaagggccggacagaggtgctgcgcttcctccaattggaccagccgccgcgcgggctgacgtggaagaggctgaaggccacgcacctggtggcgcgcagcttggacctgcggccatcgaaggcggtgttggcgcggatgaagggtgccgacggcgtgcgcgccgccgcgcttcagcgccagcatgggctggacaccgaggaaggcctcaccctggcgcagacgcgggaccggttgttgtggcggcagctcggcgtcgagacggaccggcccttcaccctgggcgcggtgcaggcccacctgctcgggaagatgctggacgcgaaaacgatggacccgcgcaagggcgtggagcagcttgcggcgcgtgcggcgggcgccccccgcgtggatgcggaggccgtgcgcctgtccctgatgcgacggtgggctgttgcgcaggacgccgacgcctccgaggacgcgccggcggaccgtgcatccacgagtccagacgcccctccctctccggcggccttcgccgagcgcgtgctgtcggtcgcccgcgccctccccacgggccgctttggcgagaacaaggtcttcatctcccacgtgtggaaggccctccagccggagtggagcacccgcgaggcattcgacgcggcgctcctggaggccaaccgaacccgcctgttgtcactgacgcgcgcggacctcgtgtccgccatggatccgaatgacgtcgccgattccgaggtccggtccttcggcgccagcttccacttcgtcgtcgtctag

SEQ ID NO: 3680 - DNA, 2916 bp, Myxococcus xanthus
ccttccctcatcgattcaggaccgcgcagcatgcccgcgggagcgccgcggacgctcgtcgaactgctccagcaggccgtggcgcacgctcccggtcatgtcatcaccttcatcgacgtacaggggcagcgggagacgctgacgttcgccgcgctctgggacgaggcgctccggctgtggggaggtctgcgggcgcggggcgcgaagacgggtgacagggtgatgctcgcgatggagcgcccgggcgacttcgtgcgtggcttctgggcctgcacgctcggcggcgtggtgccggtgccgctggcgctgccggcgtcgctggagcgctcgcagcctggcgtcgcgcggctcatctcggtgtcggagcggttgggaacaccgtggctgctcacggaggcgagggccacggcgccgctgtcggaggcggggctgcgcgccctgtcgctgcaatccctgtcgggcgcggagccggggcccctcgcggccgtggacccggaggcgcccgccatcctctccttcacgtctgggagcaccgggcgtcccaagggcgtggtgttgaagcacgccaacctgatggcgatgggcgaggggatggtggccggcggttggtacctgcctggggacgtgggcgtgagctggatgcccttggaccacgtggcggggacgagctacccccacctgctcgcgctgcgcacccgcacgccccatgtgctggtggcgcgcgactacgtcctggcggacgtgctgcgctggctggatttgctctcggagttcggcgggacgatgagctgggcccccaacttcgcctacggcctggtggcggatcggctggagcgcgaggagcgccgcgcgtggcggctggagcaggtgcgggtgctggcctctggtggcgagtccgtgctgcccgcgacgctccggcgcttctccgagcccctgcgcgacagcggactgcgcgaggacgcggtgtgcccggcctggggcatggcggagacgtcgtccttcttctcgatgacgcggggcgtgcggacccatcccgtggaagcggcgacggagctgggaccgcctccggtgggcgcggccctgcgtgtggtggacgacaccgacgcggtggttcccgaaggtcaggtcggccacctgcaggcccggggtgagcaggtgctgtccggctacctggatgacgcggaactcaacgcgcgctccttcacggctgatggctggtttcgcaccggggacatggccgtgattcaggacgggcagatgtccatcgcggggcgccagaaggaggtcctcatcctccacggcaacaacgtctacccgcaggacatcgaggaggtggtggagtcggtgcctggcgtgctgccgtcgtacaccgtggcctgcccgacgcggagcggtgcggcacagacggatgaactggctgtctgcttcgtgcccacgccggatgcgccgccgctggcggagttgctgcggagcatccgggagaaggtgggccgggtgctcggcttccatgtcgcgcacctgttgcccctggcgcgcgagcaggtgccgcgcacggagctggggaagcggggtcgcaccgaattgcggcgccgtttcgaggcgggcgagctgggggccgagtatcaccgctcgctgagcgtcctgggcggacccgccacgatgccgccgtgcctggcggtgtcccggtgggtgcctcggccgctggcgaccagggtgggaacacgcggtgccgtggtcgtcatcgcggacgaagccttcgccggggcattgcgcgaacaggccgacggctaccaggtggtgcgggtggcgccggaggcgaacggtgagctcgttcgtgccattgaggcccttgcggagcgcagtgtgccctgtggcgacgtggtggtgctgctgccggaggcgcaggaggtgcccgcggtccgtgagtctgtgcttcgcggggagatgacggctgcggatgggcgcttccaggacgctgccgccagagcgcctggcggaggcgtgtccgggggcgtttccgcacctgaccagggcacgacctcggacggcgcgatgcaggcggcgccggtcgcgcatctggctgtgccggttcaaggcacggcctcggatgccgtgccgcaagcggcggtggcctctcgcatggcgccactgcttcatgcgctccagtccctggccaggcgaggcgagggcgctccggtcgtgcgcgtgctcgcggtgcttccggagtcgggaggggacgacgcggcttcgctggctgccttgctgacgccgggcctgctctggaccgctgcggcggaggttccggggctggaagcgcgggtggcatggacgccaccggatgcatccgccaccgcccatgctgtcgcccgcgaactcgcctcccaggatgccgcgcgcgaggtggcgtggcgggaaggcacgcgttgggagcgcgtcttcaccccatggacgccgccaccgctcgcggcgccccagcgcctcaagcggggagggctctacctggtaacaggcgcgctcggtggcctgggacgtgagtgggcacgtcagctgcggcagggcctggacgcccggctgctgctcgtggggcggcgccctcatggtcccgaggcaagggcgctggagtccgagctgggcaccgcgaagtatgtctccgtggacgtcacgaacgaggtcgcgcttcggaatgccgtgcgcgacgcggaggcgcacttcggtcagtcgctcgacggcgccttccacttcgcgggcacgctgacgcccgtcgcgttggagcacgagacgccggagacactggtacaaggcgccgccgcacatgcactgggcgcgagggccatcgcgaccgtcttgaaagacaggccccaagccgtctgcgtctttgcggggtcggtgatgggaacccctgggcgcgggccgcca

SEQ ID NO: 3681 - DNA, 915 bp, Myxococcus xanthus
atgaaggattcactgaagggacgcgtggcactggtcgcgggcggcacgcgaggagcaggccggggcatcgcggtgcagctcggcgcggcgggcgccaccgtctacgtcacgggccggacgacacgggcccagcgctcggagcagaaccggccggagaccattgaagagaccgccgagcaggtgacggcggcgggtgggctcggcgtcgccgtgcagacggaccacctggtgcccgaacaggtccaggccctggtggagcgcatcgatggggaacagggccggctggacgtgctcgtcaacgacatctggggcggcgagtccatctttgagtggaacaagagcgtgtgggagcactcgctcgacaaggggctgcggctgctccggctgggcgtggacacgcacctcatcaccagccacttcgccctgccgctgctcatccgccgcccgggagggctcgtggtcgaggtcaccgacggcaccgccgactacaacgcgacgaactaccgcatctccacgttctacgacctcgcgaaggcctccgtgctccggctggcctggagccaggctcgagagctcaggccccatggcgccaccgccgtcgcgctgacgccgggctggatgcgctccgaaggcatgctggagcacttcggcgtcaccgaggcgaactggcgcgacgcgacggtgaaggagccccacttcgtcatctcggagacgccggcctatgtcggccgagccgtggccgcgctggcatcggacgcggacaaggcccggtggaacggacagtccctgtccagcggccagctcgcacgcgtctacggcttcgcggacctggatggcagccagcccgatgcctggcgctacgtcgtcgaggtccaggacgcgggcaagcccgccgacgccactggttaccggtag

SEQ ID NO: 3682 - DNA, 1296 bp, Myxococcus xanthus
atggaaccgctgcgcaccttcttcatggaggactacctggagggctcgcgcttcaccgcgcgcttcaacctgggggagtccggtggacgccccgtcaccgtgggcgagctgctcctcggctcgggcgtcagcgccgagcgcgccgccgaggtgttcctctccacgcctttgaatgacagccccaactggggccgcgcggacctgcgcgacgcggtggcggccatgcacccgggcgccacgcgggacaacgtcctcatcaccactggcaccagcgaggcgttgctgctgctgttccgccagctccgcccgcgcaaggtggccctggcgtggccggcgttccagctcctctacgagctgccccagcgtcagggcgcggaggtggtgcggttgcccgtgaaatgggacgcgaacggcgtgccgtccgtggacgcggacctgtggctggagcggctggagcgcgagcagcccgacaccgtcatcatcaacaacccgcacaatcccagcggcctggtgctgacggcggaactgctgtcggcggtggagcgctgggcggagcggacgggcgccacggtggtgggggacgagcactaccgcttcctgtcctcggagacgtccgtgctgggcgcgtccgtgtaccggccgggctcgcggcacttcgtcaccggctccttcatcaagtgcctgggctgcccggggctgcgcatcggctggacggtgggcgacacggccatgctgtcgcggatgcagaacgagaagaactacacgacgcacacggtgaatccggtgacggagtgggtggcgcgcgaggtgctgcgggatttggacagtcctgcgttgcgccgcgctcggggaggactggctgcgcaatcgcgccacgctctctgctttcctggagcgctcgcgcggtgtctatggcgtcgcgccccagggcgggctcgtcacctgcatcggcctgcgggaggctcgggacgacgccagcgcggagacgctgctcaaggccctgtcggatgtgggcgtgttcgtcctgccgctgagcgccatggaggcgggctcgccggacggagcacatccgctggagcgcgggcacggtttccggttgggactgggcatcgcgccggagcgtttctccgaggcgctggacgccatcgagcgcgccaccgcgcgctgagcgcccgcgctaccgcgtcagggacgcgaaggcatgctcgcgcgcggcatagtccgcgtcgcgcagcagcagttggtgcacgcgcccctggaagggcgtgggcaccgcggggaagaggtggtgcgtga

SEQ ID NO: 3683 - DNA, 738 bp, Myxococcus xanthus
atggcctactgggaggcgctggggcacctggatgaggcggtgcgcgagcagcgcttccggttggacttgcgtgacccggagacggcgcggcgcatctaccaggagaacgcttcacgcatctccagcatcttcgcctcgcacctgcggctgagccggcaggccgcgacgctggtgcggtcgatgcggccattggcacaggcgcgcgtgttggacgtcggcacgggctcgggcgtgtggggcgcggccttcgggttggcggaccccaccacgcacgtcacgtacctggattcgccgcacgtgctggacgcggtgcgcccccatctggcgaagctgaagctggaggcccgctccgagctgtgggcgggagactgtctctcggtggactacggcgagtcccgctacgacgtcatcctgctgccacaaatcatccccgcgctgccgccctcggagctcccgagcttcttcgcccggctggctcgggcgttgcgtcccggcgggctgctgctcatctccggctacctgctgacggaccggcgcgacggcccgctggacgcgctctacttcgcgctgcgccgatacgtgacgaacgagggggacgtgctgtccctgccggagttccgtgcgctgctggggccggtgggcctcacggacgcccgcggcttcgacatgcccattcagcaggtcgtcatcgctcatcggggggacgtcgcgtggccggacgtcgccccctccgcctga

SEQ ID NO: 3684 - DNA, 999 bp, Myxococcus xanthus
atgcggctgcgcatgttgatgcggcagccggaggtgctgttctggacgttcatcttccccgtcgtcacctcgctgttcctggggctggcgttccggaatgactccctgggcccggtgcgtgtggccgtggcggagggggcgggcgcgccggcgctgatggcgaagctggagggcgtgccggagctgtcggccgaggtcgtggacgaagcgtccgcccggcggcggctggcgcgcgggcagctctccctggtgctgctgccgggcgcggtgcccgaggcgctggtggaccccagccaggcggagggccgcaccgcgcggctcctggtggagcaggcgctcgccgcgccggaagacgccgcgcgtcccgccgtggtgaaggccacgccggtgtcggagccgggaaaccgctacgtcgacttcctcatccccggcctgctgggcctgtcgttgatgtccagcagcctgtgggtggtggcgggctcgctggtggcgatgcgcggaggcaagctgctgaagcggctggccgcgacgcccatgcggcgctcccagttcttcctgtcctacatgctggcgcgcgcggggttcgcgctggcggaaatcctcttcttctgtgccttcgcgcgctggctcttcggcgtgccgatgttcggcagctacttcacattgacgctggtggggctcgcgggggcgctgtgcttcgccgcgctcggcgtgctggtggccagccgggcgcggacggaggaggcggtgggcgggctcgtcaacctcgtctcgctgccgatgatgttcgtctccggcgtcttctttgcggccggaaacttcccctcttggttgcagccggtcatccgcgccttgccgctcacggccatcaatgactcgctgcgggctgtcatgctggagggcgcgggcctggcttcactgggtgcgcccatgttggtgctggccgcgtggaccgtggtgccgctgctgctggctcttcgttggttccgctggacgtaa

SEQ ID NO: 3685 - DNA, 951 bp, Myxococcus xanthus
atgacacaccaggacgagctcgccatcgaggtgaagggattggtcaaacgtttcggcgacgtcaccgccgtggacggaatcgacctggacatccgccgtggcgagtgcgtgggcctcctgggccccaacggcgcgggcaagacgacgaccgtggaaatcctcgagggcctccagacggccacctcgggggaggtgcggctcctggggttgcgctgggagacggacgcgccggtgctgcgggagcgcattgggatgacgctccaggagacgcggctggtggaccagctcacggtggaggagatggtgcgtttgttcacctccttctacccacgccccctggaggtcgaggcgctcatcgggctggtgcaactgggcgagaagcgccatgcccgggtgggcaagctgtccggcggccagaagcagcggctggccttggcgctgggcttggcgggcgacccggacgtgctcttcctggacgagcccaccaccggattggacccccagtcgcgccgcgccttgtgggacgtggtggcgcagctcaaggcgcgcgggcgcaccgtggtgttgaccacgcattacatggatgaggccgaagtgctgtgcgaccggctggtcatcatcgaccggggccgggtgattgcgcgcgggacgccgcgggacatcatcacctcgctgggcgcggagcaggtcatcgagttggaggcggagccctcgccggacctggagcggttgcgcccgctgccgtcggtggtggccgcccagcggcacgctggccgcatcaccctgcgggtgcgggagctgcacctggcgctgccggaggtgctgcgcgaggtggcggcggggggcggccagttgctgcacctgtccacccggcgccccacgctggatgatgtcttcatcgacatgacgggccgctccctgcgcgagtccgcggaagagaaggcggcctga

SEQ ID NO: 3686 - DNA, 174 bp, Myxococcus xanthus
cagcacacgctggaggcgctgctcctgggcgcggggctgccgcaggactcggcattgaagtcgctcgcggtggcgcggacgctggggctcgtctcgatggagcccgcgacggatgaagacgcgggcgacctgccgccggagctggacgttcggcgcctggaagccaagttctag

SEQ ID NO: 3687 - DNA, 534 bp, Myxococcus xanthus
atggtccgtgagatcctcatctggcccgaccctgtcctgaaacagaaggccaagccggtggcgaaggtggatgactccacccgcacgctggtgaaggacatgttcgaaacgatgtactccgctgaaggcgtgggcctggccgccccgcaaatcggcgtgctccagcgcgtcatcgtgctggacaccacgcacagccagccggagctgaagcccgttgcgatgatcaatccggagatcatcgccatggaaggcgacacgacctacaacgagggctgcctgtccatccctggtgaggccgcggatgtcgaccgggccgccgtggtcaccgtgaagttcctggacccggacggtcaggagcagacgctgcgctgtgacgggctgctgtccatcgcggtgcagcacgagacggaccacctcaacggcaccgtcttcgtggaccacatttcgtccctgaagcgcgagttcatccgcaagcggatgaagcgcctcaagacttcgcgcgagcgcgaggcgagcgcgccggcgtctccgtag

SEQ ID NO: 3688 - DNA, 1026 bp, Myxococcus xanthus
atgaagcgcatcgacttccgttccgacaccgtcacccagcccacggccgccatgcggcgcgccatcgccgaagccgaagtaggggatgacgtttatggcgaagaccccaccgtgctccgtctggaggcacgggtggccgagcggctcggcctggaggccgccgtcttcgtgccctcggggacgcaggccaaccagttggccatcggcgcgcattgccgggcgggcgacgaggtgctcaccgaagcaggcagccacatcctccactacgaagggggcgcggtgcccgccttgtggggcgtgcagccgcagccactgccagggcagcgcggtctgctgtcgccggaggatgtgagcgcggccgtgcgcgaggacaacatccacaacccgcgcacgcgcctgctgtcgctggagaacacgcacaaccggggtggtggttcggtatggccggtggagcgcttccgggccgtcgtggaagcggcgcgcaaggcggggttggccgtccacctggatggagccaggctcttcaacgccggtgtcgccctgggcgtgccggtgtccgcctgggccgcgctgacggacacgacgtccgtgtgtttctcgaagggcctgggcgctccggtgggctcggccctggcggggcgcgcggacgtcattcgcgaggcgcgccggctgcgcaagcggctgggcggtggcatgcggcaggcaggcatcctggcggcggccgcgctgcatgcactggagcaccatgtagagcggctggcggatgaccatgcgaacgcccgcaggctggccgcggggctggcggagctgcccggcgtggaggtggacgcttcgcgggtggagaccaacatggtcttcgcggagttctcccggtccgctctggagatggtggcacgactggagcagcacggggtcctgacgaaccccgcgggtgctcctcggacgctgcgcctcgtcacccacctggatgtgtccgctgccgacatcgacgaagccctgcagcgcatccgccgcgccgtgggctga

SEQ ID NO: 3689 - DNA, 714 bp, Myxococcus xanthus
atgcccgccgcccaggtggagaattgggagcaggtgaccttcgcattggacggcttcctgtcgcgtcccgcggcgccgcgcgtcggctcgggtgatttgctgcaggcccagagcgtcctggaggccgagctggagcgggacggcttcacctatggcgacatgccggccccgctggccgaggcggtggtgttgcgcgtgggccgactggcgctgcgcaccgccgagctgcgccgcctggagcagccgcccgagccggccgaggatgcgcttccgcgcttctcctggccggtggatccggtgtccgtcaccagcctcttcggctaccgctggcaccccgtgacaggcgtgcaccggcgccacctgggcgtcgacctggccgcgacgcagggccagcccatctacacggcggacaagggcgtggtgctgcgtgcgggccacaatggcgaccatggcctccaggtggaggtccagcatgaggggcgctgggtgacgcgctacagccacctgtcccgcgtgctggtggaccctggcgaggtgctggagcgaggcaacgcggtggggctggccggggagacagggctggccaccggcgtccacctccacttcgagctgtggcgtgacggccagcccatggacccactggaggcgctgggtgacgcggagccgcctccggagcccatgccgtcagtggcccgtgggcccgtaagccgctag

SEQ ID NO: 3690 - DNA, 717 bp, Myxococcus xanthus
atggacggcaccctcatcctggatgaggtctccgtgacggggcacgagtacggcgtgtcctccatgcaagcacgcaggctcgacgtgcaccgcttcacgtcggtgcgggccattcgggccggcatgggactgctgatgtcatgcgtccggctccgggacatcgtggtgcgggacagcggcgcctatggcgggcttcagttctcgggcggggacctggacgtccagggcgttcgagtggacggcgccgccgagtacggggtgatggcgctgcgtgggaagctgcggcttcgtgacgtggacatccgccgggtgcgcacggcggacggtgtcaccggggatggcctgcacctgcgtcaggtcgaagcggacgtggagggcgtcgtggtgcgcgatgcacagggggcgtgtgtcctcgcggcgcagaatgcccgcgtgtcactgcggggcgcgaagctggagacctgcgggtacgtcggcctgctgacggacaccctggcgcgcatgaacgccgtcaacgtggacattcaaggggcggcgacggcgctgggcgctctgggaaacggcgagttgcgtgtggaatccctctccgcgagtggcctggagacggggttcgtccatgcggagtgcgagggcgccacgcaggtgcacctgaaggaattccgctccgaggacacgcgaggcctgtcggcgcgctgtgtccacgccagtccgaagtga

SEQ ID NO: 3691 - DNA, 987 bp, Myxococcus xanthus
atgacgctgaaggatcgccacgtcgtggtggcgccccaccccagtgtggacgggctcgccgcaggggcgctgatgctccgcgcgctccaggccatgggagcgcgggtcaaggcgcaggtaccggccaagggcgagcatgccctctcgccaacctttcagcagcgcctccgcgcggcacagcccgacgcatgggtggtgctcgagatgtcgtcggatgcgatggacgactccgtcgctccgccgggcctccccacgctcatcgtggcgccccaagcggcccccgctggcaaggcgggcacgaccgtgctctccgcacggggattggagcccgcggtcagttgcagcctgctcacctacgcgctcgtgtcgccctgcgtggtgccgggcccgttggaatggctggccgtcctggggaccgtggcggaccagggcgtggatgcgcccattcccttcctcaaggacgccctccgccgggcggggcgcaccgccgtgacggaatccgtggccttgctgaacgcggcccggaagtcctcccggtacgcggcaccgctggcgttgggagtcctccttcgcgcgggcagcgccaccgatatcacccggggcaacgtccctggcgtcgacacattgcatgactgtcgactggaggtgcagcgcgaggtgctgaggtgctcgaagacgccaccgcgcatcgccagtcccgtggcgctgttgctgttcagctcggaggcccaggtccatccgcaggtcgcggtgcgctgggcccagcgactccccgagcacatcatcatcgccgccaacgcgggctacctgccgggccgcgtggacttcgccgttcgcagccggacgccgatggagctcggagggctcccgttcaacgcaaccggaggcagcctctcccgggaggacttcctccgcttcgccgccggactgggcttcaagggcctgcgcgacattgacgtggagcggcggggcgcgtttcccggctga

SEQ ID NO: 3692 - DNA, 879 bp, Myxococcus xanthus
gaagtcgagggaatgatgaagttgcggaaactgatgttcgtgctgccgaatctcttcaccgtcacgtccattttctgcggcttctacgccatcaccttgtgcacgggggacgccgaaccggtgcagctgtaccaggcggccctggccatcttcttcgccatgttcttcgacggcttcgatggccgggtggcccggttgacgaagactcagagcgacttcggcgtgcagctcgacagtctggcggatgtcatctccttcggagcggcgccctctctcctggtgtacaagtgggcgctcgagcccctggggttcatggggctgttcatcgcgttctccttcgcggcctgtggtgcattgcgtctggcgcgcttcaacgtgctggcggcgcgcaacccgcacggaggcggtggcagtttcttcgtgggcctgcccatccccgtggcggccggaatgctggtctccgtcatcatctcccaccatgcggcgacgcaggggcagcccctggccgagagcgccgtggtgcccatggcggtggcggtggccggcctggcgctgctgatggtgtcgacggtgcgctatcgcaccttcaaggacacgcggcccaaccggaagagcgcgctggctttcatgctcgtggtggtgggcggcacggtgatcgccacgcagttgcacccggcctgggtgctggtggcgtgctgcggcgcctacctcgcgctggggctggtggagtcggcggtgctggtccgcagtcggctggtcgctcgcaagggggcggccccctgcgcggtggccgcggtcgcggtggccacggtcatcgacgacgaggaagaagaggacgcggagtccaaccagggcaacgacgggcccgcgtacctctga

SEQ ID NO: 3693 - DNA, 1224 bp, Myxococcus xanthus
atgcgcgtcgagctgctgtgcaccggtgacgagctcgtcaccggcctcattacggatacgaacagcacgtacctggaggcccgcctcttcgaccttggcgtcaaggtggagcgcgtggtcctggtgggtgacgtgcggccggacatcatccagtcgctgaaggaagccgcgtcgcgcgcggatgtggtggtggtgtcggggggcctggggcccacggcggacgacttcaccctcgaatgcgccgcggaggccgcgggcgtgccgctggaggaggatgcccaggtcctcgactggctgcaccagcgctacgccgcgcgaggcctgtcgcccaacccgagcgccctgcgcatggcccgcgtcccccagggctcggagcccgtgaagaaccccgagggctccgcgccgctcgtcgtgatgaagctgggtggcgcccagttgttcttccttccgggggtgccccgtgagttcaaggcgctcctggaaggcgaggtgctgccgcggatccgcgcgacgctggacgcccgccccgagcgcacctaccgggccttccggctgctgcgcacggtgggcatcccggagtcggagctcgacattgcggttgctcccatgggcccccggcatccccgcatcgtgttcggcttccgcacccacgcccccgaaaaccacctgaagctgatggcggaggccccctcccaatcggaagcggatgccgcgctcgccgccgtggaggtggagtgccgccagatgctgggcacgaagctcttcggtgtggactcggaagcgtacgccgcggtggtcctcgaaacgcttcgtcgggcgggcgccacgctggcggtggcggagagctgcaccggcggcctcatcgcccagcagctcacggccgtgccgggctccagcgaggtcttcatcggcggcgcggtggtgtactcggagaagatgaaatccgcatgggtgggcgttcctcccgacgtgctcgcacggcacacggctgtctcgcgggagacggccgaggccatggcggagggcgtgcgcgatgcctgtggcacgacctacggcctgtcggtgacgggatacgcgggccctggcggtggcacgccggaggaccccgttggcaccgtgtactgcgcgctgtcggcgcctggcgtgcccacccgctgtgagcgcatctctgtcaccggcgaccgcgaccgcgtgcgcctgttcgccgctttcccacacgcttga

SEQ ID NO: 3694 - DNA, 1161 bp, Myxococcus xanthus
atggaggggcggctggacgtggacccgcaggtgctgcccaacatggaggactgggcctgcgtccgcatggtgaacggcgacaaggtccgttgcaccggacgcccgctcccaacggaccgctggttcgtgagcttcccgtccttccccgcggaggcgatgttgcccttcgtcgcactgcacggctaccagttcaacgacacctcgtttggtgtcatcgtcggtgcgctggcggtggcgctcttcttctcgctgctgcgcttcctggcgaaggaaggggagacggagcgcaaccgcaacgagaacgtggccctggcgctcatcctcgccttcggcaccctgttcttctactgcgccatccggggagaggtctggttcagcgccgaggtgatgggcgtggcgctcacctgtctctacgtacgcaacgccgtccgggcgcatcgtccgctgctcgcgggcctgttcttctccatggcgacgctcacgcggacgcccttgctcttcacggggctcttcttcgtgctggaggcgctgtgtcccgggccggagcctcgcctggcgcagctcaaggccctggcgcagaactggacgcccgccgcgaagaagctgggcctcttcacgttgggcgccgcgccgctggcggggctcgcagccgcatacaacgtctaccgctacggccggctgagcgagttcgggcacgcgtacctcttcaacaaccgcgtcaacgcggacatcgaccgcacggggctcttcaattgggagtacctgccacgaaacctggaggcggccttcttcaagctgccctcggtgtccttgtctccgctgaagctgggatatgacccgcacgggctgacgctgctgctgacgctgccgctgctcgtcttcctgttggtgccgaagacgcgcccgcgcctgcattggccggtgtggctcaccgtggcggtgtgcgcgctgcccgggctcttctatcagaacaccggttacatgcagttcggcttccggttcagcctcgactacacgccttatctcctcctgctcttcgcattgggggggtggtccctgcggaatcgggcggtgatggccgcggtggcgcttggggtgctggtgaacttctggggagcggtggctttccgcggctacacggaacttgtccggaactggtag

SEQ ID NO: 3695 - DNA, 429 bp, Myxococcus xanthus
atgcgctggtggcacgacgacgagcccatcctccatcccaagatcatcgagctcttcaacgcctcgctcgtgctggatgacgcggaccgctaccagctccgcattggcaacgactggtgcttcatccaggttgaaggcgccgcctacgaggtccggacagtggacgtcacccccgacgagcgggtgtccgtgcgcctgagcgaccgcaccgccgaggcgctggacgtcgccagcctgcatctggacgcggacggcgtgttgtcctgccgagtgaagcaggggcgggcccaggcgcgcctctcgcgcgacgcgcagtaccagctcggacagctcctggaagaagggcccgacggcgggctcgtgctgaatgtcggtcagcgcaagctcgccgtcccggtcaagctggacgtgttggcgtcctccgtctag

SEQ ID NO: 3696 - DNA, 1383 bp, Myxococcus xanthus
agcccgaaatcaaagcgcgaagacctgccccacgtggtcatcctcggcggtggttttgccggcctctacgccgcccgtcatctctacagggcacccgtgcgcgtcacgatggtggaccggcagaatcaccacctgttccagcctctgctctaccaggtcgccacggcgacgctgagtcccagcgagattgcggcgccgctccgggcggtgctggggcaccaccaggtggcggtggtgctggcggaagtgacgggtgtggatacggctggcaagcgcgtgctgctctccgacggagagctgaactacgactacctcgtcatcgctacaggggccacacactcctacttcggcaatgacgcctgggctcagttcgctcccggcctgaagtccatcgaggacgcgctggcgattcgccggcggatcctggtggccttcgaactggcggagcgggagacggacccggagatccgccgctcgctcctcaacttcgtcatcatcggcgccggacccacgggggtggaactcgcgggctcgttggcggaaatcagccggcattcgcttcatggcgacttcaggaacttcgatccgcgggacgcgcgcatcatcctcatcgagggcatggacaaggtcctgcccgtctatccggatgacctgtcacagaaggcctgccgcacactcgagaagctgggggtggaggtccgtacgggggctcgggtcaccaacatcaccgagcaaggggtcttcatcggccaggagttcatccccgcgaggacggtattgtgggccgcgggcgtggcggcatcgccggtggcgaagtcgctgggcgtcgaactcgaccggtccgggcgcgtgctcgtcactcctgagctgaccataccgggccacgacgatgtcttcgtcgtcggtgacctgtccttgctcaaggatgcggagggcaagccggtgccaggccttgctcccgtggccatgcaggaaggcaagcacgccgcccacaacatccgccgccagttgcagggcaagccgatggtgcccttctcgtactgggaccgcggctcctacgcggtgattggccgaggccacgcggtgggcattgccttccgccgcttcaagcaggcgggcttcggtgcctggatggcctggctgctcatccacatcaccttcctcatcggcttccgtagcaggctggcggtgctgctcaactgggccttctcgtacctgacgtttggcaagtcggcgcgcatcatcaccggcccttcgcctcgcctggaccggctccagcccacccacgccttgccggagggtgggcagaccccgtccatcgcagagccccgcttccagacgacgacgtctcacgcggagtccgcgacgaccgggacgcactga

SEQ ID NO: 3697 - DNA, 573 bp, Myxococcus xanthus
atgaaggtggcgttcgccgtgttccgcttctgcctctacggcatggtggggctcagcgccgaaatcttcttctacaacctggtgcgcatcgcccagcacgtgccgttgctggaggcgctcttccgctttcaatggcgcgtggacgaccggttggggctcaacgccatctgggatacgcccatctccacggcgtatggacagtgctcgctgtggatgttcgtcatctacggtgtggcgtgcttcttcttcatcgagccgctctaccgctggatgctgtaccagcacacgggcctgcgagccgctgtgtacggcgtggtcatcctgctctttgaaggcttctccggtgtcatgctggagcggctcacgggataccgcatctggtactatgcggatgccggcgccattctctggcagatgacctcgctctacatcctgcccatctggatggtgacgggcctgctggcggagttcatctacagggagctgatggaccctgacctcctggcggccttggagtctccgctgcccgccacgccggaagagaccgaggcctcgttccagttgattcggtag

SEQ ID NO: 3698 - DNA, 735 bp, Myxococcus xanthus
gtgacatacaacggcgccgtgcctggacgtgagacggtcgcggagaagcgaaagcgcgcgttgctggtgatggaccggctggccgcggacatgccggatgcccgcatcgagctggactatcggacgcccctggagctgctggtggccgtcatcctctccgcgcagtgcacggacaagcgcgtcaacatggtgacgccggccctcttccagcgcttctccgacgcccaggcctatgcggaagcagaaccgtcggacgtggagcccttcatccgcacctgcggcttgtaccgcgccaaggcgaagaacatcgtcgcggccgcccggtcgctggtgcaggagcacgccgggcaggttcccttgaagcgggacgcgctggagaagctgccaggcgtgggccgaaagacggcgggcgtggtgtgcatccacctgggaggcgacgtggccttccccgtggacacgcacgtgaagcggctcgcctaccggctcgggttcaccacgaaggcggacccggacaaggtggaagccgatatgcaggccgtgctgccgtcggagcggtgggccctgggccaccagctcctggtgtggcacgggcggcggacctgctttgcccgctcgcccgcgtgtgagcgctgcgtcgtcgcggacctgtgcccgaagaagggcgtgaaggtccagaaggacgccggcgctacggagacgccggcgcgctcgcctcgcgctcgcgcgaagtcttga

SEQ ID NO: 3699 - DNA, 270 bp, Myxococcus xanthus
atgaccaaggcagaactcgtcgaggtggtggcggcgcagacacgtctcaccaagaagtcggcggcgcagatcctcgacatcgtcttcaccaatatcggtaaggcggtgaagaaggacgcccgcttcagctatcccggctttggaacctggtcggttcggtcgcgcaaggctcgcaagattcgcaacccccagaccaacgagatgatgaagctcaaggcgtcgaagacgatcggcttccggcccgccaaggagctgaagaactccctctag

SEQ ID NO: 3700 - DNA, 531 bp, Myxococcus xanthus
atgagcgccagcctcgcgccgttcctgggctacatcaccctgcccctgtccgacctgctggtgaaccccgagcacatccccccgcgcatccagcggcaggtctacgcgaacatgatgtcgtcgatgagccgcaaggtgctgcttcagttccaggactggattgagcacgacatgttccgctcctttgaccgcacgaaggactggcgcgctggcatcgcacagctccagcttccgctgctcgtcatgggcggcagttcggaccggctggccacgccgggcaacgtggagtcgcagttcgcgctcgccaccgcgcccgaccgcacgctgcatatcttcggcacggaccatggcgacaagatgaactacgggcacggggacctcatcttcggcaccggcgccccgtcggaggtctatcccgtcatccgcgagtggctggagcgacatgcctccgccctgcccgccgccatcaccgaccccgctcccgccccagtggaagaggagcctcgcgagccggagcgctccgtcccatga

SEQ ID NO: 3701 - DNA, 1029 bp, Myxococcus xanthus
atgagcaagctggcggagaagctgaaggcagtggcggcggcggtagcgagcatcgagaagcagttcggacgaggctcggtgatgacgttgggcggggaagcacgcgaacagaaggtcgccgtcatcccctccggctcggtgggggtggaccgcgcgctgggcgtgggcggctatccccggggccgtgtggtggaggtcttcgggaacgagtcctcgggcaagacgacgctcaccctgcatgcgattgcacaggtgcaggcggcgggtggcgtagcggccttcatcgacgcggagcacgcgctggatgtgtcctacgcgcgcaagctgggcgtccgtgtggaggagttgctcgtgtcgcaacccgacaccggcgaacaggcgctggaaatcacggagcacctggtgcgctccggcgcggtggacctcatcgtcgtcgactcggtggcggccctggtgccacgggccgaaatcgagggcgagatgggggacgcgcacatgggcgtccaggcgaggctgatgagtcaggcgctgcgcaagctgacgggcgcggtgagccgctcgggcacgtgcatcatcttcatcaaccagattcggatgaagattggcgtgatgttcggcaatccggaaaccaccacgggtggcaatgcgctgaagttctacgcatccgtgcggatggagattcgccgcacgggcaacatcaaggacggtgatgccgtcgtgggctcgaaggcgcgcgtgaaggtggtgaagaacaaggtcgccccgcccttccaggaagcggagttcgacctcatgtacggcagcggcatccaccgcgtgggggaagtgctcgacctcggcgtggccacgggcctcatcgagaagtcggggagctacttcagcctgcgcggagagcgcatcggccagggccgggagcgcgccgccgagtggctgcgcgaacatcccgacgtgctggaagcgctgggcaaggagattacggggacttccgccctgccctcctcgcccgcgccggtggaggtcgcggcctag

SEQ ID NO: 3702 - DNA, 1587 bp, Myxococcus xanthus
atggactacgggaagcatctgaacctgcacaccatcatcatgctcagggatgtcatccgcaagtggtggcaggtcgagctggcgttcgcggaccgccacggcatggtgcatgagtggcagcgcggggaaatcagcccgccgccgaacgccttctgccgtgcctccctgacctcaaaagagggcttgcggcgctgcggccagtccgtccgtgtactgaacgagaagttcaaggccaacaagaaggtgcgccgctcgctcatccacgactgccacctcaacttcagcatcgtgggcgcgcccctctacatcgccaacgaatacgaggggttcctcttcgtcgagggcttcgcccgccagcctcttgacgcgcgcgaagcggacgtcctcaagtcgaaggtgcgccagttcgccccgcagcacgcgaccctggacgggaggagcgagcaggttcccgtcctggacggcgccgagctgagcaagctgtccgacctgctcgagtgcgcggcgaacgaaatcgccaaccacgaagcggcggaggcctcccggcaggaggacggcgcgcccgggtcgtcccgtgagctgagcgaccgctaccgcttcgagaagatcatcgggcgctccgggcccatgatggaggtgttccggttgatggagaaggtggccaactccgactccaccgtcctcatcaatggcgagtccggcaccggcaaggagctggtggcccgcgccatccacctcagcggcccgcgcgcgcagcagcccttcgtggtgcagaactgctccgccttcaacgacaacctgctggagagcgccctcttcggccacacccgcggcgccttcaccggcgcgctgcgcgacaagaagggactcttcgaggtcgccgacagcggcacgttcttcctggatgaagtgggcgacatgtccgccgcgctgcaggtgaagctcctgcgcgtgctccaagagggaaccttcctgcccgtgggcggcacgcagctcaaggaggtcaacgtccgcgtcatcgccgccacccacaaggacctgagcgagctggtgaagcggggcgagttccgcgaggacctctactaccgcatcaacgtcatccgcgtgcagctgccgcccctgcgggagcggcgcgacgacatgcccgtcctcatcgaccacttcctgcgcaaacaccaccgcgagggccagcgcgcgcgggggctggacgcggaggccctggccatcctgggcgcgtacgcgtggccggggaacatccgcgagttggagaacgaaatcgaacgcctgctcgtgctggggggcgacttggagtccatccccgccgagctcatctccagccgcatccgcgacgccgtgttgcccggaggaggccccttcatctctccgcgcgcccacggcaagctgcacgaggccgtggaggccctggagcgggagatgattcagcagggactgatgcgcacgcgctacaacaagagccggctggcgcgagagctgggcatcagccgctccaacctcatcttgaagatctcgcgctacggcctggacaagggcctgcccgaggacgagtcggagatgggcgacgcatga

SEQ ID NO: 3703 - DNA, 1644 bp, Myxococcus xanthus
atgttggcgagggtgcggtcgggggcgttgatgggtatcgacgtggtggtggtggagtgtgaggtcgacatggcgctcggcctcccctacttcaacgtcgtggggcaggcggagggcgcggtccgggaatcgaaagtccgcgtcatctccgcgctgaagaacacgggcttcgagcttccccagaagcgaatcaccgtgaatctggcgcccgcggatttgaagaaggaaggcgcggcgttcgaactgccgattgcattgggcgtcctagcggcggcgaagttgatggatgaagccccgctggaacggcttctcttcggaggcgagctgtccctggacggcacactccgccccatcaaaggagtgcttccgttggcggtggcggcgctcaacggcggcttcgaaggtgtcatggtgccttgggccaatgccgcggaggcagcgctcgtcgaagaactgcgcgtcattcccgtgaagaccctgcgggaggcggtggaccacctgacgggggcccgcagcatcccgccgtacacgcggcagcgggaaccccgtcttctggcgcccacgggacaggcgcctgacatgtccgatgtccgcgggcaggccgacctgaagctcgccctcgaaatcgccgcggcggggggccacaacgtcttgatgtccgggccaccgggctcggggaagacgatgctggcgcggcgcctgcccggcatccttccggagatgacgttcaccgaggccatggaggtgacgaaggtctactcggtgctgggcttgctgggcgaaggccacgcattgatgcgcgagcgcccgttccgcgcgccccaccacaccctttccgacgcgggcctggttggcggcggcctctcggcgaggcctggcgaactctcgttggcgcacaatggcgtgctcttcctcgacgagcttccggagttccggaggaacgtgctggaggttctgcgccagcccatggaggaaggcgtcatccacctggcacgcgccaaccagaacatcacctatccctgccgggtcatgttggtggccgcgatgaacccctgtccctgcggttactacaacgtccccagccgctcctgcacttgcggcgagcagcgcgtcttcgactacatgacgcgcgtgagcgggcccctgttggaccgcatcgacatcagcctgcagacgcgcccggtggagtatcaccacatggcccgctcgacggtccaagagccctcgagccgctactaccgcgagcgggcccaggtcgcgcgcgagcgtcaacgcgcccgctatcgcgatgagccgggaatccactgcaacgcgcagcttcccgcgcacctgctgcgccggtactgcgccatgagcgaacgggccgagcacatgctgcagcaagcggtgcggatgttcggcctgtccgcgcgagcccatgaccgcatcatgaaactggcgctcacacgggcagacctcgagggacgcgaccgcatcgagcagaccgacatgcagctcgccatcaactgccgcatgctggaccggcgaggggcgatgcaaggcaagcttcacggagcccgccctgcccctccgcccgaggacgccgcttggcggaacaccgggccctccggcagggccagcccgctggaggacctggatggttga

SEQ ID NO: 3704 - DNA, 306 bp, Myxococcus xanthus
atgcgggccacacagaacttccgggctggcaacaactacacggaatccaagctgcgtgagctggggcccacccagttcgagctctggatgaacgaggtaggcccctaccctgccttcaccgcgggcatcatccacgcggggctgcgggtggccggtgcgcaggacatcgtcatcgagatgtccggctacgacggccacgcctgcgtctaccgaatcaactggaacgaggcctcggtctcttccggcgtggcgggcagcggagactccaaggccgccaggaggtcagggtccatcagctccctgtag

SEQ ID NO: 3705 - DNA, 165 bp, Myxococcus xanthus
atggcggatgacgccaccaactacgggcggctcatcactgcgctggacggcgcgaacaccgctggtgcgaaagtcctgggcatggccacggagctgccgcagaacgccatcatccagggcacttcggtcgatacgccgaccccgccccccgcacccacgccctga

SEQ ID NO: 3706 - DNA, 243 bp, Myxococcus xanthus
tacggggacctggacacgctggtcggcagctccggcgcgggcgtactcaaccagcaagggcacctgctgggcgtccacaccgacggagactgtgaggtcaacggccggggctccaaccggggcgcgcccgcggaagtcatcgtcgaagcctccgcgtatctgcaaatcgaagacatcgccgtgccgtccactgcgactcgcacgaagggggcggacgccccatccgcgcggctcgcgccctga

SEQ ID NO: 3707 - DNA, 149 bp, Myxococcus xanthus
atggaagtcgcagcatccccgaatgccgatccacacggcgcaccgtcgctggggctgttccggctcacgtggcccatcttcctggagctgctgatcttcatgatgatgggcacggcggacacgctgatgctcagcggcgtgtcggatga

SEQ ID NO: 3708 - DNA, 2253 bp, Myxococcus xanthus
atggcccggagcgcggcgaagaccaacccgaacgccgcctgcaacgtcctggtgcgcgacgccgcgctgaacgccgtggcgagcctgcccgagcgcaccgtgctggtgcccatcacccgcaacgcgagcggccaggagattgcgccagacgccgccaccaagagcgtggccttcgtcgaggagaacccgaacgcccgctacatgagcggcctctccagcttcatgctgggcaccgcgcaccgcgaccggacctacttccccgcgtcgaccaagacggccaccctcatgcgcttcgcgcgcctctcccagcgaaacgcgtggaacaactccggcaacaccgtcgactcctgccgcgagtacgtccacgagaagtactacgactacagcgtcttcgaggacgccatctcctccgcgggcaccgactaccgcaaaatcttcgacatcgcctacgcccaggcgcccagcggcggcagcgtgcccgcctccgccattggcacccgctcgattgcggacccggtgcagcgcggcaaggacggcacccctatccaacccgccatccagttccccgccggcgcgccgaagaacgagttcttcaccgtgccgcctcccgtacagggcaaggtcaccatcagcgccagcaacgtggaccgggtggtcgtggttccaggcgggaggggcgtggccttcatcgagctcaaggacctggaccgtccgctgaacctctacggcaccatcctgcccgaggcgacgctgtccaccctggcgaacggcgccagctactacaacgagagctgggcgtggcaccgaagcatgagcaccattcgcaacgccaacgtcctggatgagcggatgtacgaactggaccggctccaggaggagttcgccgcgctcgtccagcagcgcaaggacctggtcagctccatccaggtggagctggcccggcgctaccagcccatccaagggttcctgaaggccgagccggaaacgtccagcaacctgacggacgacgacgagccccaggacccggtcgtcacccagctctaccagttggcctcgctggatgccgtcatcgaagcggcgctccagcaggcccaggcgaaaggctgcctcaacttccagattggcaaggccgccgctccctgcgactggtcgcccaagcgcttcgcgcgcagggtgatgaacctctaccagggcgcgcgtgagcaggacttccagaagtgctcgacctatacccgcgacgacttcgcggacctcaaggccaggcccctgcagattggcaccgtcaactaccccgcgcaggactacacgacgagcccctcgcgcctggagacgtacttcacccgacgggaccagtacatgcgcgccctgtcctccacggtggggcccatgctggatccgaagacggcgcagccccgcctgcgctgggagtccggtgacagctacagcctgggcaatgacaccttcggcgccaccgcgaactaccaggtggccgtggccatcaacaacgtgaagaacacgcccgactgcggcctctccccggaggtgacgggcagcttcaccgccaccggcagcgccctgggcatcagcgccaacctcatcaacgcccaggtgaatgtgacgcagaagcgcgcggacatcgacctggacgtgctcgacaacaccgtgccgctggtggacatccacaagaacctgacgctgggccagttcaacatcgtgtccggcaagcaggagaagaaggccacgctggtgagcgcgcaggccaccttcgtcatcgtggtggtccccgtcacgatcggcgccaaggtggccggcgtggtggggctcgaatacgggttgtcggcggatcacaaggtgacgggcaccacggcgtgcagcgtgacgagcgtgggcatcaccggacacgtgcagccctacgcgcaggtggacggtgagctgtacgcgagcgtcgacctcttcgtcatcgaggcgggcgtgaaggggcgcctccaactggtccacgccgccgtcccgctcaacgccaacgtctggctgtcgccggtcggaggcagggtgaagctgcgcatggaggggaactccgacctgcgcttcaccttcctgtccggcagcatctccgcctacgtggaagtgggcatctggcccttcgaaacggagttcgaggagacgctcgtgagctggaacggcatcaccgagaacgtgaagttgttcgaccactcgttcaacgtcgacctcctcgacctccgctccctgctgtaa

SEQ ID NO: 3709 - DNA, 1869 bp, Myxococcus xanthus
atgaacgcacgcaaggtcatcactggcggtgcactgctggcactgctgctcctgggagccgcctggctcttccacacccaggcccccgtcaccggggcgcctccagcggcgacgcccctccgcgtccacttccccgtgggggagcgccggacgtaccgcatggactacacggcccggaccgaggtgcgcctcgccgggtcgcaacagaaacccaccgccatggggggccgggcccacttcgttggagacctggtcctccgcggccaccccgcgcagggcaccgccctgcgcgtggggctgagcctggagaacctccacgagcacacgctcgagctgtttggccacgcgctgctgccagacgccgcggccgtcgcggccaccttcaccggccgcgaggccctgctggacctggacgccgacggcaccctgcgcgccgtctccttccaggaggaagacccctccctcttcaagaacaccgtgcagacgctggccggcgagctccagtgggtgctgcgcgacggcgccacctggcaggtggaggagctgacgtcgcgaggcacggccctcacggagtacgcgcggctggacgaaggcgccctgcccgcgcgcatcctcaagcggcgcctggcctacccggagccccgcggcatgggcacgggcagcggcgccgtggaggtggactcgcgcttcgagatgacgctggacgcggacggcgtcctggagcggctctccggtgaagagcgggtgctccgccgcccgaccggtggcggcgaacccaccgccacctcgcacatccagctccgcctggagcccggcaagcgggaccggttcgtggtggcgcaggcctccgccgcgcccgccgcgccgctccaaaagctcgcgccgggcgaactggtgacggacgcccacgcgcgggagcggatgctggagcagcaggtggatgggctcaccccggagcgcttcttcgagctgatggagaagtacgccaacggcggcaccttcccggaacacaaccacttcctcctccaagccacgggcctgctagagcagcagcccgagctgtgtgcgcggctggccgacttcttccagcagtccaccctgaagccgcggggccgggcgctggtgctggacctgctggcgggcacgggcacgccggaggcgcagacggcgctggtgcgcgccctgtccagcccccaggcgctggccgagcccggctacggcatgttgctcagccgcctgtcgctgctgaccagccccacccccgacacggtgcgcttcatcgaacgcacccaccgcacggcccgtgacgacacccgcgtggccaccgcctacgccctgggcgccaccgccggcgccctctaccggcagcagcaggacgcggagtccctggccgccgtccagcagctcggggccgagctgcgcgccgcgcgcacgcccgaggacaaggcccacctgctgctcgcgctgggcaacgcgggcctggaggagcaggtggacgtcatcgcccactacgcccaggacgcggacgcacaggtgcgccgggcctcggcccgcgcgctgcggaagattcagacgccccaggccatgcgcacgctcctctccatgaccgaggacaccgacgcgcccgtgcagtcctccgcgctgacggcgctgggccgccgggacctggacgaatcggccctgcgccaactgcgcgacctggccctctccggccgcgtgcccgtggaaaaccaccacaccctggtgacggtggtggagccctacctccagcgagcacccgaggtgcgccagctcctccagcacctgctcacccaggacgtgcctgacgcccagctccacacgcgcatccgaggcctgctcgggacgtga

SEQ ID NO: 3710 - DNA, 1305 bp, Myxococcus xanthus
ctctgggctcggatgctggatgccatccgccaggagaagttcgactacgcgctgagatggctggagcggatgcgcccgctggaggtgcgtgacggtgccctggtgatgggcgttccggaccgcttcttccgcgactgggtggatgaccactaccgccccatgctggatgtccagctcgcacggatgggggagggcctgacctccatcgcctatgaggtagtggagggcctggagccggacccgcattttccacccacaccctcagtcaaggcgagcgccacgcgtccgggccggctgaacgcgcgcttcaccttcgacaccttcgtggtggcggacagcaaccagctcccggccgccgcggcgcaggccgtggccgacaagccgggccaccactacaacccgctctacatctacggcggcacgggtctgggcaagacgcacctgctccaggcagtgggcaacctcatctgggagcgagatccatcccagcgcgtggtgttcctctccagcgagcagttcaccaacgagtacgtggagagcgtccgcgagcaccgcatgggggacttccgccggaagttccgtgaggagtgcgacgtgctcctcctcgacgacatccagttcctcggcaagcgtgaggagacgcagaaggagttcttctacaccttcaacacgctctacgagatgaacaaggccatcgtcctcaccagcgacaccgtgcccgcggagattccgggcctggaggaccggctgcgcagccgcttcgccatggggctgatgacggacatccgcgagcccacctacgagacgcgggtggccatcctccagaagaaggccgtggccgaaggtctggacctgccggactcggtggcgcacttcatcgccaagcacatccagaagaacgtgcgcgagttggaaggcgcgctggtgaagctgtccgcggtgcacagcctgacgcgccagcccgtgacggaggacttcgcgtcccaggtgctgcgcgacatcctccccgcccacagcgcggtggacgtggaggccatccagcgcgaggtggcccgcttctacaaagtcacggtggagtcgctgaaggaagaccgccggcacaaggccctggcccatgcgcgccaggtggccatgtacctcagccgcaagctgacgaagagctccttcccggaaatcgccgcgcgcttcagcaaggaccactccaccgtcatctccgcggttcgcaaggtggaaggcctccgcgtgacggatgccaccgtgcagcgtgagttggcggagctggaattgaagctcggcaatccctga

SEQ ID NO: 3711 - DNA, 1458 bp, Myxococcus xanthus
atgcaggcgctccggggcatgttcgagcggccggtgtacgtgggccaggacgtgcggggccgggtgatggccgtgcacttcgatgcggcgcaggacgcgacggcgcggcggctcgtgcgcctgctgctcgcgtcgacgcagttcgtggcggaggacggcccccgctggagcaccgaggagccggactcgcgcggtgacctcgaagccgtgtaccgcgcgggtggcagcgcgaacacctacgtgaagacgaagcggcgctacctgcgcgctggctcggcggtgcttccacggctgcaagggcacctggacttcaccctgttcgcggatgggcacgtgaaggaagcgacgggctcggacgtggtggagttgggcggaggcagcacggggctccctcgcatccgcgaggaggcgagggtcgcgttgaccaacgtgggcgtggactaccggctttcgtcgctgaggccgtttgaggccacgcggacgacgttgcggtcggagcggctcacggattcggccgacatggagggggcttcgctggaggcgcgggacaggcagctcgtgaagggggtgaagctggatgacttgctgcgggcactggcgaagcgcgaggacctggacaccgcgcggctgcgactgacggccttgttccgacagaatctggcggaagtggaacgagccgtggcgctgattcgtcagggctccgcggacgcggtgcgctccgagcagatactggaggcgctggccagcgcggggacgccagaggcgcagcgggcgctggtgtccgtgttggagggagaacgggtccggccgaagacccgggcccacgcggcacgggcagcgggacggatggaacggccttcgctgctgctcggtgatgcactggagcgcgtgatggatgggacgcgggacgcgggggtgaggaacgcggcggcgctgtcgatgggggcgctgtcgaagacgttggaggtggcggagccgggccggagccaggcgctggtggagggaatcgtgaggcgctgccgcacgggtgctttggagcccgaggtctgtctggatgccctggcccgggcaggtgctccggtgggattggcctacgtgaagtcggcgctcgtgcatccggaggcggatgttcggggcgcggcgacgaaggcactgagtgccattcctggcgcggcggtggatgcattgttggaccaggtgatgctcgacgacccgagcccgcgggttcgtgcgctcgcggtgaaggctgtctctcaacgggtcactggcgcccacttggaagtactggcccgggtgctgcgctccgagcggagtgagcgcgtccgcatcgaagtggtgcggctgctgggccacctgcaagccgtggaggctcccgctgcggccctgcttcgcgatgtggccgcgaacgatgggtccgcgaacgtacgcgcgctggcggcgtcactgctcggcgaatag

SEQ ID NO: 3712 - DNA, 2665 bp, Myxococcus xanthus
ttccgaatgaaggccctcgtcgccgcagccctcgtgttcagcgggccgccggcgcttgcccagacaccgacaccccaggaggcgaagccactggagcccggccgcgaggcgctcgccatctcgtatgagaaatacgcgctgcccaacggcctggaggtcatcctctccgtggaccggaagctgccagtggtggccgtcaacgtctggtaccacgtcggcgcatatcacgagcaacccggccgcaccggcttcgcgcacctgttcgagcacatgatgttccagggctcgcgcaacgtggccgacgacgtccacatctcccggctggagcagttgggcgccaccgacctcaacggcaccaccagcttcgaccgcaccaactacttcgagaccgtccccagcaaccacctggagacggcgctgtggctggagagcgaccgcatgggcttcctgctcgacgccatcacaccggagaagctggagacccagcgcgaggtggtgaagaacgagcggcgcgaatccattgaaaccgcgccgtacggcgccgcccgcgagaaggcgtggcacgcgctcttcccgctgccgcacccgtaccacggggatgtcatcggctcgatgaaggacctgaacgcggccaacgtggacgacgtgaaggacttcttccgcaagtggtacgcgccgtccaacgccacgctggccatcgtcggtgacttcgacgtggcgaagacgaaggcgctggtggagaagtacttcggcacgctgcccagccacgcccggccgcagcggccggaggtcgcgccggtgaacctcaccgcgcccgtggtgctgcgcgaggaggagcgcgtggcccggctgccgctcttgtccatccagtggctcacgcccgcgtacctggaagaaggggacgccaccgcggacgtgctggccaccgcgctgtccaccggcaaggccagccgcctctaccgccggctggtgctggacaaggagctggcccagagcgtcagcgccacccagcagagccagggcgcgcagtccgtcttctcggtggacgtggtggcgcggcccggcgtgtccacggacacgctgctccatgaggtggacgcggtgctggacgaggtccgccagcagggcatcaccccggcggagattgcccgcgcccgcacgcgctacgacacgcgcacgctggccggcctccagtccgtcggcggcttcggcggcaaggcggacgtcctccagagctacaaccacttcgtcggcgagcccaactacgtggcccaggacctggctcgctacgagtcggtgacgcccgaagccgtgaagcagttcgcccaggacacgctgcgccccggcgcgcgcgtcatcctccacgcggtgccgcccgcacgccggcaggcgcccctcgactcgaaggagcgccactgatgcgccgcctcttctccgccctgctcgtcaccacgctggccgcctgcgccagcaacccgaagcccgcgccggccaatccggactcgcccgcgctgggagagaaggcggctccggccgaagccacggctgacgccgagtccttccgcgccacgccgccccagcccggcaaggcgccggacctggtgctgcccaccttccagagcgcgaagctggacaacggcatcaccgtgattgtgagcacgcggcgggagctgccgctcgtgttcgcgggtgtggccttcgccgcgggcagcgcgcaggaccccaagggcaaggaagggctcgccgagctgacgtaccgcatgctgcttgaaggcgcgggcaagcgggacacggtgacgctggacaacgccttcgcggacctgggtgtgactcccgccatggacgtgcaggcggacggcgcgcaggtgggcgtgcgcgtgctgacgcgcaacctggacgcggccatggccctgctgtcggacgtggcgctgcgacccgctttcaacctcgacgccttcgagcgccgcaagaagcagcagctcgcggacctggcgcgcgcgatggggcagcccggtgtgctggcgcaactggcctacctggaggccgtgttcgggctgaaccacccctacgggcacctccccgacggcacgcccgcgtccgtgcagacgctcaccctggcggacgtcatgggcttctaccggaagcacaccggccccaaggcccaggcagtcatcctcaccggtgacatcagcctggaagaaggggtggccctggcgaagaagcacttcacctggtcgaagaacaaggccacgccgccgcctccgccgccggccacgaaggccccgccgcgtcagcaggtgtacgtggtgcccaagccgggcctggaccagacgctgctgctggtgggccgcgctggcatcgccgcggggaacccggacgagtacccgctggagctggccaccaccgtgttcggtggcttcttcggcagccgcctcaacatgaacctgcgcgagaacaagggctacagctacggcgcgggcgccagcctctctccgcgcctgggcgtggggccactcaccgcgtacagctccgtgcgccaggacgtgacgggcccggccttgaacgaagtgatgaacgagctgacgggcctgaagaaccggcccatcaccgccgaggagctggaggccgcgcgcgagggcctcatccgcgccttcccgggcgcctt

SEQ ID NO: 3713 - DNA, 894 bp, Myxococcus xanthus
gatggcgcgcagttgtattaccaggtccagggagatggccttccgggcatggtcttctgtgacggcctgggctgtgacggcttcgcctggaagtacctggcgccctacctggtccggaaccaccgcgtgctgcgctggcactaccggggccacggccgctccaccgtccccgaggaccgctctcgcatcggcatgctgtacacctgcgatgacctgcggcggatgctcgacgccgtggggatggagcgcgtcgtcctcttcggccactccatgggcgtccaggtggcgctggagttccagcgccgctacgcccagcgcgtgtgtgggctcgtcctggtgtgcggcagctacggcaacccgctggacaccttccacgactccaccgcgctcaagcgggcattcccgctcatccgccgcgtggtggagcgctaccccgagcagtccgcccgcatcatccacacggtgctgcgcacggagctggccgtgcagttggccatcaccctggagatgaaccgggagcgcatcgcccgcaacgacctggccccctacttcgaccacctggcccggatggaccccgtcgtcttcgtgcgcaccctggagtccatggcggagcacaacgcgtgggaccacctgcctcatgtggacgtccccacgctggtggtggcgggcggccaggacaagttcacgccgggttggatctccgaggaaatggccgaccggatccccggcgccgagctggagctcatccccgaaggcacccacaccaccccactcgaagcccccgggcgggtggaggcccgcgtcgagcgcttcctccgggagcgactgaacgtgcgtaccggcgccccctcacccacgcctacaccggtggtgagccctcccgctggcccctga

SEQ ID NO: 3714 - DNA, 1038 bp, Myxococcus xanthus
atgaccatcgcggccctggcgaccgcacctgccgcgggcgccgtgggcatcctccggctgtcgggcccggaggccctggatgtgggccggctgctggccccgggtgtgcccgcgcagcccacgccgcgccatgcgtacctcgcgtccttcgtggatgcggagggtcgctcgctcgatgagggcctgttcctctacttccgcgggcctcagtccttcacgggcgaggacgtggtggagcttcaggcccacggcagtccgcggctgctgcggctgctcctgacgcgggcgctggaggacgcgcgcgtgcgccacgccgcgcccggtgagttcacccgccgggccttcctcaacgggcggttggacctgacgcgcgcggaggcggtggcggacctggtggcagcggactcggaggccgcggtgcgtgccgcggctgcggggctctccggcgcgctcgcctcgcgcgtgcaggccctggaggagccgctgcgcgcgctgcatgcggacatggagggcgtgctcagcttccctgacgaggcggaaggcgcggacgaggacgtgggcgagcgtgtcaccgcgctgcgtgcccaggcggagacgctgctggccgaggtgggccggggccggctggtgcgcaggggtgctcgcgtggcgctgttcggtcccgtcaacgcgggcaagtccacgctgttcaaccggctggtgggcgaggcccgcgcgctggtggatgacgagcctggcaccacgcgggatgccttggaggcccgggttgagtgggacgggctggcggtgacgctcttcgacaccgcggggcttcgggagacgccgggacgtgtcgaggcgctgggcatcgcgcgaacgcgggcgttgctcacgggcgtggacctggcggtgctcgtgcttccgccgggtgtcacacaggcggaggtggaggcttggacgcgtgacgtgggaggcacgcccgtgctggtggtggacgggaagtgtgatgtggccgaggtatccagctcgccgcgccagcgtgtgagtggcctcacgggt

SEQ ID NO: 3715 - DNA, 228 bp, Myxococcus xanthus
atgggcaaggcgaaagctctcaaggacaagctgtacggcgcggcggtgctcaagatgagcttccgccttcgcggggatgaggagtcccctgcgttccgcttcgtctacccgggtgtcctacgggacctggagctcgaggacgaggcggtggagcgagacatcgaggagaaccgcgaggacgaggagaatgccgaccgcggctccacgcctcccattgggacccgctga

SEQ ID NO: 3716 - DNA, 678 bp, Myxococcus xanthus
atgggcttcccggcgcggctggacatgaaggacgccgccgacggcagcctgtcggtggcgctccacttcgagcccgcaccgcctcccggtgtggaggtgggacggcgcagtcaggtggtggactcgctccagttcctgttgaacaagatgctgcatcgccctggcgccgaccggcgctgggtgatgctgggtgcgggtgtgcacccggagccccggccgcgccgtgagccccaggccgcggcggctcaagccgcggctccggccgcccccgcccccgcccccgccgcgccccgtgccgcggcggcccaggcgccagcgcctgctccggcgaagggaggccagcggggtgcgcaggcgcccgccgccaaggccgctcccgccagcaagggcgagggggatgagcgctcggtgacggtggaagaggatgccgcgctgaaggcggccatcaggcagctcgcggagaagtcgggcagcctgggccgcttctacgcgattgccgccatgaagcttgaagaccgcgcgcgcgtcctcacgtcagtagaaggagtgggtggcgtgaaggtgtcggcggagggcgaaggccgaaaccgccgcgtggtgttcactccggacaagcccgccccgcttcccaagcggagcatgctgccggacgacgacgaggacgacttcgacgcgtga

SEQ ID NO: 3717 - DNA, 1272 bp, Myxococcus xanthus
gacggcgtcaccttcaccggccgccgcggaccgtgggaggtcgtgaagacggtcaagtggcccatggacgggttcgagctgagctacaccctccaggtgcgcaacacctccggccagccgcagagcggcgagctgcaggtgcaccacaaccgcgccatcgaccccaacttcgagcacgcgccgtccttcttcggcggcgtgggcaacctgagccgctccgcctgctgggtgggtgacaagctccagaagatgagcccgggcgacgaccacccggacgccgaggacacccgcggccagattcagttcttcggcatcgaccagcagtacttcctgtccgcgctctacccgctggaagggccgcgcgccggctcgtgctccttcgaggccacgcccaccctgcgcaaggtgacggcgtccttcccgattacggccgcgccgggcgagacggtgacgctgcgcttcggcggttacttcggccccaaggatacggacctgctggcccaggtgcccggtgcctcgctgcgcgcggccaccggccagacggacgcgacgttccacccgccgctggcggagacggtggacttcggcatctgggccgtcatctgcaaggtcctgctgtgggtcatgaagttcttctacggcgtcaccggcaactggggcgtggccatcatcctgctcacggtggtggtgaagctcgtcctgctgcccctcacctaccgctccatggtcagcatggaagaggtgaagaagctccagccgcgcatggaggagatccgcaagaagcacgcggacaaccgcgagcagcagaacctcgaaatcatgaagctgtaccaggaggccaaggtgaacccgctgggcgggtgtctccccctcctcatccagatgccggtgtggattgccctgttcaccgcgctgcgcaacagcttcgacatctacggcgagcccttcatcgggcccatctggcgtgacctgacctacaaggaccccacgtacctgttgccgctggcactgggcgtgtccatggtcatcacccagaagatgcagccgcagatgatggatgcgacccaggcgaagatcatgacctggttcctgcccatcatcttcacgctgacgctgctccagtacccggccggcctgtcgctctacatcttcacgaacaacatcctctccatcgcgcagcagtacggcctgcggaagtggctggaccggaacaagccccagacgggcggtgggacgccggcggtggccggtgcgggaggcagacgcaagtga

SEQ ID NO: 3718 - DNA, 219 bp, Myxococcus xanthus
atgagccccctggccttcgtcatctcgctgcccatccgcttctaccggaagttcctcggaccgctgctccccaaggtgtgccggttccatccctcctgctccacgtacgccatggaggcgctggagaagcacggcggcctcaaggggtcgtggctcactctctggcggctcgtgcgctgccagcccttccaccccggcggtatcgacccggtgccgtga

SEQ ID NO: 3719 - DNA, 429 bp, Myxococcus xanthus
aaggtacaagacgtgatgacgaaggacgtcacggtcatcaacgcgaaggattcattgaaggacgccgcgttgaagatgcgcgagctgagcgtgggcccgctgcccgtgtgtgatggtgaccggctgatgggcatcatcaccgaccgcgacatcgtggtgcgtgcggtgtcccagggaaaggaccccaacagcacgacggtggcggaggcgatgacggggcagctcgaatacgccttcgatgacgaggacatctccgtggtggcggagaagatgaaggagaagaaggtccgccgcatcctcgcgctcgaccgggacaagaagctggtggggattgtcgcgatgggcgacttgctggaggcgctggcggaggaggacgtcggcgagaccctggagagcatctccgaggcccctccccccgctgcgcactga

SEQ ID NO: 3720 - DNA, 228 bp, Myxococcus xanthus
atgctgaagcggtgtcctcggcacgagggcaaggtcgcccggaagtacaagctggagcagttcctcgccatggtggccgaggagctcgacaccacgcccaacgaggccgaacgcctggcccgggccgtgttcgtcacggtgcgaaatcacatcagcgagggcgaggccgacgacgtcatgggccagctccccgcagacctgcgctcgttgtgggtgcccgaggcctga

SEQ ID NO: 3721 - DNA, 723 bp, Myxococcus xanthus
atgtactgccctgcctgcgcggtgcgtccggaggtgaactacctggaggccttccggctcaagctctggggacggagggacgcgagcgcctggctggtggtcggtgtcacggtggtgctcgtcgggctggcgctggtggcgctgatggccggggacgtcggcaccacgctggcgtgcctgggcagctcgggcgtgggcgtggcgttcttcctgggcatgcggtgggcgcgcatgggcctgctcgccgtgccgctgctggcgatgctgctcaccgcgcagtccctgggcgcgcccgcgttgcttttcttcattcccctcatggtcgcggtgaacgtctttcgcgacacacgcagccggctcttcttccgcctggatgtccccgagcgcgagctacgccagctatgggacctgcgggtcaacaacccccttgctcggcatgcgctgtcgctgagcgtggggtcgctgttcctgcccgtgttcgcgccgctgctctcctacttcggggtgtggagcgcgctgacattcgtcttcgcggggttgtccatgctcgccctcatcctgggcctggtggcgctgcggcgggtggacccggaggcacggccgcccattggccggcggtgggaggcgctcggcgcggtgtgtctggcgttggtcgcgctggcgctctggggcgtgttgcaccggactcggatggtggagctgctcggcggcgcggtggactga

SEQ ID NO: 3722 - DNA, 507 bp, Myxococcus xanthus
atggaggccctgggcgaggggcccgcggtgctgcgcgaactggtgcatgcgccggagcgcacggtggaggccctgcgacagggctgtcatgcactggtgcgccgtgagcgggagctgcgggcgctggcgccacccgctgagacccagcggctggacgccgagcgggacgcgctggccgcgcgggtggcttcggaagaggacgcggtggttcgggagcggctggccggagcgctggccgcgctggagtcgcagcggcgtcagcgcgcggagctggccatcgcggcggcgcggctcgaggcggagcacatgcgcctctactacaccctggagagcctctacgcgcaggtgctgcgggtgcgctcggcggacactgtgggagaggacatcgccgggctggggctgcggcagagcgtggagcagctcggtgcggaagtggaagcggtggcgcaggcgctggaggaggttcacgccgcgcccggcggtggtggccggacgcggacgcggtag

SEQ ID NO: 3723 - DNA, 1176 bp, Myxococcus xanthus
ctctacagcggaggcggcatgcgattggtgaggacgtggagcacggggctcgccgttctgctcctcgcgggctgccgctcgcagggagacccggggccgcagggaggccaagcggccacgaaccagcccatgccggtggaggtggagcgcctggcccccgccgaggtgcgcgagtccaacgagtacctgggcgcgctcatctcccgcagcagcatcaccgtctatccgcaggtcgctggctacgtgaagtcgattccgctcaagccgggagcacgcgtcgaacagggggaagtgctgctcgtggtggacccccggcgagaaagcgcgggcctgcgcgccacccaggcgcagcaagccgccgccatggcgcagcgagagtacgcccaacagacgcgcaagcgcagtgcgcaactgctgaaggagggactccagagccgccaggaccatgaccaggcggtggcgcaggcagtgcaagccgaggccagcgcgcgtgccatcgaagcccaggtgcaggcccaggaggtccagctcggattctacgaagtgagcgcgcccttcgccggcatcgtgggcgactacccggtgaacgtgggcgacttcgtgacgcagcagacggccctcaccacactggaccagagcaacacgctggagctgtccgtccagattcccgtcgagcgggcaggcaccgtccgggtgggcaccacgcccgtggaggtgttggacccggagggccggctcgtggtgtccgcgccggtgttcttcgtggcgcccacgcccaacgccaccacgcagttggtggagatacgcggcgccttcgagaacaccgtgggcctgcgcgcgggacagttcgtacgcgcccgggtcgtctatgccacgcgggaagccttgcgcgtcccgacctccgccgtcacccgcatcagcagccagtccttcgtcttcgtggttcgggactcggacgctggcaccgtggcgcagcgggcgccggtgagcctgggactcgtctccggcaatgactacgaggtgacgggcggactggacgcgggcacgcccgtggtgctcagcggcatccagatgctccgcgatggccagcccatccaacccaaggccccctcgcgcaagccacctcctggcgtaggcggcagcgggaccgacggcggcaccccgccggaacagtga

SEQ ID NO: 3724 - DNA, 1828 bp, Myxococcus xanthus
cgtaacgtcgccattgtcgctcacgtcgaccatggcaagaccacgctcgtcgatcacctgcttcgccaggcgggcactttccgtagcaacgagcacgtcgccgaacgggtgatggactcgaacgacctcgagcgcgagaagggcatcaccattctcgcgaagaacaccgcggtcaattacaagggaatgcagatcaacatcatcgacaccccgggtcacgccgactttggtggtgaggtggagcgtggtctgcgcctcgttgagggcgtcatcctgctggtggacgccgccgaaggccccctgccccagacgcgcttcgtgctcagcaaggccctggccatgggcctgaagacggtgctggtcatcaacaagatcgaccgccaggacgcccgcgcgaaggacgtgctggacctggtgtactcgctctacatcgacctgggcgcggacgagcagcagttggagatgcccgtcctctacaccatcgcccgccagggtcaggcgtccacgcagctggaggtccccggcaagacgctggagcccctgtacgacgccatcatcaaccacatcccgcctccgccgaagtcggacgagccgtcgctgcagctgctggtcgccaacctggactacgacgactacgtcggccgtctggccgtgggccgcgtgcagtccggccgcatcaccgccaacatgcctgtctccgtctgccgcgagggcggcaaggtgcatccgggtaaaatcgtcaagctctacggcttctccggcctgaagcgcgtggagattccggacgcgggtcccgggtgaaatcgtgtccatcgccggcatcgaggagatctccatcggcgacaccatcgccgacgccgagaagccggtggccctgccccgcatcgccgtggacgagcccacgatgatgatggtcttcaaggtcaacgacgggccgctcgcgggcaaggaaggcaagttcgtcacctcccgcaacctgcgtgagcgcctctaccgcgaggcctaccgcaacgtgggcgtccgcgtggaggacaccgacacgccggacgcgttccgcgtggtgggccgtggcgagctcgccctggccgtcatcatcgagaacatgcgccgcgagggctacgagctgacggcctccaacccggagccgatcaccaaggagatcgacgggcaggtccacgagcccatggagctgctcttctgcgacgtgccggagaacagcgtgggcgtggtgacggagcgcctggggccccgcaagggccgcatggtggacatgggctccctgggctcgggccgtacccggctccagttccgcatccccgcgcgtggcctcatcggcttccgctcggagttcctcaccatcacccgtggcgagggcatcatgagcagccagttcgacggctacgagccgtggttcggctacatccccaagcgccagaatggcgccatcgtctccgaccgcctgggcgacaccgtgccctacgcgctcttcagcatccaggagcgtggctcgctcttcatcggcgccggcaccacggtgtacgagggcatgatcatcggcgagcactcgcacgcgtccgagctgaacgtgaactgctgccgtgagaagaagctcaccaacatccgcgccgccggccgcgacgagaacgtcatcctcaccactccgcgggaaatcagcctggagaaggcgctggagtggatcgccgacgacgagctggtcgaggtgacgcccaagtccatccgcatgcgcaagaaggcgctggcggtgggcgagcgctaccgcgccgagcgtgaccgcaagcgcgaggagcgcgcgtccgaaggcgagtag

SEQ ID NO: 3725 - DNA, 240 bp, Myxococcus xanthus
atggccgacatcatccgcgagcgccgcttcaacttcctcatcgccggggtgctgtccttggtcattcccggcctgggacagctctacaaaggccagttcctgcgcgccgtcctgtggttcctgatggtgggggccggctactggttcttcttcatcccgggcttcgtcctgcacttcttctgcgtcctcggcgcggccttcggcagcgcgggcagcgaccgcatccgtcttcccggatag

SEQ ID NO: 3726 - DNA, 705 bp, Myxococcus xanthus
atgtcgggatgggacgtggcggtgacgcggccattggggctgctgttgctggtgctggtctgctgtctgggcttcatcgccctgtcggacgaggtggccgagggcgagacgcagcagctcgatgaacgcatgctgttggcgctgcgcaaccccgaggacccggcgcagcctcgcggaccctggtggctgcggcgcacggcggaggacgtgacggcgctgggcggcattcccgtgctgacgctcgccaccctggcggtgtgtggcttcctcctgctggtgaggcgttaccggacgctgctgctcgtgctgggcgcgacgctggggggcgcgggcctcaatgtcttgctgaagcagttcttcgcccggcctcggccatccgtggtgccgcacctcaccgaggtggtcagccagagcttccccagtgggcacgccatgctgtcggccaccgtgtacctcacgctgggcgcactgctggcgcagctcgccgagcgcaagcgactcaagctctacgtcctcaccgtggcgctgctgctgtcgttcctcgtggggctgacgcgcgtctacctgggcgtgcactaccccacggacgtgttgggcggctgggtggccggactggcgtgggcgctgctcatggcggtctgtgcgcggacgctccgccggcggagccctgcgctgcgcgcggaggcccggcgcccggtggagtga

SEQ ID NO: 3727 - DNA, 1761 bp, Myxococcus xanthus
atgagcctgcgggactggctgtcgcgatggcgttggggcggcgcgccggtgcccgccttctacgacgagtcctaccggctgcccctcaccggcatcgagtcctccgcgggcatcgagccgcgcggcgtggacttcaccacctggtatctcctggaggcccgcgcgctgcgcacccaggacgtgcaccacccgcagccggtgagcctcgccgagctgtcgcgcgtgcatgacgccgcctacctggagtcgctcggccagccggagacgctggcgcgcatcttcgccaccgaccccgccgacgtgccggtggacgcgctgctgtccaacctgcggcgggtgtgcggcggcacgctgggcgcggcgcggctcgcggtggcgcgcaagggcccggtggtgaacatggcgggcggcttccaccacgccggtccggcgcgcggcggcggtttctgcgcggtgaatgacatcgcgatagcgctcgccgccctccacgcggatggcttcgacggacaggccgtggtgctcgacctggatgcccacccgccggatggcacggcggagtgtctggcgggacagaagcgggcctggattggctcgctgtccggtagcgactggggcgcgttgtcgcccgaagtggatgagacgcgcgtccccgaggacacggacgacaggacgtatctggccctgctcgacggactcctggagcgcatgccccggccggacgtggccttcgtcatcgcgggcagcgacgtgctcgcgggagaccgcttcggccgcgtgggcctgtccctggacggcgcccgtcgcagggaccgggccctggcgcgcgccctgcgtggcatccccagcgtctggcttccaggcgggggctatcaccgcgacgcgtggaaggtgttcgcgggcaccgtgctcgtcctcgcgggtcagggccgtcgccgcatcaaggcgcgttatgacccgctgagcgcgcggtatcggcgcatcgcccgctcactgacgcgcgagggcgcgacgccgctggacgagcccatcacccaggaggacctggagggtgccctcggcctgagcggcggcccgcgccagccgcgcatcctcggctactacacggcgcaggcgctcgagtacgccttcttccgctacggaatcctctcctacgtggagcggctcggctacagccggctgcgcgtggaggtgggctccgtgggagagggggaccggatggaggtgcacggctgcgccgcgggccaggagcaccagctggtggactgtgtcgtggagcgccgcgtgctggcgggggagcccttcctcttcgtcaactggctcagcctgcgccacccgcgcgcccgcttcagcgaggggcgctcgcggctccccggccaggacgtgccgggcctgggcctggcgcgcgaggcgacggagatgctgctcgtgatggcccggcgcctcgtcctggcgggcgtggccttccgtcccatgtggttccacctggcggtgctggcgcgctcgcgcttccgtttcctcgacccggcgcggcaggggcgcttcgaggcgctgctgcgcgacctggggcagctgcccctcctggaggtctcccaggcggtggtggacggccacgtcctgctcaacggtcagccctacgcatgggaggcgaacgacatggtgtcgcgcctggagcccgaggccggagacttggaggccattgcccgggagcgcgagcgctgccgcttcacctgggaacccgcccggctggccaccggagcatga

SEQ ID NO: 3728 - DNA, 609 bp, Myxococcus xanthus
atgccgtggctctacttcgtcctcaagccccgccaccgcgaatgggcggacgcatggcagcgcgaggtgcaggcgctgctgcgcgaactggagacggtggaaatcgcggaggggtgcttcatcgccccggaggcgcgcatcttcgccgagcccggacgcaccgtctccatcggccccgggtgcagcatcgccgcggatgtcttcctccacggccccgtgacactcggaccccgggtgagcatcaacgcccgggcgagcctggacggcggctccgcgggcatccgcatcggtgagggcacccgcatcgccaccggcgctaccctctacgccttcgaccacggcattgccccggaccggcccgtgcgcgagcaacccgtcacctcgcgggggctcgtcatcggcgccgacgtgtgggtgggggccaatgccggcatcacggacggtgtctccgtgggggaccacgccgtggtggccatgggggccgtcgtcacccgggatgtgccggcgtgggccattgtcgcaggcgtgccggcccgcgtcgtaggggaccggcggcagcggccccgctcaggtgctccgggtggatgggagcccgaagacggagcgtga

SEQ ID NO: 3729 - DNA, 2076 bp, Myxococcus xanthus
atgaagtcgcaggcgtcacacgctgggagccaggtggagtccgagcgcttccggcacctgtccgagctgctgcacgaggtggtgttccagctcgacgcgcaggggcggctcgcggtgctgggcggtgcctgggagcggctcaccgggacgcccgtgtccgcgtggcggggccgcgcgctcttggaggccatccacccggaggaccgcgagcgcgcccaggcgttgctggcgtacacgcccggcatccccgtttcgcgccaggaagtacgcgtggacacgggcggcggccatggcgtccgttgggtggagctgtccgcccgggccctggccaccgtgccgggcgaggtgatggggacgctcctggacgtgacgtcgcgacgcacggcggaggaggccgtcaccacccgcgagcgctacctggacgccatggtgcaggtgcagcggcggatgatggggcacgatttgccggacgacctgtacggcgccgtcgtcgagccgttgggccacgtgtccgccgccagccgcgtctacgtcttcgagatgcacttcgccgaggacggcacgctgctggcgtcgcagcgcgcggagtggtgcgcgccggggattcctcccaacctggaggaccccaacatgcacggcctgcccttcgacgcggccctgcggccccatcagtccgaacagttgcagcgcggcgagccggtgcagggccagccgcgagacttctcggagctgctggcgcccatgctggaggcgcagggcgtccgctccgtgctgctgctgcccatgcacgtccacgggcagctcttcggcgtcatcggcttcgacaactgccgcgaacccgagtcctggggccccatcgaggtgaacctgttgtcgggcgcggcgggcgcgctgtccctggcgctggagcagcgcacggccaacgcgctgcgcatgcgcacggagacgacgctgcggcgcaccgaggccggcgtccacctgctcatcgaggccttcccggacccggtgctggtgcacgtgggcgacggcgtgctgctctccgtcaacccggcgctggtgcagtacctgggcttccgcgacgcctcggagttggtgggccgccacatgctggacctggtccgccccgaggaccggggggccgcgcagctccacctgagccaggcgctggagggcaagagcgcggcgcgcgtggtggagatgccgctggtgcgcagcgacggcgaggtggtggtggcggacctggtgacgctggccgtggtgctggacggctcgcccgcgcgcatcaccgtggcgcgcgacttcaccgagcgcaagcgcacccaggcgcagctcatgctgaccgaccgcatggcctccatgggcctcctggccgccggcatcgcccacgagctcaacaaccccctggcctacgtgctgtccaacctggacttcctccacagcgccgtgggcggcgtgcgtccacggatgctctccccggaggacatggtggagctgcggcaggtgctcgacgacgcccgtgagggtgccgagcgcatgcgccagattgtccgccaactgcgcgtcttctcccgcgtggaggacggcaaggaagagtcggtggacgtccacgcggtgctcgaatccgtgacgcagatggccgccagcgtggtgcgcgcccgcgcccggctggtgaaggactacggtgaggtgccgttcgtccgtggcaacgagggcaagctgttccaggtgttcctcaacctcctcatcaacgccgcgcacgccatcgaagagggcgattcggaggcgaacgaaattcgcctcaccacccgcacggaggtgggcggccgggtgatggtggtggtgagcgacacgggccagggcatccccccggagcacctgcgccgcatcttcgaccccttcttcaccaccaagtcctccggcctgggcaccggcctggggctgtccatctgtgacacgattgtgacggcgctgggcggccacatctccgtggagtcgtcgataggggccggcaccaccttccgcgtggcgctcagcgccgcgccgcccaaggccccggcgaaccggccgggcgcgtga

SEQ ID NO: 3730 - DNA, 2061 bp, Myxococcus xanthus
atgcgcacccacttcgtccggcatctgctggcgctttcgctcgtgcttgcgacgggcgcccaggcggccagccagccctggcggacctcccctcatccggagtcctccgcgtccggcctgacgggcgcgtgcgaagacgcgcgggacttcctgctgggcgcgggcagcgccgacatcaccggccccgccgccgaggtggggatgatgggctacggcatgctggaacagcagaccaccggcatccaccagcggctgcactcgcgcgcgttcgtcatcgcctcgccctgcaatggtaagcgggtggccttcgtcagcgcggacctgggcatggtgttccaggcggtgaagcagcaggtcgtggagcggctgcgcgcgcgttatggcgacctgtacaccgacgacaacgtgctgctgagcgccacccacacccactccgggcccgggggctattcgcactacaccctctacaacctcaccacgctgggcttctcgccgcagaacttcgaggccatcgtctccggcatcgtcgcctccatcgttcgggcgcatgagcggctcgccgagggcacgctgcgcctgtcgtcgggggagttgttcggggccagccgcaaccgctcccccaacgcctacctgctcaacccggccgaggagcgcgcccgctacgcgcacgacgtggacacgcggatgacgctgctgcgcctcactcgtgcggatggcaccgacatggggctcatcaactggttcgcggtgcacgccacgtccatgggcaacggcaacacgctcatcagtggcgacaacaagggcctggcctcgtacctcgccgagcaggcgcagggggccggggacacgttcgtcgccgcattcgccaacgcgaacgagggcgacgtgacgcccaacatcctgggaggcacccacggcggcggtgccaatgacttcgaggacacggacctctccggtcgcaagcagtacgacttcgccgcgaagctgtgggcggaggcgaagacgccgctcacgggcggcgtggactaccggcacgtctacgtgaagatggacgcggtggacgtggcgccagccttcgcggacggggcgccgcgaaccacctgcccggccgccatcggcgtgtccatgctggcaggggcggaggacgggccgggcgtcggcgtggagggcgtcacttgcgccgccggccagaatgcctgggggcagttcagttgctcgctcgccaccacgccgtgtcaggcggagaagcccatcgtcctggagatgggcagcatgcggcccttcccgtggacgccggaggtgctgcccctgcaactggtcaccatcggcaacctggcgctggtggcggtgcccttcgagctgacgaccatggccggacgccgcctgcgcgacaccgtggagacggcgctggcgcccgcgggcgtgacggacgtcgtcatcgcgggcctgtccaatgcctattcgggctacgtggccacccgcgaggagtacgcgcgtcaggactacgaaggtgcttccacgcacttcggcccgtggacgctcgcggccctccaacagaacttccacctgctggccacgtcgctgcgggacggcgccggtgtgcctcccgggcccacgcccagggacctgcgcaaggagcagctcagcctgcaacccggcgtggtgttcgacgacaagctcttgtgggtggacttcggcgaggtcgtcaccgacgcgcggcccacgtactcgcgcggcgacacggcgagcgccaccttctggggcgggcatcccaagaatgacctgcgcctggagggcaccttcctgcgcgtgcagcggcgcgagccggacggcacctggacggacgtggccaccgacgcggacccggccacgcgctaccagtggcggcgcgagaactgcgtgcccacgttggcgtgctcccacgtcaccgtgacgtggggcatccccgacgacacggtgccgggcacgtaccggctcgtccacgaaggcaactggaagtcgggctgggacggcaatgtgcggccctactccggtgcctcacggaccttcacggtgaagtga

SEQ ID NO: 3731 - DNA, 3699 bp, Myxococcus xanthus
atgacagccctgtcgcagggcctccaccgtgcgctccggcgcatgcaccagttcgcgcagcaccgcgggcccctcgcccagggcctccatcagccgggcgcagagggcgtccaccttcgccacccgggcgtccgcctccccctccgagacacccacgggctcccgctccggcactccagcgtcgcgcgcgcggccctcgtcacgccgaggacgctccaggtgcttcagcgaggccaggaagaagcccagggccacgaagaccagccaccacagccggcggggctgtgccagggcaatcaacacgcacgttatcgacgcggtgacgtaggcggcgccccgcgcggggttgcgagagcggttggacagcacctcccgttcggcgcggcgtgcggcgcgcttcgcctcccgccgccactgcttctcccacttccggcgaatcttccggggcggcatctgcccggtgcggcgcacccaggcctccaccgccgcgtcctcacgcgcacggccctccgaaagcgcgtcttccaacctgagcaggcgttcatgttggatgcgggaaggtggggaaaccggaggctgggaacgtccacgaggcacgaggtgacgataacgacgacacgccccctcagggaggggaagcgcaccattcgtcgcctgctgcatatgcacggtgcaacaagcggaaatgctcaaccgtttgcattcgccctgggaaactccgtagagaatgtgcgctggcggggggcgaaaaagggggcaggtgccgtggagttaccggaggcgaagggggagagcgccgggtgggaacccgagaccatccgcgccctgcgaggtgagcagagccgcgcggcgtttgctcgcctgctgggcgtcacccctctcaccgtctaccgctgggagctgccgagcgaagccccccaggcccgccgtccacgaggccgcgtggccgtggcgctccgccagctcgccgcgcgaggcggggcccccacgcccgtcgtctccgcgccccggcggcaggagctgcatcccgaggagctggcccgcatcctccccagcgtcacccacctgacgcgggccgagtggcgagccgccgaagaggagctgctgtcactgctggcgtcgggcctgctgcgcaccccgggcgcgcgggccatggccgcggtgggacttgcctatctccagcgctggggccgcgaggacagccggggcgccttcaccacgctgctgccccacctggcgttcgcggacgccggcatctttcccgaagaggtggagctgcgcgtgctcgccatggcggccaacctctacgcgtcaccggacgggaagctgttcgacgcgaacaagtccgccgcgtacgtggcgcgcgcggaagcgctgctggccaaccacgacgacccggaggtgcgctgccaactgcgcatggccgaggtcgcctgcggcttctacctgggcgaggcggagcgcatcacccacgggtccggacggctggaggatgcgctcgtgagggtgaaggacccggccctgcgactgctcgccgaggacgccagcgcccacgaggcggccctgcgcggcgaggccaccctggccacgcgccgcttccgcgaggtggcgcagggcgcggcgcggatgggctacgccttcctggaggcgcgcaacctggccttcctggctcaacgccggttggacgaggcctgcgagccgtccgaggcgctgcagatggtgcgccgcgcgcgggaggccgcgtatggcgggcgaatggtgcgcggcttctccttcatcttcgccgcgcgcgcggaggccgaggccctgctgcggctggcgcgcttcgcggaagccgaggccgtgctggatgaagcggacgcggtggtggaggagctgcgctggacgccgctgtacctgacggtgacgcgcgcgcggctgtacctgctcagcgggcgctacccgggactgcgcaagctggcgcggcagctgacggcctacgacggcaccatccagcgggccctcaccggggcctatgcccagttcgcggagtcgctggccgacctcgccgagggcaacacgcatcgcgcggcggagggcttcgccgcggccgggcagcgcaccatggagctgggcggctggccctacctgcgccgcgaatgcctgctgtacgagacgtatgcgcgcgtctacgcctgccagcgcgacgagggcctggtgctgctgcgcctcactggcgccttcctggagcgcatgccatccgcgtggcactccgccctgctccaccgcttcgaggccctgctgcacgtcctggacgggcgcaccgccgaggcccggtcgctgctggaggccgcgctgggcaccttcagcctcaccggcgacctgtgcatggccgtctacacgcgccacctgctcgcgttgctggcgcggatggagggcgaccccgccgccggtgagctgctggccgccagcgaggcggagctgcaccgcgtgggcatggtggtgcacccgcagcacttcgtgcactacgtcgcccgcgagccccacgccaccgcccgcgaagccgagggcgccccccgcctgggcgcggaggccctggtggtgcccttcgagcggctgtcggtgcgcggtatgggcgcgcccctcatccagcgcgagctgctggccgtggtggaggggctcttcccccactgcgcgccccggctggaggagctggactcgcagggccgcgccacgccgctgggcggcgacaccaccgtgcccgccaccgaggccgtggagttcggggatggctgtggccggcggctccgcctgggtgtcgcgggccacctgcctccggacggccgcgcgctgctgacggcgctgtcccggctgggcggcttcgcgctggaggtcgccaccctgcgcggcttcgcccaggtggacgtgtccgcgctcgccagtgatgacacggacgtgcgggacgcggacgtgccgggcttcatcgccgcctcgtccgccatgcggcggcttcgctcggagctggcgagcctgtcctccagccgcgccaccgtcatcgtcaccggcgagtccggctccggcaaggaggtggtggcgcgggcgctgcacgccttgtccgcgcgctcgcagcggccttacgtggccttcaactgcgccgcggtgccccgggacctcttcgaagggcagctcttcggctaccggcgcggcgcatacaccggcgcggccacggaccaccccggcgtcatccgcgccgcgcacggcggcacgctcttcctggacgagattggcgagctccccctggaggtgcagcccaagctgctgcgcttcctggagaacggcgaagtcttcccgctgggagagatgcggccagtggaggtggacgtccgggtggtggcggccacgcaccgggatttgggccagctcgtgcgggagggccgcttccgcgaggacctctattaccgcctccaggtggtgccggtgcgcgtgcccccgctgcgcgagcggcgcgaggacgtggtggcgctggcccggcacttcgtccggcagctcacgcccgagggcatggagccgccgcaactggggccggatgccatcgccgcgctgatgtcacacccgtggcccggcaacgtgcgcgagctgcgcaacgtgattgagcggtccatggcctacgggccgttccccgcggtgctgggcgcggagcagatgcgcatcgcgggctga

SEQ ID NO: 3732 - DNA, 291 bp, Myxococcus xanthus
atgaagaaggctttcctcatcgccctgtccctatccctgcccgcgttcgcctcgtccgacttcgattcggaggacctgtcggtggacgtggacccggaggagctcgtgagccaggaggccgccgacgccagccgaccgccgctgctccagttctgctggaacctccactacacgtcgtgctccggcccgggtacgacgcagcagtgtacggatggcatctggtccgactacgtctgcacctgccgcaccctgggcacgcgcaacgtctgggtctgccccgaggtccgctga

SEQ ID NO: 3733 - DNA, 1203 bp, Myxococcus xanthus
atggagcaggggcccggcttcatcaagctgctgctggcctacttcgcggtgggcctggcgctcgcctcgctgcaactcccggccgtgctcgactggctcattggcaccaccctcttcgtgctgctggccatcagcggcgggcggctggcggtgtccctgctgcacctggcgtcagagcggctggtcgggacctgggcggcgaagagcacggccacgaagtacgaggagtacttcctggccctcggccggctgctcccggtggggcagaagagcctggaggccatcgtctacatctcggtggcgacgctcgtcatccgccggttccagggcctggagttctttgcgccctacgggccggtgctcatccgcgtcatcgccctgttcttcgccgccagcgtcgtcgtggagttcgtccggctgctcatcgcgcgggcattcaaggtggacggctccaacctggatgacgcggcccggcggcgcaacaccttcgtctccctcatccaaagcgcatccaagtacctggtctacttcctggtggggatgatggtgctcagcgaccttggcgtggaccccacccccatcctcgctggcgccggcatcgtcggcctcaccgtgggtctgggctcgcaggccatcgtcacggacatggtcaacggcgtcttcctgctcttcgaggaccagatactgaacggtgactacatccgcatcaacgatacagagggcgtggtggaggagataacgcctcgcatcacccgcattcgcgaccgcttcgggcgccttcacatcctccgcaatggcgaggtcaagaatgtcatcaactacagccgcggctggacgctggccatcgtggacatggccgtggcctacgaaagcgacctgaagaaggtgatggatgtgattcgccaggtgtgcgagcaggtgcccatgctgtcgcaggggaaggtgtccgaaatccccaagcttctgggtatcgagagcatggacgagagctggatgaccatgcgcatcgaagccaaggtgcagccagggacacacttcgacgtgaagcggcttctcaaccggctgctgatcgaggccttcaccgccaatggcctggaattcccctaccccaagggggtggaatacgaggggggcccgttgcttcccgccacctccgaggcaccgcaggaggagccccaggcgctcgccgcctcacaccggtaa

SEQ ID NO: 3734 - DNA, 1415 bp, Myxococcus xanthus
atggccatttccaccatcgacccggcgaccggcaagacgctgcgcaccttcacgcccctctccgccgaggaactggaggcgaagctccagaccgccgccgacacgttccgcacctaccgcgagacgaccttcgcagaccgcgtcacctggctgcggcgcgcggccgacctgctggaggccgaggccgaccgctacggccgcatcatgacgcaggagatgggcaagcccatcgacgccgccaaggccgaggcgaagaagtgcgccacggcctgccgctactacgtggacaagggcgagtccctcctgcgcgacaggctcgtcgacatgggcaccggccgcgccttcgtgcgctaccagcccctggggcccgtgctggccatcatgccgtggaacttccccttctggcaggtggtccgcttcgccgcgcccgcgctgatggcggggaacgtgggcctgctcaagcacgcccacaacgtgccccagtgcgcactggccctggaggaactcttccttcaggcgggcttcccacgcggcgccttccagacgctgctcatcgagacagccgacgtccatcgcgtcatcgaggaccgccgcgtgcgcgcggtgacgctcaccggcagcgagggcgcgggccgagccgtgggcgccgccgcgggcaaggccatcaagaaggtggtgctggagctgggcggcagtgacccgttcatcgtcatgcccagcgcggacatggagaaggcggtggagacggcggtgtccgcgcgcctcatcaacaacggccagtcctgcatcgccgccaagcgcttcatcgtcgccgacgccatctaccccgagttcgagcgccgcttcgtggagcggatgaagcgcgtcacggtgggcgaccccatggatgcgaagacggacctgggtcccctggcgacgcgcggcatcctcgacgggctccatgcccaggtggaggcgagcgtgaaggccggcgcgaggctgctcctgggcggcaagccctggagggtccggggaacttctacccggccaccgtcctggccgagcccccgccccaggcccccgccttccacgacgagctcttcggccccgtggccacgctgctgcgcgcgcgtgacgtggaccacgccctggagctggccaacgcgacgccgttcggcctgggcgccagcgtgtggacacaagacgaagccgagcagcggcgtttcatcgacggcatcgacgcgggcatggtgttcgtcaacgcgcttgtggcatcggacgccaggcttccgtttggcggcgtgaagcactccggccacgggcgcgagttggcggacgtgggcatccacgagttcgtcaacatcaagtccgtccgcatcgccgcggcggaggagacgaagcagcagcctccgccccgcggcaccatcagcgagtag

SEQ ID NO: 3735 - DNA, 1410 bp, Myxococcus xanthus
atgcactgcgagctctgtctgaccgagcatccctacgatgtggcgtgtggcggcgagccctggacgcaggtgtacctgtccacgggcgacgcggaagcccctcccgcggacctcacgggccagacgttgggaagttaccggctggtccgccggctgggcgcgggagggatgggcaccgtctacctgggcgagcagacgcgcattggcgcacgggtggcggtgaaggtgctgcacccccacctgggccgggacgaaagcctgcgcgcgcgcttctacgcggaggcacgcacggtcaacgtggtgggccatccgaacatcgtccacatcttcgacatcaacgaggcgcccggcggcatccactacttcgtcatggagtacctggaaggcgtgcccatgtcgcacctgccccggcccatggtgcccgcgacgttggtgtcgctgctggcgcaggcgtgtgacgcgctggacgcggcgcaccggtgcggcgtggtgcaccgggacttgaagccggacaacctcttcgtggtgcggcacgcaggcgagccgccgtcgctgcgcgtgctggacttcggcgtggccaaggcgcgccggccccacccgggtgaggatgaaacggcggcgggcatcgtcctgggcacgccggcgtacatggcgcccgagcagtccgcggggcagccggtggacggacgcgcggacatctacgcgctggcggtgacggcctattacctgtccacggggcagcttcccttcgagcgggggcagatggtggagctggcgctgggcacgggcccggtgggcgcgccgccgccgcacctgctggtgcccggggttccgcccgcattgtcggaggtgctgctgcgcgcgctgtcgcgccgctgcgaggaccgctacgccaccgcgctggagttcaaggaggccctgctgctggccgccgcccagccgctggcggacgccctgtcaccccagacgccgccgccacgcagccacacgccggtgccgtccctggcgtggctggatacggaggacccggcgacggagcccaacgcgctcaccccacccctgacgtgggtggcgcgggtgcggcgccgctccggcgcgggcgacgtggaggtgctgtgcacggagttgagccggggtgggctcttcatgtgctgcgcggaccccttcccgcgcctgttcaaccggctggagttcaccctgctgctggccggcgagttggtggagtgcgcgggcgaggtggtgcgtcacgtggacgccgcccaggcgcagacgtggggcatgttgtccacgggcgtgggcgtgcagttcatcaacccatccgcccggctgtgcgagctcatccgccgcgtgcagccccaccggctgaccacacccgcgtccacgttgatgcgcgcggaggtggtgctgtga

SEQ ID NO: 3736 - DNA, 1053 bp, Myxococcus xanthus
atggcggacatcgcggacggggagcaggtctcggttcagggctcgggttccaagccctacatcctcaagaacaccggcggtgtgtattcgtgttcatgccccgcctggcgcaaccagtcggtggccatcgagcggcgcacctgcaagcacctgcgccgcgtgcgcggagacgccgcggaggacgcgcgcatcggcggtgacgggtccggcgctcccgcggtccccgcgcgtccgacgaggagcacgtcggccagcgacgacaccaaggccccacccctgctgctggcccagtcgtgggagaacgacgtggacctcaccggctggtggatgagcgagaagctggacggcgtgcgcgcgtactgggacgggaagcagttctggtcgcggctgggcaacgcgttcctcgcgccggagtggttcaccgcggggctgccggacttcccgctcgacggtgagctgttcggcgggcgcaagcgcttccagcgcacggtgagcatcgtccgccggcaggaccgcagcgacgattggaaggagctggccttcgtcgccttcgacgcgcccggcgtggaaggcaccttcgaggcgcggctggagcgctgccggcagtggatggaggaggcgaagcccgcgtatgcgcagtggcacgcccacgcgcgctgtgacggcacgccgcacctgcgcacggagctggcgcgcgtggagtcgctgggtggagaaggcctcatgctgcgccagcccgggtcgcgctacgaggcgggccgctcccacacgctgctcaaggtgaagagcttcaaggacgacgaagcgcgcgtggtgggacacgtggctggcgcgggccgccacaagggccgcctgggcgcgctggaggtggagctgcgtaacggcacgcgcttcagcgtgggcacgggcctgtcggacgcggagcgcgcatcgccgccacccgtgggtgccatcatcaccttccgctaccaggagctgtccaacgacggcgtgccacgcttcccgtcgtacgtgggtgtgcgcgtcgacgccgcccccttcgccgcgagctga

SEQ ID NO: 3737 - DNA, 109 bp, Myxococcus xanthus
atgggggtatctggagcggggaagaccaccgtgggccgcaccctggcggccgagctgggcttgcgcttcatcgacgcggatgacctgcacccgcgctccaacgtgatga

SEQ ID NO: 3738 - DNA, 258 bp, Myxococcus xanthus
gctctacaggcgctgctgctggccatgggcagcaacgcgctggcccggctgcgcaacaagccctccatcaccacgctggtgcccgggctcatgctcctggtgcccggcagtgtgggcttccgcagcctgtcatccctgctggagcgggacgtggtggccggcgtggacacggccttctccatgctgatggtggccgtggcgttggtggccggactgctgtccgccaacgccctggtccccacgcgcaaggtgctctga

SEQ ID NO: 3739 - DNA, 804 bp, Myxococcus xanthus
atggcaaccgagcagaccgcccggcgggtgttcactggcctcatcatcctttccatcatcctgctcgccctggttgtccgcccgttcgccaaggccttcttcctggcggcggtgctcgcgggaaccttctacggcctctactcgcggctgagccggaagctccgcggacacaacaacctggcggcgggggtcatcgtctcgggagtcatcctggccctgctcctccccctgggtggtctcacggccttcatcgtcaccgaggtgtcggacggcgtgaagttcgtctctgacacggtgcagcgggaaggggtggaaggactgattggcaagattcccagccccgtgcgaggcccggtagagaggctgctggagcgcatccccctggagcaggcccagctcgacgagacgctccagcagcaggtgagcacccagggcggcacagcggcgcgggccgtcaccggcgcggtggccgcgacgggctccatcgcgttccagacggtgatgatgctcatcgccctcttcttcctgctgacggagggcgcgcggctggtgagttgggtggagagcgtctcgcccctgcggcgcggccagacgcgtgaaatcctgcgggagttccgcagcgtctccgtggcggtgctcgtctcgtcggtggccaccgcgggcgtgcaggcggcggcgggcgctcgtcggtttcctcatcgcccgcgtccccgcgggcgctcttcttcgcgggcgtggcgttcttcatggcgctcatccccgccgtgggcgccgccatcgtggtgctggtcgccgcggcgctga

SEQ ID NO: 3740 - DNA, 444 bp, Myxococcus xanthus
atggcgctcatccccgccgtgggcgccgccatcgtggtgctggtcgccgcggcgctgatgttcttcagcggccacccgtgggcggcgctgttcctcgccatctggggcacggtggtggtggggctggtggacaacatcgtgaagccgctgctggccaggcgcggcatgcaccagcacgcggccatcgtcttcttcgcgctgctcggaggcctggccgcgtttggcacggtgggcctgctgttggggcccctcatcgtggccttcttcctggccctgctgcgcatctacgagcgcgactacggccggcccacgccgcgccccggagacccggccacgcccggaggtccgagcggcgacgaaagcctcatcatccgcccgtccgtgctgtcggcggagacgcgcgagcgcgtgcccctgtcgcccacgccgccggagaaccactga

SEQ ID NO: 3741 - DNA, 975 bp, Myxococcus xanthus
atgagcagcaccatcgccccagtcccaagcccgagccagagctccgacctccgcctcgtgccggtggagattgcccccgagacgttctgggtgggcaagcgcgagcccggcaacatcttctacgccaacccctacctgctgcgcttccgcggtacggacaagaagacgcagcggcccacggagttcaacctcctcatcgacccgggctcgagcagcgacttctccaccatccacaccaaggtgacgtcgctcattggtggcatggagcggctgtcggccatgttcatcaaccaccaggacccggacgtgggctcgtcggcgagcatcatctccgcgcgctacgcgccccgggccgggctgctgtgctcggaggacacctggcggctcatcgtccaccagaacctgccgcgccaccgcttcatccccacggagaagttcgcgcagggcctcagcgtgcccacgggccaccggttgctgccggttccctcgcccttctgccacttccgcggcgccgtcatgctctatgacccgcagacgcgcgtgctcttcaccggagacctctttggcgggctcaccgactccaacgccaagggcatctgggcggacgaatccgactgggcgggcatccgcgccttccatcaaatctacatgccggtgaactccgcgctgcaacgcacggtggcggccatccgcaagctggagccgggcgtggagatgattgcgccgcagcacggccgcatcatccgggggccgcctggtgcagcagttcctggaccggatggagaagcttccaggtgggggcctggaccatcatggacgaggcccaggccgcacgcactgcaggctggaatgccgtgctggaccgggtggtgtcgctggcgcccggctacctgggtgactccgtggaggcccagctggccgcgagcccggagctgtcggacacagcgcagtacgacggcacgcggctggtggtga

SEQ ID NO: 3742 - DNA, 348 bp, Myxococcus xanthus
atggacgaggcccaggccgcacgcactgcaggctggaatgccgtgctggaccgggtggtgtcgctggcgcccggctacctgggtgactccgtggaggcccagctggccgcgagcccggagctgtcggacacagcgcagtacgacggcacgcggctggtggtgagccgcctgggcaagtggacgctggagcacgtggtggacctgctgtgccacggcgagccgccggagattgccggccccatcatcgtcgaggccaccagcgccgcggccgagtacaacctgcccacgccgcacctggacatcgagggcgtgggggcaccgtcccacgtttcgctgctcgacccctga

SEQ ID NO: 3743 - DNA, 975 bp, Myxococcus xanthus
atgtcgccgcacggcacgatgctccagggcatcgtggtgcccgcgccctccagcgtcgtgcgaggcctggtgcccggccagacggtggcccagcgataccgcgtggagcgctggctgggcgccgggggcagctctaccgtgtacgaggccaccgacctccaccaggacatgcgcgtggccctcaaggtcctcgcggtgccccatgcggatgccgcgatggtggcgcgcttccgccaggaggtggagcacgcccgggcgctggagcacgtcaacatcctgcgtgtcttcgatgcgggcgtggacggcgagcggcacttcctcaccgtggagttgctggatggcgtggatttgcgtcagcggctgctggagcggcgcgccacgttggcggaggcgctgcgctggctcacccacgcgacggtggcgctggaacacgcgcacggccggggcgtgctccaccgcgacgtgaagcccgccaacctcttcatcacccgcaccggcgtgctcaagctgatggacttcgggctcgccaagagcacgcacgtcatggggacgacggcccagggcgcggtgctcggcacgccggagtacatggctcccgagcaggtgacgggcaaccccgcggtgtcacccgccacggacctgtacgcgctcggcgtggtggcctacgagctgttcaccggacagcttccgttccgccacccggagcccgtgccgctgatgttcctgcacgtccaggagcgccccgtcccgccgcgcacattgcgaccggcgctgccggagcccttcgagcgcgtcgtgctgcggctgctggagaaacgccccgacgaccgctaccggtccgctgccgagctccgcaccgcgctggcgaagctgtggccccacgcactgaatggtgatgcgtcggtggcggcacgagcaccggcgccgcccctcgcgcgcgcccgagcaccgggcccgggaggcggcacgggctga

SEQ ID NO: 3744 - DNA, 744 bp, Myxococcus xanthus
atgaaactcgctcaccggctccaggccatcaagccgtctccgacgctcgctctcaactcgcgcgccaaggcgctcgtcgccaagggtgtggatgtagtagtcctggccgcgggagagccggacttcgacacgccggattacgtgaagcaggccgcggtggacgcactgcgagcgggcttcaccaagtacaccccgaccaacggcatcccggagctgcgcgaggccatctgcgccaagctcgagcgggacaacggcttgcgctacacgccggaccaggtgctcgtcacgtccggtggcaagcagggcctctacaacttctgccaggcggcgctggaggagggggacgaggtcatcatcttcgcgcccttctgggtcagctacccggacatggtgcggctggcgggtgccacgcccgtcatcgtccccacgcgcgaggaggacggcttcgcgccggacccggacgccatccgccgcgcgctcacgccgcgcacgcgcgccgtcatcatcaacagcccaggcaatcccaccggcgccgtctattcgcgcgcggcgctggagcgcatcgcggaggtgctgcggccccacgactgcctcatcgtcacggacgacatctacgagaagctgctctacaccgacgaacgcctgggcatcagcgacgtagcgccggacctggtgccgcggctggtggtcgtgaacggcatgagcaaggcgtactccatgacgggctggcgcatgggctacgtc

SEQ ID NO: 3745 - DNA, 936 bp, Myxococcus xanthus
atgacctccgaacagctccgagccttcctcgaagtcgcccgggcgggacgcctggccaccgccgcgcgtgggctgggtctgtcccagtccggcctctcccggcagctccaatcactcgaggccgccctgggcacgcgcttgctcgtccgcacgccagggggcacggtgctgacagacgcgggagagcgcttcctgcctcatgcccagcgcgccctggacgcactgacggcgggcacctcggagctggagcggctgtcggggacgccacacggcgtggtgtcgctcggcacgctgcataccgtgggggcgtacctgctgccggacatcatcccggccttcgcgcgccagttcccggaggtccggcctcggctgagcgagggactggcaccggccatggaggaaggcgtggcacgcggcgccctggacctggccatcctctccctccccgtgcggcgcgcggacctggtggcgcagcgactgtgggaggagtccctggtgctcgccgtcccgcgtggacaccggctgacgaagtcaggcaagcccgtgacgatggacgaggccgtggaagagccctgggtcgtcatccccggcatgagcggcacccgagcgatggaggccgcctgtgaggcgcggggcgtgacaccccgcctggcggtggagacggacaacgcggaggccatgcgccgcatggtggagcgcggcctgggcgtggcgatggtgccgcagttgatggcccgagaccaccatgcccagggcttcgatgtggtgcccctggcgcgcgccggggtgaagcggcaggtggcgctgatacaccggggagagggctacctcacggccgcggcgcgggcgctcaagtccttcatcgtggagagcgtgcgcgccatgcccgaaccctggggcacgaggaaggcggctccaggcgctcgggtgcgctag

SEQ ID NO: 3746 - DNA, 402 bp, Myxococcus xanthus
atggcccggacggacagcttcgttgagtacacggtggaactgctggagaagctggggcccgtgaagtcccggtcgatgttcggcggctgggggctctacctcggcggacggatgttcgggctcatcggcggcggtcagttgttcctgaaggtggatgacgtcaccaagccggacttccaggccgccggatgccggccgttcatctacgaaggcatgaagaccccggtggagatgggctattggacgccgcccgcggacgcggcggatgacgcctacgcgctcctgccctgggcccggaaggccgtggacgcggcgaaccgggccgcgttgaagaaggcccagaagacggcacgaaagaaggcaccggcgaagaagcgcacctcgcgcgtcaagccgtcttga

SEQ ID NO: 3747 - DNA, 846 bp, Myxococcus xanthus
atggatgactccaacgccaggctggtcgcggccctgctggaagcccggcagcgacactgcttccctgcggacgtacggcgcgctgcccccgaattcgtaggccaggtgctcggcctgctcttcccccacttcgccgagcgcctggagtgtacggccgcggccgtccaccgcgacgtcaccaccgtggaggccagcctccaccgcatccgggacacgctggcgcccctgtacccgggcattgaacgggacttgccggcgcgcttcatggagcggctgcccggcctctatgactggctgcgacaggacgcggacgccatcttcgaggcggacccggccgcgcgcaccgtggacgaggtcatcctcacctacccgggcttcaccgccatcgccatctaccgggtggccaacgcgctgcacgccctgggcttcccgctgctgcctcgcttgctcacggagtacgcgcaccagcgaaccggcgtggacatccacccgggtgccaccattggccggcgcttcgtcatcgaccatggcactggcgtcgtcatcggtgagacgacgctcattggcgacaacgtcaaaatctatcagggcgtcaccctgggcgcgctcgtcgtggagaaggggctgacggacaagaagcgtcaccccaccatcgaggacgacgtggtggtgtacgccaacgccaccatcctgggcggagaaaccgtggtgggccggggcagcatcatcgccggcaacgcctggctcacgcagagcatcccttctcaatccgtggttacccgccgcagcgaggtgcgtcagcgcggcgagaatggctcgctggacgcactcgaattccacatctga

SEQ ID NO: 3748 - DNA, 921 bp, Myxococcus xanthus
atgaaggtgaacaacatcctggagaccatcggaaacacgccgcacgtgcgcatcaaccggctgtttccgtcccgcgtgacggtccatatgaagctcgagcgcgccaacccgggcggcagcatcaaggaccgcatcgcgttgtccatgattgaggacgcggagcagcgcggcctgctcaagaaggacagcgtcatcatcgagccgaccagcggcaacaccggcatcggcctggccatggtggcggcggtgaagggctacaagctggtgctcgtcatgccggagtccatgagcgtcgagcgccgccggctgatggccgcctacggcgccaccttcgagctgaccccgcgcgcgcagggcatgaagggcgccatcgctcgcgccaatgaactgctgtcgcaggtgcccaactcgtggatgccgcagcagttcgagaacgaggccaacatcgaggtccaccgccgcacgacggtgcaggaaatcctcaaggacttcccggaagggctggactacctcatcaccggcgtgggcaccggcgggcacatcaccgcgtgcgccgaggagctgaagaaggtctggccgaagctgaaggtcttcgccgtggagcccaccaagtcgcccgtcatcagcggcggccagccgggcccgcaccccatccagggcattggcgccggcttcatcccgaagaacctgcacaaggacgcgctggacggcgccattcaggtgaccgaggaggacgccttcgagttcacccgccgcgccgcgcgtgaggagggcatcttcgtgggcatctccaccggcgccgcgctgtccgccgtgaatcagaagctgggcgagatgaccgacggcagccgcgtgctcgccttcaactacgacacgggcgagcgctacctctccatcgagccgctcttcccggcccagtag

SEQ ID NO: 3749 - DNA, 1602 bp, Myxococcus xanthus
atgcgccgcaccatcctggacgccatgaggaacacgttgttcgtgggcgccgccctgctggcgggctgcgcgggaaccgttcatgccccctacccgcccatccgcgcggacatgtcccccgccgccctggagcgaggggccgccatcttccacgcaagctgcgagtcatgtcaccgagggggcgacgcggagacggcatcgggcgcgccgctgcgcgaactgccctcgtacatggggcgcttctacgcggcgaatctcacatcacatgccgaggcgggcatcggcgccatgacggatgaagcgctggcgcgagccatccgctacgccgtgagccgcgacgggcggttgatggtgatgcccagctacggcatgggcgacgcggacctggcggcggtgctgggcttcatgcgctccgggcacccgctcttcacgccggattcagtgcccgcgcccctgtcgaagttcagcttcttcggcggtattggcttccgcttcatcaccgggaatgagccagtggaacggcccgcctcgggcatccccgtgccgcccaaggcggcgacccgggagtacggccactacatggcgcatgacgtctatgactgcgcctcgtgtcacacggatggcttcagtcctcggaagacggagggcgatgacgtgttcgcgggaggcatggcgttcgtcgacccggagggaaggaacgttcattccagcaacatcacgttccacgagacggggctggcgcattggacgctggaggacttcacccgcgcggtgcgtgacggactggcaccggatggctccgtgctgcgctcgcccatgcctcgcttccggggcatggacgaggtggaggcgcgagcgctctacgactatctgcgctcggtgccgcacaggaagaacgcggtgaagggcgcgcggccgcggctcaccgcggagtcagtccgcccggactggggcgcggaggagatggaggagcagagcgcggaggcactccctgatgcggtgcaggccagcgcgcccgatgagacgcgcacgggagctgttcccaacgccagctcctccgtgaagggagcaggggaagaaacctcgggtccgctggtttcccccgcgcaacctccggccaaccatgagggcacacggggagaagacgcccatgccgcagtgacgtcttcggcctcggcgaccgcttccggctcggcgatgcacacagcgcccggagccaccgacaagagcgcggcatcggcaccgtccgcgaaacacgatgcggccaacaccgctgcggccggtccctcgacgctggccagcaagcccacccccacccgtaagccgcgccccgctgcgcccaaggtggacgcccccgccctcttcgtgaagctcggctgcgcgagctgccacgcgcctggcgcgcggtatcacgaccggctcgccaaggtctcctcgcgcagcgaggccgagctggtccgatgggtgcgaaaccccgagcagttcctccccggcacgcccatgcccacctacgcggagttgattgacgagaagaccgcgcgtgcgctggtgcgctgggtgaaggcgggaggcctggccacgctgccctccacctcgcgctga

SEQ ID NO: 3750 - DNA, 1213 bp, Myxococcus xanthus
  unsure (1)..(1213): unsure at all n locations
ctcaacgtcgacctgggtgagcttcctggtgaagacgaacagctctacgcgctggcccatgtggcgaacatcgcttgcggcgggcatgccggggacgatgcctccatgcgccgggcgctggagcggtgcgagcggcacggcacgcgcgtgggcgcgcacccgtcctacgaggaccgagagggcttcggccgccgcgcgctcgacgtcacgccggagcacctccgggcgcaagtggccgcgcagtgcggccggctcgcaaagctggcggctgaccgtcatctgcccgtggcgtacgccaagccccacggcgccctgtaccacgcggccaatgcaacaccggccctggcccgcgcggtggtggcgggcatcgtggaagcgctggggaccgccgtcaccttcattggccccggcacgggcgcgctgcacgacgcggccctggcggcgggtctggcctacgcccgcgaaggcttcgcggaccgaggcacccggccagacggctcgctgattccccgaggacagcccggcgcggtgctgaccgaccacgcccaggcgcgggccaacaccgtgcgcctggccaccagcggcagcgtggacaccgtctgcgttcacggcgacacgcccggcgcggtggagctggcgcgcgaggtccgcgccaccttggacgcgctcgcgcttcgcgccgagcctctgggtgaaggcgccctgcgactggtccttcccgagggactggagcgacgcgccacgcgcgaggccctctgtgccatgcccggcgtcctcgacgccgtcatcaccgaggagcacgcctgcgtgtacttcgccccggatgcgccacccgaggagcctcggctcgcgctggcgcggttgctgcgcatccccgccccagtggccggccggcccctcacgaccatctccgtgcgctacgacgggcaggacttgcacgcagtggcggaacgcgcgggcctcaccgaggacgaagtggcgcggcgccacaccgcgcgcgagtacacggtgcgctgcgtgggattcctccccgggtttgcctatctgggcgaagtcgacccgagcatcgcggtccccaggctggccacgccccgcacgcgagtgcctgccctcgcggtgggaatcgcgggtgggcgcacggnggtgtatcccttcgcatcacctggaggctggaacctcatcggcaccgcgctggacttcaccgcttcacacc

SEQ ID NO: 3751 - DNA, 240 bp, Myxococcus xanthus
atgctggccaccgtcaccgtgctggagctggcggcgggcgcgctcagcgccgcggggctggtgtcgctggtggccacgggcagcgcgacgctggccttctggggcgcgctgctctccgcggtgtcgctggtggcgctcttcttcggccagcggctggcgaaggactacgccggcgcgggcggactggtgcactacttcctgctgacgctggtggcggtgtacgtcacccgcctgggctga

SEQ ID NO: 3752 - DNA, 819 bp, Myxococcus xanthus
atggccgtcatcaaggacttcctcatcccgggcgacagctcgcccggcaacaatgcctccgtcacggtgacgtcgcccaacggcggtgagagctgggcgggcgggagcgtgcgcgacatcacctggacgtcgaccagcgtcacgaacgtgaagctggagtacacgctcaatggcagcacctggagcacgctggccgccagcacggccgcctccgcgggcagctacgcgtggacggtgccgtccagcgccaccaccaccgcgcaggtccgcatcagcgacgcgtccaacgcgagcgtcagcgacctcagcaacgcggccttcaccatcaccacggtgccgacgggcggcacgggcaaggtcatcatcaacgaggtgatggtcaacgagccgggctcgaacgtcgcgggcgagttcgtggagttggtgaacacgggcaccggggcggtggacctgagcgggtggacggtgtccgacgcggccagcctgcgtcacaccttccccggtggcacctcgctggcggcgggcggcgtcatcgtggtgttcggcggcgcggcgggcatcccggccggcacgcccaacgcggtgtccgcctccacgggcacgctgggcctgtccaacagcggtgacaccgtcaccgtgaagacggcgactggcacggtggtggagtccgcggtgttgtcctccggtgtgagtggcacggatggcgtgtccgccaaccgcagcccggacctgggcgccacggcgaccttcgtgctgcacaccagcctgtccagcctgcagtcctcgccgggccgtcgcgtcaacggctcggcgttctga

SEQ ID NO: 3753 - DNA, 147 bp, Myxococcus xanthus
atgtcctggatgcccgtggtgggtgacgcgttcgtcatcgccggcggcatgctgggggtgcgcccgctgcctttcgtcttcttcgtcacgctcggcaagggccttcgttatctcgccgtcgccctgtccgccgccgccacgctgtag

SEQ ID NO: 3754 - DNA, 1317 bp, Myxococcus xanthus
cggcggacagcgacaggcgcggtgttgctggccctggtggtcagcgcgttcgaaggcaccgtcgtgacgagtgccatgcccaccatcacccgggagctgggaggtcagcacctctactcgtgggtgttctccgccttcctctttgcctccaccgtcggcgtgctcgtctccgggaagctggcggaccggctgggacgcaagcccgtcttcttctcgggcatggggttgttcctggtgggctccgcgctgtgtggcctggcggactcggtgccggggctcattgccttccgggtcatccagggcttgggcgcgggcgcgttgcagcccaccacgctcaccatctccgccgacctctacacgctgcgtgagcgcgtcgccgtgcaggggctgttcacaggggcctggggcgcgggcaacgtcgtggggccgctcattggcggctggctggtgatgcacgcctcgtggcgctgggtgttcctggtcaacgtgccggtgggcctgttcgccgcggcgctgctgtacctctcctaccgcgacccgcctcgccgtccggaggtccgcatggaccggtgggggcccgtgctcgcgggctcctcggcggcgctgctcctcttctcgttggagccgggggccgcgagcctgcggtgggcctgcgcgctggccgccgtgggcgcgggctggctgctggtgtggcagcaacgcacgacggtgtctccgttgcttccggcggagttgctgagagatcgcgcggtgctcagcggcatcgtgggcggcatcgcgggcggctcgctgctgtacagcatggccgcgtgggtgccgttgtggatgacggagcaaggcggtcacacgccactggcggcgggactggcgctgctgccgatgctgctgggctggtccgtgggctccaccttcggcgtgaagctgctggtgcgcggaggcatgcgactgagcgccggcgtgggcttcgcggtggcggcgctgggggccgggtggctgtcattggccgccgcacggggctggggtgtgcccgcggcgctgatggggctggcggtgctcggcctggggctggggcccgccgccagcacgtcgctgattggaccgcagtcccgcgcgccctggcaccaccggggcatcgtcaccagcgcgctctacgccacgcggcttctgggcggctcactggcggtggcgttgctcgcgctggccagcgggcacttcgccctgcagttcggcatcgccgctggactcacggccgtcgcggcgctcgggttggcgctgttggctccgggcaggacggagccagcggcatcgggggcgtga

SEQ ID NO: 3755 - DNA, 483 bp, Myxococcus xanthus
atgctggtcgccatctatcctggttcttttgatccgctcaccaacgggcacctgagcctcattcagcgcagcctgaagatgttcgatcggctcatcgtggccatcgcggtgaacccgaagaagacaccgctcttctccgaagaggagcggctcacgttgattcgagaggccgtccaggacgaccgggtggaggtcgacgccttccacggtctgctggtggactacgtgcggcgccgcaacgcgggcgtcatcgttcgcgggctgcgggcggtgtcggacttcgaatacgagttccagctcgcgaacatgaaccgcaagctggcacccgacgtggagaccgtcttcatgatgacgggggaggactacttctacatctcctccaacctcgtccgggaggtggcctccttcggtggggacgtcaccgggctggtgccgcccaacgtgcacgaaggtttgaaggccaagttcgctggacggaagtag

SEQ ID NO: 3756 - DNA, 1638 bp, Myxococcus xanthus
ccggtcccttcctacgcccatggcaccagcaccaccccgctgctgggggagacgattggccagaacctgcgccgcaccgtcgagcgccacggcgaccgggaggccctggtggtggcgtcccaggggtttcgggccacgtatcaacagctctgggcgctcacctcgcaggtggcccgggggctgatggccctgggcgttcagaagggggaccgggtggggctctggtcacccaaccgcttcgaatgggtggccgtccagtacgccacggcccgtatcggcgccatcctggtcaacatcaacccggcctaccgctcctcggaggtggagtacgccctcaaccagtccggcaccaaggtgctgctccacgcacggggcttccggcagacggactaccggggcatggtgaaagaggtccggccgcgctgtgccggcctggcggcggcgctcgtcctggaggacgactggcagcggctgctcgatggcgcggaggatgtttcggaggacgcgttggccgcccgcgaggcgtcgctccagttcgatgacgccatcaacatccaatacacgtcgggaacgacaggcttcccgaagggcgccacgctgtcgcaccacaatgtcttgaacaacggcttcttcatcggggaggcccttcgctacggccccgaggaccgggtgtgcatcccggtgccgttctaccactgcttcggcatggtgattggcaacctggcctgtaccagccacggcgccaccatggtgattcccgccgaggcgttcgacccgctgacggtgctccagacggtgcaggccgagcgctgcacgtcgctgtacggcgtgcccacgatgttcatcgcggagctggaccatccgcgcttcggtgagttcgatttgtcgacgctgcgcaccggtgtcatggcgggctcgccgtgcccggtggaggtgatgaagcaggtgcagtcgcgcatgcacatgcgcgaggtgaccatctgctacggcatgacggagacgtcgccggtgtccacgcagagcgcgctggacgagccgctggacaagcgcgtgtccaccgtggggcgcgtgcatccgcacctggaggtcaaggtcatcgacgcgggctcgggtgaggtggttcctcgcggctcgccgggcgagctgtgcacgcgtgggtacagcgtcatgctggggtactgggccaaccccgaggccaccgccgcggccgtggacgccgccgggtggatgcacacgggcgacctcgcggtgatggacgacgagggctacgtgaaggtggtgggccgcatcaaggacaccatcatccggggcggtgagaacatctccccgcgcgaggtcgaggagttcctccacgcgcacccgggcgtcagcgagacgcaagtcattggcgtgccgagcaagaggtacggcgaggaggtcatggcctgggtgcgggtgaagcccggcgcgacgctcaccgccgaggagctgacccggttctgcgcgggccgcatcgcgtccttcaagattccccgctacttcaagttcgtggacgcgttcccgatgacggtgacgggcaaggtgcagaagttcaagatgcgcgaggcgtccgtcgtggagctggggctggaggacgccgcggccatcaagacggcttga

SEQ ID NO: 3757 - DNA, 1137 bp, Myxococcus xanthus
atgacgcgctcgctcgagtcctaccgagacctcttccccgtgctgaaggagcagctctacctcaaccacgccggtgtggctcccaccagcctgcgcgccgccgaggccgtgcgcgggtggatggaggacatcgtccaccacggcatcaagcacgagcgcggctgggaggcccactgcgagcgcgtgcggggcctggccgcccgcctcatcaacgccgagcccggcgagattgccttcgtgcgcaacaccagccacggcctgggcctggtggccgaggggctggactggacgcccggcgacgaggtcgtcgtcgcatcctcgttggagtacccctccaacgtctatccctggctgcacctgaaggaccgcggcgtcaccgtgcgcgaaatccagacgcccgaagggggcgtcacgccggaagccgtggccgccgcgctcaccccgagcacccggctggtggcggtctcctccgtgcagttcgccaccggctaccgcacggacctggatgcggtgggcgccctgtgcgagcgggcgggcgttctgttctgcgtggacggcatccagagcgtgggctgcatccccgtggacgtgaagaagagccgcatccacttcctcagcgcggacagccacaagtggatgctgggcatcgccggcatcggcttcctctacgtggccaaggacgtcctgcccaggctgcggcccgtgctggtgggctggcgcagcaccaccgacgcctggaacttcaaccgcagccacttcgagctgcgcccggacgcgggcaagctggaggagggcagcgccgcgtacaccggcatctacgccctgggcgccgcgctggagctgctgcacgaggtgggggtggacgccatctccgcgcgcatccgcgaactgctgggccaactggagacagggctgcgtgggctgggctgcgacgtggggcccgcgccggagcaccgggcgggcatcctcacgttcctgcctccggagggcgaggcccgcgcgctcggcgcgtggctcgccggacgagaggtggccctctcggtgcgccgcgggcgcgtccgcctctcaccccacttctacaacctgcccgaggagatggaccggttggtggagctggtgcggacgcaccgcggctga

SEQ ID NO: 3758 - DNA, 564 bp, Myxococcus xanthus
atgaaggcgatgacgcggtacctggtgcttttctccatgctggcggtgggttgtggtgactcgagcgatggtgatggggactccgcactcaagtgcgacgcgatcggatggtgtacctcgtgggagtcggaccaggcgccggtgacggacgcccccgcgctgaagggaggctcggtgcctgaggggctgtatcgcctggagcgcggctcggaggacgcgcgcgccctgctcttcaagggcaagtccgtcctcaaggtgggcggcagctgggggaacatcctggggacctggaaggtggatgggaaccacctggtcatcaccacggcgagttcctgctacgggaccagggaggatgccttcaacgagaccttccgttatgcgttcgccgtcaagggggacacgctgtacctgcacgaggacgagttcgaggatatgcccatcatggcctggcgcaaggtggactcgctctgtcaggagaacgcctcgttcaactgcaaggtgagcaactgcacctgcaagtacgtggcgaactcgtccttcgatacctcggaaaggtgcttctga

SEQ ID NO: 3759 - DNA, 1086 bp, Myxococcus xanthus
atgcatgcggtggcagtgtttccagggacgcgcgaggttcgcctcgtcgacccgccggagcctcggcccgtgacgggctctcaggtgctcctgaaggtcctcgaagtgggcatctgcggcacggaccgggagatcggtgcctttgaatacgggacgcctcctccggactccgaccacctcattctcgggcacgaggcgctcgcggaggtggtggagacgggcccggacgtcaccctggtccgcgagggagacctcgtggtccccaccgttcgccggccctgtccccatgcgcgctgccgtccctgtcgcgcggagcgtcaggacttctgtgtcacgggggatttccgggagcggggcatcaaggcggcgcacggcttcctccaggagtgggtggtggaagaggaggggcacctggtcgtggtgccccgcaagctctccgacgtggcggtgctggtcgagccgctctccgtggccgccaaggccgcggagcaagtacaggccatccagcggaggctgccctgggagcgcgcgcgcgtgcgagccctggcactcggcgccggaccggtggggctcctgggcgccatgagcatggtggtgaaccactttgacaccttcgtctactccctggagcccgcggccagcgagcgcgcgaacctcatccgctccttcggtgccacctacgtctccggacaggacgtgctccttggggagctcggaaagaaggtcgggacgttcgacatcatctacgaggctgtgggcatgtcgaaggtcgcgttcgcggccctcgatgcgctggggcccaatgggctcttcatcttcacaggcattcccgcgcacggcggcccgaaccccgtggatacggacaccctgatgcgcaacatcgtgctgaggaaccaactgctcctcgggaccgtgaatgcgagccggagcgcttacgagctggcgctccgcgagctggagcaagcgatgttcttgttcccgcagagcgtgcgcgccctcatcacccatcgggttcccatccaggaggcgcccgcgctcctcacggaatcaggtggcatcaagcaggtggtccaactggcttcatga

SEQ ID NO: 3760 - DNA, 1833 bp, Myxococcus xanthus
ctcgagcactacggccttatcggtgacctgacgaccattgcgctggtatctcggagcggctccatcgactggatgtgcctgccgcgcatcgactccgatgcctgcttcgccaagttgctcggcacaaacgagcatggctactggagcctccggcccgcggtggaggtccgggccgtccagcagcgctaccggccggagacgttggtgttggagacggaggttacctgtgacggcggccgggcgcgcatcatcgacttcatgcctccgggggagactgagcacgacatcatccgcattgtcgagggactcgaaggtgaggtcccgatgcattccgacctcagggtgcgctttggttatggcaagttgaccccctggattcagtgcaacagccaccgcgccaccctgacctcggggccggacgcgctcgcatacatcagcccggttccgctcgtaccggactgggatgcgtcccgcctggaagcggactttgtcgtccgcgcaggtgagcggctcccctgctcgctgacgttctatgcgtcgcacctggctgcgccggggcaccctgtcgatgcggagcgggacctggtgcggactgagcagtactggcgtgaatgggcgagccggtgccgatacgagggctcttttcgcgacgccgtggtgcgctcgctcatcaccttgaaggcgctcacctatgagccgaccggaggcatcgtcgcggcaccgaccacgtcgctccccgaagaactcggcggagtccgaaactgggactaccgctactgctggcttcgagacgcatccctcacgctcgaggcgctgatgcgaggaggctacctcgatgaggcgcgggcctggcgcgactggctattgcgtgccgtcgctggcgctccggatgaggcgcagatcatgtacggcgtcgccggcgagcaccgtctccccgaggtcgagctgccatggcttcccggctacgaggagtcccggccggtgcgcatcggaaatggcgcgtacggccagttccagctcgacgtctacggtgaaacgctgaacgcgatgtacgaggcgcgcgtgtacggggtgcaggaggccggatcgctcccctgggacacgctgaaggtgctcgtcgacttcgtggagaagagctggcagcgtccggacgagggcatctgggagatccgcagcaagcgccagctccacttcacgcactcgaagctcatggcgtgggtcgcggtggatcgaggcgtccgcttcgtcgagcagttcggtgccaacgcgccggagaaactgaagaagcgcctgccccgctggcgcgcgctgcgcgaggagatccgcgccgacatcctggcgcgtgcctacaactcgcgcgtgggggccttcacgcagtcctatggctcggacgccctcgacgcgagcgtgctcctgattccgcacatgggcttcctgcctgcggatgacccgcgcatgttgggcactgtcgccgccatcgagaagggcctcaccaaggctgggtttgtggagcgctacttggccgagacgggcgtggacggactggcgggccatgaggccacgttcctcatctgcagcttctggctcgtcgacaactacaccatggttgggcgcctcgacgaggcgggggcgctgttccagcgcctcgtctccatccggaacgacctcgggctgctggccgaggagtaccaccccgggctgcaccgccagcttggcaacttcccacaggcgttctcccatgtcgggctcatcaacagcgccgtgttgctggaggccaagcgggcagggcgggacgtgtcgttcaccgccatggccgccgcgagcatgcactag

SEQ ID NO: 3761 - DNA, 522 bp, Myxococcus xanthus
atgggcgtcccggaagtgacagcgctcgcggcctcacttccggccggtgcctgggtgctggacgttggctgcggcactgggctgccgctgacgcgggtgctgctggagcacggctgccacgtgatgggcgtggatagctcccgcgagctgctggcgcgatttcaagtgaacttcccccacgtgccggtgagctgtgcgcccatccagtcgtgtgagcttcatgagcggacgttcgatgccgcgatcgcgtggggggtcttgttccacctgcgccacgaagagcaggaacaggcgatcgccaatatcgcgagggcattgaaacctggcgccgcgttcctcttcacctcgggcgacgcccacggctccatcgacggcgagccgatgaatggcgtgccgttccgctatcactcgtacagcgtcgacgggtatcgcgacctgctgcgcgcgcacaggctcgcgctggaagcgacgcacacggacccgggcgcgaacgtctactacctgtcgcgcaagactggataa

SEQ ID NO: 3762 - DNA, 1956 bp, Myxococcus xanthus
atggtcttctttggtgtgcgtgcggccggagacatcaaggtcgacgtcctgccggagatgaacctccctgtcgtgtacatcgcgcataccttcaacgggtatacgccggcacagatggaggggtacttcacgaagatgtacgtgaacatgatgctgttcacgaacggcatcaagaacatcgagacgaagaactcccagggcctgaccctgatgaagctttcgttctacgaaggcaccgacatggggcaagcggtcgcggagatcaacgcgctctcgaatcgctcccaggtgttcctgccccccggtgcgcctccccccttcatcatccgctttgatgcctcgtcgcatccggtgggacatctggtgttccgcagcgagagcaagaccaccaaccagctccaggacatcgccaacttcaccgcacggccgttcctcatctccatccccggcctcacgacggcgcccccgttcggcggcagcccgcgcacgattgaaatcaacatcgagccggagaagctgcgcgtgcacaacctcacgcccgaacaggtcgtggaggccatcgctcgccagaacgtgacggcgccctccgggaacgtccacgtcggcgacgtgacctacatcaccccgaccaacagcacccttcgcgccgtggaggacttcgggaacatcccgctcctcaagggctcggtggcgaacgtctacgtccgagatgtcgcgaccgtgaaggacggagccgacatcgccaccggctacgccctggtgaacggcaagcgctccgtctatctcaacgtcgccaaggcggggaatgcctcgacggtgcacgtggtgcagcagctcaaggagtccatcccccgaatccagagcaacctgcccgacgacgtgcacatctcctacgagttcgaccagtccgtctacgtggtgggggctctgaaggggctgattgcggagggcgtgctcggcgcggtgctgacggggctgatggtcctgctgttcctgcgtgacgtgcgctccgccatcatcgtcatcatcacgattcccatcgccatcatctccggcgtgctgttcctcaagctgtttggccagaccatcaacatcatgaccttggccggcctggcgctcgcagttggcatcctggtggacgagagcacggtgaccatcgagaacatccatcagcacctccagcgaggcaagacggtggcggtggcggtgtgggacgcgtgcctggagatcgccttctcgaagctgctcatcctgctgtgcatcctctctgtcttcgcgcccgccctcacgatgggcggaatccccggggcgctcttccgaccgctcgcgctggccatcgggtgctcgatggtcgtctccttcctcctctcgcaatcactggtgccggtgatggcgaactggatgctcaagcagcacggcccgcccccgggcggtgagggcgccagcccctcccctggacgcgtgcgccgcgtgattgagggcatgctgccgcacaggaagttgctcgtctcggcaggcgtgggaggcctcatcgtcctggcggtggtctcgctccagcgcattggcaaggacgtgctgccgagagtcaactccagccaactccagttgcggctccgcgcggcggagggaacccgaatcgagaagaccgagcaggtcgtccaccaggcaatgggcctcgtcgaagaagtcgtgggcgccgggaaggtccgaatctcctcggcctacgtgggccagcacccctcatcgttcgccatcagccccatctatctctacaacgcgggcccccacgaggcgctcctgcaggtcgccttcgagggcggcgtcggcgacatcgacgcgttgaaggagcgcatccggcagcgagtgcgcgaggcgatgccagacgtccaggtcgcgttcgagcccgtggaaatcacggagaagattctcggtcagggccgcgctgtatccccatcg

SEQ ID NO: 3763 - DNA, 1140 bp, Myxococcus xanthus
ggaccctccaatggatcgaccagcctcccgttgccggagcaaaactggaacgcggcgttcggcgccttgtactcggtgctcgtccactggaacgtctccaccttcggccgtctcgaccggcagattgagctgtcggagaggacgcacgaactgaaacagcgcgagctcgaactcgcgcggttccagcatggggttcgcgtcacccacgcgtacctcaacctatcgaccgctcagcgcatcacccacatccagaagcagagcgtggcgcgcttcgaggtcgtgctcgagtccgtccagagccacgccgagaacggattggtccccggggtggatgtctccttcgcgcgcgccgaactcgccaacgccaggtccctccagctcaaggcctacgacgccgagctcctggcatcgaaggagcttgcggtcctgatgggcgttccgtttcgcgagttccagctcgagccgacgttccaccagtcgacgcccgagtccggcgagccagcgcacgtcgcgcccggacatcccgtcctcgcggagcatgaagggaaggtccgccgcagcgagcaggaaaagaaggtggccgcggccgagggccttcccacgctcttcgccttcggaatgttgcaggggcgcggctcgggctttcgctccaactatgcgcaggacccgggcgcattctcgagcgggtacctcggcggggtaggcatcgatcggggcaacacccttgtcgggttgggattgagctggaacctggcctccgtgctgcgcagcttctccagcgaggcggcgcgggacgcgcgtacccgcgcgctccaccaggagcaggagttggtcacccaggagctggttgcccaggcgcgcttcgccgagcacaagttcgacctggcgcgagaggtgacccaccacgccgtgttgcaacgggacgccgccacggaggggttccggcagagcaaggcccgctacgacagtgggctcgggacgattgtcgaactcacccaggcgacgttctccgcgacccgggccgatgtcgacctcgagctcgcccagaacggcatctggcaagcccttctcctcaagtcggccgcggccggtgacctcaacgaattcctgcagcaggtccgtggagtgaagaagcaatga

SEQ ID NO: 3764 - DNA, 426 bp, Myxococcus xanthus
atgagagccaatctctgggctgtagtgggactgatgatgctcgcgggggcctgtaagcagcaggccgcgcccgccatgaaggtgacgccagcacctccagcccttgaacagagtgcggggcagcaaggccacctcaccctcgtcacggaccgcagccttgtctgcatggtgaacgaccagcacatgggacagccacagattcccgtcgaggtcagcgggcgcacgtattacggctgctgcgagatgtgcaaggaccggctcgcgaatgacgcgacgttccggaccgcgacggacccggtgagccagcggcccgtggacaaggcgacggccgtcatcggcatcacgcaggacaactccgcgctctacttcgagaacgaccagaccttcgccgcctactcgcgtcaggctgcgggggcgccccggtag

SEQ ID NO: 3765 - DNA, 498 bp, Myxococcus xanthus
atggcacggctcgccgagggcgaccgggtcgcgttcacgcgtgtcttcgagttgctctggggccccatccagaagctatgcctgagcctgctcaggaacgaagcagacgccgctgacgccggccaggaagcgatgcacaagattctcgaacgcgcctccgacttcgacaagacccgtccggcgatgccctgggccctcgccatcgcgggctgggagtgccggaccctggcgcgccgccgagatcgccggcgcgaatcccaggcggacgccatgccctcgtgcgccggacctcacgcggaggaggagttcctccagcgggacctgaccgccgccgcgatggccgccctgggagagctctcggagttggaccgcgaggtgctcatcgccacgttctgggacgaggccgcgtcggtctctggcgccacgctgcgaaagcgccgggagcgcgcactggaccggctccgaaagactttcaggaggctctatgggctcgactga

SEQ ID NO: 3766 - DNA, 558 bp, Myxococcus xanthus
atgcgaatcgtcgcaggcaccgccaagggccgcgccctggccggccccaagtcctcgtcccttcatatccgtcccacggccgaccgcgtccgggagacgctcttcaacgtgctgggccagttcctggacggccagcgggtgctggacctctacgccggcaccggcgcgctgggcctggaggccgtgtcccgtggcgcgggacaggcggtgctggtggaccaggaccgcgaggcgctcaccctctgccgtgagaacgcgcaggccgtggggctcgccgggcaggtggaggtgctggccgcgccggtggcccgggcgctggagacgctgaagcggcggggcgaccgcttcgagctcatcttcgcggacccgccgtacaccgcgcgcgtggtggagacggtgctggacggcatcgtggccgccgggctgctgaccccctctggcatggtggtggtggagcacgacaagcgcgaggcggcgccggacacacatgccgggcttgaccgggaagaccagcgccgcttcggggatacgttggtgagcttctatcgggcgccgtga

SEQ ID NO: 3767 - DNA, 1026 bp, Myxococcus xanthus
atggagtacgcatcgattctcggcatttcggcccctgccagccgcgtgggcctggggacctgggccatgggcgggtcgcagtggggcggcaccaacgacgacgagtcggtgcggaccatccacgcggcgctcgacctgggcatcacgctcatcgacaccgcgccggcatacggcttcggtcactccgagaaggtcgtgggcagggcgctcgccgaacgaggcgggcgtgagaaggtcgtcgtggcaaccaaggtgggcctggagcggcgcggggacggagtcatccgcaactcgtcgcgacaacaggtcatccaggagctcgaggtctcgctgagacacctgcgcaccgactacgtcgacctctaccaggtccattggccggacttctccacgccatatgaggagactgcccaggcgctgctcgacctccagcgcgccggaaagatccgcgcgatcggcgtctccaactactccatcgaggcgatggagcggttccggagtgtggcgccgctcgcctcggcgcagcccccgctcaacctcttcgaacgggaagccttggaagacatcatcccctggtgccgcacgaatggcgtggccaccctcacctacggcgcactctgccggggactcctgaccgggacgatgaacaaggacacccggttcgaaggagacgacctgcgacagaccgaccccaagttcctgcctccgcgctacgcacagtacctgcaggccgtccagcggctcgcgcagttcgcgcgcgagcgctacgacaagggcgtgctcccgttcgcggtccgctgggtgctggaccagcccggcgtcacagtggcgctgtggggagcccgccaccccggcgagttggagccgctgcgggacgtgattggctggagactcgacgacgaggccctgacgtacacggactcggtggtgaacgagtccgtgcccgagcccgtaggccccgagttcatggcgcccccggagcaacgtccggaagaatcgggcgagcggccaggggcgcccgcctga

SEQ ID NO: 3768 - DNA, 891 bp, Myxococcus xanthus
gtcgaattgcgccatctgcgctactttgtggcagtcgctgaggccggcagcatgatggccggcgcccgcgcactcgggattgtgcaacccgcgctttcccgacagatccgcgagcttgaggaagcggtcggcaccccgctactcatccgccgctcgacgggtatcgcactcacagcagccggcgcgagcttcctgcaggacgctacgcgcctactcgccgagctgcaggccagccgcgagcgcgcgctgcgcagcgcggccggccaactcggcgagctgcgtctcggcgtcctaccgaattacttcccgttgccgatggtgtcgaacgtcctcaaggccttccggagcgcctgcccggacgtcatgctgtcgatcacgccaatgctatcagccgagcaggcgactgcgatatcacgcggcgatctcgatggcggcatcatggcgtggcgacagagcgaggcaccgcatctgtcaggcatgcggctgctacgcgaccgattcgtgctcgcgatgctatccacgccgggccagcgcttccgcgcgcctcgtcaactggccgaactcgcaggcgcgccgttcgtctggttcgacccactccggtccgcagcgcatcaccggttcttgctcgagcagtgccggcgggccggcttcacgccgcgcatcgcgcaggtcggcagcgacatcccgacgctcatcggactcgtcgcagccggaatgggctacgcgttcgtgccggagagcatttcaccgacgtgcccacgcacggtgcggctggtcccgattgacgagctcgacggccgcttcgacgtcgaattcgtgtacgacggccaagcgaactcgccggtcgtgcagcaattcctcgcggcgctgcgcacgaccgccaacacatga

SEQ ID NO: 3769 - DNA, 99 bp, Myxococcus xanthus
atgctggtcatgtccctgcgcgagcgcgactacatctataccgcgatttcggtgttcgtcctggctgtcatcgcggccggggtcatggtcgagctgtga

SEQ ID NO: 3770 - DNA, 720 bp, Myxococcus xanthus
cccctctatgcgaaagtcgaattgacgcttgcgtctgaaatcgcagctggggtcctccctcctcgcagccaacttcccacggaagaccgcttgattgagcggttcggcgtgagccgaacgacagtccgaaaagcgatcgagaacctcgtggctcgtggcttggtagagatccggcgcggcgtaggtaccttcgtcgcgcagcccaagatcatccaagaactgaccgagctgactggcttcgtcgaggacatgcaggcactcggccgcaccccgaccgctcggctcctggatagtcagatcgtcccagctgatgctgacgttgcccggcaactcgccgtgtcgcccggcagcctcgtcatgcgtatccaacgcgtgcggctcgccgacggcttggccatgtccttcgatgaaacctacctgccgcgcgagctaggggagaagatcgtcacccacgatctagaaaccgagccaatcttcgcgctgctcgaagaacgataccacctgccactgattgaggccgaataccggctggaagccatcacagccacaccgaccgttgcacaggccctcgccgtggagcccggcaacccggtcttcctgatcgagcgcacgtcatataccgaagggtctcgccccatcgactacgaaaggctccactatcgcggcgacctcatcaggttcatcactcgcttgtcccggcgtccacgcgcgcggtcatga

SEQ ID NO: 3771 - DNA, 924 bp, Myxococcus xanthus
atgctcaccgagggctccgtggtcgagcgcctgcgccgccaccccgcgggcctgctggacccgcacgtggccaatgcgagcctcctccttgagccggagggacgcgaggcgctcgcagccatctaccgagactaccgcgacatcggcctggggcatggcctggccaccctgctgctcacgcccacctggcgcgcgaacgcggaacgactcgcgcgcgcgggcctggctggccgggacgtgttcaccgaggcggggaggctgctggcgggcctacgcgatgagcctcgggagcgggagacgcgtgtcttcgtcggcgggctcatagggtgccgcggggatgcataccagcccgcggaagcactgccccgccgggaggcggcagccttgcatgcgccccacgtggaggcgctctcgcgtgctggagtggacttcctcgtggcgcaggcgctgccggccctctcggaggcagagggcctggccctggcgatggcgcgcaccggggcgccgttcctgctgagcttcgtgctccgacccaccgggacgctgctcgacgggaccccgctggccgaggccgtcgcgcgcatcgacgccctgcccgacgcgcgcccaaccgcgtacatggtgaattgcgtccacccctccgtcttccgcgagggcctatcgcaccaactggccgcctcgccctccctcggcgcgcgggtggtgggcctgcaggccaacacctctcgactctcgcccgaggagctcgacgggcgcgcggagctcgactgcgcgcccccggacgcttttgcgcgggagatggctcgtgtccatgcggaactcggcacacgcgtgctcggcgggtgttgtggcaccgacgaacggcacatcgcggcgctcgctggcatcctgacagaaggcacgccaggcgctctgcccccatga

SEQ ID NO: 3772 - DNA, 957 bp, Myxococcus xanthus
atgtgcatgagttccggttcgccgggacggatccgcttgtggaaaccctgtcgggagggggcgcccagttgttttaccagcaggcctggggcttccagggggagatgttgttcaccttcgtgtgggtggatggggccgacattcccccaggaccagcaaaggagcacattttcaatgagcgcgcgattcgccaatcagaagctcatcgttgtgggcggtaccagcggaatgggaaaggccgtagctcgtatcctccttgaggagggcggtcgagccgtcgtcatcgggcatcgagacgacaagctccaggccgccgtcgcggaattggctgcgtccggccctgtggagggcctgcgcgcggacatcgcatccggcacggagagacaggccctggtggcccagttgcagaaggaccacgccgacgcgacgctgctggtcaacgcagcgggtgtcttcctgccgaaggcattcttggagcacgaggagcgcgattacgacttgtacctcgacatcaacaaggcgctcttcttcatcacgcaggccgtcgcccgctccatggtcgcgctgcgcaaggggggagcgattgtcaacattggctcgatgtgggccaagcaggccatccaggccactccatcctcggcctattcgatggccaaggcaggactccactcgctgacgcagcacctggcgatggagctggccggacatggcatccgcgtcaatgctgtttcgcccgcggtcgtcgagacccccatctacgaaggcttcatcccaaaggagcaggttcacggtgcgctccaggggttcaacgggttccatccactcggccgcgtgggccgcgcagaggatgttgcgcagaccatcgtccatctgttgtcggacgagacttcttgggtcaccggcgcaatctgggatgtcgacggcggcgtcatggctggacgcaacaagtacagctga

SEQ ID NO: 3773 - DNA, 804 bp, Myxococcus xanthus
atggcgttcagcgagttcgagtgctggtccgaatcaggccagttggagtgcgtggcggtgttccggcccgcggcgctggacgtcaccagtgcggaggaggcggcggcggttggcttcatgcggcctgtcactcgcagtgaggcggaggacgcctttggccggctgcgggacacgctgacgcgcctcggttgccagacgattgacctgtgggagttgctaccggagcgcgagcgcgcggtgagcgacaccacggtgaaccgggtgtttgtccgcgacaccgcggcggtgctcgggcgtcagctcgtgacgggcacggcggccttccccgtgcggctggcggagttcgacgtggcgcaccgcgcgctgtcgcagctccagccggagctgtcgagcgacgaagtcccgacgtccgcgcgcatcgagttcggggacgtcttcgtgctcgacgcggagcggttgctggtcaacgtggggctgcgcagcgacgcgcgggcgcttcaacccttcctggagctggcgtggcgttcgggcttccgcgaggccgccgtcgtccgcatcccggagagcctgggcatcatccacctggatctggccttcaacgtgcttgggccgcgggccgtggtggcgcgggcctttcttcgccacacgcccatccaggtgttcgcacagggcgtggcgccgcactgggagccctttgacggctacttcgcccagcggggctgccgcgtcatccccttcgagccgaaaggggagagcggcttcatgtcgaacttcatctacgtggggcccaacctagttctttag

SEQ ID NO: 3774 - DNA, 1431 bp, Myxococcus xanthus
atggccgacgacaacgccgcccagcctgggaaggacaacgccgatacgccggccgcccgcgagcgccgcaccgacgcggtcctcctcaagatgccaaaccacaacatggactatccgcatctggcggtgcccacgttgacggcggcactgaggaagaacttcttcaaggtgaagcagcaggacgtcaacgtgctgctccgggatttcctcctcacggaggagatgctgaaggatctggcctaccggttcctccctgaactggccaaggcacacatcgacatcccggcggacttcgatcgcattcgcaatgcgctcgtctacctgcactacatcgacaaccagattggcttcgccagggtcgaacaggtgaagcagaagctccaggcccgcaagtacgaagaggtcttctgcgacgagcaggagagcagcctcgcctcgctcatcttcgtgctgaccgggatgctgcacatcgtcatcgatctggcgctgacctatgacgaggccggcggagagatcgacaacccggtgacgaacttcctgcaccagaaggtacgggaggtggcggccctcaacccgcgcgtggtgggcttctccgtcatccagattcagcgcaaggccaccctctggttcgcccggcgcctcaagccgctcatccagggaaaaatcgccgtcgggggaccggacgcctccaccttcaaggaagagtacctcaagaacaacgactgcatcgactacgccttcctcaaggaagcggagaccaccttcctggagctcctgcgcggcaagcccgtggagcagctcgacggcgtcgtcttccgggatgcggaaggaaacatccaggtcaacgagccgcgccacgacatccagctttcgatcttccggccggacttcgatggctacgacctcgacaagttcttgctgccgacgttgcccttgtccacctcgcgcggatgcgcgttcgccaagtgcacgttctgcaaccactacaagacgtactccggctactacagcaacgatgccgtgaagacggtggacatcatcgagctcctggcgaagcgctacaacacgcgcttcttccacttcgtggatgacatgctggaggtgaaggagggcacggccatcgccgaggagctgatccggcgcgaccttgacgtgaacatcctcacctatgcccgcttcgagccccagttcaccgacgagaagatcctggagctctggcacaaggccggcatccgcgtcatcgaatggggcctggagtccgcctcgcaggaagtcctcaagaagatgatcaagggggtctccatccggcaggtgcagaacatcctcgacatcagcagccagaaggggatcgtgaacaagctgatgctgttccacaactatcccggcgagacagtggatcagctcaagatgaccgtggacttcctgcgaaag

SEQ ID NO: 3775 - DNA, 675 bp, Myxococcus xanthus
atgctgctgccgcacctgacggaccatgacaacttctccggcctggcggacagtctccggtccacggccgccctcctgcggcgctacatcatcgacttccggttctgtatcaccgccgagcggctgccccagacactcccggcgctgctctccgagctgcggaagctctccgagagcccggaggatcgcgccctcctgtctcgcttcccggtgatcgaagtccccttcacggccggtggcgacgactcggcgcaactggcgaacgccctcgccgaactctggtcccgctggccgcagttgaacgactcggtgaacctgagccggggcggcttcgtgaagcacttctacgcgctgaaggagctgtggcacctcgcgcggatcatgaaccaggagcagtccgtcgaagccgatatcgcgaagctgcgcacaggctatggggtggaggccgcggtggaggcccgaatcgccgcgttcgaccaggccttcctcgagcggtatgcctcgctgggccagtacaatgagtggcggcacagcagcaacagcgtggtgctggagtttgatctggattcgatcgccgacacctacgagtgccagtcccccgtcttcgtggacaacaggtggatcctggagcgcaactcgttggagctcgcgaccgacaagggtcgcaagagctga

SEQ ID NO: 3776 - DNA, 687 bp, Myxococcus xanthus
atgaccgcgctggcggccttctacacgctgcttcaccggctgacgggcagcgaggacgtcgtggtgggggttcccctggccaaccgggcccacccgctcaccgaggatttgatcgggttcttcgtcaacaccctcgcgctccggtgccaggttcaaggcgccctctccttccaggaactccttcagcgcgtcaggacgctgacgctcgaggcctacgagcaccaggacgtgcccttcgagcgcgtcgtggacgagctcgggattgagcgttcactgagctacaacccgctcttccagattctcttcgtgttgcagaacacgccgctgccaccgctccggctcgggaacctgagcttgagccaggtgactcccaacttcgacgcggtgaagttcgacctcgtcgtcatcctcacggagcacgacggcgggctcgaggcatcgtggagctacgacgccgacatcttcgacgaggcgaccattgcgcggatgcaccggcaatacgagctgctcttacggcagcttgccagcggggcggacaggagcctggcccgtctggagctccagacggagaccgagcgtaagcaagagggcgtcctcaaagacacacgccgcgcctcggacttcgatcggctgcgccgtatcaaacccaaacccgtcaccccgcagcgcaccggagaagagggatag

SEQ ID NO: 3777 - DNA, 1035 bp, Myxococcus xanthus
atgaacgtgctggacaaggtgctgacgttacggccggggaacacggtggcgcgggtgggcgcgggttcgcgcgttccgctgctcaatccccgggagctgctgcgtgccctggcggaggcgccggtggcgctgccgtgcctgccggtccaagcgaagggcgccttgccgggcctgctgcgcgcggcccggtcggaagacgccgtgctggggctggcctgcccacacccgctgtctgaccggggggcgcccgagcgcttcgtcgtggccgcgcaccaggcggccgccgaggccgaacacgcgcggcccctgttcctccaggccgggcccattcgggtggcccgggcggacgcggacaccctggacgccctgaaggacggcatctaccgcgtggtggacgccggcttctcgctggtgtcgttggacctgtcccggctggactcctatgaggccgtggaggccgtgaatgccctggtggcgccggtgaccgagcgcgagctggcgctggagctgacgggaccggccgcttctggcgggttcgtggacgcgtaccggacgctgctggagggcctcaggcagtggaaggtgccagtggacttcgtccgtgtgccggagtccgcgctaggtgagggcgagccggacgtgcggctggtgcgcagcctggtgcaactgcccgcggagtacgacgccgtgctgtcggtgggtgaggcgggcgcggcgctggccggcgggctgcccacgtacgtggcggcgggcgtgcgcaaggtggcctgcgtgggcggcttcgatcggctcgcgctgggggcgtggcccccgcaagtccgcgccagcgtggcgaagaaggccacagccgccgggctgccctcagaccagctgctgagcgttctggaggagcaactgccgccgctgaacgacaccgcgcgggagaagctgcaggccctgtccttcatggaggccaccgaggtactgtccgcgctgggtgccacgcgcacggggcaggcgtcactgcgcttcctggcggagaagcggggcgactga

SEQ ID NO: 3778 - DNA, 2874 bp, Myxococcus xanthus
atgctggtggagtggaacgacaccgccgccgcgctgcccacggagcccacgttcctctcccgcttcgaggcccgcgccgccgccacgccggatgcgctcgccgtggtcgatggcgaacggacgctgacgtaccgggagctggatacacgtgccaaccagctcgcgcatcatctggtgtcgctgggcgcgagcccggagcgcgtggtggcgctcggcctggaccgctccgtcgagttggtcaccagcctcctggcaacgctcaaggccggcgcggcctacctgccgctggacccgagctacccccaagagcgcctggcttacatgttgtccgattcgcgcgccgtcgtgctgctcaccacgcagacgcaagaggccacgttcacgggcgccagcgttcctcggctcctggtggagcaggaagcggttcgcctggcgacgttgccgacggaggcaccggcttcgaccgccgctggggactcactggcgtacgtcatctacacgtcgggcaccacgggacagcccaagggcgtgatgctcacgcagcgagggctgctcaactacctgacgtgggcccaggacgcctacgcggtgaagccgggccagggctcgctggtccacacgtccatcgcgttcgacgccaccatcaccagcctcctcacgccgctgctcgcggggggagccgttcacctggtgccgtcggggcgggaggtggaagcactcgcactcgcgctccagcagccgagagggcatgacctggtcaagctcacgccggctcacctccaggtgttgtccgggctgatgacgccggaggcactgtcgaagctgactggcaccttcgtcgtgggtggcgaggccttgccgccctccaccgtcgccttctggcggaagcacgcgccccagatccggctcatcaacgagtacggccccacggagaacaccacgttcacctgctgccaccccatggaggcgctggacgaaggcacggcaccggtccccatcggcgcgcctgtcacgggcactcgggtccatctcctcgacgcaggactcgagcccgtaccgctcggagcgccaggcgagctgtactgcgcgggcgacgggctcgcgcgtgggtacatggggcatgccgacttgaccgcggagcggttcctgccggacccgttcagccgcaagccgggcagccggatgtaccggacgggagacctcgcctgctggagggctgatgggtccatcgagttcctgggccgggtcgacaaccaggtgaaggtccgcggcttccggattgagcccggtgaggtggaggccaccttgctcaggcatccggcggtgcgcgacgccgccgtggtggcggccggtgagcgcgcggacaccaagcggttggtggcgcatgtcgtcctccgggacgcctccgccatcacctccggcgacctgcgggactacctggagcctcagctccccgagcacatgattccatccgccgtggtgttccaccacgcactgcccctgtccccgaacggcaaggtcgatcggcgggtgcttgcccaggcgcctctggacagcccagaggctggaggccccctgagcgcacctcgcaccgcggccgagctgaccctcgtgtcgctctggcgcgagttgctcggaaggacccacgtcgggattcacgagaacttcttcgagttgggtgggcactcgctgctggcgacacggctcctgtcgagggtgcgtgaaaccaccggcatcgagctgccgttgaagtcgttgttcgagggcggcaccgtggccacgctggcggagcgaatcgaggcggcaagccgctcccggcaggccgccgcgcggccgctctccccagtggacaggggcgcccccctgccactgtcctactcgcagcaacggctctggttcctcgcccagctcgagccgcacgcctcgacgtacaacatcccgggagcgctgcggctcaccggcgcgctcgacgtggcggtgctcgagcgatgcgtggagacgctgctggagcgccacgaggtgctccgcaccgcgttcgagtcccaggaggggcgcccggtccagcgcatcgtgccgtcgctgacgctgaagatgccggtcgaggacctccgcgcgttgcccgcgggcgagcgcgaggcgcgtgccccgggagatcaaaaagacggaggcggaccgcccgttcgaactcgccgagcccccgttgctgcgcgtccgcctgctgcggctggacgaacaggagcacgccttgctggtgacgctccaccacatcgtctcggacggctggtcactgggagtgctcttccgcgagatgacagcgctctacgaggcgttcagcgcaggcaagcagaacccgctgccgcccctgccaatccaatatgccgacttcgcgtactggcaacggcactggctccagggcgagctcctcgaccgccagctccagtactggcgccagcggctggcaggagcccccgcgcggctcgcgttaccctccgcgctcccacggcccgaagttccgagccaccgcggcaagctcgttgttggacggctcagcccccaggacaccgaagcgctccagaagctcggaagacaggaggggacgacgctcttcatgaccgcgctggcggccttctacacgctgcttcaccggctgacgggcagcgaggacgtcgtggtgggggttcccctggccaaccgggcccacccgctcaccgaggatttgatcgggttcttcgtcaacaccctcgcgctccggtgccaggttcaaggcgccctctccttccaggaactccttcagcgcgtcaggacgctgacgctcgaggcctacgagcaccaggacgtgcccttcgagcgcgtcgtggacgagctcgggattga

SEQ ID NO: 3779 - DNA, 4716 bp, Myxococcus xanthus
atgaccgctgaatccttcgtcttccccgtctccttcgcgcagcagcggctgtggttcctccatctaatgcagccggagaacccgagctaccacatcgctggcgcggtccggctcggtggcacgctcgacacggccgcgctccggcgcgccttcgacgtcctggtggaacggcacgaatcgctccgcaccaccttcgcgcaggaagaaggccagccggttcaggtcgtcgcgcccgaaggcaccgcgtccttcgccgtcaccgacctgtcgtcacttccgcgggacgagcgcgaggcggaagcacggcggctcgccaccgaggagattcgccagcccttcgacctgatgaagggcccgctgctgcgcacgcggctgctgcggctggcggacaccgaccacgtcctggtgctgacgatgcaccacatcatctcggacggggcgtcgctgggcatcctcatccacgagatgacgcagctctacggcgcgttcatcgcccaacgagagccggagcttcccgagctgcccatccagtacgcggactacgcggagtggcagcgcgagtggatggcgacggaaggcgcgctcgacgcgcacgtggcgtactggaagcagcagctcgcgggcgcgcccgtgttgcagctccccacggaccgtccgcgccccgccgtccagacgcagcgcggggacgccctacccttgcacctgccaaccgcgctggtgcaggcgctccagcaggtgggccagcgtgagaacgccaccctcttcatgacggtgctggccgcgttccaggccttgctgtcacgctacacgcaccagacggacatcctggtcggcgcgccgcagaacagccgcaaccgggtccagacggagagcctcatcggcttcttcgtcaacacgctggtgctgcgcgcggacctgtccggcaatccatccttccgcgagctgctccagcgcgtgcgggaggcgacgctgggcgcctatgcgcaccaggacatcccgttcgagaaactggtggaggcggtgcaacccgcccgcaacctggcctacacgccgctgttccaggccgcgttcaacttccagggcatggcgggccaggtgctggccctgcccggcgtcaccctccagcaactggacctgcaaccggggacgtcgaagttcgacgtgacgctggacctccaggagaccccggacggcctgcgcggcttcgtcgagtacaacagtgacctcttcgaccgcgcgaccatggagcgcttcgccgggcacttccagacgctgctcgcgggcgtcgcggccaacgcggagctgcgcctggacgcgctgccgttgctcacgtcgcccgagcggcaccagctcctcgatgtctggcccacgctgaagtccttcccaggcgcggacaccctgcacggccgcttcgaggcccaggtgcgccagcgccccgacgccatcgccgtggtcgccgatggagagcgcctcacctacgcggagctggaccgacgggccaaccagttggcccatgcgctgatcacgcgcggcgtccagccagagggattggtgggcctctgcgtggagcgctccctggccacggtggtgggcatcctcggcatcctgaaggcgggcgccgcctatgtgccgctcgacccgacctatcccgcggaccgtctggccttcatggtgtcggacagccggatgtcgttggtggtggcgcagcggcccctcatcgaccgcctgcccgcggacgggacggcgctgctcatcctggatgaagccaccgaggaactcgcacgccagcccgcccacgcgcccggactggcgacgacgcgggaacagcttgcgtacgtcatctacacctcgggctccaccggcctgcccaagggctccctgcttccgcacggcaacgtgatgcgcctgttcgaggcgacggagcactggttccacttcaacgagaacgacgcgtggacgctgttccactcgtacgcgttcgacttctccgtctgggagctctggggcgccctgctctacggcggccgggtggtggtggtgccgtacctcgtctcgcggtcaccggatgccttcttcaggctgctgagcgatgagcgcgtcacggtgctgaaccagacgcccgcggccttccgtcagctcatccaggccgaggagcgcctgggcgcggaggcgccgcccctgtcgctgcgctacgtcgtgttcggcggcgaggctctggagccagccacgctggtgccctggttccgcaagcacggggacacccagccgcggctcatcaacatgtacggcatcaccgagacgacggtgcacgtcacctaccgtcccatggatgccgccgaggcggagcgcacgcagcagagccccattggcgtcgcgattcccgacctccagctctacgtgctggacgcgcggctggagccggcgcccattggcgtggcgggtgaaatcttcgtcggtggcgcgggtctcgcgcgtggctacctgggccgaccgcagctcacggcggagcgcttcgtcccccaccccttcagccgcgagcccggtgcccggctctaccgcacgggcgacctggcgcgcttcaccgcggacgggcagctcgagtacctgggccgcatcgaccaccaggtgaagattcgcggcttccgcatcgagctgggcgaaatccagacggtgctcagcctgcacccggcggtgcgtgaggcgctggtgctcgtgcgtgagagctcgcccgggaacaagtccctggtggcctacgtcgcgtcgtccgaacagcctccgcccagcgtcaacgagctgcgccagcatctgctcggcaagctgccggactacatggtccccagcgccttcgtgatgatggagcgcttcccgctcacggcgaacggcaaggtggaccgcaaggcccttccggagcccgagggcgcccgcgcggacctggccgacccgtacgtcgcgccccggacgaaggaggaggaagccctctgcgcaatctgggcgcaggtgctggaagtcccgcgcgtgggaatccatgacaacttcttcgcgctgggaggcgactccatcctgagcatccaggtgctcacgctggcgcagaagcaggacatccgcttctcgttgcagcagctcttccagcaccagacggtggcggagctggcggcggccgccgcgaaggcggagcccgcgcgtgaggtcttcccgcgcaccgagcccttcggcctcatctccgccgaggaccgggcgaaggtgcccgaaagcgtggaggacgcctacccgctggcccgcatccaggccggaatgctcttccacatggagctggcgcccacctcgaacatctaccacaacacggacagcttccatctgcgcctgaaggcgccgttcgaccccgcgcgcttcgtggaagccgtgcaagtggtgacggcacggcagcccgtgctgcggacggcgttcgacatgacgtcgtacagcgagccgttgcagttggtgcaccgcgaggcccagctctccgtcgaaatcaccgacgtccgccacctgtccaccgaggcgcaggacgccgaggtccgcaaactgctggaggacgaaaagcagcaacacttcgacctcgcgtgccctccgctgctgcgcttcttcatccacatccgtggtgaacgggacttccagttcacgctcacggagtgccacgccatcatcgacggctggagcctccactccacgttggtggagatgttcaaccactactacgcgctggtgaaccaccaggagccgccgcgcttcgaaccgctgagcatcacctaccgcgacttcgtggccatggagcggcaggccctcgcgtccgaggaccaccaacgctactggcgagagctgctggaggacggacaggtcatgcgcgtgccgcgctggcgccgtccactggcggagggcgagccacgcatcgccacggtgaaggtgcccatctctcccgaagtgagcgagggcctgaatgccctgacgcggaccgcgggcgtgcccttcaagagcatcctgctcgcgtcgcacctcaaggtgatgagcgtgctgagcggtcaggaggacgtcatcaccggcacgggcgtcaacagccgccccgaggaaggcgatggctcgaagctgcgcggcatcttcctcaacacggtgcccttccgcctgaagctggcccccggaagctggctgtcgctggtccgcgccgccttcgacgcggagcgtgcgctctatccgtaccgccgctaccccatggcggagattcagcggcagtggggccgcgagacgctctacgaagtcatgttcaactacatgcacttccacgtcctccacgacatcgcgggcacgctcgcagagctggaggcgctgagcaccatcccgctccgagggaaccaacgtcaccctcgccgtccacttccagaccgagccccacacgcaggagctcacgctggagctggactacaacgccgtcgagctgggcccacgcccaggtggagcaaattggcgcgtgcttcgcgcgcgtcctccacgcgctggccttggaggctgaggccgcgcaccacacctccagcccactgcccgccgacgtgcagcgccggatgctggtggagtggaacgacaccgccgccgcgctgcccacggagcccacgttcctctcccgcttcgaggcccgcgccgccgccacgccggatgcgctcgccgtggtcgatggcgaacggacgctga

SEQ ID NO: 3780 - DNA, 3384 bp, Myxococcus xanthus
atggaaggcgagcgcctgcgcttcaacgcccctccgggcgtgatgacgcccgacctgctcggagagatgaagtcccgcaaggaggagctggtctccttcctccagcaggtgggccagtcactccagggcgccgcggacctcatccccgccggccctcgcgatggagcgctgccgctgtcgtccggccagcagcgcatgtggttcctggagcagttccaggggcccagcggcgcgtacaacatgcccgcggcgctgcggctcgaaggcgccctggacatcgccgcgcttcagcggagcctggacgaaatcgtccgccgtcacgaggtgctgcgcacgagctatgggcagcatcagggcaagcccttccagcgcgtcttgccgcctgcgtccgtgacgatgcccgaggtggacctccagcacctccccgccgacgcgcgtcaggccgaggtccggcggcgggcgacggaggaggccagccggcccttcgacctgtcacgagacctgcccctgcggctgtccctgctgcgattggacccacgcgagcacgtgctgctgctcacgctccaccacgtcgcttgcgacggttggtccctgggcgtcctcatccgcgaactggcggcgctctaccgcgcgttcagcacgggcgagccctctccgcttcccgaacccacccttcagtacggtgacttcgcgcgctggcagcaggagcgcaccactcgtggcgacctccagccgcacctctcctggtggcgcgaccatctggccggcgcccctgcgctgctggagctgcccaccgaccggccgcgccccgcgaaccagcgcttccacggtgcgacccatcgcttcaccgtgccggcggagctgaccgcccggctcaagcagcggagccgcgaggcagaggccacgctgttcatgacgctgctgtccgcgttcggcgtgctcctgtcccgtggcagccggcaggaggacctcgtcatcggcacgcccatcgccaaccgggtgccccagacggagcccctcatcggcctcttcgtcaactcactgccgctgcggctccaggtggacggcgcgcgtccgttctccgagctgctggcccgcgtgcgtcaggacacgctgagcgcctacgcgcatcagacgctgcccttcgagcaactggtcgaagcactccagcccgcgcgtgacccgagttactccccgctgttccaggtgctgttcacgctccagaacacgccgtccgaggtcctctcgctgtccggcctcacgctggagcaattggagttcgagagcggcaccacgcagttcgacctctccctgtcgatggcggagacggcgcaggggctggtgagcgagctgaactacaacaccgacctgttcgatgcggccaccgtcgagcggatgtctggctactttctcacgctgctcgcggccatcgcggaggaccccacccggtccgtgagcgacctgcccctgctgaccgggcccgagcgcctgcgactgctgcgggagtggaatgacaccgcgctcgacctgcccctgcccggcagcctccacggcctcttcgaacggcaggccgcgcgccgtccagacgccaccgccgtgcgcttcgagtcgcgcgccctgacctaccgggagctggatgaacaggcgaaccgggtggcgaaccacctgcgccagctcggcgtggagccggggcaccgcgtgggcatcttcctggagcgctcggtggagctgctcgtgggtttgctcggcatcctgaaggcgggcgcggcgtatgtgccgttggacccgctgtatccgccggaccggctggtgcacatcctggatgacagcggtgtctcactgctactgacggagccggagctggccgcacaggtccccgcctatcgtggcaagcgcatggtgctggccgaggccaccggcgctcccacgacgccgccccaggtgatgctcgcgggcacgaacctggcctacgtgctctacacgtccggctccacgggtcgcccgaagggcgtggccgtgccgcacgccgcggtcgtcaacttcatggcgtccatgcagcgggcgcctgggatgaccgaccaggacacgctgttcgccgtgacgacggtggccttcgacatctccgtgctggagctcttcctgcccctgagcgtgggcggcagcgtcgtcatcgccagtagcgaaacggccgtggatggcacccggctgatgcgggcgctggtggagagtggcgccacggtgatgcaggcaacgccttccacgtggcggatgctgctgacgctggggtggaaaggcagccccacgctgaagctcctctgcggtggagaggcgattccctccgaactcgtcgagccactgtgctcgcgcggcgcatccctgtggaacatgtacggccccacggagacgaccatctggtccaccaccacgcgcatggagccgggacgccgcatcaccctgggccgtcccattggcaacacgcaggtgtacgtgctggacgcggccatgcagccggtgcccatgggcgtgacgggcgcgctgtacatcggcgggcacggcgtggcgcagggctacctccaccgtccggacctgacggcggagcgcttcgtgccggatcccttcggacaggagccgggcgggcggctctacgccacgggtgacctgatccgcgcgctgccagacggcacgctggagtacctgggccgcggcgatggacaggtgaagctgcgcggctatcgcatcgagctgggagagattgaagcccggctggcgcaggtgcctggcgtcctggaagccgctgtgaagctgtgggacgtgtcgggccacgcggagctggtcgcctacgtgcgccccggcaccaagcccgcccccgaggcgctgacaatccgccagcacctggcttctcacctgccggcgtacatgctgccgagccacttcgtgacgctggagtccttccctcggacggccaacggcaagctggaccgcaagtcgctccccgcgccgtcggcaaaccagcgcgcctcggcagcctacgaggcgccgcgcacgcccatggaagtccagctcgctgccatctggcgcgacgtcctcgcggtggagcaggtcggcgcgcgtgacaacttcttcgacctgggaggccaatcgatgaaggccgtccaggtggtggcgcgcatccaggagtcctgcaaggtggacgtgtcactccgcgtcctcttcgagcaccccacgctggacgccttggcgaagcacctggagacactccagcagcccggtgcgcccgccgcgcctccgccgttggtggcccgaccccggcaggcccgccgggtccaggccgcgacgcgcgccgagctgaacctccccgactcgacttcttcgaagaaggagtag

SEQ ID NO: 3781 - DNA, 1893 bp, Myxococcus xanthus
atgctgaaggtggacaaggatggctcggtcacggccatcgacctgggcagtgagggtggcacggaagtgcggggacagcggctcgtcctccccacggcgctcaaccccggggatgtgttgatggtgggcggcagccaggtggaggtgctcttcggagcgacccagccggagcgtccgcttcccgcgggtgcgcgggttgcggggccggtgttccaggggccggtggccacgccaccgccgccgcgtggcatgcagatgcagacgcagacgcgcgcggacctgccgaacctggttcccacgccgccgccgcccatgcgccaggtgtccacggcgctgggcaaccgcgtggagcgggtggcctctcccggtgtgattccggtcgagccaccccggcaggtgcctccagggctccagcctcgcacgacgccctcctcggcgcggacgtccacgccgaatgtggcgaacacggccacgccgcggcggacggtggcgccgcacctccaggagccgctgcctcccgaggccatgcccacgcccgaggcgcgcgtcctccaggtcgcgctgctgtggggcgacaccctgctggaggtccagcacttcaaggacggcgtgcccgtcaccatcggcgaggcgaagcagaacttcttcaacgtcttcgcgccgtccgtgggcaagagccacgtgctggccgtcagcaagaaggatgtgttggaggtgcgggctcccgcgggctcgcgcgccttcgtcaccaaccagggcaacgtgcgcaccaaggacgcgctgcgggccgcgggcgcgctctccggccaggccggcgacgacgccgagcagcgcttcaccctgggcctgcacgaccgggtggaggtgtcgctgggcacggtgtccttcgtcgcgcgctacgtgaagccgtctccggtcatcaccgccgcgtcgctgaaggactctgacttcacgttcttcaagatcaccagcatctgcatgctggcgggcctggcggtggtgctgaagatggtgcagtctccgcgcccggagcttccgcacagcgcggacatcttggagtcgcaccagcgcgtggcgaagttcctcatcgccccggagaagaggctggaggcgaagaagctccaactgtccgcgccggaagagggcgccaaggcgaagcacgaggaaggcaagttcggcaaggaggaggcgaagcagcaggaagcggcgccttccaagcccggcacgcccgtggtggacaagagcaagaaggagaaggaccgtcaggcggtgggcaaggccggcctgctgggcgccttcaagggcatgaagggtggggcatcggacgtgttcggtcccggcggcttcggcaccggcatcaacgatgcgctgggcggcctcaagggcggcgcggccatgggtgacgcgcagggcgtgggcggcgtgggctcgcgtggcactggcaagggcggtggtggcaccgcgctgggcatcggtggtctcgggacgcagggcaccggccgtggcacgggcgggtcgggcggcatcgacctgggcggccgtggcaagtccatcaccaaggtcatccccggcaagacgacggtggtgggcggcctggacaaggacgtcatcgccaaggtcatccggcggcaccagggggagatcaagtactgctacgagtcggagctgaacaaggatccgagcctcgccggcaaggtggcggtgtccttcgtcatcgaccccgcgggcgcggtgtccgacgcgagtgtctccgagacgacgctgaacaacgccgcggcggagcgctgcatgctgtcgcgaatccgccgctggaagttcccggagcccaagggcggcggcgtggtgtcggtgacgtacccctggctcttcgcgcccgctggcgcgggagggtga

SEQ ID NO: 3782 - DNA, 402 bp, Myxococcus xanthus
atgagggccacggacgccaagtgggagcggccccagaagggagatgtgatggacgccaagagacgctgcgccacctgcaccgaggaagtgagcctggaggtccggaggtgcccgcgctgcggcgcgcgcacggagcccatgcaccggggcgtggatgggcggctgctgaccggggtgtgcgcggcgctgggacgggagctgggcgtggacgcggcgctgattcgcgtgggcttcgtggtggcgctggcggtgtccgggggcaccgcgctgatggtgtacctgctgctgtgggccttcacgccgccgtcggcgacgggcaccgcgcccctgcggcgcacgtacaactggctgtccggcctgggcaattcggagcgcacgccccgcgtcgagcgtcgggtgtag

SEQ ID NO: 3783 - DNA, 243 bp, Myxococcus xanthus
atggaccccaaggactacctcaagcgcagcgcgggcatcccgctggatccgaagaagcagaaggaccccgaggaagacggcgagcgcgtccccgccgaggggcgcgccgagttcctcaacgacgtctccgagcacaacggcggtcagcgcaccgacgtcgacgtgccgtggcgcaagggccccgagctgcaacgaggccagcgcgacgcctacaacgcggagagcgacaagaagaaggggtga

SEQ ID NO: 3784 - DNA, 339 bp, Myxococcus xanthus
atgtccaccgaccaggcacctccctactggctcctcatctccgtcctcttcagcaaccagccgctgtcgccctcgctggcgatgacgctgcaccaggtggcctatgagctccaccagcgcggtgagggcgccaaggaagtggccggggacatggtgagcggccgggtggtgaacctgcgcaaggacgtgtccttcggcggcatcgccgggccggccttcgaggcggagatcgagaccgagcggggctccggcgtcgtccgcttcgtcctcacccggcagggcctggagatgatgaagcagcagcccgccgagccgccccggcccaagtacctcaactga

SEQ ID NO: 3785 - DNA, 84 bp, Myxococcus xanthus
atggtgggcaccgagcggttcaaggaggcggtgcagcgcttggagctggagggcatcaccttccgtgagctgcccacccgctag

SEQ ID NO: 3786 - DNA, 1317 bp, Myxococcus xanthus
atgcagccatctcgccgtgtttcgctcgtcctgagctaccagtacccaggtaagtacgccttcaccgtgctggcgggcgccgtggagtcggacccggcgctggcggacgtgacgctgcactttccgcgcagccgcgagacgctgctggacacgattcgcgagcgcgtggacgccggagacacggtggtggcggcgtggtctttttactcggccagcttcgccccggcggcggaggagctggcatgggtgcgtgagcggttggagggacgggacgtgctgtgcatcgccggcggtgtgcacgccacggcggagacgctccagacgcttcaggcgggcttcgacctggtggcggtgggcgagggtgagtactccctgcgcgccttgctcagccgggtgctgcgcggcgaggtgccgcgtgagacgcacggcgtcgcgtatctgaaggatgggaagctggtgcagcacggccggggggagggcgtgcaactggacgactatccccccttctccgggcgcaacgggcagtacggcgccatcgagattacgcgcggctgcatctacgcgtgtcgcttctgccagacgccgttcatgagcaaggcgcgctttcgccaccgctccgtggccaacgtggcgcactgggcgcgggagctgcggcgctcggggcggagagacatccgcttcatcacgcccacctccatgtcctacggcaccgccgacgagtcggtgaacctggacgcggtggaggcgctgctcgccgcggtgaaggaggccatggcgcccgatgggcgcgtctactacggcaccttcccgtcggaggtccgccccgagcacgtcacgcccgaggcgctggagttgctcaagcgctacgtccacaacgacaacctcatcatcggcggccagtccggctccgagcgcatcctccagagcacccgccgggggcacgacgtggagacggtggtgcgcgccacccgcatcgcggtggagtgtggcttcgtgcccaacgtggacttcatcctcgggctgcccggcgaggagcccgaggacgtggatgccacggtggcgctgatggagaagttggcgggcctgggcgcgcgcgtgcatgggcatacattcatgccgctgccggggacgcccttccgcgatgcgccgcccgggtcggtggatgaggcgcacacagcgcaagctggaccggctggcctcgcaggggcgccctgtatgggcactggaagcagcaggtcgcgctcgccgagggcattgcctcacgccgtcgcccgcgcgcggggtaagggcagcgcggaacgggcaagacagacctga

SEQ ID NO: 3787 - DNA, 1401 bp, Myxococcus xanthus
atgcagcggctgtgggagggcggccgccagacggacgaggtggcatggcttgccgcttacgcctcgttgggcgtgggcgacgacgccgcggccttccagtggctggagcgcgccgtcgagcgggggatgggctcgccgggcgatctgctgcacgacaagtccctggagccgttgcggcggatgccgggttacgacgcgctggtggcgcgggcgagagagaacgcactgaaggcgcgcgcggagggcaacgtcggggcggggctggagaaggcgacgcccgccgaggcggggctgtcggagccggcgctcgcggccttcgtgaaggcggccgaagaatcgggctcgtcggccctggtggtgctccgccacggcaagttggtgggggagtggtacttcggcggcgagacgcagcgcatcgagtccatgtccgccaccaagggcgtggtggcgctggccatcgggctgctcatcgatgagggccgcattccctccgtcgacgcgcctgtctccaccttcttcccggagtggaaggacggcctcaaggggaaggtcacgcttcggcacctgctcagccacacctcggggctggcggcgaacgcccacgcgatggacatctacgagtcgcgggacttcgtccgctacgcgctggacagccacgtggtggacgtgccgggcagccagttcttctacaacaacaaggccaccaacctgctcgcgggcgtggtggagcgcgcctcaggcgagaaactggacgcctatctcatgcggcgcctcttcgagccgctcggcatccgtgacgtgttctggcagaaggacccgtccggcaatccgctgggcatgtccggcctgcgcctgcaccccgtggacttcgccaaggtgggccagttgatgcttcagcgaggcgtctggcagggccagcgcatcctgagcgaggcctggattcaggaatgtaccgccgcggcatctcaggcccacacccccacggcgggcttgttgtggtggctcgtctacgacaaggcgttccgcgtgctgggccaggacatggtgaacgaggcgcgtcgcaacggcatgcccgaggcgtcgttgtctcgcctgcgggacgtggtggacaagccgattcccgccggggacttcatgcaggtgctctccgagcggctcggcgggatgaagggcgtcatggcgttcatggagaagagcgcccgcatcccgttgcgcacgcacgtggagggcgcgccccggggttactccgcgcgaggctccttcgggcaactcctgctggtggtgccagagcaggacctggtggtggtgcgcatggctgtgccggacgggcgggttcctccagacgtcatggagttccctgcattcaacacgctggccctctcgctggtgccttctccctga

SEQ ID NO: 3788 - DNA, 597 bp, Myxococcus xanthus
atggtaaagatcagcttcctgattgattccaccaagcttcccacggggggatcctccgtcagtaccgcggtcgcggttagccatcagacgttcctcgtgaacgacaacccccatcccaaccaaaatgaccccgactatgcggtgcccgtcccgagtggggagagcgtccgcatctacatccaagaggcgaactacgcctcgaccgtggggctcgcgcccaatggcatcatcgtgcatgcgttcaacggcgctccggtctcggacgcgatcatgaatgacgccacgaagcggcccatcgacatccccaacttcgatttggatctgggccctattccggacttcatcggtttcgtcggcgatagcccgaagtggacccagacgcccccctcctggagcaactggcccaacgagccgctcatcgaccagcaactccgggcgggctggacgcccaccttcgttccgtacatcacgttcaatgccagtaagctcgtgagcggtttgctcgagtacggagtggtgttcgcgctgacgaaggacggagcgaacgtccagtacttctacttcgaccccttcctcaagatcggttcgtcgagctga

SEQ ID NO: 3789 - DNA, 918 bp, Myxococcus xanthus
atggtgaacgcggaccggctgcaggtggtgacgtcacccgtggccgagggcaaatacgcgctgaaggcgacggtgcatcagggcgacgaccccatcaacgccagcgggaatcgcaacgagctggtctacatcagcaacgagccggtgggctcggagtactactaccgctggaaggtgatgttcgcgaacgacttccccagcgtggacacctggcagctcttcacccagtggcaccacgacggatgctgtggttcgccgccggtggagttctacgtgaagggggaggaaatccggctgtcgctccccggcaccagcgagattccctggcgcacgaagctcacccgaggcgtgtggcacgagttcatcctgcacgcgaagtggtcgtccgacccgaaggttggcttcgtcgagctgtggcacaacaaggaactggtgctgcccaagcgcggcgcgatgacgatgtactcggggcagcgcaactacctgaagctcggcctctaccggagtgacaccgtgaagccggtgggcgtcgtctaccacgacggcttcatccaggcgacggcgctgtcggacgtgctcgagcagaagccggagccgccacccgtggacgcggggacgccgatggatgcgggctcgcccatggacgccggctcgcccgaggacgcgggccgcgtggacccagaccccgtggacgcgggtggggccgaggagccgggcccgcagccggaggcggacgcggggacgccagcctgggacgcgggcacggagcctgggccgaacgtgcccccgcctggaggcatctcctcggatgagggcgccgcggcacagtcggggtgcagcagcaccggtggctccgcggcggccttcgcgctgctggggctgatgggcctggcgggctaccgccgccgcaagggctga

SEQ ID NO: 3790 - DNA, 633 bp, Myxococcus xanthus
atggttcagaaaggtcagttcctcgaacgcgcgacgctggtgccggtggggtcggaggtcatggagggcaccacgcaccggggaagccgagcgccgccgctgctcgtgattccgccccggccggacgaagggggcggcatggaccacgtcatcgcggcggagctcgtctgggcggcggcgaacgcgggctttccgacgctgcggttcaatcaccggggcgtgggggccagccagggcaagcgggggcgggacttggagctgctggcggacgcggaggccgccatgcagatgctgctggagaacgcgggggccaacgcactggcggtggcgtcactccacgggggcgcccaggtggccctggcgctccaggcgaaacaccccgccgtgggaggcctgtgtctggtggccccggccctggtggcgccggaagtcctgtcccgggtgacgtgcccgctcctggtggtacagggggaggaggacacccggctgccgcgggccgccgtctccgccgctatcgctcggacgggaggcgacttggaggtcatcgacgatgccggacctaccttccagcggaaccttcctcaggtcggccgagctgtcgcggcctggctgcggcggctctccggcggatga

SEQ ID NO: 3791 - DNA, 1794 bp, Myxococcus xanthus
atgcggaaggtgcgatggaccctggggggcgcggcgctggccctgacgctgtcggccgcctgtgcgtccgcttctcgtgagcaggacacgcctccccctgcgaatctgcgggcgctcgatgcgcgggacgtggtggcgggcgccatcgtcgtggacttcaaggacggcacgacgaaggcggagttcgacgcctgggaggccgactggggcgtcgacctggaactcaactccgtggagagcgccgacgaggccctcacggtggcggtgggcgtggacgacgtggacggggtgctcgagcgcatccgccagcaccccgccgtggaagccgccgagccgttgatggaggtccgcgccagtttcacgccgaacgacccgcatttcgcgcagcagtggaacctgcggatgatcgacatgcccaaggcctgggagcgcaaccggggcaagggcgtggtggtggcggtgctggacactggcatcgcgtacgaggaccacggcgacttcaagcaggcgccggacctcaagggcgtgaagttcgtgaagggcttcgacttcgtcaacgacgacgagcacgccaacgacgaccacgggcacggcacgcacgtggcgggcaccatcgcccaggccaccaacaatggcgaaggcgtggcgggagtggccttcgaggcgacgctgatgcccgtcaaggtgctcaaccacttcggtggcgggaacacggcggacatcgcggacgccatccgcttcgcggcggacaagggtgcgaacgtcatcaacctgtccctgggcggcggggcgtactcgcaggtgatggccagcgcggtcgagtacgcgcgcaagaagggcgtcaccgtggtggccgcggccggcaacggcgggcgggcgacggtggaattccccgcggcctacccgggcgcggtggcggtgtcggccgtggggccggacggtgtgctggcgccctattcctcctacggcaaggagttggacatcgccgcgccgggtggtgacaagcgccggggcgaccaggggggcatcctccagaacaccctcgacccgcgggacgtctcgcgcttcgtctacgcgtcctaccagggcaccagcatggccacgccgcacgtcgcggcggtggcggcgatgctctacgcggccggcgccaagggaccggacgaggtggagcaggccctctacgcgggcgcgaagaagtccgcggaccaggcgtggagcgagcagtacggccacggcctgctcaacgccgaggcgtcgctcgcgtcgctgcgcggcggcggcttggcacagtggccgccgctgtactgggcgctggcgctgctggcgttcgtgctgctgacgctgcgaggccgtgcgcggccgggctacctcaacgtgctggtgcggcccgccttcctcatcccgctgctgctctcgacggtgggggccttcttcctgcgcggctggttcgggggcgctgagggggccgcaggagacgtggtgcaggtggcgtcgctgcccctgccggattgggagcgcatcatcttcggccggggccggacggtgaacccgctgttctacagcgcgctcatcccgctgctcctgtcgctgccggccatcaagtggcgggggctgcggtcggccatggggggcctggcgctcggcttcgcgggcttcctggcctacacggcctgggccggagcgccggcgctggcgtggctgcccttcgcgttccttgccaagccctggctgggcttcaacaccgtcatctgcctcgtcatcgcccgcgcgatgctccagaaggaggacgcatga

SEQ ID NO: 3792 - DNA, 285 bp, Myxococcus xanthus
atgaggcgactggtatcagcggtggtggtgctgggcctgtgggcggcaccctcggtggcgatgtcacaggagccgagagacacggtgaagatcgtccaggaggaggaccgcaccgtcgtccggaagaagacggtcatcgacttcacggatgtcgcggtggaaggcgagctcacgaagcctgagggctcgtacgtactccaccggaagaagacggacttccagagcctcatcaaggtccgggacaacttcgatccagagttacaaaagtcagtcgacaacctctag

SEQ ID NO: 3793 - DNA, 216 bp, Myxococcus xanthus
atgaagctcactggccgcgtcgtgttccgtgacatcgaaacgggggtctgggtgctggagggagacgacggcaccacgtaccagctcgctggcggggaccggaagctgaagaaggacggtcagcgcatcgaagccgaaggccgcgtggacggggacacactcaccagcgccatggtgggtcccatcttccacgtcagcacgtaccgcttcgtctga

SEQ ID NO: 3794 - DNA, 711 bp, Myxococcus xanthus
atgagggagcccatgtcaccgcctcgatggctcggtgcggataccctgtggcttgcgggctggctctcgctggcgccagccgtgggggctgcggcgactccgccggccaccgtggagggccgggtcgcggaccaggtggtggcgatcattgagggccaggtgctcaccctgagcgagctgcgcttcgaggctcgggtcgcgctcctccagcgaggcggcgtgcaggccctggagctcccgctcgacgaggacacgctccggggggccctggagctcatcatcaaccagcgggtccaggttctgaatgcggaccgtctgcaggcattccctgccgagcccgcggaggtccaggcgcgggtggacgcattccaggcggtgctaggaggggaggcggcgttgaagcggttcctgtcccgccatgacgtggacgtgcaggggctggagcgggtgctggcgcgggggcttcgggccgagcgcatcctggacagccgcatccggctgcgggcgcaggtgggtgagaccgaggtccgccgccacttcgagcagaacgcggacgaatatccggaaggctacgaggcggcgcgcgccgccatccgggagaagctggttcgggggcggtatggggcgctggcggcggaagagctggcgcaggtgcgggcctcggcgcaggtgcgccgcgtggcgccctttgcccgggaggcaagtcgatga

SEQ ID NO: 3795 - DNA, 486 bp, Myxococcus xanthus
atgcgcgaggagtcggcgcccgaggcccggcacggctacaccatccggcagatggcggcggaggacctgtccgcggtcatgctgctggagcaggcctcgttcaagaacccctggtcccaggacctgctcaagcgcgagcttcagcacgaatggtccaccatcctcctcgtggaggaggagcgggaggcggacgggccggagctgctgggcctggccatcttctggatcgtccatgacgaggtgcacgtgctgaacgtggccaccgcgcccaagcaccggcgccggggcgtggcgcgcgccgtcatggacgaggtcctggcgcgggggagggccaagcgctgcacgctggccaccctggaggtacgcaagagcaacgaggccgcgctccagctctaccgggcctttggcttccgccccgtcggcatccggccgaactactacgtcgacgagggggaggacgccgtcgtgatggtcctcgacttctaa

SEQ ID NO: 3796 - DNA, 372 bp, Myxococcus xanthus
gtgccgaccattagccagctggtccgcaagggccgcgagaagctcgtcgtcaagggcaagagccccgcgctcaaggagtcccctcagaagcgtggcgtctgcacgcgcgtgtacaccacgaccccgaagaagccgaactcggccctccgcaaggtggcccgtgttcgtctgacgaacgggatcgaggtcacgtcctacatccccggcgtgggtcacaacctccaggagcactcggtggtgatgattcgcggtggccgtgtgaaggacctcccgggcgtccgctaccacatcgtccgtggaacgctggactccgtgggtgtcgcgggtcgcaagcagagccgctccaagtacggcgcgaagcgtccgagctga

SEQ ID NO: 3797 - DNA, 471 bp, Myxococcus xanthus
atgcctcgccgtcgcgtagtcgccaagcgcaagattcttccggatccgaagttccaggaccggctcgtcaccaagttcgtcaacgacctgatgcggaagggcaagaagtccatcgcggaaggcgtttgctacggtgccttcgccctcattgaggagcgcgcgaaggaagaccccctcaagaccttcaagaaggccctcgacaacgtcaagccggtgctcgaggtcaagagccgccgcgtcggtggcgccacctaccaggtgcctgtcgaggtccgtcaggaccgccgcgtggcgctcggcatgcgttggatcatcacctactccaaggcgcgtggtgagaagaccatgcaggagaagctggccggtgagatcatggacgccgccaacaaccgcggcaacgcggtgaagaagcgtgaagacacgcacaagatggcggaggccaacaaggccttcgctcactaccgctggtag

SEQ ID NO: 3798 - DNA, 2737 bp, Myxococcus xanthus
atggcccgtgagtaccccctcgatcgctaccgcaacatcggcatcatggcgcacatcgatgccggcaagacgacgaccacggagcgcattctcttctacaccggcgccatccaccggatgggcgaggtgcacgaaggcaacaccaccaccgactggatggtccaggagcgtgagcgcggcattacgatcacgtccgccgccatctccgccttctgggcccggcacgaccagcgctaccgcgtcaacatcatcgacacgccgggacacgtggacttcaccatcgaggtggagcgcagcctgcgcgtgctggacggcgccatcacggtgttcgacgcggtgaacggcgtggagccgcagtcggagacggtgtggcgccaggcggacaagtacaaggtccctcgcatctgcttcatcaacaagatggaccgggtgggcgccgacttcgagatgtccgtggggaccatccgcgagaagctgggcgcgcgtgcggtccgcatgcagctgccgctgggcgcggaggacaagcaccgcggcgtcatcgacctgctgaagatgaaggccctggtattccaggactcggagcagggcagccactacgaagagtcggacatccccgaggagttcaaggaggcggcggatgctgcccgcgccgagctgctggaggccgcggccgagcaggatgacgcgctgacggagaagttcctcgagggcgtggagctgaccgaggacgaagtgcgtggcgccatccgcaagggctgcctgggcctgaagctgttcccggtgttctgcggttcggccttccgccacaagggcgtgcagccgctgctggacgcggtggtggactacctgcccagcccgctggaggtgccgcccatccacggcaagacgcccaacggcgaggatgccgtgcgcgagacgcgggacgacgcgcccttcagcgcgctggcgttcaagatcatgaacgaccccgcgttccagtcccagacgctgacgtttctccgcgtgtactccggcaagctggaggcgggcactgcggtgtggaactcggtgaagggcaagcgcgagcgcatcagccggctcgtgcagatgcgcgcggacaagaaggacgaaatcaccgagtgctatgccggtgatatctgcgccgtggtgggcctgaagctggccggcacgggcgacacgctctgcgacgacaagcagcccatcatcctggagcggatggatttccccgagccggtcatcgacatcgccatcgagccgaagtcgacggcggaccaggacaagatcctccagtcgctgcagcgcctggccatggaggacccgtccttccgcgtaaggacgaacgaagagacagggcagacgctcatcgcaggcatgggcgaactccacctggaaatcatcgtcgaccgcctcctgcgcgagttcaaggtcgacgcgaacatcggcaagccccaggtggcctaccgcgagaccgtcaccacgcaggtggagatggaagggaagtacatccgccagacgggtggccgaggccagtacggccatatctggctgcgcgtggcccccaatgagccggggaagggattctccttcgagaacaaggtcaccggcggcgtggtctccaaggagttcgtcgacgcggtgaaggccgggtgcgccgaggccatgcagaacggcccggtggccggctaccccatggtggacgtgaaggtggaggccttcgacggctccatgcacgacgtggactccagcgagattgcgttcaagatcgccggctcgctggccttcaaggacgccgtgcgcatggccacgcccgtgctcctcgagcccatcatgaactgcgaaatcgtcacgcctgatgacttcatgggcgacgtcatcggcgacctgaacgggcggcgtgggaaggtgcaggggatgaccccccggcctggtcgtgtgcaggccatccaggcgcaggtgcccctggcggccatgttcggctactcgaccgacctgcgcagccgcagccagggaagggcgacctacaccatgcagttcagtcactacgcgcccgcgcccaagacggcgctcaaccgctgagtggcttcggcccggccgtggaccggtcgggcgatttcagttgacgttgtggcaggtttggagcaggacgcagcaccttcgcagttgttttccgcgagtcgagacgtgccgggctttggaccggcaaccccgtgaggagaggccatggccaaggaaaagttcgagcgtaacaagccccacgtgaacatcggcacgatcggacacgtggaccacggcaagacgtcgctgacggccgccatcaccaaggtgctggcgaagacgggcggcgccacgttcctggcgtacgacctgattgacaaggcgccggaggagcgtgagcgcggtatcacgatttccacctcgcacgtggagtaccagacgtcgaaccggcactacgcccacgtcgactgtccgggccacgccgactacgtgaagaacatgatcacgggcgcggcgcagatggacggcgccatcctggtggtgtcggcggcggacggcccgatgccgcagacgcgtgagcacatcctgctggcgcgccaggtcggcgttccgtacatcgtggtcttcctgaacaaggtggacatgctggacgaccccgagctgcgcgagctcgtggagaatgaagtccgcgacctgctgaagaagtacgagttcccctgcgatgacatccccatcatcccgg

SEQ ID NO: 3799 - DNA, 273 bp, Myxococcus xanthus
atgctcgccgacgtcatccaggccgcgaaggacaagctgaacaagggcaagaatcccgcggtcgactcgctgtcggacatcgtctactccgagctgaaggcgggccgtgacatccacctgatgggctacagccgcggcggcctcatcacctcgcgcgcgctgaaggatgtcggcagcgggctgcgcatcgaagatggcatgtccaaggcgcaggtggaccatctgctcagccgcgtcaacgtggagaccttcggcgcggcggcgacaacctac

SEQ ID NO: 3800 - DNA, 387 bp, Myxococcus xanthus
atgagcgccctgctcgcctacgcgcgacggcagcctggcgtctggggtcccggcgcacgcgccagcgacgaggaggcccaggagcccggccccacgccttccctggtgcgactgatgcttccctgggtggtgggggccacggtgtctctgggcctgctggtggccgtggactcgcgggggttggccctcaacttctacgacgcgcagcacccgctgccgacgctggagtccccccaggcccccgcgctgcacgcggagcgtaaggcgttgagcgcgctccgcgcctcggcgcgccgaggggagctgcccatggaggcctactacgaggagcgggagcggcagattcgcgcgcaccgcatccaaaccgggccagggctgaagccctga

SEQ ID NO: 3801 - DNA, 2490 bp, Myxococcus xanthus
atgggccgggcgctgggaacgcgctacctggagagcgtgcacttcccgccggaagcagaaacagagctccggaacctgcacgccaagggcttcgtggtgcacgtcatgcgcaccaccgcctgggtgaacttcctctacctgacgtgggccatggtgcgccgggcgctgccgcccgtgcgcgccgtggtgaacctgcggccatggttcacccgaccctggcgacaggcgaaacagagcggtgacttcacgcagcgcttcgagcacgcccggcagacggggggcagcggtctggtcttcctgcgccgcaccgccctgctccgtccgtctgggaaagagacgcgcgaggaccccttccccgccctggtggccatggcccgccagtccgacaagcccgtgtacctggtgccggagttgttcgtctgggagaagcgccccgcgcgcctgaagcccaactgggtggacgtggtgttcggcagccccgaggcaccgggattcctgcactcgatgctggccttcttccgcaactacaagcgcgcgcagttccgcgtgggcgagcccatcgacctgcagcgcttcgtcgcggagaaccctcgcgactcggacgaactgctcgctcgcaaggcgcgtagcagtctccacgtccacctcgcgcgcgaaacgcgggccgtgttcggtccgccggtgaagcccgcctcgcgcgtcatcgaggagacgctgcgcgacaggtccctgcgcaaggtggtggaggagtgcgcggcggaatccgggcgcaagccggagagcgtcctgcgcgaggctcgccgcaacctggaggccattgccgccaaacccagccccaccgcgctggcgttcacctcccccgtgctggagtgggtgttcaaccgcatctacgacggcatgcacgtggacgaggccggcctccaccgcgcgctcaaggccgcgagccacgcgcccatcgtcctgtgccccagccacaagagccacgtcgactacctggtaatgagctgggtgctatggaaccggggctacgcggtgcccctggtggccgcgggcgccaacctctccttctggcccctgggcacgttcttccgccgctgtggcgcgttcttcctccggcgctccttcaagggcgacaaggtctacgccgcgtccttcaaggcctacgtgcgcaagctggtgcacgacggcatccaccaggagttcttcccggaaggcggccgttcgcgcacgggcaagctgttgttgcccaagctgggcatgttcacctggcaggtggagtccgtgctggagggcgcgcgcgatgacctcatcttcgtgccggtggccatcgactacgagaaggtcgtcgagtccagcagctactcgaaggagctggctggcggagagaagaagcccgaggacctcaaggcgctcttgagcacgcccaaggtgctggcggcgcggtacggccgcatccacctgggcttcgatgagcccatctccctgcgcgcgttcatgcaggcacgtggcatcaacccggacgaaccggtgtcggacgaacagaagaaggggctcgtccgcgcgctgggcaaccgggtgatgtacggcatcagcaaggtgtccacggtgacgccgcacgcgctggtcagcaccgccctgctctcgcaccggcgccgcggcttgacgcagcgggagatggcagaccgcatcaacatcctgcgccgcatcgccgtggaggagggctcgcctcagtcggtggagatgcgcaacgcccccagcaacccggagacgatgggccccatccaggacgccatgcgcacgttcatctccgacgagatggtgcgcacccaggaagcgcgtggcgaggtcatctaccaggtcgaggaggcacgccgcccggagctgtccttctacaagaacacgctgatgaacctggtggcctcccggagcctcgtggccaacgccatgcttgccagcggcagcccggcgccctacgacaccgtgaaggagcgcgcgctgttcctgtcccgcctcttcaaggtggaattcatctaccgggtgggcaccacgttcgactctatcttcgcggagacggtggagcggctggagcgcatgggcctggtgcttgaggagaacgagacgctccgcgtggcccccgaggcccacgcgcgtccggacctggagttcctggccgacatgctgcgcgactacctggaggcctacctgctggcggccctgacgctccaggatgtggccaccggcgccgcggaggaccggaagtccttcgtgaagatggccctggaaacgggccgcgcggagtaccacgccggccgcatcaccgcctccgagtccctggccaaggtgacgctggagaacgcggtggcgttcctcctggaccagaagctgctcatcgaggccgacaagaagctgacgctgggccccgccgccaccgagcagcaggcccgcacacagctcgtggacgacatccgtgggtacctgaagcgcggctga

SEQ ID NO: 3802 - DNA, 3123 bp, Myxococcus xanthus
atgttcaccgacttcttcatccgccgtcccgtcttcgccagcgtggtgtccatcatcatcaccctggtgggggccatctccatccccatcctgcccatcgagcaataccctgacctgtcgctgcccgtggtgcaggtgacggcgacgtacatcggcgcctccgcggagaccgtggagagcgccgtcaccaccgtgctggagcggcagctcaacggcgtggagggcatgcgttacatctcctccaccagcagcaacacgggcgtgagcaccatcaccgtcaccttcgacccgggacgggacttggacatcgccgcggtggacgtccagaaccgcgtggccaccgcgtccgcgcagctcccggccgccgtcaacgcgctgggcgtcaccatcaccaaggcccagacgcagctgctcatggccttcggcctgttcgacgaggagaaccgttacgagacgggcttcctcagcaactacgcggatgtcttcatccgggacgcgctgctgcgcgtgacgggcgtgggcgacgtgcggatattcggcgagcggcgcttcgccatgcggctgtggctggacccctctgagctggcacggcgtgggctcgccgccacggacgtggtgaacgccctgcgcgcgcagaacgttcaaatcggcgcgggacaggtaggacagccgccagcgccgccgggccagacgtaccagttcacggtgcgcgtgctggggcagctcacgtccgcggaggagttcggcaacatcgtggtgcagcaggggccggacggctcgctggtgcggctgaaggacgtgggccgcgcggagctgggcgcggagaactacggacagctcttgcgcttcaacggccgcgaggccgtgggcctgggcatcttccaactccccggctccaacgcgctggacgtgcgcgacggcatcgtcgccgagctgaagcggctgaagggcaacttcccgccgggcatgcgctaccagcgcgccttcgacaccacggcggcggtgcaggcatccatcgaggaggtgctggtgacgctgggtgaggccatcttcctggtggtgctggtcatcttcatcttcctgcacggctggcgcagcgtgctggtggtggccaccacgctacccgtgtcgctggtgggtaccttcctcttcgtcaacgcgttcggcttctccatcaacacgctgacgctcttcggcctcacgctggccacgggcctggtggtggatgacgccatcatcgtcatcgagaacgtcgagcgcaccatggagcaggacgacgtgggccctcgcgaggccacccaccggggaatgaagcaggtcgccggcgcgctggtggccattgccctggtgctgtccgcggtgttcgtgccggtgtccttcttccccggcaccaccggcatcatctaccggcagttcgccctcaccctggccttctccatcagcctgtccgcgctggtggcgctcaccctgtcccccgcgctgtgcgccatcctgctgcggccccacgaaggccagaagtggaaggtcttccgcatgttcgaccgggggctcgacgcgttccgagacgcctacggccggatgttggcgaagctcatcggaccgctgcgctggccggtggtcatcgccttcgtcgtgtgtctggccggcaccatcctggtgtaccgcctcacgcccacgggcttcatcccgggcgaggaccagggctacctcatcatcgccgtgcagggaccggagggcacgtcgctggactacacgcgcaatgtgctgctccaggcggaggacgtgctgcgccagcagccggaggtcgcggacatcttcaccgtgggcggcttctcgctgctgggcacgggcgtcaactacggcaccctcttcgtcaacctgcacccgtgggacgagcgcaagcggccggaccagagcgtggcgggactggtggagcgcctgcgacacccgctgatggccattggcggcgcgcgcgtgttgcccttcgagccccccgccatccgcggcgtgggcagcgtgggcggcttcgagttcgtgctggaggaccagcaaggcggtcgaacgctcgctcagctcgcgcagacgacggacatgctggtgggcgcggccagccaggacccgggcctccgcggcgtcttctcttcctacaccgccaacacgccactcctggacgtgcaggtggaccgggagaaggccctggcaatgggcgtcccgctggatggcgtcttctccacgctgcaagtctacctgggcagccagtacgtgaatgacttcaccttcgccagccgcgtgtaccgcgtgtacgtgcaggccgccgtcccgttccgcaacgagccgcgcgacatcgacgcgctctacgtccgctccgcgaagggagagatggtgccgctggagtcactggtgcaggtgcggcccatcaccagcgcgcagaacatccagcactacaacctgtaccgctcggcgaccatcaacgggcaggccgcgccgggctccagctccgggcaggccctggacacgatggaggcggtggcgcgcaagacgttgcccgtgggctacaccttcgaatggacgggtttgtcccaggagcagaaggaggcgggccgcagcgtgctgctcatcttcgggctgggcgtcgtcttcgtcttcctggtgctgtccgcgcagtacgagagcttcgccctgcccctggtcatcctcctgggcgtccccgtggccatgctgggcgcgctggggctgcagaatttgcgcggcctccagaacgacgtgttctgccaggtcgggctcgtcatgctggtgggtctggccagcaagaacgccatcctcatcgtcgagttcgccgagcagctccgccacgaaggccggagcgtcgaggacgccgccatccacgccgcccagacgcgcctgcggcccatcctgatgacgtccttcgcgttcctcatgggcgtggtgccgctgatgctggcctcgggggcgggggcctccgcgcgcaagtccctgggcaccaccgtgttcggcggcatgctgctgtccaccttcgtgaacctcatcttcatccccgtgctgtacgtggtgctggaggccgccaggctccgcgtccgcccaccgaagccccacgcaccctga

SEQ ID NO: 3803 - DNA, 999 bp, Myxococcus xanthus
atgtccgcacgcatcagagagcgtcaggagagctggggcaccatcatctacgacaacctccgcgatgagttctctgcgaaggtgttcgagggctgcgtgcctgtgccgcggagtcccatcggttgtggatggctcgtcaccgcgccgtgcaacctcgtgtgtatccactgctacgggaacgtcgaggacctgccgtcgaagcggctctccacgccccagcagctcaaggtggccgacgaagtcatccgcgcgggaatcatgcgacagattctctccggcggtgagccgttgatgcgccgagacacgctgaacgtcatcgacaagctcacggaccatggtgtcgccaccatcctcggtaccaacggcaccttcctgacgcagcagatgatgaagacggtgtctcgctgcacgcgcgtggaaatcagcctcgattccatggacgagcgggtcaacaacgagattcgccccagccgcaacgccaagggtaacacctaccaggagacgctccgggccatgggcctgtgcgtggaccatggcgtggcgccgcgaatcctgacctgtctcaaccgccacaacagccagcatgtcgaggagctggcccagttcatctacgagcggggcatccgcgactgggccatctcctggacgctctccgccggccgcgcgtatcacatctacggcgagttgatgccggaggagacgtcgcacgtcaccgcggccgtggagcggctgcgggtgcgctacccggacatgcagattcgcctgtcggaccgcaccgtcaactacagccgctactacttcctcatctggccagacggcatcatgggcaccgaggagatcgtcaccggcaagaagctcttcttcgcctcgctggtgacgggctccgtccaggacggttggaagcaagagaactacgacctggacgcacacttccggaagtgggtgggggaccgcatcgaggtcattcccgcggaaggccggaagcccctggtcgcatag

SEQ ID NO: 3804 - DNA, 1722 bp, Myxococcus xanthus
atgagcacatccgtctactcccgttaccgcgccgccttcgcccaggctcttgccaatgccctgggcgtgccggccgccgacatcgaagcccaggtcaagcccgccgagccggcgcacggcgacctcagcttcgccaccttccctctcgccaaggcccagaagaaggccccacccgccatcgccgccgggctggcgcagtcgctcagcgtccccgggctggaaatcaaggccgtggggccgtacgtcaacgcgcgcttccccaccctgcccttcacggcggaggtcatcgacgccgcgcgaagcgcgggcatccgctacggcggtgacgaggacgcgggccgcggcaagacggtggccatcgactactcgtcgccgaacatcgccaagcccattggcttccaccacattcgcacgacgttcctcggccactgcatcgccaacatctaccgggcgctgggctggcgggtggaaggcatcaactacctgggcgactggggcaaacagttcggcctggtggccgtgggcttccaggagtacggcgacccggcccgcatcgacgacatgggccacctggtggaggtgtacgtcaaggccaacaagcgcgccgaggccgagcccgagttcgacgagaaggcccgcgccttcttccgccgcatggaggccggtgacgccgaggccctcaagctctggaaccagttccgggacaccagcatcaagggcttcaagaagatctacgcgcggatgggcatcgagttcgagcacatcgagggagagagccgctaccagggaaagatggacgcggtcatcgaccagattgcgaagaagcccggcgtgaaggagtcgcagggcgcgctcatcgtcgacctgacctacgcggagaacgagccacccatcctgctgaagaaaaacgacggcagcacgctgtacgccacgcgtgacctggccgccgcgcaagacaggtacgagcgcttccagttcgacaagtcgctctacgtcgtcgcgcaggaccaggcgttgcacttccggcaggtgttccgcgcgctgaaggagatggacctgccctgggcggaccgcaccgtccacgtcgcgttcggccgcatccacggcatgagcacgcgcaagggccaggtggttcagctcaacgacgtgctggacgaggcgcgcgagcgcgtttccgtcaaggtgcgggaaaacgtggaggccggccgcatccagacggatgacgcggacgccctctccgagcagatcgccctgggcgccattgccttcggcgacctcaagcacaagcgtgccagcgactacaccttcgactgggacgaggtgctcagcttcgagggccacaccggcccctatctccagtacgcccacgcgcgcgccgtcaacgtgctgcgcaaggacggtggcgcgccggccagctacgacgcggccctgctgacgctccccgaggagcaggccctgctgcgcgaaatcatgcgcctgcccgaggtggttcgcgacgcggcggagcagtatgagcccagcctcgtggcgagactgctgctcgacgtggcctcggcgctcagccgctactacacgctgggcaatcaggagcgcgacaagcgcatcaacgtcgaaggcaatgacgcgctgcgttccgcgcgactcgccctcatcgacgccgcccgggttactctggccgcgggactgacgctgctgggcattcccacgcccgacaacatgtag

SEQ ID NO: 3805 - DNA, 1557 bp, Myxococcus xanthus
atgtcgcggcacctgacggacaacgcggggcccaccgaagcgctccgcgcccacctgcagaccatccacacactcctcaagccgaaggtctgctacgtggcgcgctacttcccatcccgggagcagctccacgtcgagcacgtgcgaggccgttacgacgaccgcgtcaccgccgccgtccccggtgagggcgtggtgggccgggccttctcccagaaggcgctgctgcgtgatggggacacagtcgccgtgccactcgagggcccgcaaggcgtcggtggcgtcctggtggtgctgggctcccggcgcgagccgtccgacacgctgttgcagtcactggcggcgcagctcaccgccgcctacgaggtggcgcgcctgcgtgacgacagcgcccgccgcaacaaggacctgcagacggccatcgctggcctcaagagcctggagcagaaccgcgaggagctgctgggcaacgtctcgcacgacctgaagaacccgctcaccaccatcaagtcctacctggcgatgatgggccgcgagaagctggggcccctcacggatgcccagcgccgcgcggtgcagatctgcgaccggaactcggaccggatgctgcgcatggtgaacgatttgctgctcatgtcccggctccagtccgggaagatgcagctcaatcagcgtcccttcggcctcaaggccgtggcggaggaagtggtgcgctcactgggggcgctcgcggagcactgcaaggtacgcgtggtgattcccccctgccccgaggtgttcgtccgcggcgaccgcgagcgcatcgccgaggccatccacaacctcgtggagaacggcatccaccacagcgaggcggacgacaccgtcgaggtgcgcgtctccgccgaggacggcctggcgatgctgaccgtgaaggacagcggcccgggcatgtccagcgaggccctggagcacgtcttcgacgccttctaccgcgccaccccgggcatgccccggccgcctggtgcggggctcgggttgccgctggtagggaagattgtcgccctccatggcggacgaatggagagcgccagcgtcctgggcgagggcagcacgttccagatggtgctccccatgttcgccggcgccgtcagcgcgccggagatggcccaggcggcgcccaagagcggcggcatcctgctggtggaggacgacgccgactgccgggaggtgctgcagcaggtgctggagcaggagggctaccgggtgatggccacctcgggcgcatccgaggcacggtccattctctctcacatccggccagccatggtcctgctcgacctgcggctgagcgaggaggatgggcaatcggtgctccgctacatccgtggcaacgagtcgctggcggacatcgtcgtgtacatcatctccggagccaccgaggtggcgtcactcacctcgggccaggggctggagcgcatcgacggcttcttcgaaaagcccctcaacctgcccaagctgctggacaccgtctctgcggtggtccggcccagccggcgagcccccgccgtgccgtga

SEQ ID NO: 3806 - DNA, 732 bp, Myxococcus xanthus
atgggcctcttagacatcttcacgggcggctcgggccccgagaaagccctcaagctcaagcccaaggtcacccagaagtacggcgaccccgcgacccggcagaaggccatccagcagttgggggagatgaaggtccccgaggccgtgtccgtgctgctcagccgcttcaccctcaccgtggacccgctcactacggacgcggatgagaaggagcacacgttcgagctggtgaagagcttcggcaaggacgtcgccgtgccgcccatcctggagttcctgcgcaccagcgagcaggccgcctcgtgggccctgcggctgctcggtgagctgacctccgaggaggagaccatcaccgcctgcgtgagcgcgctccagcacctgtccgcccactacacgcgcaatccggagaagaaggtggtgttgctgcaccacgtggccggcagccaggacccccgcatcccccccacggtggtgcccttcctggaggacatgtcggacgacgtgaagatcgccgcgctcaaggcgctgggcgtcttcaagtacgagccggcgcgcgagcccatgctgaagctgctcaccgccgacgagacggctcgccgggtgcagacgtccgtactcagcgcgctggcggaaggtggcttctccgtggagggctaccgggagaaggtggagccgctgctggtggagccctacgccctgggcaacgaccagcgcatccagcgccgggcctga

SEQ ID NO: 3807 - DNA, 1176 bp, Myxococcus xanthus
atggcggacgactactatcagaccctcggcgtcgatcggtcggcttcagcggaggacgtcaagaaggcgtaccgcaagctggcgcgcaagtaccacccggacgtcaacccgggcaacaaggccgccgaggagaagttcaagcaggtgagcgcggcgttcgaggtgctgtcagacacccggaagcgcaagctctacgacgagttcggcccggacgccgagaagattggcttcgacgaaaagaaggcggaggcctatcgggcctacaaagcctcggccgggagcgccggtgccgggggcattccctatggcgccgagggcttcgacctgggtgacctcttcggcgacctgttcggaggccgtggcggtggcgcggcgggcggcgccccggggggcttcgacattggcgagatgtttgggcgtcggggtcgcaacgccgggcctgagcgtggagaggacctgacggtccgcgtccagctcaccctggctgaagccgtctccggaaccgagcgccccctggccttcaaccgtccgggccggtgctccacgtgcagtggccgaggcacatcaggaccggtgtccacctgcaacgtttgcaacggtacgggccgagcccggcgttccgggagcctgttcggtggcgcgggcgcgtgccccaactgccacggcacgggcaaggccgcgccaccctgcccccagtgcgggggcgcgggtgtgaaggaggagctggcccggctgacggtgaagattcccgcgggcgtgcacaccggctcaaaggtgcggctctccggccagggcgcggcggggacacgcggcggccccccaggagacctctatatcgagaccgaggtggccgaacatcccctcgtgcgtcgcgaaggcgacgacctgcacctcgatctgcccgtgacggtctccgaggccctgctgggcgccgacgtgcgcgtccccacgttccagggggaagtcaccgtgaaggtgctcccccactcccaatccggccgccgcatgcggctgaaggggcgcggcgttccctcgctcaagggcggagcacagggcgacctgtacctccacctccaggtgaaggtccccgaggaaacaaccgccgaggctcgggccgccgccgaggcgctcgcccgggcctaccagggcgacgtccgccgcgagctgacgctctag

SEQ ID NO: 3808 - DNA, 198 bp, Myxococcus xanthus
tacggccgcacgctggagtcggagatggcgccctacctggcgcatggcctgctccacctgctggggcacgaccacgagcgcccccgggatgccaagcgcatggcggccctggaggaacagctcctgggcgagcgaggcatggtggcggactcgctccaggtggatgccaaggcccgccgcgctcgcagcctcatgtag

SEQ ID NO: 3809 - DNA, 1323 bp, Myxococcus xanthus
atgctccgcccatcactcatcgcctcctgcctgctcggcctgctgctcctggcggcgcccgcgcgcgcggcctccatgccgccgtggggcacgggagaaagccagggcgaggacctggccatcctcctggtgacgttcagtcccggggatgacgtgccgtcctggtggggccacggttcgctggtggtggaggaccggcggcggcagatgtcgcgcctctacaactacggcatgttctccttcgacgaggccatgctcgcgcgcttcgccatgggccggctggagttctgggtgggccagtcgtcggtggggggcaccttccgcttctaccaggccgaggaccgcgacgtccgcgtgcaggagctcaacctcacgcccgagcagcgcgtcgtcgtggcgaagcggctggcggagaacgtgctcccggagaaccgcgagtacctgtaccaccactacaacgacaactgcgtcacgcggctgcgggacatgattgatgtggccacgggcggccagctccgcgaggcggaccgggcaccggggcggatgacgctgcgcgagcacacccgtcgctacacctcggtgaacgcgcccatgagcgtgctgctcgacttcatgatgaacgacgagatcgaccgtcccatcacgaagtgggaggaggccttccttccggatgagctggagactcaggtcgcggcgctccaggtgaagggcgcggacgggcagacggcgtcgctcgcggcgaagagctggaactactacgaatcctcccgacgtcagcgtccgccggcggcgcctcccccgtggggcccgtggatcctcgcgttgggcctggccctgggcggcctggccgtcgggctggcggtgtgggagcgccagcggggcagccgcgtggcccgcctgctgctcgggctggagaacgccgtggtggggctggcgctcgggttgccgggcaccgcgctgttcatcatggggttggtgacggaccacacggtgacgcaccgcaatgagaatctcttcctggccaacccgctgacgctgctggcgctgcccttcggcgtggcgctgacgtggggcagccagaaggcccgcatgcgcctgttcaaggtgtggacgctgctggccgccctgggggtgctgggcgtggtgctcaaggtgttgccgcccttcgaccaggacaactggcggctcatcgcgctcatcctgcccatctccctgggcatggcgggcgcattcggtctggaccgagtactggcgcgcctccccagggcggaccgcgcgtcagccggacggcgggatgccgtcgcatcgctgaagactccttag

SEQ ID NO: 3810 - DNA, 1062 bp, Myxococcus xanthus
ggcatctttcacctcgaccgcaagcggtcccgcatcgcgctgattgaacgcgactccacgctgcccaccttttgggacgacaacaccaaggcgcaggcgctcttgaaggagaagtccacgctggaggccagcgtcggcgcctacgacaaggtgatgcgcggcctggatgacgcgcaggtgctcttcgagctggccgtcgaggccaacgacgaggccaccacccaggaggcggaaggctccctcacggggctggagggtgacgtcgccaagctggagctggcgcgcatgctgtccggcgagcaggaccgcagcagctgcttcatggacatcaacgccggcgccggtggcacggactccatggactgggcggccatgctcctgcgcatgtacacccgctactgcgagaacaagggctggaaggtcgaaatcaacgacgaggtgccgggtgaagaggcgggcttcaagaacgtctccctgcgcatcgaaggtgacttcgcctacggctacctgaaggcggaagtcggcgtgcaccggctggtgcggatttcgcccttcgacgccaacgcgcgccggcagacggccttcgcgtccgtggacgtctatccagaggtggatgacaccatccagatcgacatcccggagaaggacatcgatttgaagttcatccccgccgccggcgcgggcggccagaaggtgaacaagacgtcgtccaccgcgcagctgcgccacctgcccaccggcatcatcatcacctgccagacggagcgctcgcagtcggccaacaaggacatggccttcaagattctgcggggccgcctgtacgaactggagatgaagaagcgcgaggccgcgcgcgacgccgccgaggcgcagaagaaggacatctccttcggctcgcagatccgctcctacgtcctggcgccgtaccgcatggtcaaggacctgcgcaccggcatcgagacgggcaacgtggacgccgtgctggatggggacctggaggagttcgtcacctcccaactgctgggcgtgaagaaccccaaccgcagcgcgggcgcggactag

SEQ ID NO: 3811 - DNA, 525 bp, Myxococcus xanthus
ggggagccggacgccttcgagctgctggtgcgcacccaccaggaccggctctacgatttctgcgtccgcatggtgggagaccgtgaggaagctcacgacctggtgcaggaaatcttcgtcagcgtgcaccagaacgtccgccgcttccgcgaggactcgaagctgtccacctggctgttccgcatcacccgcaaccactgcatcaaccggctcaagtacctgaagcgccggggccggggccgctccgaagtgttcgacgaggccgcggccctgctctccgaaggtgggggcaccgcgcccggcccggatgcggccctggaatccgcgcgtgagcgcgcccgggtgcagtgggccatctcccaactggagccggacgcacgcatgctggtggcgctgcgcgacatcgaaggcctcagctacgacgaaatcatcgacatcaccgagctaccggagggcacggtgaagagccggctccaccgggcccgggaaaagctggcggacctcctggggcggcttgagccatga

SEQ ID NO: 3812 - DNA, 342 bp, Myxococcus xanthus
atgaaccatcgcgaggcgagggccctgttcctcgcgctcgccgacgacgagcttcccgcccccaaggcgcaggaggttcgcacccacctggacggctgcgacgactgccgccagggctggcagcgctattccagcacggtgcagcggctccagcgcgtggagcgtgagaaggccccacccgcgctcgcctccctggtgatgaaccgtgtgcgccgcaagcgccgcttcggtctgcggggcctgcacaccctgcatatgaactaccggctcccggtggaggtcctcatcccgctgttgctggcggccgccgtggccgccttcctggtgatggtcgatccctga

SEQ ID NO: 3813 - DNA, 1554 bp, Myxococcus xanthus
atggccgagaccgaaaacaagagcgagaagagtgcgggcgagggcgacctcgggacgaaggaacaggaaatctacgaccagcggctggagaaggccgcgaagtggcgcgaggccggcttcaatccgtacggcaacggctaccgtccccagcaccaggccgccgaaatccacgagaagcacgccgctcagtccgccgaggaaatcgagcaggccgcgcctccgccctatgacgtcgccggccgcgtcgtggccatgcgctccttcggcaaggccgccttcatcaagctgcgcgaccgctcgggcgaaatccaggtccacatgaagaaggacgccttgggggactcctatgagaccttcaagctctgtgacttgggcgacttcctggccgccaccggtccggtgttccgttcgaagacgggcgagctcacgctctccgccacgaagttcaccccgctcaccaagtccctgcgccccctgccggagaagtggcacggcctgacggacgtggaggtccgctaccgtcagcggtacctggacctcgtgtccaacccggacgtgaagcagaccttcctccggcgcaacaagctcatccgcttcatccggaacttcctcgacacgcgtgacttcgtcgaggtcgaaacgccgatgatgcacccgctcgtgtccggcgcggcggcgcggcccttcaccacgcaccacaacgcgctcgacattgacctgtacatgcgcatcgccccggagctgtatctcaagcgcctggtggtgggcggcctggagcgcgtctacgaggtcaaccgcaacttccgcaatgaaggcatcagcacccggcacaacccggaattcacgatgctggagttctatcaggcgtacgccacgtacgaggacctgatggacctctccgaggagatgatttcggaggccgccaaggccgtcaccggcgacacgaaggtgaagtacggcgaccacgtgctcgacttcggcaagggctggaagcgcatctccatgacggaggccatccgcgaggtggtgagcggcctgtccgacaaggacatggcggacgcggaccggctgcgccacgaactgctcaagacgagccactcggaggccgagcggcgggccatcgacacgatgaaccacggtgagctggtgggcgcgctcttcgagcaccacgtcgagcacacgctcatccatcccaccttcatcacccatttccccaccgccgtctcgccgctggcccggcgcaatgaccagaacccggacgtgacggaccgcttcgagctgtacgtggcgggccgcgaaatcgcgaacgccttctccgagctgaacgacccgctggaccagaagggccgcttccaggctcagctggacgcgaagcagcggggccagcaggagaccatggactacgacgaggactacatccgggccctcgagcacggcatgccgcccaccgccggtgaaggcatcgggattgatcggctcgccatgctgttcacggattcgcagagcatccgggacgtcatcctgtttcccctcctcaagccactggcgaagtag

SEQ ID NO: 3814 - DNA, 519 bp, Myxococcus xanthus
atggagctgattgacgtcatcgacacccagggacaggtggtggggagcgcgccccgcgaccagatctacggccagaagctgccccatcgcatcgtgcatgtgatggtggagcgcgacggcaaggtcttcctgcagcggcgctcccggcacatgaccttcatgcccggccacctgtgcacgtccgcgggaggccacgtgagcgcgggcgaggcgcccctggaggccgcccagcgggagctccaggaggaactgggcctggagggctcgctggtgcccgtggcggagttcgtcttcgacgatgggcaccaccggcgcatctttctctaccgcgcccgaatggaaggcccgctgcgcttctccgagcgggaggtggacgggggcctgttcctggcgccggaggagttggggcgcctgctggacgagccctgtcatccccagttgtggccctgtctggagcgcctcttccccgggccgagcgccgacgcgcggacgcgatggaaacagtcctctactcgctga

SEQ ID NO: 3815 - DNA, 1806 bp, Myxococcus xanthus
atggtggccttcatctccggcttcatcggcgcgtcgcgcgcgcagcggctgtcgctgcccgaggccaccatcggcgtgctgtacctgggcctgcccatccccatcatcctcacgttgatggagcggctgcccgggctgcagctcgcgctgggctaccggctgcgcgaggtgacgtacgtcgcggggctgattggccgcccggagctggggtactggctcgtcttcaccttcctggtgctggcgctggtgctgggcatcaacaccggcttcatcgccgccggcagcggccgggtggacctgaagctggggttcgagctctttgtcgcgcgccggcacgtggcggtgttccggccgtcgctgctgctggggacgctggcggtgctgatgctcggcatcatccccccgctgctcatctacttcatcattcgctcggcggaagcggccgtggagcgcacccgcattcgcgagctgggcctgaaggacccgttggcggccgcctccgacctcaaccgcctcaagcttcgggagcagtcgcccaccatgatgatgaccgccctgtccgtgggcggcgtgggcgtgggggtgatggcgctcatcatcgtcctgtcggtgatgagcggcttcgaggccgacctgcagcagaaaatcctgggcaccaacgcgcacgccgtggtgtccaagtacgcgggcgacctgcccgagtacgccaaggtcatggagtccgtccgcaaggtgcccggtgtcgtgggacagacgcccttcatcatcaaccaggtgatgattgcgtccgagggcaacgtggacggcgtcatcatcaagggcatcgacccgggcacggtgggcgaggtgacggacctgcccaagaacatcctcggtggcggctcgctcgacatcctctatacgccggagaagatcgtccaccgcggcctgccggacgaggagcccgcggaggagagtggggtcgaggaggacgacatcatccgccgctccgggacgcccaagaaggcgccggtgctgccgggcatcgtcattggccgtgagctggcggcgtcgctgcgcgtggtggtgggagaccgggtgaacgtcgtctccccgctgggcaccgagctggggccgtccggcccgattccgaagagccgcgccttccgcgtggcggccatcttctactcgggcatgtacgagtacgactccaagttcgtctacatcctcctcaacgaggcccaggacttcttcgacgtgaagggggccacgggcatcgaactgaaggtggcggacatcgacgatgcgcggcgcatcgcctcgcaggtggtgaaggtgctgggcggctatccctaccgggcacgcgactggggagagatgaacaagaacctcttctccgcgctgcgcctggagaagctggtgatgggcatcatcctctccatcatcatcatcgtggccgcgggcctcatcgtcgctaccgtcatcatgctggtgctggagaagcggaaggagatttccgtcctcaaggcactgggggtccccgatggcggcatcgtgaagatattcctcgcggagggcctgcagattggcgtcgcgggcggcttcctcggtctgatttccggcctgtcctggtgcgtcttcatcgagaaggtcggcatcaagctggacccggacgtctattacatcccggcggtgccggtgcgcgtcgagccggtgcagaccgtgctggccgtcgtcatcgcggtgctcgtcacctacctcgcctccatctacccggccctcaaggccagcagtgtggagccggtggaaggcctcaaggcggagtag

SEQ ID NO: 3816 - DNA, 675 bp, Myxococcus xanthus
atggcgctcttgtccatccgcaacgtcttcaagagctacttcctgcacggcaagcgcatcgacatccttcgaggcgtctcgctggacatccagcggggagagctcgtctcgctggtgggcgcgtccggggcggggaagagcaccttcctgcacgtcctgggcacactggatgccccggccgccggcgaggtgatgttcgaggaccgctcggtgttctccatgaacgacgcggagatcgccgagttccggaaccagaccatcggcttcgtcttccagagccacttcctcttgccggagttcaccgccctggagaacgtagccatgcccgccctcatccggcgacaggaccgcaccgccgcctacgcctacgcccgtgaactgctggagcgggtgggactgggacaccgcgtggaccaccgtccaggggaattgtcgggtggtgaggcccagcgcgtggccctggcgcgcgccctggtgctcaagcccgcggtgttgctggcggacgagcccaccggcaacctcgacccggcgacgggcgagggcatccaccagctcctgcgggaggtcaaccgcgagcaaggcatcaccgccgtggtcgtcacccacaacgagacgcttgcccgctccatgccccgccgcctcaggttggcagggggcgaggtgtcggaggcgtga

SEQ ID NO: 3817 - DNA, 2404 bp, Myxococcus xanthus
atgtggtccctcgtgcccggctccgtgctggcgcaagaggatgagggcgccgccgcgccttctgccgtgcccgaggtgaccgctcccgctgctcctgccgacgtggcctccgagcccgcgctccccgatgacgccccggtgtcgccggaggatgcccgccgggtggtggaggtccgcgtcgaaggcaaccggcgcgttgaggccgaagccatccgccgcgccctccgcacccgtgtgggggacgaactgagccccacgcgcaccgcccaggacctccgggcggtgtgggcgctgggctacttccaggacgtggagctgctcgtccagcggctggcccgcggcgtcgcctacgtggtgcgcgtggaggagcgccccaccgtccggctcgtccagctcgtcggcaacgaggagctgagcaaggacgacctgaaggaggagattgacgtcaagccctccaccatcctggacatggagctggtgcgctccagcgtgcagaagatccaggcgaagtacgtggagaagggctacttcctcgccgaggtcagccaccagctcaagcccgtcgagggcggcgccaacgtggatgtggtgttcaacatcaacgagcgcgccaaggtgatggtgaagcagatcaccatcctcggggcggagaagctgtccgcctcggagctgaaggagacgatgatcacccgcgagggcgggttcctctccttcttcaccggtgagggcacctaccgcgaggaggccttccagcgcgacctggccgtcatccagatcgcctactacgacaagggcttcatcaacgtccgggtggacaagcccaccgtccagctctccgcggacaagcgcttcatcttcatcaccctccgcgtgacggagggcgagccgtacgacatcgggaagatcgacttctccggggacctgctcgacgacgtcaccaaggagcagatggcgtcgatgatgaagtccgccaccggcgggcgcttcaaccgctcgcagctgtcgcaggacatcctctccgtctcggacgtctactacgaccgcggctacgcctacgcgaacatcaaccccatcaccagcgtcaacgcggacaaccgcacggtggacctgaccttcgacgtgcagaaggggccccaggtcaccatcgagcgcatcgacgtggtgggcaacagcaagacgcgtgacaaggtcatccgccgcgagctgcgcgtctacgaaggagagctctacagcggcaccggtgtgcgccgcagccgcgagcgcgtcaccgcgctgggcttcttcgagacagtggaaatcacccagcgccccggctcggcggacgacaccatcgtcctccaggtggaggtgaaggagaaggccaccggtacgttccaggtcggcctgggcttctccaacgtggagaacttcatcttcacggcgcagatcgcccagaacaacttcctgggctggggccagagcgtctccgcgtccgcgcagatttccggtctgcgctccctggtgcagctgtccttctacgacccgtacttcctggacacgcgctacctgctgtcggcggagttcttccgcatccaggcggactacgaaggcttcatccgcaattcgaccggtggcacggtgtccatcggctaccagttcatcgacgacctgctgggcaccattggttactcgcgtgagtgggtcaacgtggaggccgggcagaacctgggcgcggtgctgctggccaaccagttcctgtccggaacgaccagcgcggcccgccctgtcgctgtcgttcgaccggcgcgacaaccgcctgttcccgtcgcgtggcttcatccactacggctcggtggagctcgccccggacttcctgggcggtacgttcctctacaaccggtacacggcctactcgcggctgtacttccccatgccgctgggcttcgtcttcaagacgaacgccaccattggctacatccagcaactggaccagaacaagccgctgcccatctccgagctctactacgtgggcggcatcaacagcgtccgcgggtacttcctgcgcagcatcagcccgtccgtgaaggttccccgctccggcagtccggacgcgaccgtcaccgatttccgggtcggcggtaacaagcagctcatcttcaacttcgagctggagttccccatcttcgagaaggccggcctgcgcggcgtcgtcttctacgacgcgggtaacgccttcgcggcgaatgagcgcttcttcgaggaccgccaggaccggctgccggccggtctcttccatgccgccggctttggattccgctggttctcgcccattggccccctgcgcttcgagtggggcatcccgctcaccaagcggccggaggacgacaacattctgttcgagttcactatcggcaacttcttctga

SEQ ID NO: 3818 - DNA, 555 bp, Myxococcus xanthus
atgtcgcttcgcaccaccatcgcggccacggccgccgctctgtcgctcgccctcccggtggccgcctcggccgccgagctgaaggtcgcctacgtggacctccagaaagtcatgctggaggtggatgacggaaaggccgccaagtcccgtctccagaagtggctcgacgaccgccagaaggaaatcgacaaggagcagaacgcgctccgcgccgagaaggagacgctcgacaagcaggccagcgccatgagcgcggagagcaaggcccagaaggaggccgagctccagcgcaaggtgatgttgctcgcccagaagtgggagaagagccgcgccgaggccgccaacaaggagcagcaggagatgaagccgatcatcgacaagatcgactccatcatcaacaccatcgccgagcgcgatgacctgggcttcgtcctcgagcgccgcgactccggcatcgtctacgcccgctcgcagcacgacatctccaacgaggtcatccgggcgtacaacagctcgaagaagacggcggcgaaggacgccccgacgaagaagtag

SEQ ID NO: 3819 - DNA, 1221 bp, Myxococcus xanthus
atgacctgggcttcgtcctcgagcgccgcgactccggcatcgtctacgcccgctcgcagcacgacatctccaacgaggtcatccgggcgtacaacagctcgaagaagacggcggcgaaggacgccccgacgaagaagtagccgtcactcccaactcgtgcagaccgctcccatgccccgccagctcggggaactcgccgcccacgtgggtggagagctcctcggtgacccctcacagctcattcacggactcaacgggcttgaagaagccggcccgggagacgtgtctttctacggaaacccgcgctatcggcgccagttcgaggccacccgtgcctcggcggtgctggtgggcgccgacgtgcccccccgcgagggcgtggcgctggtccgggtggccaacccgcatctggcgtacgcgaagctgctgcgcctgttccatgcgccagagcgtcccgccgcgggcgtgaggcccggcgcctgggtccatcccgaggccaccgtccatccggaggccgtgctgctgcccggcgcgtcggtggaccggggcggacgggtgggcgcgcgcacggtgctgtacccgggcgcctacgtgggcgaacaggccgaggtgggggaggactgcgtcctgtaccccaacgtcacggtgcgcgagcgctgcatcgtgggcgcgcgcgtcatcctccacgcttccagcgtggtgggcgcggacggcttcggcttcgccttcaacccggaaggcgaggcggggccggagcacttcaagattccccaggtcggcatcgtccgcatcgaggacgacgtcgaggtaggggcgtgcacctgcatcgaccgcgcgacggtgggcgagaccgtggtggggcgcggcgcgaaactcgacaacctggtgcagattgcccacaacgtgcgagtgggcccgctgtccctcatctgcgctcaggccggtgtgtccggctcggcggaggttgggacgggcgtggtgctcgcggggcaggttggcgtggtggggcacatccgcgtcggtgacctggccaaggtgggcgcgcagtccggcgtcgcgcacgacgtgccggacggccaggtggtgagcggtagccccgccgttccccaccgagagtggctgcgggccagcgccgcggcgggccagatggcggacctgctcaaggaagtgcgcgccctgcggcgccgggtggagacgctggagaaggaaaaggggccgtga

SEQ ID NO: 3820 - DNA, 462 bp, Myxococcus xanthus
atggacatcggagagattctcaatctgctgccgcatcggtacccgttcctgctggtggaccgggtggtggagatcatcccgggccagaagctgacggcctacaagaacgtcaccatcaacgagcccttcttcaacgggcacttccccggtcacccggtgatgccgggtgtgctcatcctggaggcgctggcgcaggcgacggccatcctcgcctacaagagcgagaacatggatccgtcgcgcaagctcacgtacctgatgggcgtggacggcgcgcgcttccgcaagccggtgttgccgggggatcgcctccagttggagatcgaggtggtgcgtcacaagggcgctgtctggaagacgaagggcctggcgacggtcgacggcgcgcgtgtcgccgaaggcgagttcctggcaaccgtcgtggacaaggacgccgacgcggctgagagcgcggcatcctga

SEQ ID NO: 3821 - DNA, 777 bp, Myxococcus xanthus
  unsure (1)..(777): unsure at all n locations
atggctcaggttcatcccaccgcggtggttcatcccgacgcccgccttcacgaaaccgtcgaggtcggcccctattccatcatcggtccccaggtaacgattggtgcaggctcccgcgtggggccccacgtcgtcatcgaaggccgcacgacgctgggcgagcgcaatcgcatcttccagttcgcctccgttggcgccgacccgcaagacctcaagtacgcgggcgaggacacggagctggtgctcggcgacgacaaccagattcgcgagttcgtgtcgctgcacaagggcaccgccggtggtggcggcgcgacccgcgttggcagtggcaacctcttcatggccaactgtcacgtcgcgcatgactgcgtggtgggcaatggctgccgcatcggcaatggctccgcgctcgcgggccacgtgacgatggaggaccacggtataattaccggccttgcagcgcgccatgagataacccgattgggcaagcacgccttgatgtccaggggagccatggtgaccatggacatgcctccgtattgaatcgcccatggagatcggagggagctggtgggcctcaacacagagggcctggtgcgcaccggtttctgcaacgagcagatccaacgggtgaacgaagcgcaccgcatcctgttccgctcgaagctgacgctccagaaggccatggtgcgnctgcgcgcggagctggcgggccactccgaggtggaccacctcatccagttcatccagcagagcaagcgcggcctcacgcgctga

SEQ ID NO: 3822 - DNA, 817 bp, Myxococcus xanthus
gaatcggcggtggatcggattggcctcatcgcgggcaatggtcggctgccttttctcttcgcgcgcgccgcgaggaagaagggcctggaagtcgtggccgtggcgcaccggggagagacggacccggcgttggcggcggaggtggaccggctgacgtgggtgcgtgtcggtcaggtggaccgcatccagaaggccttccgggaagcgggcgtgaagcaggcggtcatggcgggcggcatcggccgcgtgcgggcgctggcggaagcccggccggacctgggcgcggtgcgcatcatctcccggctgcgaagcttccgggatgatgcgctgctgcgcgcggtggcctcggacttcgagtcgcgcggcgtcaccatcatcgctcccacggacttcctgggtgaggtgctgtgcccggagggccacctcgcggggcctcggctgcacccggcgcaggagaaggacgtggccctgggccgagaggtcgcccatgctgctgggccaggcggacgtggggcacacagtggtggtgcacaacggccacgtcctggcgctggaggcggtggagggcacggacgaggccattctccggggcggcaggctgggtggcaattcaggcactgtggtggtgaagcgctgcaagccgcagcaggaccgccgcttcgacctgccggccgtgggccctcacacgctggaagtcatgcagcaggtgggcgcgcgcgtgctggcgctcgaggtgggacgcacggtgctgctggacgccccggtcctcttcgcgggcgccgagtccaggggcatcaccatcgtcggcgtgccctga

SEQ ID NO: 3823 - DNA, 885 bp, Myxococcus xanthus
atggaaacagtcctctactcgctgacgtccgtcctgctgcggtcgggaaacagcgtcttcgaccggctcagctacgggctccgccgccagtccatcctcgtcctcaacttcgccaacaacttcgtcccgttcctcttgctggcggcgctgacgccgctgctgccgatgacggacagggcggggtgggcgctctatggcaacgcgaggctcgcgctgttcgcggtgagcgtccagggggtggccttcgccttctcctacggcttccggcacctcacggtcgcccgggtgaacatcgcctcgcgcatcggggatgtgctcatccccctggcgctcatgctgtccggccgaacggtgcactggaccgagtacctgttcgccctcgccgtgtccggctgctcgttgctggccgcgggaggtggctcggacagccgccgcgccctgtggctgccggcgttcttcatcaccgtggccgtcctcgtgcagagcctctgcggggagctcttcttccagggccagccttcgggcgtggcgtccaacctggaggtgagcaccgccttgatgttctggaggagcgcggcgtgtctggtgctgctgctcctcttcggcgcccgggggacgctgggggcgcagttgagcgagctggtcgtggacggccgcgcacgcaccaacctgctggtgcgcgccctcttcaccgtgggcaatcaggtcgccttcgtcatggcgctggcggcgggaaaccgcgtcgtcgcctggcccatcctcaactcggtgacgctcttctccctggtgttcgccaacgccttcatccaggaggcgcccgcgcgacgcgaggtgttcgccgtcgtggccatcgtcgcgttggccgtgctcaaggccgcgctgtag

SEQ ID NO: 3824 - DNA, 1023 bp, Myxococcus xanthus
atgaacgcccgcctgctgctcctcgcctttgtcctgtcttcgccgatgccggtgctcgcggacgccgttcgagtctccctggaggggcgcgccgtgctgggggagaagctcccggcgctgctggtccacatcgaggagcccatcgcgggcttcgaggtgaagctgaagcgcagcgacggccaggacgtggaggtgaagggcggcgggagtccgggcctcacgcgccgcatcgagctgaatcagccggaaggccgcttccgctacgagggagcgctcacggtgcgcttcccggatgcggaatccggcgtgatgccgttgtctttcgacacggagctctacggcacgctgaagctggacgtccgcaaggaggacgtggacgtggccgcgcgccggctgcgcttcgtcctgtcccggcccgcgaagcgcgcggagttgacggtgttgatggacaccgggaagaaggccttcgagggcgaggtgccattcaagggggaggcgggggggacgccactggagctgacgtggccggcggcggaggggcgggtgatgaagatctccctccgtgcgttcgacacggcggagttctacacgggcgtcgacctgtatccgtggcaggtggacattccgcacgaggaggtgaacttcgcctcgggccaagcggacattccggcgacggagcggggcaagctggacaagagccacgccctcatcgtggacgcgctgacgaagtacggtcgcttcgcgtcgctgcggctctacgtgatgggacacacggacaccgtgggggccgcggcggagaacctggacctgtcggtgcggcgggcgaagagtctggcggcctatttccggaagaaggggctgcgggtgcccgtgtactacgaagggctgggagaagaggccccggccgtcgcgacgcccgacgagacagcggaggcgggcaaccgccgcgcggaatacatcatcgcagtggaggagccggtgcttcagcacgcgcctcgccccccgcggtggcggaagctgtag

SEQ ID NO: 3825 - DNA, 468 bp, Myxococcus xanthus
atggaccgattccaccagaaggcatgggcgttgctcgggctgggggtgctggggagcacgggatgcgcgcaccaggcgcgtctcgcggagcgtcagggcgtggaggctgagaagtgtgagctcgtgcaccggctgctgcgggagccggtgccatcccaggtcgtccgcgaagtcgtcgcggccggtcgcgatgagcccgcgccggtggtggtgtacgtacgccgtccggaggaggcgatgctggagcgcttcttctccggtgacgcgcccagttgtggcgacgccaccttcaaggtggtgcaggagaacgtgctcgacgcggtggtggtgtacctgcaggagatccaggacggctacgcgtacgacgcgcaccgcgccagccacgacgagctgtcactggagggcaagccgcagggcctgctgaagcgcaagggcccagagtgggtggccatccccggacctacttga

SEQ ID NO: 3826 - DNA, 663 bp, Myxococcus xanthus
atggcgggcgcgctgcgggcgcacatgggcgactacccagtgcgctcacaagagttcgggcgcgacctgcaggccatggggctggacacggacgacctgaagatcgccatgcaggtcaacggccgcatcgcgctgaaggacctgctggcgcacgggcgtggcgagctgcgcatggcgtactcgctgctgtggttcctgaagctgacgggtggggtgacgttctcctcgacgcccgtggccacgggcacggacgtgctgtccgcggcggtgctgccggaccggatcgcgccgcgcaagcgcaaggccctgccgcccgagacagcggcctcgctgcgtgaggaagcgctgcgcatcatcacccgcagctacttcggagggctggggctggacatcgcggcggacgcggaggcggtggagcgcgcctatcacgagacggcgatgcgctttcatccggacacctacgccgagttcgacatctccgacctgaaggacctgctggagttggtgcaggacccgctgtccgcgtcgtaccgggtgctgagcgtggaggagaagcgcaaggcctacctccagtacctcttcagccggatggaacgtgggggcggaacgcggcggtggtcgtggatgcggaaatcgcgctgcgccggggcgagtccgccctga

SEQ ID NO: 3827 - DNA, 627 bp, Myxococcus xanthus
atgccggaatacgcgtcgctgttcctcgtctcgctgtcggccatcttcttcgtggtggaccccattggcgtcgtcccgctgttcctggcgatgacggccggggactcgcaggagaaggtgcgccgcactgccatgcgcgcctgcctggtggcctgcgggatgatgctgttcttcgccctcttcggcggcgtcatcttcaaggtgttcggcgtgtcgctgggcgccttccgggtggccggtggcatcctgctgctcatcaccgcgttggacatgcttcgcgcccgcccggcggagacgcgcaccacgccgtccgaggaacaggaaggcgtggtgaaggaggacgtggccatcgtccccctcgccattccactgctggcgggcccgggcgccatcgccaccgccatggtgctgatggccaagggcgacacgctcgtctccgccatccccgtgctggccgccgtcgtgctgacgttcgtggccagctacttcatcctccgcgcctccgggctcatccagcgcgtgctgcgccaatccggcgtggccatcgtcgagcgggtgatgggactcatcctggccgccatcgcggtgcagttcatcgcggacggtggcaaggagctgttcaagtag

SEQ ID NO: 3828 - DNA, 705 bp, Myxococcus xanthus
atgaacccagccctggtctgcatccccacgtacaacgagcgggaaaacatcgaggccatcgtccaggcggtgctggagaccgacccccgggtcgacatcctcatcgtggacgacaattcgcccgatggcacagggcaactcgcggatgggctcgccgcacaggattcgcgcgtgcgcgtcctccaccgcgagaagaaggagggcctgggccgcgcctacctcgccgcgttccgttgggccctggccgagcagtacacgtacatcctggagatggacgccgacttcagccacgacccgcgctacctgcccggcatcctggatgcggccgaggctggcgcggacctggtgctcggctcgcgctacgtcacgggcggcggcacggtgaactggggcgtggggcggcagctcatcagccgcggtggcagcctctacgcacggtcgattctgggcgtgggcatccaggacctcaccggcggcttcaagtgcttccaccgccgggtgctggaggccatcgacctggattcggtgaagagcaccggttacgcgtttcaaatcgagctgacctaccgcacgctgcgcaaaggcttcaccgtgcgcgaagtgcccatcgtcttcgaggaccggcgcgtgggtcactccaagatgagcaagaaaatcttcgccgaggctctcaccatggtgtggaagctgcggctcacggtgtaa

SEQ ID NO: 3829 - DNA, 1152 bp, Myxococcus xanthus
atgacgaatccaccccgcatcctcgtcgtcgccggcgaggcgtcaggcgatacccacgccgccgagctcgtcgccgccctccgggcccgccgtcccgacctcaccttctttggcatgggcggtgcccgcctggccgcccagggagtggagctgctcttcgacgcccgggaggtgtccgtcatgggcatcaccgaggtcctgccccggattccccgcatccttcaaatcctgaagggcctggccgaggccgccgccgagcgcaaaccggacgtcgccatcctggtggacatccctgacttcaacctgcgcctggccaagaaactcaaggcgctgggggtccccgtcgcctactacgtgtcgcccatgatctgggcctggcgccggggtcgggtgcgcaccatcaaacggttggtggaccggatgctctgcatcctcccgttcgaggaagacttctaccgggaggccggcgtcagcgctcgctacgtcggcagcccggtggtggagcaggttccctcaccggatacggccacggccttccgcgagcggctggggctgtcgaaggacgcccccacactcgcgctgctgcccggcagccggatgggcgaaatccgccgtctgcttcccgacatggtggaggcggcgaaacgcctctccgccgagcggcccggactccaggtcgtcgtccccctcgcgcccaccatcgaccgggaggaaatcacgtcccgcttcgaaggcagtggcgtgacgcccatcctggtagagggacgggcacccgaggtcgtgggcgccagtgacgccgcggtggtggcctccggtaccgccgtcctggaagccgggctgatgcagcgccccctggtggtcgtctaccgtgtgtcactcatcacgtactgggtgggccggttgatgctgaaggtggccttcgtgtccctcatcaacctgctggcgggccgacgcgtcgtccccgagctgctccagggggagatgacgcccgagcgcatcgccgaggaggtccgccgcgtctggatacccggtgctccccgggaggagatgctccaggggttggcggagatgcgcggccggctgggcgagacgggcgcggccacccgggcggcggagtccgtactggagctgctgcccccgggccgcgtttag

SEQ ID NO: 3830 - DNA, 1467 bp, Myxococcus xanthus
acaactgcgctggagacctctccacgaacagcggccccctccttccgggccgccggtcaggattcgtacgctcgtatccgcggcttgagtggcgcggagggtgggacgtgtctgtccggcggacggaagtgcccgccagacgcgcaccaggaagccaccgtcatggacccaacccgcaatgcctttcccgagaagaaccgcaatctcgccgtgggctccgcccggctccaggaagtccagaaggcggtccattactacgtggacaaccatcactgtgacgtcattggacgggtgtttcacgggatgccgggccgggaggcgcgcgtcagcttcagtccgacgcgccgggatgtgaggctgaacgcggagggacctcgggacgtcctccacttcggctcctacaactactccgggctgaacgggcacccgcgcgtggtggccgcggcggaggcggcgctgcgccgctacgggacgacggtcagcggcgtgcgtctgctcaacgggacgtgtgagctgcacctggagctggagcgcgcgttggcggagttcctgggcttcgaggactgcgtcacctacagcagcggctacgcggcgaacctgtccgtgttgtccgcactgtgtgctgagggcgacgtggtgctgtcggacatgctcaaccaccagtccatcatcgacgggctgaagctgtccggcgcggacatccgcacctaccggcacaagagcctgcgcagcatcgagtccacgctgaagaagctgccatacgagcagcgcaagttcatcatcaccgacggcgtgttcagcatggacggcgacgtggcggacctgccgggcatcgtggcgctggcggagagctacaacgccttcatcctcgtggatgacgcgcacgccaccgccgccatggggcccaacggccgcggcaccccggcctatttcgggctccagtcgcaggtggacgtgctcaccggcagcctcagcaagggcctgccgggcatcggtgggttcgccgccggctccaaggccaccatcgacctgctgcgcttcggctccaacggctacatcttctccgcctcgctgccgccgcccatcgccgcgggcctgctggagggcatccgcatcctccaggagcagcccgagctccaggagcgcctgcaccacaacgagaactacctgcgcgccggcatccgctccatgggcctggactgcatgaacagcgagtcccccatcatccccatcctgatgcccgcctacgagaagacgttcgagctgacgcggctgctccacctggagggcatctacgtcaacccggtgggctaccccgccgtgagcaagaaccgcacgcgcctgcgcatcaacgtcagcgccaacctcacccaggcggacctggaccgattcctggacgcgctggaccgctgcagccgcaaactcaacctccaggacgcgccgccgctccagcagaccggcacctga

SEQ ID NO: 3831 - DNA, 1281 bp, Myxococcus xanthus
atggacctcaaggaacagctcctctacggcctgcccgtgttcctcgctcccatcctcatcgagctggtggtggggctcttgcggcgcaagccggcctaccggctcaatgacctgctcaccaacgtgacgatgagcctgctcaccgtcctgggcagcgtggtcatcgcgggcgccaccttcgtcttctacggctacgtctacaagcaccacgccctcttcagcctggcgaaggactccgcgtggacgtgggtggtggccttcttcgcctacgacttcttctattactgggcgcaccggatgcaccacaccatggcgtggatgtggggcgtccacgtcgcccaccactccggcgaggacatgaacttcggcctcgcggtgcggcagagcgcgctgggtgagctgaccacgtggcccttcttcgtgcccatggcgctgctgggcatcgcgccggaggtgttcctgggcatcaccggcatccagctcatcttccagtacgccatccacaacacctacgtgccgccgctgggctggctggagtacgtgctcgtcacgccctcccagcaccgcgtccaccacagccgcaacacgccatacatcgacaagaactacggcaacatcctcgtcgtctgggacctgctgttccgcacctaccagccggagctgaaggaccagcctcccgtctacggcctgcgcagcagcctgcgctcgtggaaccccttcaccgcgcacttccactacttcgtggagctgttccagaagtccgccgcctgcgcgcggctggccgacaaggtgctgtgcttcatcaaggggccggactggaacccgccgtcgctgcgccaggagcgcttcaccggccccccggatggcggcccgtccgccaccttccagaagtacgacccgcgcctgcccttgcccgtcaccgcctactgcgtgacacagttcttcagcctggcggccagcatcctgctgctcgcgtggtacctggacacgctcagccccggggcccgcgccgtaacgctggggctggtcctcttcggtacctggagcctgggcgcgctgatggactcgcgcgccttcgcgtggcggcaggagttcgcgcggctggcgggtatcgcgctgctgggtcccgccctggcgctgatggagggcgttccgctggtcagcgcgctccccatcctgctccaccccgccctcagcgccgcgtggctgctgcgcttccgcgccgcgttccacgaaggcgctgacacctccacgcgaggctccagcgccctggccgcctga

SEQ ID NO: 3832 - DNA, 1167 bp, Myxococcus xanthus
gaggactggcacacctgcttcccacccaccgacgtgatgcagtccttcgagctgcaccaggccaccgaggccgccagcatcgaggacgtgcggttccactacctggtcctccggaacgagggcgcggtggtggccatcgtcccctgcttccgcttccggatgtcgctgacggtcatcgccccggagaacgtcaacaaggtggtgtcccaggtccgccgcgcgttcccggacttcctcttcctgaacgcgttcgtcatcggaacgcccatcgccatctgcaaagacctgctgggcgtgcgcgcggacctgccgaaggcgcggcgtgacgacgtgctgcgcgccatctcccgcgaggtgattgcccgcgcccggcacctgaagctgggcctggtcttcatgaaggagttcacctcccagaagctgcccgaagtgaaggacgtgctgtccccgcgcttcaacttcgtggagagcgcggccaccacctacctgtacctgggcgagcccgggaagagcaccttcaaggagcggctgcgcaagaagtaccgctccctgatgaacaaccgcatggcccgcgtccaggaggcgggcatgcgctgggagaccgtctccgacttctcacgctacgccgcgcagatgcacccgctgtacctgcaggtcctcaaccgctcgaagattcgcttcgagacgctcagcgtggacttcttcgcccagctcccccagcgcctgggcgaccgcgtcttcgcgctcctgtgcttcaagggcgagcagttggtgtccttcgagctgttcctcaaggacgcggagtgggtccaccccatctacctgggcctggactacagcctccgcgacgagggcgcgctgtacttcaacagcatctacaaaatcgtggaggtgctggagtcccagggcaagtcggtggtgcagttgggacagacgagctacgcggtgaaggccagcatcggcgcggtggtggaccggctgtacctggccgtgcaccacacgaacccggtgctggaccagttgctgaagcgcttcggcgcggagctcttcccgcccacgcccctgccccgctcgcagcgcgtgttccgggacatgaaggagaacgacgacggcctggcccgccatggcatccacttcgagcgactggacgcggagggcgacgaatga

SEQ ID NO: 3833 - DNA, 1194 bp, Myxococcus xanthus
atgacggcgcaggcgggcatcaccacgaaagtcgtccctcgcatccaggacgtgccccaggcgctgtgggacgacaaggtggcgcggggccaccccttcaagagcgccgcgttcctctcctgcctggaggactcgttcccggagcggaagttcggctacctcatcgtgtcgcaaggcgcggacgtcgtcggactggcggtcatcaccgaggagcgcctggacttgagcctgctgctgccggagcaggtgggcacgctgaccaagggcgtgcgcaaggtgctgcccggcttcctgtcgctgggcctgggcatggtgggtaccttcgaaacggcggagcggcactggtggtacgacgcgcagcgcgtttccgagcacgacttcgcgcgggcgctgctcgccgcttgcgacgaggtgtgtggcgacgccgcgctgctgctggtgcgcgacttcatggaggccctgcccgaggacgtgcgcctggagtcgtggttcctccagcggggcttcaagcaggtggccaaccaccccatggccatggtggcgctggacgggctgagcagcgaggcccacttccagcggctgaagaagaagtcgcggcagaacctgcgcaagaagctgaaggacgcagaggcgctgggcttccaggtggagcgggtgcgggacttccgccccctcatcgacgagtgctacccgctctacctccaggtccacgagggcgcgtcggagttcaagcgcaacccattccctcgggccttcttcgagaccatcgcggagcggatgcccaccaccagcagcttcctcacgctgcgggattcggccgggcacctgattgccttcatcctcacgggcaccgggggcggcatcaacaaccccttctgcatcggcatggactacgcccggacggaaggcacgccggcctactacctgatgatgtggaaggaaatcgagcacgcggcccgcacgggatgccgcgtggtggtcctgggcctcaccagctacttcgtgaagcatacggtgggcgcggagctggagggcatgacgatggccgcccgcatccagtccgcgtggctgcggcccctgctcaatcccctgctgcccgcgctgctgagcgagaagcagccgcaggagcgacggaagttccgcgtctccaccttcgacgacgactcgcagccccccactgaccaggccgcttga

SEQ ID NO: 3834 - DNA, 3168 bp, Myxococcus xanthus
atgtggatcgtccggctggcgctccgacgcccctataccttcgtggtggcggcgctgctgctcgtcttcgtgagtgtgcaggtcatccacgaatcccccacggacatcctccccgaggtcgacatccccgtcatcagcgtcgtctggagctatgacgggctgcccgcgcagcagatcgagcggcagattacccaatacagtgaatactccctggccaacaacgtggcgaacctggcccggcaggaaagccagtcattcgacggtgtatcggtcgcccggttgtatctacaccccggggctgacgtggccgaggccatggcccaggtgacggcgtcctcgcaatccatcacccggcgcatgcctccggggacgcagccgcccatcatcctccggtattcggccagcagtgtgcccatcctccaggtgtcgttcagcagtgagacgctcaccgagtcgcaaatctacgaccatgtgaatcaacgcgtccggcctctgctcggcacggtccggggcgcgcgcattccccagctcatgggcggcaaggtccgtcagatgaccgtggatctggacctggaagccctcgaggcccatgggctggcgccgcacgacgtcgcctcggcggtctccgcgcagaacctggtcctgcccacggggaacatcaagatgggcgcgcacgagtaccgcgtgacgctcaacagcagtccggagacgctcgccgcgctcaatgacatcccggtgcgccggagcgatggccgcgtcgtgtttctccgagacgtggcgcacgtgcatgacggcttcgcggtgcagacgaacatcgcccgggaggagggccggcgctccgtcatcctgtccgtgatgaagacgggggacgcctcgacgctggaggtcgcccgccgcgtgcgcgaactgctgcccaccatccaggccgccgcgccggagggattgtcggtgcggttgctggcggaccagtcctccttcgtgacgaccgccatccacgggctcctggttgaaggcgtcatcgccgcgctgctgacggcgacgatgatcctcctgttcctggggagctggcggagcacgctcatcatcgccatctccattcccttgtcggtgctcgcggccatcctggtgttgcggggcctcgggtacacgctcgactcgatgacgctgggcgggctggcgctcgcggtgggcatcctcgtggatgacgccacggtggagatagagaacatccaccgcaacctggccatggggaagccgctcacccaggccatcctggatggtgcggagcagatcgccgtgcccgccttcgtcgcctcgctctccattggcatcgtcttcgtctcggtgctcttcctggaggggccggcccgatacttgttcctgcccatgggcctggcggtggggctctccgtcatggcctcgtatctgctctcgcgcacgctggtgcccacgctcgtacagttcctgctgcgcgcggaggttcagcggcacgggcagccccagacgggctggctggcgcgactgcaccaccgattcgaggagggcttcgaccgcttccgtgcgcggtacgtgagggcgctccagggggccctggcccggccgcgccgcgtgctggttttcttcctgctcgcggtgctggcggcggtggggttgatgcccttcgtgggccgcgacttctttcccaccgtggacgcgggccagctccgccttcacgtcgtggcgccgccggggacgcgcatcgaggagacggagcggtacctgtcgctcgtggaggacgccgtgcgcgagctcatccccgccgaggaccgggtgagcctgattgacatgatgggcatgccgggcggctacaacctcgcgctgacggacacctccaacgtgagcagcgcggacggggaggtcctcgtgacgctggctccgaagcgccgggtccggacggacgcgtacgtccggctgctgcgcgaggagttgccgcggcgcttccccgagctcacgttctacttccagcccgcggacatcgtgacgcagattctcaacttcgggctgccgtcgcccattgacgtgcaggtctccggctcccaacgcgaggccacctatgccatcgcgcggaagctcgaggtggagctgggacaggtccgcggcgcggtggacgtgcgcctgtcgcaggtggtgaacgcgcctcggctgcacttcgaggtggaccgggtccgctccagcgcggtggggctcacgcagcgggacgtggccaacaacgtgctgctcaccgtgtcatccagctcgcaggtgagccccagcttctggatcgacccgaagacggggaacagctatccggtgtcggtgcgcgtgccggagacgcgggtgtcctcggtggaggacctgacgcggatggcgctgcccacccgggaagggccccagctcctgggtgacctcacccgggtgcagcgcgagtggacgcccgtcttcgtcacccatgtggacatccagcccaccttcaacgtccgcgcggacgtccaggacacggacctgggcagcgtggcgtcgcggctggagcggatcgtcgaccgctaccgagaggagctgccgccgggctcgcgcatccaggtgcgtgggcaggtggagagcatgcgcaccagcttcgaccggctgctgttgggcctgctgttcgcggcggtgctcgtctatgcgctgatggtggtcaacttccagtcctggctggaccccttcatcatcatcaccgcgctgccgggggcggtggtgggcatggtggtttcgctgttcgccacgcagacgcccttcagcattccctcgttgatgggcgccatcatgagcgtgggcgtggccacggcgaactccgtgctggtggtgtccttcgccaacgagcagctcgcgctcggcgcgagcgcggcggaggctgcgctcgaagcggggcgggtgcgggtgcgccccgtgttgatgacggcgctggccatgggcctgggcatgctccccatgtccctgaacctgggcgagggcggcgagcagaacgccgcgctcggctgcgcggtcattggcggcctcgtgggcgccacggtggcgaccctgttcttcgttcccgtcgtttacagtctgatgcaggcgcggcgggctgtccgcgcggcggcccctgaactcgagccctcggtgacagcgtga

SEQ ID NO: 3835 - DNA, 843 bp, Myxococcus xanthus
atgctccgcttcgcctacggctgcattccctccgtcatgtccctgtacttcgccaacaccctggtgcggcgagcagggctggcgcccgcgtgcatcctcctgtccgcggggggcctgcgcttccagaagaagcgctacaccccggcccaagtgctgcctgtcttcctgaagcagtttggcccgcgcttcaccggctacaacgtgctcgccgggctgagtggctcgctgcccttcagcattcccgcctcggggttgatgagcttccaggcgctctcccaggcgtatggcattccgctggtcatcagtgatgacttctccggagcggccacggtgagcgagctcgagcggcacggggtggagttgttcctcaccagcatgtgcgatcaaatcatccgggagccactgctcagtctgccgcgccatggctgtttgaacatccacccatcgctgctgccggagttccgcggcgtggactccgtcttccaggccatgctgaacggcgtgtctgagattggaacgacactccaccgcaccaccgggcgcatggacgcgggcgacgtgctggcccagagcgcgttcacccgtacggccgccgattcccacctggcgttgacggcgaaggcgaccgccgcgggcattgccctgctcaagcggcacatggagaccctggagcgcggagagacgccggacgcgcgccccatcgacgtgagccgggcgcgatatccctaccgctcctggccggaacgggaggagctgcgccgcttccacgcccaggggaacaccttctggcgggcgtcggacttccgccgcctcctcgccttcgaggacgtgctggcgacatag

SEQ ID NO: 3836 - DNA, 135 bp, Myxococcus xanthus
atgcgcaagcttcccaaggacgcggtggcgccctttgaagtcggcctggccttcacggacgtaccgccgctggccatggacaagctcaagtcggtgctcgtcgtggatgacgagggcggcccggccgactcatag

SEQ ID NO: 3837 - DNA, 1339 bp, Myxococcus xanthus
atggaggaggacgccccggaggtgtcggccgccctgctggagggcatccgagccgccgcgctccccgtgtcgggccgcgcttcggacctggacccgctcatcgagagcatcggtgatgcgcggttcgtcctgctgggcgaggccacacacgggacacacgagttctaccaggcacgcgccaccctcacccgccgcctcatcgccgagcagggcttccacgcgctggtggtggaggccgactggccggccgccctccgtgtcgacgcgttcgtgcggggtaacgggcaggacgcgacggccgctggcgccctgggcaacttccagcgattcccgcggtggatgtggcgcaaccgggagatggaggagctggtcacctggatgcgtgcccacaacgccacggttccgccggagcagcgggcgggcttctacggcatggacctgtacagccttcacgactccatgcgggaggtggtggcctggttggacacggtggacccggatgccgcgcagcgggcccgcgagcgctacgcctgcttcgaccacttcggccccgagccccacgtctatggccagtccaccacgtcggggcaggcggactcgtgcgaggagcaggtctgggcccagttcgtggagttgcagcggcggaggactcgggggcccgaggacgcggacgcccgcttccacgccgagcagaacgcccggctcgtcgccaacgcggaggcgtactaccgcgccgtgtatgcgggccggcacgaaggctggaacctgcgtgacacgcacatggcggacacggtggacgcgctcgcggcgcacctgtcacgcagcggtccaccggcccggttggtcatctgggcgcacaactcccacctgggtgatgcccgcgccacgcagatgggtgaccagggggagctcaacgtgggccagctccttcgcgagcggcacggcgcggccacctacaacgtgggcttcaccacgtacacgggcgtggtcatcgccgcgcacgaatgggacgagcccgggcctgcgacgccgcatccagcccgccatgtccggcagctacgagcgcctgttccacgacgtgggaatgcccgcgttcctgctgcgcatggccgagctgggcgaagcggcgggcggcctgcatgagcgccgcctggagcgcgccatcggcgtggtgtacgcgccgcgcaccgagcggtggagccactacttccacgcgaacctgcccgcgcagttcgacgcggtgctgcactacgacgagacgcgggcattgcgcccgttggactcggatgccgggcacggggaagaggacgcgcctgacacgtatcccttcgggttgtga

SEQ ID NO: 3838 - DNA, 774 bp, Myxococcus xanthus
atggtcctcgagagtttcctggtgggtgagggcgatgtgcccacggtgatgctgcacggcttcctgggcacggggcgcaatctgcgctcactggcggcggcgtggagcgcggcggacccgagccggcgcatcctcttgccagacctcaccggacacgggacgtcccctgcgctgccagcgaactcggacctctacagcatggcccggtacgtggtggacacggcgcgtgcgcagggcttccagggtccgttcgactgggtggggcattcgcttggaggacgggtgacgctcgcggcaagcctcaatgtcccggaggccgtccggagcgtgtcgctgctggacatcgcaccggggcctgtcccgggagacttgtcggagagtggcaaggtgctgggcatccttctccaggcaccggctcaggcggagaaccgccgggcgatgcgcgcggagctcacgggccgcggcttgtcggagccgctggcggactggctgctgatgaacctggtgacggaggagagcggcgtgcgctggcgcttcgaccggcagggactggcgggcctgcactcgcgcgtgaatgacacagacctgtggacagcggtggagcgcaaggaccggccgccgatgcggtgccttcggggtggccgctcgaagtacgtgagtgacgcggacgtggagcgcctggtggccgcgggctgcccggtggagacgctgccggaggccgggcacttcgtccacgtggacgcgccgcaagcggtgttggcgtggctgcgctga

SEQ ID NO: 3839 - DNA, 819 bp, Myxococcus xanthus
atgagcatcaagctgacgggccgcctgatggcggcagcactcctgagtctgacggccgcgggttgccagggcgaggagtcgcagcctgccgaggctgacgcgctttcggcccaggaagcgcctgtgaaggcgcagtgcgttgagaccttcgccggcatcacgaactgcgccacgggcaacgcgaagctcgagcgcacggagaagggcctcaacgtcaccggcctggagaaggccgccaacgacggcgtctccagcaacttcgccgccgcgacgcagtgggagcagaaggccgtcttccaggacctcgccaaggccggacagggcttcgccctggcggcgcgtgatggcgaccaggtggtcagcaccgtccaggtcggcatcggccgtgagccgggccaggtgacgttccagccgcagttcaccggcacgccgggcggttcgacctacagtgtgtacgtgtacaacggcggtcagttccagggtcggcacatcaaccgcggcctctggttcccgatggatgcgtcctggtacgacatccacatccgcttcacgcccatccacatcggcttccgcaaccacatgaccttcgggttcaatgacaccatccccacgggcgcctgcgtgtggtccttccgcagtgcgacgccgggagccttcacgttcgacttcgacggccgcgaggtcagcggtgaccacgtcgagttcgtcgaggagctgggcgatggccactacccgtacaccagcttctcggccatcgacctgacggccgccgcgagcgcgctgaccatccacagcgagtccatcagccgcggcaagtag

SEQ ID NO: 3840 - DNA, 627 bp, Myxococcus xanthus
aagcctcgcgaggggaccgccgttcacgccaaggggaccgagcgggtggcgtccatcctcgatgcggccaccgacacactggtggaggagggccattcggggctcacgctgcgccgggtggctcagagggcggggctcagcgtgggcaacctccagtactacttccccgcgaagcaggacgtggtgcgggcgctgctcgcgcgctacctggaagccgccagccaacgggtgcatgcgcgggtggaggaaggcggccgtgcgccgatggagcggcttcggcgcgcggtggaggccctgctggaggaccaggagtcgccgcgtcattgccagctcttcgcggagctgtgggcgctcgccgcacgggatgaaatggtcgcggacgcgctcgccgtcttctacgcgggcttccgggcgggtgtcgtggcgctgctgcgtgaactggcgcccgggctcagcccgtctcgcctggagcgtcgcgcggcgttggtggtcgcattcctggaggggctgtccctcttcagaggcggcggtgcgctccggagggcctcggtgccagggttggagcaggagctgcgggccgtgttggaggaagtgctggcgggcgtccccgcagccgggaagctatga

SEQ ID NO: 3841 - DNA, 1092 bp, Myxococcus xanthus
atggtggctgaggacagtgtcgtgctggtggggggctacggcgtggtggggacgtggctcgcgcagttgctgcgggagcggcatccggaccttccgctggtcatcgctggccgccgccgcgagcccgcggaggcgttggcccggcggctggggaatgcggaagccgtggtgctggatgtgacggcgcccgacccgctggcgtgcctgtccggacggcccagggccgtggtgtcgctggtcaatgacccggacgatgcggtgctgcgctcggcggtccgggaaggcgtggcggtgctcgacatcacccgctggacgtcgcgtgtgaagtcggcggtgctgcggctgtcggggacgcccccacgggcacccgtcctgctcagctccgcgtggatggcgggactggtgcccaggctcgtcgcgggcgcgtcggagcgggtgggaggcgtcgagcgcgtcgacgtgggcatccgcttcgccctggcggatcaggcgggtccggactcggtggagtacatggaccggctggggatggccttcgacatcacggagggagggaaggagcggcaggtgttgccgctgacggacggccgccgggtgatgttcccggatgggcggcccacgcgcgtcttccggctcgacacgcccgagcaggccacgctgccgctggtgctgggcgcgcgtacggtgtcgacgcggctggggttcgattcgggcaccgtcacctggatgctcgcggcgctccagcaggtggggctgctccggctgctccagcatccccgtctgacgtccgtgcggcgcgcgctgatggccagcagcggcacgggcggtgaggcggcgtgggtggcggacgtggaaggtcctcgcggagcgctgcgaatcgaagtggtggacccgaagggacaggcccacctcacggccgtgggcgcggtgctggggacggagcgactgctgggatgggatggcgcgccgcctcccgccgcgggcgtgtggttcccggagcacgacgcgcgtccggagcaggccctggcggccctgcgcgggtgcggtgtccaggtccgcttcgaggaacaatcgcgccgggaggcggcctga

SEQ ID NO: 3842 - DNA, 1677 bp, Myxococcus xanthus
atgacggagttccccggcatggcccggcccggcctcaccccgcaggcggtccacgacgtgttcttctccacgacgcgccgttcgctggcggattactggagcgaggtgtccgagggtcgcaccaccaccacgggcgacgtggtgagcgggtacacgctggaccgcgcctattcatgcagtgaaggcgcggccatgcgtgaggccgcggtgcgggcggcggacgcggacgtggacttcacgcagtacgaccgcatcttcattgtccacccacggccgcaggcgggctgttcctacgccggtcaggccacggtgtcctgcgggcaggtgcagacggcggacggtaccgtgatggcctccacttcgtggctcgtggcggagtccatgatggtccacgacagtgccgtggagttggtgacgcacgaggcggggcacaacctcacgttgggccatgcgagctcgcgcgacttcggcgcggaggccctgggcctgccgggggcgacgggtgtcatcgacgagtacggggatgtcttctcgacgatgggacggtggaacctgggccactacgcggcgccgcagaaggcacgtatcggctggctggacgcgtccgcggtggccgaagtggacggtgtggacggtgtggacggcaccttcaccctcgcgcccgtggtcgcgtcgggcgggctgaaggcgctcaaggtgcggcggcggcctgggagcaatgactggctgtggttggagtaccgccagcccgtggggggctatgaggcgacgctggcgccgcaggtgttcggcggagcgctcgtgcactacgcggatgcgacgacgctgagtggctcgcacctgctcgacttcacgccgcagacggcatcgtggaccgacccggccctgcttccgggcacgacgtgggacgacccctacagcaccctctccgtgaccgtgaacgcggcgacgtccgcgggactcgtcgtgagcatcgcgcaccgtcaatccgcgtgcgtccgcgcaccccacgaggtgcaggtgacgtccttcgcccccacgtcctggcccggaggccggccggagttcgaggtcgttctcgtcaaccacgactcgcctacgtgttcgccgtccaccttccaggtctccgccctccttccgcaggggtggggctccgaccgtctgcccgcgcaagtcactgtcgccgcgtccgcctcgttgtcatggggcctccaggcgtatgcgccctacagcgcggcgcccggcacgtacgccgtgggcctggccgccacgcgagacggccacacggtgcaaggcacagcggacatcgacatcgtcgagcgttgtgtcaccgcatcgcctaccgtcacactgtcaccgcagacagtgacggcggcgccgggcacggatgtcacctggacggtgaacgtcaccaacaacgactccgcgtcgtgtgattgggtctggtacgacttctattccaacctgccgtcggcctgggacaccgccttttccgactggggtgtgaacctgccgccgggtggcgccttcactttcacgatgacgaagtccattccacgggaggcgcgcggcggcagccacacggtggacctggacatctacaaggacgagtacggtctcgtgtggcacggcaccaccaccgtggatgtggccgagccgctgacgcgctcgaggtga

SEQ ID NO: 3843 - DNA, 321 bp, Myxococcus xanthus
atggcgctcgtcatcgtcccggtgaggctggcgcgccggaagcgcaggagcatctggacgcacgggctgcgcgcacgggcccggctggtgaaagcggaggccggtgtcctggaccgcaaccgccagcgcaccaccgtgatgacgttccaggtcgacggcgtggacgggggagcgccctggatgctggtgcaacagcggaccctgggggccgagcacggccacctgctcgcgccaggaacggagctggaggtgatctacctcccagaggctcaatactcggccgtcgtcattccgagattcgacggtgaggattgggattga

SEQ ID NO: 3844 - DNA, 1005 bp, Myxococcus xanthus
ccgctcgtggccaccgcgcgcgtgacgcggtccgagccgaaggcggagctcacgttgccagggacggtccttcccagtcagcgcgcgtcactgcacgcccgcatcaatggcttcgtgggacgcatccacgtcgacctgggcgaccgggtccgcgcgggccagttgctggcggagcttgaagcgcccgagctccaggcggagtgtcaccgggcccgggcgcgcctggatgagacggagcggaacctggagctcgctcgcgcgtccgcgcggcgcgggcagattctcgcgggagagggcaacgtcagccacgaggtggcggaggaggcgcgggcgcgggccaactccgcggaggcttcgctgaagagcgcgaaggcggaggtggagcgcctcgaagcgttgtacgcatttcgccgcgtggtggcgccgtttgatggtgtcatcgtgcgtcgcaacgtggaccggggagcgctggtcaccgcgggcagtggcagcggaatgacgagcctgttcgaactcgcgcagacgcacacgctgaaggtctacgtggacgtgccgcagtccctcgcccatgacatccggccggggctcgaggcgcggatcttcacgctggatgcgcccgcgcgggcgctgccggggcgcgtggtgcggaccgcgggggtgttggacccagggacccgcacgctcctgacggaggtgcagctcgccaacacagaggcgctgttcgccgggtcattcgtgcgcgtccggttgctcatcgagcgcgaggctccgcccatgctcattccggccagcgcgctggccgtgcggagggaggggcccacggtcctcgtggtgggggaggcgaatgccgtccagcagcgcgtggtcgtgctggggcgtgacctgggcgcgcatgtcgaggtgatggacggattgtccgcggaggacagggtggtgctgagcccaccggacaccctgggcgatgggcgcgtggtgcgcgtcgcggaagggcgtgccgcgcgctag

SEQ ID NO: 3845 - DNA, 1632 bp, Myxococcus xanthus
atggacgcggcgtcgcaggtgcggggccacgcgtacctcgcctccagctccgcggatgaagtggcgcaggagtcggacaccattggcgcgtccttcttcacgcacttcctggtgacgggcctgcgcggcgcggcggacgccagcggtgacggccgcgtcaccctgcacgaggcctaccagttcgccttccatgaaacgctggcgcgcacggagcgctcgcagggcggtccgcagcacgcggcctatgacatccaactggcgggtagcggcgacctggtgctgacggacctgcgcacctcgcgcgtgcggctcacggtggcggaggacgtgcaaggccgcctcttcgtgcgcgactggggcaaccagttggtcgcggagctgcagaagcccgcgggccggcgcctggcgctggggctggaggcggggcgctatcaggtcgtgctggagcgtccctcgcagcggttcgaagcggagttgacggtgtcgccaaaggggggctcggagctgcgcgccgagcacttcgttcccatgacactcacgcgcacggcggcgcgaggcgggacggacatgcgggccgaggccctgtccaccggcgagccggtcgtcctcggcgacatgccctccgtgcccttcaacctgtcgctggtgccgccgctggccaccacctcgctgtgggggggcgtcgggcgcaaccacctggcgctgggtgtgctgggcgtgcgctcgatgcagcttcaggggttgggcgtgtccgccggcgtggggtgggtggacgggacggtggaggggttccaggtgtcgggcgtggcgaatgtggcgggcggggagattttcggtctccagacggcgttcggcggcaacctcgccttcggtggcgggacgggcgggcaggtgtccgccgtcttcaacatggccgagcgggacttcacgggcttccaggtgagcaccacggcgaaccgcgcggcggcgcgcctccgtggcgtgcaggcggccgtgggcatcaacctggcggagcggctcgcgggcgcgcaggtgggcctcatcaacatctccggggacgtcgcgggcgcgcaggtgggcctcatcaacgtggcggccgaggtccgcggcgtgcaactggggttcatcaacatcgcggatgacgtgtcggtgcccatcggcttcttgagcatcgtgcgcaaggggcgcttcgtgctggagctctccgctgacgacgtcatgcccctgtcggtgggcatcaaatatgggagccggacagtctatgtgctggccaccacgggcgtggggattggcaaggactcgctgcggaccttcctcaacatgggcctgggcgtgcacgtcccgctggatgcggcggaccgctactcgctggacgtggacctgtcgtacggaagctggcagccgaacttctatggctcggggcccaagaacacgctgttccggatgcgcgccacgctggggtgggagctcaagcggcgcttcgcgctcttcggtggtgtgtccctcaacgcgtacgacccgtcgtcccaggacgagtaccgcgacgtgagctggctgccgcagtggaagctgggccgcggccccggcggcgtccggatgtggcccggcctgctgctgggcgtgcgcatctga

SEQ ID NO: 3846 - DNA, 921 bp, Myxococcus xanthus
atgaagaccctgctcgagtatggcggcctgttgctgctgctgggcgccaccgcgtgtgtcgacgtcgaggaccagccttcgcgcgtccacgacttccgtgtgctcggtctcgcaacggagccgccggagttcatggcgtccgcctgcgagctcaacccggcgacgctggatgaactctccgagcccgtgacataccgcgcgctgctggtggacccggcgggtgagggccgtcccatccagtacacgctgtgggcgtgcgcggaccccgaggaccggacgtgcgcgaacgaggccaaccgcgtactgctcgcggagggcaccaccgcgcccggtgagctgacgctcagcatccaaccgggcgcggccacgctggcggatgacacgccgctgctggtgcgggtgcaggcgctggacccctacctggggctgggcggcctgcgcatgccgctggtcctcttcacgcaggcgggggaggagcgggtgtacgcgcagaagctgatggtcttctggtgcccggcggtggaggggatgcgggccaacgtgcagccggtgattccgggcctgcgcgtggacgacgtggcctgggccgcggaggcgccgctggagcttcggggcgccgggcccttcgtggtgacgtccgaggacgtggtggccttgcaggagacgtacgtggtgcccgggctgcggctggaggcggtgacgctgcgggagagctgggagatttcgtggcacgcgacgctgggcgagttctcgccgcaggagacgggcggctcgtccttcggcgggcaggaaggccggcaccgcacggagtgggagccgccggagggcgcgcaggcgcaagaggtgacgttctgggcggtggtgcgggacggccggggcggcagttcctggttggtgcggcgggcgctctggagcccgtga

SEQ ID NO: 3847 - DNA, 1899 bp, Myxococcus xanthus
cgcgcgcccttcatctccggtgagctgctggtgcgtggctcgaacccgggccagacgtcgacgatgatggacggggtcgaaatccccctcctgttccacctgctcggcggaccctcggtggtcaacgctgagttcatcgaccagctcgacttcttcccgggcggttacggcagccagtacggccgcgcggtgggcggcatcgtcgaggtgggcacgcgcaagggcgcctcggacacgctgcacggctcggtgaaggtggacctgctggacgcgggcttcttcctggagagcccgattacggacggcatcagcgtggccgcggccgcccgccgttcgtacatcgacgcgattctgcccgccgtcctgccgaagacggaggggggcacgctctccgtggtgccgcgttattgggactaccaactgcgcgtggacttcggcgcgaagcgcgggacgcccaacgacgacacaaccgtgacggcggggggcgcgcgcagctccggctacatcatggccttcggcagtgatgaccagctccgcgtggtgtccaccggccccgagacggagcgggacctggagctggacacgcgcatgaacttccaccgggtgaagggcgactggacctaccgcaagggcgcgatgtggtccgtcttcacgcccttcgtcggcatggaccgcaacaacatcgacttcgggctcgcgcggcaggagggcaagacgtacacgctgggcgcccgcgaggtgctgggcatcgagctgtcctccgcgctcaccctccgcacgggtctggacctcgtcttcgagcacgagcgctacgacgtgtccttccccgcgccgggcggcatcgagtacgtgcccttccccggggccgagccggtgggccagcagttggaggagcagattgccctgagcgccttcgacggcgcgctcttcctggaagcggacctgctggtggggcgcttcaccttcacgccgggcgtgcgcggcaacctccagacggtgggcaacacgcggaacctggcgctggacccgcgactctgggtccgctacgcggcgacctcacgcaccaacctcaagggctcgctgggcctctacagccagccgccagagacgttccgcttcatcaccgcgccctacggcaacccggacctcgcctaccagcgcgcgttccagagcagcctgggcgtggagcaccgcatcaccgacgtgctcaacgtggacgtcaccggcttcttcaaccgccgcttcaacaacatcgtgtcgcccggccagctcgtcgccaacgagggcggcggcgtcttcacgctgccgtactccaacgacggcatcggccgcgcgtatggcgtggaggtgatgctgaagaaggagcgcgcctccgcgacggacaagtggtccggctggctctcgtacaccttcagccgcgcggaggacgggcgcgtggggccgccgccccagggcggaggggccttcggtggcggcagcgtgccggacgactccacctatggcctcagcccctgggaccagacgcacatcctcacgatggtggcgggctatgtgctgggcaacggctgggagctgggtggccgcttccgctacaccagcggccggcccatgacgccgctggcgagcggccatgacgtctacgacgcggaccgcaatcgctacaacgcgacgttcggtccctacttctccgaccgcacgggcggcttccaccagctggacgtgcgcgtggacaagagctggcggttccagagctggacgctcacggcctacctggacgtgcagaacctctacaacgcgaagaacgtcgagttcgtcttcaacgactaccggttccgtcgggagtacgaggtgccgggcatccccatcctccccgtggtgggtgtgaaaggaagcttctga

SEQ ID NO: 3848 - DNA, 198 bp, Myxococcus xanthus
atgaaccagtgcccgcgcggcaaggtcaccgtgctcgtctccagcgactccggccgcggcggcgccctggtgacggtggacccgaggctgcatcgagaggagctggtacagctcgtcgaacgccatgcgcgtggcgagcccacccgggaggcccccgtccccggcgacgtggaggcggagcgcgagggggcgacgtag

SEQ ID NO: 3849 - DNA, 1017 bp, Myxococcus xanthus
atggcgatggtcattggccacacgctggacgcggtgttgtcgccggtcgtgcgcgcggatgtgtgggtccagcactactggacctgccgaggcatcaccgcgcccctgttcctgatggtcgcggggtgggcggtggtcgcggcgctgggctcgaagcccacggcggcccgggacacctacggcaagcgggtgcggcgcgcgctgttgctcatcttcctgggctacctcgtccactggcccgggtggtccacggtcatccagatggggctgaccgagcggatgctgacgaaggtgctcgtcttcgacgcgctccagtgcatcggcttcgccctcctggtgggcgccaccctgctggcggtgacgccgggccgctggggacgcacggtgatgctggcggtggtcgcggtgggcctgccgctggtgagcgcgaccctgtggaccctgggcgaagggttgcccgggccgctgacccagttcatcggcagtggcggcgccagccgcttccccttcttcccgtgggccagctacttcttcgcgggcgccctggccgccagcctgctgggcaccctccgccccggcgtgccgcaggggctggcgctgctgattctgggcggcggcctcttctggttcatgcgcggacagaaccaggactggggcaccgccagcgcgtggctggtggcgtaccgcgtgggccaggggatgatggtgctgggcgtggtcaacatgctgccgcgcaaggtcagcggcctgctggcgcccctgggccgcctgtcgctctgggtctacgtcctgcacctgcccatcgtgtacggctggtccagctacgcgggcctgtccagccgcgtgggccccaccctgacgcttccggagggactgggcatcggcgtatcgctgctggtgggctgcgccctggtggcccgcattgggacgtggttgagggaccaggcccggccgtggcgcaccggctccaccacgctggaagccagcgtgggcagcctgggttcgcgcgggaactga

SEQ ID NO: 3850 - DNA, 1143 bp, Myxococcus xanthus
ttgcgccgcggcgtggagcgctggcagggcggccacccgtggatctaccgcgcggacctgaatggcgaccccgggctgcccggcggcgaggtggtgcgcgtgacggacacccggggatggttcctgggcaaggccttctattcgaagcactcgaagatttccctgcgctggctctccttcgacgacgtcgcggtggacgcggacttcttccgggagcggctcctggccgcggaccggctgcgccagttggcgctcccgggggagaagacgtaccgcctggtgcatggcgaggcggacgggttgcccgggctcgtggtggaccgctacggcgacttcctcagcgtgcagttcctggtccccgccatggagcagcgcaaggcgctcatcgccgacctgctccaggcgcagttcaacccgcgcggcatcatcaaccgctccgacgtgggcgtgcgcaacctggagggcctcaccccggagaagggcgtgctgcgcggcgaacatcccggcccggtggccttcgacgagggcctggtgaagatgcgcgcggacctgctggagggccagaagacgggcgccttcctggaccagcgcgagaatcacgtcatggccgcgcactatgcccacggcgaggcgctggactgcttctcctacgtcggcggcttcgcgctccagctcgccacgcgggccaggcacgtcacggcgattgaaatctccgaagcggcctcggcgcagcttcgggagaacgccgcggccaacaagctgaacaacctggacgtggtggtggccaacgccttcgacttcctccgcgacgcggtggacgagggcaaacgcttcgacaccatcgtcctggacccgccgtccttcgcgaagaacaaggacgccatcccagccgcggtgcgcgggtacaaggaaatcaacctccgcgccctgcagctgttgcggcccggcggcatcctcatcaccgccagttgcacgtaccacgtggacgaacaggccttcgaggacatgctcgcctccgccgccgcggatgcccgccgccgcgtgcaaatcatcgagcgccgcggcgccggccgggaccaccccgtgctgctcaacctgcgtgagacgcgctacctgaagtgcttcgtgctccgggtgctctga

SEQ ID NO: 3851 - DNA, 489 bp, Myxococcus xanthus
atgcggacgcgggactgggacgacgaggcggacgacgcgcccctgggtggcacccgcgagagggagcgcgcgctgaaggaagtgcgcgccgtctaccgccaggcggacgcggcctacgccccctactcctgcccggccagcggcgagtgctgccagttggccgtcaccaagcgccagccctggctgtggcagcccgaatgggagctgctgtcccgaggacgcccgctgccgccacctcgcgcggacggcggctgtccctacctggacgccacgggcctgcgctgctcggtgtacgcggaccggcccttcggctgtcggaccttcttctgccagcgcatccaaggcccctcacgccaacccgcggagacggtggccacgctgctggagcggctggagcgtgtgtctcagcgcgtggccccttcactgaaggctccgcgccctttgcttgactggcatgcggaggcctggcgcgcggcaacgaaagcttga

SEQ ID NO: 3852 - DNA, 1098 bp, Myxococcus xanthus
ctcgtcgcaccgcaagaattcaagggaacgctgtccgccgcggaagcggctgaagccatggctcgaggcctccgtgagtcctcgccggaagtggtgctggacgtggcaccgctcgcggatggcgggccagggacggtggaagcgctgctgacgggcctgcgcggcgagcgtcgtcagcaggtggtgcgtggaccgctgggcgcgcccgtggaagcacactgggccctggtggaggacggacgcacggcggtggtggagatggcctccgcgtccggcctgtcgctgctggcgcccgaggctcgcgatgcgctgaaggcatccacgtatggcaccggcgagctgatgcacgcggcgctggagtcgggctgcgaacgcctcatcgtctgcctgggtggcagcgcaaccacggacgctggcaccggggcgctcagcgccctgggcttccgcttcctggacgcgcggggacagcctcttcccccgggaggcgcggcgctggcccagctcgcccgcgtgggcgcgagtggccgtcatccccgcctgggcgccgtggagctgctgggtgccacggacgtcacctcgcccctcttggggccggacggagccgcgcggctctttggtccgcagaagggcgcggacgaggccggcgtggaagcactggaggcggcgttggcacacgcggcaacggtgctgggggatacgtccgcgggctggcccggcgcgggggcggcgggaggcttcggctttggcctgctggccctcgctggcgcgcgactggtgcccggctacgagctggtgtcacgcgcgctgggcctggagcggcgcgtgctgatggcggacgtggtgctgaccggtgaggggcgcttcgaccggcagacagcgctgggcaaaggcccgggcggcatcgcgaggctggcccgcgagcacggcacgccggtggtgctcttcgccggacaggtgcagcgggacgaaggcctggcgctggacctcttccacgaggtggtggagctgagcgccaacgcccagccgggcgaagcggcctcgaaggtgctgtgcgaagccgccgcgcgttgggcggcccagcgcctcaagggacgctga

SEQ ID NO: 3853 - DNA, 1296 bp, Myxococcus xanthus
atgggcgtacatgggctcttgtggctgaccctggagcgcgaggagccggtcgcgaggccccctccggcgtcctcgccgcctgccctggaatgggtcgatgtggaggtggcggaggcccgtgtatcgcgagacacgctgatgccggacaagggcccggtcgccggcgccgcccagccggtgccacccaagcgttcggacagcgtccatgcgccccctgcgccccgcacggctgcgaagcaccgggctccgtcggggaagccggcgccggagcgcgacgccgcgcccgctcaagcggagtcccggtccgagcgccacacggaacccacccacgcgagttcccagcccgcccacgacacgcaagtcgcccaagcggacgcgcggcctgaacgccacgcggaggcccaggactcggctccggcgctgctccgcttcgcggacgcgcccctgacggggacgccccccacggacatgccccgcgcggagcccggcaccaacgccgtcccgggctcgcggctgttgctcgcggcccgtcaggtcaccgcgctttcaggaacgcatcgcgatgtggcggcggagctcgacggcggcgtggacccgcatgcgcctccttcagcccagggcctggtggaagagctggtatccgaaagcgtgggccgaggccgggtggaacgcgggctggtgcacccgtattacggccagctcggcaaggcgttgatgaaggcgtgggacgccgaccgctccgtgaaggcgcacggcctccagggctacttcgacatgggcatggagcgcggccgtgcgtactcgcgcatctgggcggagcgcgcggcggactacggcgcgtcgggctcgttcgccgcgaagaacggcccgggcgaagaccggcgcaggccgctcagcaccgccggagaccccacgctcaatgcccgccgcgagctgcgccagcagatgcgtcaggagttccgcaccacgcgccgtgccctcatccgcgtcgtccaggacgcgacgggccagctcgtggacgtgcaccttctggaacccagccaccagcccgaggtcgacaaggaggccctcaaggacgtgcgcgccacggcggagaagctgcccccgccgccggacgaggccgtgggcggccgctcgcgactcaccagcgtctgggagttcgagctgctcatctccatcagcccgcccatccccaccttcagcttcgagttcgatgaagcgctcggcttcatcgacacccgactgccgctggaccgccgcatctacaagcgcgtgcggctggtcgaggtccgctga

SEQ ID NO: 3854 - DNA, 1390 bp, Myxococcus xanthus
atgtcctcgaaggccgaaaccctcctcgaagcccagagccgcctggtgtgggacttctggacggagggccgccacgtggacgtcgccgccacctacgccggccaggaggcgctcttcaccatcgagaacatccgcagaatcgaccggctgcgccagctcacggacgacgcccgcgaggtgcgtgccctcaccgcgctgcactcgcacttcgccggcgagtacctgtcccacgcgctggccgagttcaacgacgcggccgccaatctggaagcatccctcaccttccccgtggacgggaaggacgtgcgctaccgggacctggagcggctgctcgccaacgagcgcacggtggcgcggcgccgggccctgtacgccgcggccacgcccgcgattgaacgcctcaaccagacgctgcgccgccgagaggagcgcgcggacgagctggtgcgggagctgggcttcgcctcctacgaggccttcggcagcgagctgcggcagtcggacctgggacggctgagcgtgctggcggaggaaatcctccaggcgacacaggctccctaccgcgtggtgatggagcgactgagccagcgcgagctgggcatggcgttcaaggacatcacccgcgcggacatcccccgcctgttccgctcgcgcgaggtggaggacgccttccccaagggcgagtccctgctcaaggcccacgggacgctggcgggcatgggcttggacctgggtgagctgccccacgtcaccatcgacgcgcgggacgtgaagggcaagagctcacgccccctggcgctggcggtgcgcgtgccctccgacgtgcgcatctccttcaagccgggcacgggcgtgctgcaccaggcacgcgtgctccacgagttcggccacgcgctgcacgcggccttcaccacggagacgcgcttcgaactggcgcgcctgggcaaccccaccgtgggcgaggcctactccgccctcttcgaggacctggccgaggacccggtgtggctggaggagcacgcgggcgtcagcggcgagcagcgcgcgcagtacctggccgcgtccagcgcgcataagctgttcctcatccgccatgccgcgggccggctgctctaccagttggagctgcaccgccgcgtcgaggccgacccgaaggcgctgtaccgcgaaatcatgtcgcgcaccgacgacatcccgatgacggacgaggacaccgagcgctacctcgtggaccaggaggacttcttccaatccgcggacagcttccgcgcctggttcctggcgggtcagctccaggcgcagctcaaggcgcgcttcggccccgcgtggtggcgcacgtcgcaggcgggcgagttcctcaagacgctgtgggccaagggcaacgcgatgt

SEQ ID NO: 3855 - DNA, 309 bp, Myxococcus xanthus
atgaagcgttttctgtggctgtctgttttcgcggtggcgtcggtgtccaacgtggcctccgcgagtgaggagctctcgaaggccaagaactgctcgacgtgtcattcagcgacggcgcggctggtcggtccctcgttcaaggagattgccgcccgctatgcgaagcaggagggcgtggaggacaagctggcgcagcgcgtgcgcaagggcagcagcggtgtctggggcgccattccgatgccggcgaacgcccaggtgtcggaggccgaggcgcgcgcgctggtgaagtggatcatgacgcagaagtag

SEQ ID NO: 3856 - DNA, 390 bp, Myxococcus xanthus
atgctcttctacgcccactccgggctccgctatctggtgctgctggctggaatcctggccctcgcgtacttcgcttacgggctcgccacccggaagcccttcgacaagctggggcgcatcctgggctcggcctactccgggctgctccagcttcaggtgctgctgggcgtcggcgtgctggtgacgcgcttctattacccggcgctcatcgggcacatcgtgatgatggtgctcgccgccggcgtggcgcaggcgacgctgtccatcaaccgccgcaagccgcagccggccttcgtgctgccgttggtgggcgtggtggtgtccatcatcttcatcatcggcggcatcatggccattggccgtggcgtgttcaccacgacggcgatgtga

SEQ ID NO: 3857 - DNA, 1110 bp, Myxococcus xanthus
atgattcagaaccggtgggtctcgctgctgtcgctgtccgctttgggcgtcagtgcgctcacggggtgtgagcggacgccgccgtccgccgaggcgcccgtggccgcgccggaagcccagaagctgccggcgcccaagccgatgacggccgaacagctcgcgcacttcttcaagccgctgccccagcgcaaggacgcgccgcctccccccgaggacaccgacgcccaggtggcgctggggcggatgctctacttcgagccgcgcctgtcgaagaaccacgacgtgtcctgcaacacctgtcacggcctgacgaccttcggcgtggacaacaaggcgctgtcggacggccacaaggggctgaagggcgcgcgcaactcgcccaccgtgtacaacgcggccgggcacatcgcgcagttctgggacgggcgcgcggacacgctggaggcgcaggccacgggccccatcctcaatccggtggagatggccatgccggatgagaagcgcgtgctggccacgctgacctccatcccggagtacacgaagcgtttccgtgaggccttcccgggcgacaagaagccggtgaccatggccaacaccgcgcgcgccatcgccgccttcgagcgcaagctcgtcacgacctcgcgcttcgacgccttcgtgggcggcaagcacgacgcgctcacggagcaggagcagcggggcctgcagctcttcgccaccaccgggtgcaccacctgccacaacggccccgccgtgggcggtacctccttccagaagctgggcctcatcgaggactacccgggcctgaaggacgcgggccgcttcgacgccacgaagaacgaggatgaccggggcaagttccgggtgcccacgctcctcaacgtggacaagacggggccgtacctccacgacggcagcgtggtggagctgccgcagatggtgcggctgatggcgaagcaccagctggcgcgcacgctgacggacccggaggtggacgacctggtcgccttcctcaagagcctcacgggggagctgccccccgcggagttcatcgctccgccggagcttccccccagcaccgcgaagacccccaagccggacccgtcttga

SEQ ID NO: 3858 - DNA, 492 bp, Myxococcus xanthus
atgcccacgattgcctgggtgctggtgtccggcctggtgggcaccgcgctctcccggcgggagggcaggcgggtgctgcgccactggcgtgagtccatggcgcgcggccaggttcccgaggaaggcattctcagtggcgtgctggtgctggccggcggcgtgctgctcgtcatccccggcatcatcaccgacgtcgtggggctgctgctcctgctgccgcccgtgcggcgcctcatctccgcgcgcgtgcgtcgcaccctggagcgcaaggtgcgtgagggctcgatgcacgtcaccaccttcggtggcggggcgtttgggggcggcttccacgcgtccatgggaagcccttttcccggaggccccgtgccgcgttctccgcggactggtgcgctggagccggacgccggcggcaccgtggcccgccggcctcaggggccgcagcaggaggtggatgccgagttcaccgaggaggagcccaggcggagctga

SEQ ID NO: 3859 - DNA, 504 bp, Myxococcus xanthus
atgacgccgggctcgccttatgaggcggcacgggtggatgccctcctttccgagcggggtgtggtcgcccggccggacggcgtgcgcaggtggtccttcaagaatggcgacgtcgacatcggcgagctgcgtgagggcggacaggtggtggccaccgagctgcgcgtgccgttgtcggaccgccccgacctgatgcgcgaggccgtggaggccgcggcggccctggcctccgaggctggtgtccggctggtggacccgcagctgggccgctcgctgaccggcaatgacgacgccggagtgctggagcagtacgtccgcacggcgcgctacgcgggcgaggtggccggcgtgcccgaggcgatgggcgcgggcagctacgcgctggagacggagggctcccgcggcttccagctctccacgcgcatggtcctcatcgccattggcatcttcgtggtcctgtacctggtggtggacaccctggtggggcagctcggcgggcgctga

SEQ ID NO: 3860 - DNA, 1152 bp, Myxococcus xanthus
atggagcccaacaaggaccccttcctgctgacgcctcaactgcccgcggccgcggcgcccgtgcgtcatccctcaccgttcccctggaatcaggtggcgctcgtgtttccatcaccggcgccggattcggtgtcggtgctcacgctgaatgacaagctctggcggctggagctgtccggctccgaggtgcgccgcgtcgaggtggatgacgagtacctggagcaggtctccggaggcgagctgcaagggatgcagcctccgtcacccacgcacctggcgtacctccagagtcgaagcctggtgatgtacgacctcaagtggcaactggccaagacgtggttcatggtcgagcgactggaggaggtcgccatccgcggcgcgtggatttctcacgccccgctggtggtggcggcggagctggaggacaccacgaattatgcccgcacctcccgcatctccttccggctgcgcacctggcggctggagggtgaaaagcgcgcgaagttgggctcgctggagctgggctccgtcgtcggcgcggtgaagtgggacgcgggggcggggctggtcgcggtgcagaagcccggcgtgccgctggagctctacgggcctgacctggccaggccccagccggagcacccgctggcgctcgcgctgcgcaagctgacggtggatggcctcacgttgcagtcgctgcgtttgcatccctcgttgccggtggcgctcgtggctctgggccgtgacgtgacgccgaagcgggaggaggggaaggagaagcccgaggaccctggcatctggcgcgtgtcgtgggaaggcgcgcccgcggtgacggtgcggctagcgcgctatgcctccggggagtcggtgacgctgggctcgttgtcgcccgagggtgactggctctactaccgcgtcctgaacagcgcgggccgcaacccgcagctctacgtgcagcaggtgggcgcggccttcaagccgcccctggcgctgggcgctgttccggagaagggcgcggcgctgctgtggacgggcggggctccgtcgctcgtcatgtatgacgggacgaaggacgcgctggttcactggaagctggcgggcgcggcggcaccggagaagcctcccgcggcgccgcccaagccagacgggaagtga

SEQ ID NO: 3861 - DNA, 1749 bp, Myxococcus xanthus
atgcacatcatgagcggtaactgcacgcccatgcccgcgctggtgcagatgatgaaggacaagggcctgggctttctcatcggcacgggcaccagccgcaccaaaatcaaccgcctgggcttctgggcggcgaaaatcccgttcgcgcccgacatcggtgatgtgtcccaccgcgacacgcaccgcattggtgaagaggccgtgcgctccaatgacagccttgcccaggaccggacgggatacacctcggatggaatgggcaacgtggaggagtacaccatccccgcgcccctgcgagcctatgcgtccacgcagggccacgcggaggccagcgcttcctacatgggcatgtccatcgtcctcaccatggacatggattactgccacctggctggctaccagggggaccctatctacagctcggattttgatggggccgagccccgcttcacctatcgctggcgcacgaagtccgacgaccctggcgagctgattgaagcgaagtccgatgagatacggcttcacgagacgtgggaccggcagctccggcacaccgagcaggtggtcgcggagaatcccttccggttgctgcccatgtttcatttcgaaccgcgccgcttcatcaagaacgaggacaagtcgttccccttcgaaaaggtggtgacggcctccaaggcggctccctacatcggcttcaagatgtacacgccccagggctacatgcccaaggagcgccatgcgccggtgaaggacatcctgagctggttcttctccgagtgcgcgtcgaacgacatcccgctgatgacccactgcacgccgtccggcttctacacacacgagcggcgcttctacctggaccacgagccggacgaggccatccgaaacgacccgaagtactggccctcgaaggacgccatcgccaccgcggacgcgaacatcaccaaggcgcgcgactacgtgacggagctggaggcgagctggaagagccacatcccgctcgtgctccgccgcgcgcgcaatggcgtggaggacgccatcgaggccaaggagaagctgctgaacccgggccggatgcgttacttctatgagaactacgtgcacccggaagcgtggcgcccggtgctcaatgacaatccgaagctgcgcttgtgcctggcgcacttcgccagcgacggcaccttctgggacatccgcaaggggttgaccgtcaagcaggatggccagaaggtccagtacgacaagagctggattggctccatcgtcgagctgtgcaacgagttccccaacttctacacggacatctcctatctggacctgatggagaagcagaagtggaagctgctggctgacatcctcaagtccagtccgtggatgctgaagaagatcatgttcggcaccgactggtacatgattaccgccgagcccgtggcgtacgcggcttggtacagccgcaccatccgcgggctggagttcatccagaaggagctgccgacgcaggtgaacctcttcacccagttcgccatcgtcaatcccatgcgctactaccgcatgatggaggtcgccccgaagatgaaggagggcctcaagaagcttcaaacggacctcaacgtgacgggcgccgcggtggacaagctcgaggacaacttcacgacgctgatgcggctgcagcacccgctggagcagattgacaaggcgggcggcctggccagcggtcccatgttgttcaccgcgaccacgaaggcgaagtag

SEQ ID NO: 3862 - DNA, 2502 bp, Myxococcus xanthus
atggccgctcaattcaatccgcctgcgttcacggtgcaggtcggctcacacggcgcggatgcgctgagtgtttcgagcatttccggcaccgaggcgttgagccacctgttcgacttccgggtggacttcttcgccaaggatggcaaccccatcgccaccagcgagctgctggagcaggacgcgttgctcaccctctccatccgcgacagtgcgccccgctacgtgcacggctgggtccgcgaggtggaatcgctgggcatgaagacgggccgccgccgctaccgggcgcacgtggtgccccggctgtggcggctcacccagcaccaccgcagccgcatcttccagcagaagtccgtgccggacatcctcaaggacgtcctggacgcggcgggcgtgaagacgcggctggccctgtccggcagctacgccccccgtgagtactgcgtgcagtaccgggagagcgacttcgccttcctcagccggctcatggagtgggagggcatcttctacttcttcgagcacaccgaggaggggcacaccctggtgctgggggacaagcccagcgcgcacgcgcccctgccgcagggccagcagctcccgctgcgtcccagcctgggcaaggaggtcgtggagggtgagtacctctccgcgctggaagtggtgcaccggctgcgccccggcgccgtgcacctgaaggacttcgacttcgagaagccaggcctggatatctccggcaaggcgcaggcgcccgaaggtgtcacggagctggagctctacgactatccggcgggctacgtggcgccgggcgtgggcaaggcggcgaccaacgtgcgcacggaagcggcgagcatgggcgggcgcacgctgatgggccagggcgtggcgccgcgcctcacgcccgggtacctgctggaggtgcagtccccggaggatggcaccttcgcgggcgagtacctggtgacggaggtggtgcattcgggcacgcagccggacgtcagcgcgggcagcgaggcgattcagggcctgtaccgaaatcagtaccagctgttgcccaaggccgtgcccttccggccccggcgcctgacgcccttgccgcagcttgcgggcccgcagacggccacggtggtgggccccgcgggcgaggagattcacaccgacgagcacgggcgcatcaaggtgcagttccactgggaccgcgagggcaagcgcgacgagaaggcctcgtgctgggtgcgcgtgggccagccgtggggcggcccggcctggggtgacgtgtggctgccgcgcatcggccaggaggtggtggtgcgcttcctggaaggagacccggaccggccgctggtggcgggcgccgtctacaacggcaccaacaccgtgccgtatggcctgccgggggagaagacgaagtccacgcgcaagagcgcctccagcctgggcagcgacggcttcaacgaggtccgcgtcgaggatgcggtgggccaggaggaggtcttcacccacgcgcagaaggacgaggacctgctcacggagaacgacaaggaccagcaggtgacgggcttcgaggacctgctggtgaagaaggaccgcaagcgcacggtggagggaaaccaggagctgcgcgtgggcgtggacgacgtgggcgtcgtcgagcagaaccagacgttgctggtgcagggcaaccgctccacccggacgacgctgtctcacgacgaggaagtggagggcaaccagacgatgacggtgggcggtaacctcaccgggctggtgctccagggcgccatggagaacgtaggggccgcgaaggccaccaccattggcggcgtctacagcgtcaacgtggcgcttgcctacaacgaggccaccggcggcgcgcgcggcctccaggtcgccgccgcgcacaccgagcacgtgctgggttcgcggcaggagacggtcggcaaggacaagacggtggacgtcggcatggactgggacttgcgcaccaagggccagctcacgctgaccatcggcaaggactgggaagaggacatcgggaagaccaccagcctctacatcaccgaggccatggcgggcctggccaagaagttcgagctgaaggcagacaccttctcgctgctcgtcggtgacaacctcatcctgaagatggagaagtccggcaaggtgaccttcaccctcaagacgctcaccgtcgacggcaaggaagtgaagatcaagggcggcaaggtgaagatggaggcggctggttcgctcaagagcgactcgcgcaaggcgaaggagctggagcacttcaaggagccagaccccgtcaacgtcgagttcaacctcaagggcatggacggcaagcccatcaaggaccagcccttcgagctgcacatgcccgacggcaccatcaagaagggccgcgtggacgggagcgggaagggcgtggtggagaaggtgccgcccggcgactaccgcgtcgtcttcccggagatgtcaggccgcatcaacaagggttcctga

SEQ ID NO: 3863 - DNA, 828 bp, Myxococcus xanthus
gccgcgttcggcatcgacgtgcaggtggccttctgcacgccaggcgccagtctcttcgtgcccggcgcggtggaggacacccagcgcgcgctgcgctggctctacgcgaacctggaccgggtgacggagctggtgttctcgctggacacccaccgcgcgtaccacgtgttccatccgtcctggtggcgggacgcggaaggccggccgccgccgccattgacggccatcaccgcggcggacgttcgctccggccgctggcgggccacgcgcttccacgaggagagtctggcctactgcgagcaactggagtccagcggccggtacgtgctcaccgtctggcccttccacgcgatgctaggcggactgagtcacgcgctggtgccgtccgtcttcgaggcgagcctcttccacgccctggtgcgcgacgtacccacgcacttcgagctgaagggggagcacccgctcacggagaactactccgtgctctcacccgaggtgacggagctgaaggggcagcaggtcggggccttcaacacgcgcctcttcgagcacctgatgtccttcgaccgcgtctacgtgttcggccaggccagctcccactgcgtgctgaacacgctgctggacctgcggcgtcacatcgagcggacggacccgtcgaagatgggccgcatccacatcctggaggacgccatgagtccggtgccggcgcctcccctggagccgctgcccgcctcgttggacttcccccggttggcgaaggaggccctccgggacttccaggcggcggggatgcgggtggtccggacctcggacccgctggaagggtag

SEQ ID NO: 3864 - DNA, 1332 bp, Myxococcus xanthus
atgccgctcgacgtggcggccttcgtcaagtcgctcatcccggagcccaaaccggaggactacgactacctcagccggtacgactatgagatgggcgtggggttcaaggcggccatcctccgccgtgagaaactcagcatccgcgccatccccaagggcgcactcttctatccgcgcgagcccatcctcacgctgacagggccgtccgccctggtgtcctgggtggagccactgctgctccagctcaacttccgcatccaggtcgccaccctggcgctgtcggaccgggacgcgctggcccgcgcgctggccaccgtgacgtgcgacgagcagaaggccatcgcgctggagacgctcgactcggtgggcgtgaaggcggtgcccatcaccgtggacacagagggctacgccaagcgcgtcttcgccaccgtcaaggagctggtggacatcgtcgaggacccgtcccgcatcttcgaggtgggcctgcgcgcggccacctgtctggagcagcacgaggtggcgctgcgaagctgcaaggacgcgggcgtcacgcgcacctccaacgtggacggggcggcgaagctgggaatggtccccgtgggtaccatgggacacgagcacatccagcgctatggctcggatgaggccgcgttccgggccatgcgcgagcgccggccacagcgctccagctacctgctggacaccttcgacacgcttacgtccggaatccccgcggccttccagctcatccaggaggagcccggcaacaacgactccatccgcttcgactccggcaacaagaagctccagtacctctacgcggtgacgcgggcgcgggacctggggattcggcccgtcaacatcctggaggacggactggacgcggaggccacgcgggagttcgaggagctgcggcggcaggtgggctgggagccgtcggcccagttctacggctacggcggccacatcatcgcgcggaccatggactgcccgctcacccgggacaaggtggccgccatctacaagctgtctcgcacgggcaacacgccggtgatgaagttcggcaacgagttggccgagggcaagaagagcatccccggcgagcccgtcctcttccgccgccgccatggttcggggcccatcggactggtcggccaggtgggagagcccgtcccggacggctacttcccgctcatggagagcgcgccggaaaccccatcgctggtgggcgcgcaggagacggcggccgaggcgcgtgtcgcctacaccgccgcgacgcaggcgctggtggatgcgctgcaccgccgtcacttcccgcagcagcaccgctga

SEQ ID NO: 3865 - DNA, 738 bp, Myxococcus xanthus
atgaagaagccaatccagaccacatcccaggcgcacccgtggcacggaatcaccccgggcgaggacgcccccgaaatcgtcaccgcgtacatcgaaatcgtccccacggacgcggtgaagtacgagctggacaaggagtccggcatcctcaagctggaccgtccgcagcgcttcagcagccagtgtcccacgctctacggcttcattccgcagacgtactgcgacgagctggtggcgaagcgctgcgccgagcgtacgggcctgaaggacatcaagggcgacggcgaccccatcgacatctgcgtgctgacggagaaggtcatctccagcggcaacctgctggtgcgcgcgattcccattggcggcttccgcatggtcgacggtgatgaggccgacgacaagatcatcgcggtgctggagtccgacctggtgtacggcgagctgcagcacctcgcgcagcttccgcgcgcgctgctcgaccgcctcaagcactacttcctcacctacaagcagattcccggtgaggggaagcgcagcgtggagatcgccgaggtctacgaccagccggaggcgctcgaggtcatcaagcgcagcatgaaggactacgagcgcatctacggcccgcaggtcaccacgaaggcgcgcgctgtccgtacgcgtggcgcggcggtggaggcgaagatcgccaagcccgcgaaggccaagacgaaggcggcgcgcaagtcgcgcgcgtcctga

SEQ ID NO: 3866 - DNA, 830 bp, Myxococcus xanthus
gaactgagcacggaggtgccgccgcccgtggcttttctccccgtgggtcgtccggtatagaccggggcatggcgttcatcgcgttctccaccatcaagggcggcgtcggcaagacgacgctctgctcgcatgtggcggcggccctcgcggatgccggccgccaggtgctgctgctggacctggacccccaggcccatgcgtcgctggtgctggggctggagagccgggaaggcccgtgcgtgggggatgcgctcgggccccgtcccaagcacacgctggcgcaggtggtcgtggcttcaccgaagcggcccggcttgttcatcgcccccgccgcgccgcgcatggccgcgcaggagcgcgagctgtttcagtggggccaccgcctccaggcgattcctcgcgcgctcaagacgctggggtggacgccggacatcatcctcgcggacaccccgcccagcatcggcgcctacaccgaggccgtgctcgcctccgcggacctggtcgtggcccccgtgcccaccggcgccttcgcgctccaggggctgggggaaatcgagaccgcctggcgtgacgttcgcgagcagggcggtgagctggtggcggtggtgaatctgtgggatcgccgcaccaccgcgaccaacgaggccatggagggcgcgctgagcgagtccaccgtgcccgtcctgcgggctcggattccgcgatcggagtccatcaaccaggcggggctgggctacgaggtggtgttcgacacgagcccgcaggcggccggcgtggaggagctgcgggccctggcgcaggagttggcgaagcgcgtggggctgcgctga

SEQ ID NO: 3867 - DNA, 972 bp, Myxococcus xanthus
ggacgccagtccctctactccgccctgcgacgtttcttcgctgcccacggctacctggaggtggagacgccgctgctcatccccactccggggatggagccgcacatcaacgcgttcgaggccggcttcatcccggagaccgatgtgggctccgcgcggacgctctacctgcactccagccccgagtacgccatgaagcggctgctcgcggacggtgccgggccgttgttccagctgtgcaaggtgttccggaatggggaggtgtccccgacccacaatccggaattcacgatgctggagttctaccggcctcacgcggactaccacgccatcatggatgacctggaaggggcgctggcggaggccggccgcggcgcgacggaaggggagcccggggcggacccgctcttcttcacacgcaccccctacgagcggttgacggtgcgtgacgcggtgctgcgcgccaccggcgtggacatccgccagcattcggatggcccatcattgaagcgggcggcggaggcggccggggtgcgcaccgggaacgcggagacgttcgacgacgtcttcttccacctcttcctccagaaggtggagaccggcttgggccacgagcggcccaccttcctcattgagtacccggcgtccatggcggcgctgtcccggctgaagcccggtgacgcggtggtggcggagcgggtggagttgtacgccaagggtttggagctggcgaacgggttttccgagctgacggaccccgtggaacagcgggcacgattgacagaagaacaggagctcaggcgccaattgggccgggccgtgtatcctctggacgagcggttccttgacgcggtagggcgaatgccaccctcggcgggcatcgccgtcgggctcgatagaatcctgatgctgctgctcggggtccagcgcatctcggacgtgctccttttccccgcccacgagttcgtttga

SEQ ID NO: 3868 - DNA, 231 bp, Myxococcus xanthus
atggacttccgggaggggcccatgatgctgcacggcgaggtggtgtggacctccacggtgccccggaagaactcggggacggtggcgccgggcttcggcgccaccttcggccggctccggccggacatgcagcagcggctggaggggctgttgtccctggccacgctgccgcccgtcccctggaaggcccgggtgagcttcggcatggaggccgtcgcgcggatgccgtga

SEQ ID NO: 3869 - DNA, 2316 bp, Myxococcus xanthus
cttcatttcggtaaatacaagctgctcgagcgcatcgcgacgggcgggatggcggagatctaccgcgctcggatgactgcggcggcgggtgtcaccaagccggtggtcatcaagaaaatcctcccgggctatgcgggcaacagcgccttcctgtcgatgttcgtcaacgaggcccgcatcgccgcggggctgagccacggcaacatcgcccaggtcttcgacttcggcgaggtggacggcgagtacttcatcgccatggagtgggtggacggccgcaccctgtcgagcgtcatgcggcgcgcgcgggagaagggcatgtacaccctgccccagccgctggcgctgctcatcgccgtggagatgctggaagggctgggctacgcgcacacgcggctggatgaacgcggccgaccgctccacatcgtccaccgcgacgtcagcccgcagaacgtgctgctcagctacgaaggccaggtgaagctggtcgacttcggcatcgcgcgggcgcggctggccggcagcgccgagccggtggagtacgacctcaagggcaagtacacctacttcgcgccggagcaggtccgcgggcgcgagcccgacgcgcgctcggacatcttcgccgcgggcatcgtcatctacgagatgctgtgcggccgcctccccttcgaagggaagatgccggacgtgctgcgcaagctcgccctgggcgacttcccgcggccccgcgacctcaacccaggcatccccaccgcgctggagcgcatcctgctcaccgcgctggccgtggagcgcgagcagcgctacgccaccgcggaggccttcgccgaggccctcacacgccacctccacacggccgggcccgacgtgtcctccagcgcgcgcgctcacttcatgggctacctcttcgaggcggagctggtgggcgaaggccgccccgtgctgctgccccgcgagttcctggcgcagatggcccggtggacccagtcccccttggagcgccgcgccctccgggagatggcgccgcccgtccgtgagccgcccgatgatgaggaggagcggacccccatcgccgagttcgagctgcctccctcccaggccgccgcgcccgtcgaagggcggatggagcgcacgacgctgacgctccccgcgctgcccggccccggagcgccgcccgagcccggtgtcccgcccctggacgcggcggcatcgcggacgatgggcatgccccgggccgtcaccctgggcgcgcccatcatcgtggcgctgacagccacgctggccctgctggtgtcgaacagcacgggcaccttctccgtggagctgagttcctcccctccaggcgccgccatccgggtgaacggccagccacagaccgcgcgcacccccgccctgctcacgcagctccccgcggacgcggagcacctgctggaggtccaggtcccgggcatggtggcgtggagtcagacggtgcgcgccgagcgcggcaccaccctggccgtccatgcccgcctgctccccaagcggattcaaggccccgcccagcagccacaccgcgccccgccgcctcatgaggtgcggatgcccgccgagcggatgtccctgtccagcgtggtgcacgccttccgcgtgccctacctctccaccgcgcagatgcggctggacccgtcgcgcacctacagcgtccgggtggagggttcggcctcgctgggacatgccaatacggtggaacacgccgggtacttcctggagggagacgcgcgtctggcggcacgcgagtccttcggcgtgctggacggcgaggagcggctggtgcgccacgcctcgcgcctccacgtcttcctgctggacgcgaaccgcacggacaaccacggcacgctgatggtccgcgtgcgcgaatgggacaacgacggcgccgtcaccaccctgcgggtggacgcccggacgcacgcggtgaagctgtcgcgcgtcgaccgcttcctgctgcgcgggctggagccggacacgcactacgacgtcgtgctgcgggacaccgctgagtccgcgcgcacacggggcttcgacgggggaccggtgggccgcgtgctgggcctgtacggcgccggcgagggcccggagaccgtgtccggcctgctgacgctgctggaggtgggccgccccctgcgcctgcggggcgccacctggttgcagctcgcgttccccgacgaccacctggccgacaacaccggcagcctggtgctggaggtatcgcccgtgacggcgcccggcacctcgcccgctcccccaccagggccgcccgctcccgctcccaaccggtaa

SEQ ID NO: 3870 - DNA, 207 bp, Myxococcus xanthus
atgaagaagctggtggcggtggccgtgttcggcctgatgggaaccctggggatggccgcgcgcgtggacgcccggccgggagtggacgggatggagccaacggatgcacaggtcgaggcggcgctggacgcgcggcagaagctggtgctgggcaacctcctccgggttcagcaaacggacgcacgcacggcggcaatccaccggtaa

SEQ ID NO: 3871 - DNA, 951 bp, Myxococcus xanthus
atgcctgaagggtccgcgtcactccagctcgcggttggcgaccgggtcgtctatccgaaccagggggtctgccgcgtctccgccatcgatgtgaaggaagtggcgggacagaagctcaccttcgtcacgatgcgccgcgaagaggatggcgccgtcgtgatggtccccgagggcaaggtgctcgccatcggcgtgcgcaaggtcgcatccgccgaggacgtggaggccatcttcaccttcctccgctcggacagcgacaaggccgacctcgactggaagcagcgagcccgcaccaacctggaccggatgacccaaggcggcatcatgggtctggccgaggtggtgaaggggctccaggttctcagtgagctgcgcccgttgccgaccaaggagcgcgagctctacgacaatgcccggcacctgctggtgacggaggtcgccgccgcgctgggcactgccgaggtcaacgccgaggacgccatcgacatcgtcctcttcccgcccggccgcgagcgccccaagcgcaccgcagccgagttccagcgcgaggaaggcgacctggacctggacagcgatttgctgggcctggacagcgacctggacctgccgtccgacgaggagccctccgagccgtccgaggaggagtccagcgaggaaggcgagtccgaggaggccgcgtcctccgaggagagcgcccccaagaagcgcggccgtccgcccaaggccaagacggaggcgcccgagggcgccgagccccctgctccgaagaagcgcggccgtccgcccaagcccaagccggaagccacggcggagggcgccgagccccctgctccgaagaaacgtggccgcccgcccaagcccaagccgcccgaggtggaaggcgccgcgcccgccgcgccgaagaagcgcggccgtccgcccaaggtcaagccgcccgagggtgagagctga

SEQ ID NO: 3872 - DNA, 390 bp, Myxococcus xanthus
atgtccgagccgctggatgcggagaagctgattgatgaggtgaagggcatccgttcctacaaggacgacaaggtgctgctcctcaccacgcgcaagctgaaggaccgcgagcttcccagcggcgtggcgcccacggcgggcttcgcgcgccaggggaaggaccgcgccatcctcaccatcgcgccgcacaaggatttggagagcgccttcaaggccgtctcccgccacgcgctccaccagttggggcacctctgggagctgcaccactgcctggacccgcgctgctcgatgtacccgccctggacgccgtccttcgcccagggtgaagccatcttctgcaccttctgccgcgaaaagagcgagcagaagattcgccttgcgaagtcctag

SEQ ID NO: 3873 - DNA, 342 bp, Myxococcus xanthus
atgcacgcgccgggcggcaagcagcggctggtggcggagttggacggcgtgcccggtggcctgggcctgcgcctggagggcggcatcatcttcgagcacgccttccccaaggactcgcgcttctccaccacgcacctgggcgtggatgacgcggcgaacggtgcgcggctgctgtcgctggcgataccgccgggcctggagggcgtgcagaaggccgaggtccggctccccgagggcgcgccacacacggtgaaggtctgggtgcaggcggacaacgcggaccggcggcaggtgtgcctggacgtgctggccgtggagcccgaagtgggagtgcagggatga

SEQ ID NO: 3874 - DNA, 1512 bp, Myxococcus xanthus
atggcggcgctgattcccgcgctgtccttcctgctgggcagcgccatgtacggccgcctcgcggggctgttcgccgccttcgccttcatgctggtgccgcggcagtacttcaacgcggagatggcgtgcttcgacgtccccgtggccgccatgtggctgctcgtcgtgtactgcttctggcgcgccatggaggacgtgcgctggggcctgtggtgcggcgtggcctttggcctgacgctggccaccaagcacaacgcgctgttcctccccttcgtactcacgcccttcgcgctgtggcgcgcctacagcgccagcgagggtcagccagaggcccgcgcctggctgggccgcttcgtgggcgtgttcacggcggtggccgtgttctacggcctgctggtcctgtcgctgggcggcggtgagggcttccagcggaagttcctgctgctcagtccgcacacgctgctgttcgccgggctcgcggtgggcggcgcctgggtgctcaagggcgtggacaaggtgaacgcgcaggtggcgcgcgcgctggtgcccatcgccgccatggcggtgctggggcccgtcatcttctacctgcactggccctacctgtggcaccagccggtggaccgcaccgcgtggtacctggcctttcacgccaagcacaaccactacgcctggttctatctgaaccagttgctgcgcgagccgcccttcccgctcgcctacgtcgtcgtgaagacagcgctgacggtgcccaccagcatcttcgtccccatggtgacgggcctggcggcgctggtggcgcgcatggtgctgggggccttcacgcggacgcgcgcgtgggtggagcgcccggtgacgatgacggaggcgctggtgtgcgtgaacgcggtggcgtccatcctcatcatcagccacccgcaggtgccgcacttcggcggggtgaagcactggttcccgtccatggtgttcctgggcatcctcgcgggcgccgcggtggcccggggctgcacggcgctgtgggagcggctgaagatgaagtggccctcattgccgcaggccgtggtggccgtgccggtgttcgccatgctgctggcccccgcgctggtgtactcggtgcgcgtgttcccctacgggacggcggcgtactcggagctggcgggaggactgccgggcgcggccacgctgggcatgcagcgccagttctggtccagccatgtcaccggcgtgctgccgtggatcaacgcgaacgcgaagcagggcgcacgcctgttcctgcacgaggtgcacggcggctcgttccgcgactaccagcgcaacggcatgctgcggaaggacctgcgcgcggtgggcagcccggcggacgcggacatcgtcgcgtaccagtaccaccaggagttccgcgagcacgagttcctcacgtggcaggccttcggcacgcgcacgccggtgacgggcctctacctggatgagacgccccaggtggtcgtctacgtccggccggagacgcggtag

SEQ ID NO: 3875 - DNA, 99 bp, Myxococcus xanthus
atgaaattcctctacggttacgtcatcgccgccacgggaacgaagcgcaacgggtggatggcctatgacgccctccaggtcagctctggctgtccctga

SEQ ID NO: 3876 - DNA, 420 bp, Myxococcus xanthus
atgctgtacacagtgtccgagaagggcgtcatccggcagctcacgctgacgcgggagaaccgctccatccgctgtgatgcgaacaagcccgtggcgcacacgagcttccgcatccccgttcaggaggggaaggtccgcatgtacatcttcttctccgacgaccgcatccccgcgggcccggtggcgcagcagctctacgagcttcggagccaggagcgcatcaacgccatggacctgcgcctgcccggccgcgtgttcgtggagacgttggagttcacccccgaggaaggcggcacgcccgtgacgggcaccgtggtgggcgcgggaggcgacaccgaaccggagggcacgggtgccccggtgctgtcggatggtggcaccgagggcagcggcatgggcgccatggacgaagcgccctga

SEQ ID NO: 3877 - DNA, 375 bp, Myxococcus xanthus
atgactccggagcgtcgaaagtaccttgtcgtgggcgggctggccacgctgttgctcatcctcgaccaatggacgaaggtcctggtccgcgagcacgtgaagcccctgggctacaccggcatgagcgtcttcggcgacgtcatccgcttccagtacgtggagaacaccggcatcaccttcggcatgttccggtcgctgccctacgcccagctcatcctcagcgcggtggccatccccgtcttcctgctggtcatccacctggtccgccagacgcccgcggaccactaccggctgcacgtcgcgctcggcctcgtcggcgccggcgtcggcaacctgattgaccgcgtccgcctgggcagagtgagaaaccgtaga

SEQ ID NO: 3878 - DNA, 1248 bp, Myxococcus xanthus
atgaagctgacggatgtcctcgcaggatgtggtgccgagcagacctcgggcggccgttccgcggttgacgtcaccggcgtgacgcacgacttgcggcgcgtgaagccgggagacctgttcgtcgccattcctggcacgaaggaggatggggcccagttcatcggtgaggccgtgtcccgtggcgccgtggcggtggtgtcggagaagccggtgccgtcctctcaggtgcccttcttcaaggtgagcagcgctcgaaaggcgctggcgctcatcgcggccaacttctacggccgcccggcggaccagctgacgttgctgggcatcaccggtacgaacgggaagacgaccaccagctacctgctggaggccatgagcaccgcagcgtacgcgtccaccggcgtcatcgggacgctgggctacaagttcgctggccgcacggtggagtgcgccaacaccacgccggatccgctggagctgcaccgcatcctccgggagatggtggaggcgggcgtggagacggtcatcatggaggtgtccagccatgcgctcgcgcaggagcgcgtgcacgggttgaccttcaaggccgcgggcttctccaacctgagccgcgaccacctcgactaccacaaggacatggaggactacttccagtccaagcggaagctcttcgcggagaacctgtccgccacgggcgtggcggtggtgaacggcgacgacacctacgccagccgcatctacaacgagcagcgcggccagaagcgcatggcgtggaagttcagccgtcagggctccggggagatttccgcggccgacgtgagcttctcgctccagggcatcaagggcgtgctgaagacgcccgccggcgacatcccgctcaagagcaagctcctggggccccacaacctggagaacatcctcctggcggtgggcattggcctgggcgcgggcttcgcgcggcgcgacgtgcaggaaggcatcgagcggatgatgccggtggccggccgcatggagcgcgtggagaactacggtccgtctggcgcccccgcggtgctggtggactacgcgcacacggatgacgcgctcaagcgctccatcgaggcggcgcgctcgctggccaagggccgcgtcatcgcggtgttcggctgcggcggggaccgcgacaagggcaagcgtccgctgatgggcgcggtggcgggtgagggcgccgacctggccgtcgtcaccagcgacaacccccgcaccgaggac

SEQ ID NO: 3879 - DNA, 1905 bp, Myxococcus xanthus
gcggtgcagctccaggtcttcgagcaggagaagctgcgcggcatggcgcaggaccagtacgtccggcacatcgagattccggcccgccgcggcgacatcttcgaccggcgcggcacgccgctggcccagagcgtggaggtggactccatctgggtggacccctccatgctgcccgacgtgaaggccgcgtcccgggcgctggccaaggcgctgaagctggacccggacgagctgggcgcgcgcctggcccgggccaagcgcttcgcctgggtgaaacgccaggccaagcccgccgaggtcgccgcggtgaaggcgctggcgctgccgggcatgggcttctccaaggagcccaagcgattctacccccagcgagagctgggcgcccacgtggtgggcacggtgggcatggacggccgcggcctggagggcctggagttggccttccaggacgagctgtccgggcagaactcctccacctccggcttccgtgacgccaagggccgcaagctgctggtgcagggcgcgttggatccgctccagcgccagggcgccgccgtcaccctcacgttggaccgccacctccagtacgtcgcggagaaggcgctcagccgcgcggtggaggacgccaaggccgtggccggcatggcggtggtgttggatccgcgcacgggcgagctgctcgccgtcgccaaccacccgcgcttcaaccccaatacgccggagtccagctcgcgctcgggcatgcgcaaccgcgccgccctggacaccttcgagccgggctccacgctgaaggccttcgtggtggccgcggcgatggaagagaaggccatcaccgccgacagcctcttcttctgtgagaatggcgcctggcgggtgggccgccataccatcaacgacacccattcctacggctggctcaccccgcagggcatcctccagaagtcctccaacatctgtatggcgaagattgcccaggccatgggacgggagaagttcgtgaagggctaccagtccttcggcttcgccgagcgcaccggcctgtccctgccgggagaggggcgcggcgtcctgccgttcccgaaggcggaagtctccctggccacccagtccttcggacaggggatgacggccacggcggtgcagattgcggccgcctatggtgcgctggccaacgatggggtgctgatgcggccctatctggtgtcgaaggtggtggacccggacggtgtcgttctgctggaaaaccgtcccacggagctgcgcagggcggtctccgcgaaggtcgcccggcaggtcgtgggcatgctcgaaagcgtggtggtcaagggagggacggccaccaaggccgccatggaggactaccgggtggccggaaagacgggcaccgcgcagaaggcagacccggtggcgcgggggtattcggacaagcggatcgcctcctttgttggggtggtaccggccgagtctccgcgagcagtgattcttgtcgtagtggacgaacccaagacggacgtatacggggggaccgtggctgcccctgctttcaaggagattgcgaccgccgccatggctcacctggccgtgcccccgtcccggacggtggcacccgaggtggccgtggccgccgagtcccctgcgcctgccgcggcgaaaccgggggcgaatgcctccggtgccgcccggacggcactggcggacgcggtgacggagacccctgaacccggcacggtgcgtgtgccggaccttcagggagaagtaggacgtgaggccgtggtgaagctgctcgccgcggcgctggagccacaggtattgggcagtggacgcgtggtatctcaaacccccgccgccggttcactggtggagaagggggcccgggtgacgctggagctcgccgcgcggcaataa

SEQ ID NO: 3880 - DNA, 420 bp, Myxococcus xanthus
atgagcaaggtgcactcccgggtgtcggcgttgcgttcttccgtgacggtgggcggcgtgctgctgcacctgctgccggccgtgtgcctcttcgccctcttcgtggcggtgggcatcctgcacgtcaccagccgggtgctggtggtggacatgggctaccgcctgtcgcgcgaggaggcggagagccgcatcctcacgcgcgagaatgaccggctgaagctggaactggccacgctcaaggcgccgggccggctggagcgcgtggcgcgcgagcagttgaacatggccatgccgcgcggcggcgccgtggtgtcgctgtcggcggagaagccggcgcgtgacagcggggcgcgcgcggaggtcccggacgccacgcagcccaccgtccgcgtggcgggccgagccggagccagtcggtga

SEQ ID NO: 3881 - DNA, 894 bp, Myxococcus xanthus
caccagaccgtcctcctgcgggaagcagtggatctgctccggccggcggatgggcgggtcatcattgacgggacgctgggtggcggtggccactcggaggcgctgctggcctcgggcgccacggtggtcggcgtggaccgggatccggtggcgctcgccgcggccaccgcgcgcctgggcgcgaacccgcgcttccagggccgtgccggcaatttcgccgagctgccccgcgtcgccgcggacctgctgcccgtggatggcgtgctggtggacctgggcgtgtcgtcgccgcaactcgacgtggccgagcgcggcttctccttctccaaggacggcccgctggacatgcgcatggggccggacggcccgacggcggcggagctgatcgccaccacggacgagcgcgagctggtccgcatcctcaaggactacggtgaagagcccttcgcgcggcccattgcccgcgagctgaagaaggccctgcccacgcgcacgctggaggccgcggaggtcgtgaagcgggcggtgccgcgcaaggcgtggcccaaccgcatccacgtggccacccggacctttcaggcgctgcgcatggccgtcaacggcgaactggaggcgctggacgcgctgctggccgccatccccgggctcctcaaggtggggggccgcgctgccgtcatcgccttccattccctggaggaccggaaggtgaagaaggcgttccgcgcgctcgcggggcgctgcacctgtccgccgggcctgcccgtgtgcgtatgcagcggggtgggtgattttgccctggtgacgaagaaggccgtgcccgcctccgaggcggaggtcgaggccaatccccgttcacgcagcgcgcatctgcgcgtggtggagaaactccgatga

SEQ ID NO: 3882 - DNA, 315 bp, Myxococcus xanthus
atgctggagggcgagctgagcgagcaggacctgctcgagctgtgcgacgacctgggccgcaagctgcagcgcggcacgcgtcaggtggtgctggacttcggggacgtggggcacctgaactaccgcggcgtcaagccgctgatggcgcgcacggatgccttccgccgcgccggcggggacgtgaagctgtccggactgtcgccgtacctggccgccatcttccgcgcggccggcgcgcacgactgtttcgaaatctacccgcacatgaacgatgcccgagccgccttcgcgctggcacgggcccccttcgtctga

SEQ ID NO: 3883 - DNA, 465 bp, Myxococcus xanthus
ggatcgtcccgagtgttccgaggcgtctatgagcaccagatcgacgcgaaggggcggacgagcctcccggcgaagctccgggacacgctggtgggcgcctacgacgagaggctcatcctcacgacggcgctcgaccgatgcctccacgcctacccggtgcgggagtgggaagcgctggagctgtcgttggccaagcgcaacccgatggagcctggggtgaagacgctgatgcgcttgtacgtggccagcgcgcaggagtgcccgctggacaagctggggcgcctgctcatccctccgacgctccgctcctatgcggggctggagaaggaagtggtgtgggcggggatggtgaaggtcatcgagctgtggagccgggaggggtgggcgaaggcgcaggaagaagcgcgccaggaagcgacctccgcggatgtgatgaaggtgctcgccgagctgcggcaagcgtga

SEQ ID NO: 3884 - DNA, 1806 bp, Myxococcus xanthus
  unsure (1)..(1806): unsure at all n locations
atggatgcggcatccaaggccacttcgcagcaggggcttgctctcgggggcgcgttcctcttcgaggaggtgggctcggcccgcatcctcaccccggagaccttcacggaggagcagcgcctcttcttcaagacggcgctccagttctcccgtgagcaggtcctccccctgtccgagcgaatcgaggccaaggacaacgcgctcctgcgccagttgctgcgacaggccggcgagctgggcctgctgagcgtggatatccccgaggcctacggcggcaccggcctggacaagacgacgtcgctgctgctggcggaggccatgagcctcaacggctcctggtcggtgacgttcggcgcgcacaccggcatcggtacgttgcccatcgtctggttcggcaacgccgagcagaaggcgaagtacctgccgaagctggccacgggggaatgggtggcggcctatgcgctcacggagcagggcagcggcagtgacgcgctgggcgcgaagacgaaggcagtcctgtcccccgacggcaagcactggattctcaacggctccaagctctacatcaccaacgcggccttcgcggacgtgtttgtcgtcttcgccaaggtggacggggacaagttcaccggcttcatcgtggagaaggacacgcccggcctcaccgtggggccggaggagcacaagatgggcatccggggctcttccacgtgcccgctctacttcgaggacgcgcgcgtcccggtggagaaccagctgggcgaggtgggcaagggccacaagattgccttcaacatcctcaactacggccgtctcaagctgggcgcgggcgtgctggggggcatgaagctccagctccagaacgcgctgcgcttcacgcaggagcgcaagcagttcaacgcgcccatcgtccagttcccgctgtcacgcgagaagctggcccgcatggccgcgctcgtctacgcggtggagagcatgacgtaccgcaccgccgggctcgtggatgcgcgcctggggcagggggacaaggacgccccggactacgaggcgcgcctcctggaggcggtggaggagtacgccatcgagtcttccatcatgaaggtgcacggctcggagtccttcggccacctcgtggatgacgccgtccagctccacggcggcgcgggctacatcgaggagtacccggtggagcgctcgtaccgcgacgcgcgcatcaaccgcatcttcgagggcaccaacgaaatcaaccgcatgctcatcaccggcatgctcctcaagcgcgcggtgaggggggacctgccgctgttcgccatggccggcaacgtggcggaggagctgtcccggggcgagcggccccgcgcgcgcgtgcaggacgccctggccccgcaggaggtcgccgccgaggccgccaagcacctggcgctccacggcctgcgcgtggcggcggagacgttcggcccggaactggagcagcaccaggaggtgctcgcggccctgtcggacgtggtgatggacgccttcgccctggactccatggtgacgcgcacgcgccaggccgccacgtccggcgcgttggacccggtgcgggtggcgatgacgcagctctacgcactggacgccatcccccgcgcctacgacaggacgcgccgcgcgctgtgcgccacgttgaaggggggcgcgctcgaccaggagctcgagcgcctgggcacgctggacgtcttcacgccatatgacccngcggcgctgcgggagacggtggtggcggcccttgagtccgcgggcggctaccccctgggcgcggtgtag

SEQ ID NO: 3885 - DNA, 354 bp, Myxococcus xanthus
atgcatgccttcgacgtcctgggtgagccggtgcgcagacggatcctcgaactcctggccgagggggaacgcccctctggcgaggtgaccgagtccatccaggcggagttcggcatcagtcagccggcggtcagccaacacctgaaggtgctgcgcgacagcggcttcgcggaggttcgcgccgaagggacccgccgcctctatcgcgtcgacccggcgccgttgcagcaggtcgacgcgtggctggagcagttccgcgtgttctggacaccgcgcctggaggcgctcgccaccgaggtggcgcggggcaagcgggctcgggccaaggccgacaacgaaggcggcggcccgtag

SEQ ID NO: 3886 - DNA, 660 bp, Myxococcus xanthus
atgattgatgtgaagcggtacctgggggccgtcgtgcgggaggtggagagccgtgagcatgagggcaagcccgcacgcgtcgtcgtcgccacgcgcgactacgacacgacggtggaggacctctgggacgcgctgaccaaccccgagcgcatcccccgctggttccttccggtgtccggcgacctgaagctgggtgggcgttacgagctcaagggcaatgccagcggctcggtcacccgttgcgaggctccgcggcacctggggttgacgtgggagttcggagggagcgtgagctggttggaggtcatcctggccaacgcgcctggcggtggcacccggctgcggctggagcacatggcccatgtgagccccttctgggacgactacggccctggtgcaaccggcgtcggctgggagctggggctgatgggcctgggcatgcacttggagtccggcggcgccgctgtcgacagcgccgcggtggaatcctggacgacctcggatgaaggcaaggcgttcatcacggccagcagcgagggctggggccaggcggatgtgacgcggggagaggacgccgcggcggcgaaggcacgcgcggcgcggacgacggccttctatactggagcgccgccgcccgacgtgcggcatccggggacctga

SEQ ID NO: 3887 - DNA, 825 bp, Myxococcus xanthus
atgtatgcggccacccaggcgctcgccgtggtgctgctcgtcgtggtgggcgccggctgtcgtgaggagaagcaggccgagccgctcaagtcattgaagcccgagcccttgccctcgctcaccgtgccgggcgaagcggctccggaagcaccgcgacccgcgtcgccgtccgaagtggaggtggcgggccccatccatggcgagccgcttccagcctccgcgctccgggtggcgctggcgggggagcgcgtgcgcgtgggcgaggaggccttcgagccagcgcgcccggatgacgccgcgcggctggcgcggcgcgtgaaagggcacacggtgttggtggttccggacgcggacacgttcctggtgcagacgtcggagctgttcaccgtgctgcgggactcggcggagtccgtgtggctggcgcacccggacgggcccgtggcctatcccgtggtgctgcgggacgaagcgggcttccgcgcatggctggaggaggtcgcgccgggcaagctgcgcatcatcatgcgcgcggacggcttcgagctgaccaccagcgtgggcaagttgccggggccggatccgaatggtccctcggtgccagtacgggcggggcggcaggacatcgtcacgctccgccggggcctgggcttgctcaaggggcgcttcaagacgtccgaggacatctgcctcgtgccctcgttcggcacggaggtggcgcaggcggcgcgggcgctcggcggaaatttcaccgcgccgggtgagccgctgttcgacaccctgtgcttcgtctaccccacgccgcacaaggccccggacggaggatga

SEQ ID NO: 3888 - DNA, 1566 bp, Myxococcus xanthus
ctgtgtatcgtcggaagtggtgttgccgcggtcatcaccgcccgcgccgcgctggagcggggctacgaggtggtgatgctcgaagccggccctcgcacgcccatgcgggactcgcgccgctggctggacttcgtcaccacgggcgtgcggccctaccacgcctgtgaggactcgcagggtgacgccaactcccgccccggtgtccaacccgagcgcgaccacttcctcatcaagggcagccggctcatggcggtgggcgggtcgacgctgcactggagcggctggacgccccgcctccagcccgaggacctggagctgcgcaagcgcaccggcaaggggaacgactggcccttcagctacacccagctcgagccctattacagccaggctgagtccctgctgaacgtcaccggccccaacgcgcccgtggacggacatcccacgccctggcgctcgcagccctacaagtggaacagcccgccgtatcccatcgagtcggagccggtgcgccacgccttgaaggcgctgggcatcacctatgaccacattcccatgtcgcgcagaggccccggcggcgagggtgtgggcggcccgtgcatgacgtttggcacgtgccggtattgcccgatgggcgcgcgcttcgaccccaccctgctgctggcggacatggagtcccatccgggcttccggttgctcgcgagcagcccggtgctggccgtgcgcatggcgggagcggtggcccagggcgtcacctaccgcacccccgagggcgagacggccacgctggacgcggacgccgtgctggtggccgcgggcgccctggagacgcccaagctgctgtggcactcgggcttcgatgagcagcgcctgcccgcgctcgggcgctacctggttacccacccgatgctgaagctcgagggcaagctggcaaagcccccccgggagttcaacgggcgcgaagtccccatgcccgccctcttctctcggcacttcgacacgccggagcagcaggccgccgggaagatgatcttctccgagtacccggaggagccggacctgcagtcatgggtccgccaggagcaactggcgcccgagtacatcgcctccttcgcccgggagagccggctcaacctccatggcttcatcgaggagttcccccaggcggagaaccgcctgcgcttcacgggcaagccgggcgagcgccaggtggagattcactacgcggtggacgcggggttcgccgcgcgctggcagtggatgaccgacaccttgatgcaggtgatgaagaccgcgggctgccgcgagtcggaggtctgggtttcgggcgtgattcgccgggcggaccactcggtgggcacggcgcgcttcggccaagggccggactcgggcgtcgtggacgggaggcacctcgtcttcgggacgaagaacctgttcgccctcaccaacggcaacttcccgaacaacggcgccatcaacccgacgctgacgctcaccgccctctcgctgcgcttcgcggaccaggtgctgccggacctggcgccgacacgaactacagcgcggccttga

SEQ ID NO: 3889 - DNA, 660 bp, Myxococcus xanthus
atggaggcgctccggacggagaaggacggtcccaatgacaacctgaacatgctggcgcactacgggagccaggcggcgagcaagaagggcatcttcgcctcggggccgctcgaccccaggggcctggggccgcagcaggtgcagaccgcggtgccggaccgcgacaagggcgagcacaccaaggtcttcgggaagatgacgggcggggagacgagctccacgaagtaccagcagaagctcggcacggcggagccgcgaacggactacgaaatcctccacggcatgggccacggcgagggtggcaagaagacgcagtcgcccaacaacctggcctcggcgtcccatggcgcgaacacggccatgattcctccggacaaggccatctccggcaacccggacgtcatcgtggacacgaagttcgccatgcgcccgggtacgcagcgcgccgagtacgtggaccagcgcttcttccacaaggacttccccgaccagcctttcttccagcagcgcatcgacggggaccggcccaaggtcacccagagcgagtacaagcaactgaaggaacaggtggcgccgctcagtgacgcggaactcctgcgtggggccgcccacttgatgaacttccgcaagaaggcggggagcagcggcggagacacctga

SEQ ID NO: 3890 - DNA, 330 bp, Myxococcus xanthus
aacgtgcaccacggcctggcgaatgccatcgtcctgcccgtggtgatggagttcaaccgcgcggtctgcacggcgcggctggcccgggtcgcggtggcgctgggggacacgacgcaggcgcgcgaagaggtgctcgcgggcaacgccatcgaccgggtgcgcaagctcaacgcggcggtgggcattccctcgcggctgcgcgacgcgggcgtccaggagaaggacctggagcggattgccgagaaggccttccaggatgcctcgcacctgagcaacccgcggaaggtgtcgcaggcggacctgctggccctggcgcgcgaggcctactga

SEQ ID NO: 3891 - DNA, 606 bp, Myxococcus xanthus
atgcaggtgctgcttcctccgctggtgctggacatcgccaacccggccgttctcgggggactcctgtccacggggggtctggggctcctgatggggagcgtcgtgatgaccgcgtggggcgggccgaagaaccgcatccatggggtgctcggagtcggggtgggcctggggacggtcatggtgctcgcagggctgttccccaccctgaggatgctcgggtattgcaccttcatggcgggattctgcatccccatcatggatgcaagcagccaggccatctggcaggggcaggtccccgccgcactccggggacgcgtcttcgccatgcgcgggatgattgcctggtccgtccagccgctggcgtaccttgcggcgggcgtcatcgcggaccacctggacggcgtctccttctccatccccgcgctcttcgggccgctggaacaactcgacgcgcgcagccggggcatcgccctgtgcttcatcgccgccggcctcttggcgctcatcgcggcggtgcggggctataccgcccgccacgtccgcgaagtcgaggagatgccaccaggcccccccttcaccggggccgtgtccccgccttcgcggtaa

SEQ ID NO: 3892 - DNA, 1449 bp, Myxococcus xanthus
atgcgcgactccgcgcgagaagcggaccgcgacgccgtcctgctggtgcatcacagcttcgagtcgcggatggtgccacgcatcgcgaagagcccaggccgcaaggtgctcgtctaccacaacgtgacgcccgcgaggctgttcgagggcttcgagcggaaagtcgccgccgcatgtgacgccgctcgggatgaactgctggcgctgcgtccccacgtcgaagcggccttcgcctactcgcgattcagcgccgaggaactggtcgccgcgggctacccgaacgtcgcggtgctgcccttcgccatcgactgggcggcgttcgacacggcgccggacccggcgctccaggccgagttggacgacggcatgtccaacatccttttcgtgggccgcgcggtgcccagcaagaaggtagatgacgtgctgcgcgtcttcaccgcgtaccagcggctctaccagccccgcagccggctcgtcgtcgcgggctacctgcaccgggatggggcctacggcgcctatctgcacgggttgaaggacgtgctgggcgccgagcaggtccgcttcctgggacgcgtcagcgccgcgcagctctccgcctgcttcgccacggcgtccgcatacctctccatgagccgccacgagggcttcggcgtgccgctgctggaagccatgtaccggggcgttcccgtggtggcctatggcgccgccgccctgccggagacgatgggcggcgcggggctcgccacgcgctcggacgagcctcgggaggtcgcgaagctgctcgccgtgctggaccgcaacgccgggctgcgcgcgcaggtcatcaccgcgcaacgtgaacgcatcgccgagctgtcgcaggaggccgtagccgaacaggtccgcgtggccttcgaagacatctgctccagtacggcgccgcggcccccggtggccacgacgacgacggccaccgtggaactcgtctgcccaggcttcaccgtacggcccgaggagccggcctcgcgtctggcccgccgggtggcggagcgcctgccaggtgcccgggtgcttgccctgcgcccgtggggtgaggacgcgtccctgacgctggagcccatcagcgacgatggagtcgcggtgacgcacttcacgccggaccaaccggtggactcgaaccccaggacggccctaccggggtcctccgcgatggagacggcggtgcgggcttcgagcgcgcctgtggtgctgttgagcgcggacacggtgtctgcgcagacactgctaccccatgtctccgcgcgagcctggggcgtctgtgcacctgccagccagtcggccctgctcgcatccgcccaggagcacctgggtgacaggttggtggtggaggagccggctcaggtcgagacggcattgcaggcactgctcacgacgctggcttcaacgggagtcctcccacgtgcgacctga

SEQ ID NO: 3893 - DNA, 342 bp, Myxococcus xanthus
atggacagccgctacgcggaaccggcgacctcccaccggggaggcttcacaggcacggcgctcgtcctggccaagcgcgccttccgcctcaccttccagcccttcatcaacgaagtgctgcgcaagcaggtggagttcaacgagtccatcctcgacgcgctggccaccctgcacgacgttcagcgtgagcaggcccgtgcccaggccgcatggcgcaaggagttggagcgcaggctggcgaagctcgaagccacgggcacccgcaccgaacccgtcaagacagagcagcaagtgcccacgcctgccgcgtcatccaagcggacacgcaagcgcggccggtga

SEQ ID NO: 3894 - DNA, 2178 bp, Myxococcus xanthus
atctgcctcgtctccaaagaactcgcccccttcgacaggggcgacatcgcgacctacgtggcaaccatgagccgggcgcttgcggaggccggacatgaggtccatgtcttgacggcggcgcatgccgactggcagcgggccgtgtcctacctccccggcgtgcacctgcacgcggtggatgagcgagaggtggacttcaagggtgcgtttccacacgccccccttcggcatgcgtgggcggcgtacagaagcctgctggaactcaacgcgcgtcatcccttcgacgtcatcgagttccccgacgacgcaggcgagggctatttcgcgatgcgcgcccggcggacgctggggcacttcgagccagcggtcctcgcggtgcgcttgcacgactccacccacgaccgcctgctgctcaacagagtggccacgctcgacatggacatcgcccagcgcgagcacatggaggacacgtccatccgtgaagcggacctcgtgctgtctccctccggaccagccatggagcgagtccgcatcaggctggagctgaagcgcaccggcgtcgtgattccacctccgttcgcgtcacgccgggagcaccgctcatccccgcgttcccacgaaggactgccccaggtgctgtacgtcggagacctggagtaccgaaagggcgtgcatcttctcgtcgaagccatgcaggtgctcttcgagcaaggcgtcgtcgcggaggtccggctcatcggggctgacacgcgcaccggcccgttcggccgctccctgcgacagtggctggaccagcgcatcgcccccgcctggcgaaacaggttccacttcgcacctccgctcgagggggcagacctcgcgtcggcgctcgccgaagcaaccgtgtgctgcatcccctctcgctgggagcacttctcccacgtgtgcatggaagccatgtccgcaggagcgctcgtggtgggcagcgatggagggggcaacgccgaactcatcgaggacggccagagcggcttgctgttccggagcgacgatgcttcgcggcttgcccgcgcgctcgagcgagccctgtccacaccggcgctccaagaagccgtccggcagacagcgccagcgcgcatcgctgcctattgcgctcccgccagcatcgtccgccagttcgaagcggcagtggcggatgcgcggcgccatcgtcacgtgggccccatcagcgccgcgaccaggaagaaggactcggccacaccgtacgtgtccatcctcgtgccctactacaacatggggcgctacctccccgagacgctgcggtccattcgcgcccagaccttcacggactacgaaatcatcctcgtggatgacggctcgacggattcggagagccgggccgtgctggagacgctccacgagccagacctccacatcctccgcaagcccaacggagggctcagctcggccaggaacgccggtctgcgcgcggcacggggccggtatgtcctcccgctggacccggacgacctcatccagcccaccttcctggagaaagccgtcgcggtgatggacagcaccccagggctggcctacgtcacgtcactcgtctcctatttcgtcgagtcgccggaccagcccgtgggcggatggattccctggggcaccgagcgtgacgcgctcctcgcggagaacgtggcctcgacctgcaccgcgctgatggagcgacagcgcatcgaagaaatcggcggctacgacgagtggcttacggcctatgaagactgggacgtcttctgctccctggccgagcgagggctcgcgggctccgtcatcccggaaccactcttcctgtaccggctgcgtccggactcgatgacccgcagcatgcgagtgaatgaccgtcatgcgcagatggcctacctgtgccagaagcaccctgcgttgccgctccacccggagcgcgcactccgcatgcagctcggccgggcccacaggcaggaactccatcttcgcgcgacaggctcggcctccccaccactcctgaatcgcttcgccgacaagatgaacgccacgctcaagcggttcgacttcgcccatgccaccttgaggcgcgccgcgctttgggtcgcgggagcagacgacgactcccgcccactgcgtcatcaggtcatggagcggttcttcaggcgccgcaattga

SEQ ID NO: 3895 - DNA, 1506 bp, Myxococcus xanthus
atgttggcggcccacgcactggtcctcggcaccctcctgctcctgatggggctctggctcacgggccgtccgccaccacccctcaagcccatgccacggcgctgggtgggactgctgacggccatccccaccgtggtggtggctggcatctggctgctgactgtctacccgggaatgctgagtccagactcgacatcccaatggcgtgacgccctttccgggtccatggatgatgcgcatccactgttccacaccgcttccatccgattcctccagaagctctgggaatcacccgcggcggtggcgctcgcacagattgccggcctgggggtgctcgtcggctggggctgcgcggcgctcgcgagggcaggtgtctcccgaggcatcatcgcgctcaccgcgacggtgttcgcgctggcgcccgtgaacgggacgatggccgtcaccctctggaaggacgtcccgttcagcctctgcatcctggccctgtgtatctgggtcttccgctccgcgaccgacaccaccacgcgctgggacgtgccgttctgggtgagcatggtagtgctgggagccatggccatgttgttccgtcacaacggcctgcccgcggtggtcggaaccttcctggcactgggtctcctccggagggagcgctacaaagcggtggcgctcgcgctcgtggccacgtttgtcgtcgcctcggggacccgctgggtgctgagccagacgtacaccatcaaaccctttcccaaggggatgacgctgatcggattcctgggcgcccatgtggcggcaggaacgcacctggagcccggcgaacgagccctcctcgaggagctccacccgctcgacgacaagtggaactaccgctgcttcagcaacgtgttcaccatctgggacggacgcttcgacatgaacgcgctgacccggcacaacaaggcgttgcttccgctcctcgtccgcctgacacaacgagacgcagcgccagtgctctcacacgtgctgtgcagcagttcggtgctgtggaagctctcgcaaggctcggaccacatcaatggtcctcccatctggagggggccccacggggaactggacaccctcgagcccggagcgcgacaccttcggtccgactcactccttccagtcctgcgtgagccccttctccggtggaccgtccggacgcttgagccagacctggcctggctgctctggcgcccggcgctgccgctctacctgctgctgctcgcctgcgcggtggcatgcatccgccaccggacctggcggcttgccgccgtggcgctccccgtcgtcttgcacacggcggcgctcgccgcgctcatcccgtcacccgacgtgcgctatcagtaccccgtgttcctcgtggccctgatgttcgttcccgcgtggctcgcggggatgcgactgaatgcggcgccggcgaccgaagcgccgcggcgcgcgccttccgtctcgcaggacgcgccgacgctcaggtcagccggctga

SEQ ID NO: 3896 - DNA, 1971 bp, Myxococcus xanthus
atgaagcgcatgacgacatggaagcggacgtttctgctgcacgccacgtgggcgctcctgtggggcaccccggcggcggccgtaacgccgtcgaacgtgacgaaggtctcccgggtgacgggcgcgacgcccgccggtgagctgctgccgaacccgaaccagacgcacacgaaccacgacgtccatgggacggacctgggcatcgtctgggacaagggcggtggcgaggtgttcgtcctgttcggggacaccttcggcgcgggctggtgtggcaatggtggctgtgggggcggctggcgcagcaacgtcttggcgcgttcgtccgatacgaacctggccaacggcttgtccttctcctccatgattcaggacgggcctcggcatgcgaaggagatcctcgcgtcccggaaggtcaacttcgacgaaatcaccgtcatccccaccgcgggcgtcaccatcggctcgcggcactacatccactacatgtccatccaccactggggggaggcgggcatgtggttcacgaaccacgcgggcatcgcgtactcggatgaccaggggcagaactgggtgaagcacccgacggcgcgttggcagaacacgccggcctggacgaacaacttccagatggcggccttcgtcaggaacggcgggttcgtctacatgtacgcgacgccgaacggccgcttcggcaacgtccacctggcccgcgtgccggagacggcgctgctggacatcaacggctaccgctactgggatggaaacggatggagcgtgtcgcaggcggcggcgcggcccgtcgccattggtatcgcgggtgagttgtccgtctcgtatcacgcgccgctcgggcgcttcctgatgacgtacctgaacgagcaccggcaggcggtggtgatgcgtgacgccgccacgcccacggggccctggagcggagagaaggtgctcgccagtggagccgtgtacccgggcctctacaacgcgttcatccacccctggggcaacaccggaaactcgctgtacttcgtcatgtcccagtggacgccgtacaacaccttcctcatgcgggccacgctggcccacgacgcgcacagcgacaacctgctctccgagcctggcttcgagacacaggcggccacgccggtgatggcgccctggtatctgcaaggctcgggcggcgtggaccgggcgctcggcaacgcgcgcagtgggcaggacaacggcttcgtgaacgcgagcagcgggtggaatgcgctcaagcagagcgtcgtcgtccagccttacacggactacacgctgcgcggctgggtccgcagctccgccaacaacaccgcgggctacttcggggctcgcgggccgggcaatggccccatcctgggcgaggtgcccttcggcgcgctgggggcctacacggagcgggtggtccacttcaactccgggccgaacgcgctcatcgaggtgtatggcggcctctgggccgacaacgttgatacctggatgcagctcgatgacgtcagcctgacgcgtgggagcaatctcatccaccaggcgggcttcgagcagcagtccacgaacaacgccacgtcgccctggtacaccgaaggcagggcgggcattgaccggggactcggctatgcgcgcacgggcgccaacaacgcctgggcgcggaacgacacggggtggaatgccgtgaagcaggaggtcgcggtgacgccgaacacccagtacacgctgacgggctgggtgaagacgtccacgaaccacgcggatggctacttcggcgcgcggctgctccggagcgggcccatcctcaacgaggtgcgtttcgcccagccgctgggcaactacacgcagttgtcggtgtcgttcaactccggcgcccagcacagcgtggaggtgttcgcgggaatgtgggcgaacaccggcgacacctggattcaggtggatgacctgacgctgacgcggaactga

SEQ ID NO: 3897 - DNA, 360 bp, Myxococcus xanthus
atggtcggccagtggatgactgggccgacggtccgggacgaggaggtgctgcggctcgccatcgacccgcgcgtgggcggcaagttctccttcttcgtgcggcgggccggagaagaaatcgaccacgtgggcacgtacctggagatcgaccggccgcgccggctcgtcttcacctggcacatcgacaaggagggggacgagctcagccgggtgacggtggaaatcacaccgcgcgacaccggctgcgagctgacgctcacccacgagatggacgcgaagtgggccgactacgcgagccggacggagcagggctgggccaccatgattgacgtgctcgtccgcgtgctggcgcagggctga

SEQ ID NO: 3898 - DNA, 1386 bp, Myxococcus xanthus
ccaaggggctcgcggctggcctcgattgctgtggccagcgcgctgttcatggagttcgtggactccaccgcgctgtcgaccgcgttgccccggttgtcgttggcgttcggcaccgaccccatccatctgaagctggcgctgacgtcgtacatcctggcgttggcggtgctcgcgcccgcgagcggctgggtggcggaccggttcgggccccgtcgcgtcttcatgcttgcgatgagcgtgttcctgctgggctcggtgctctgcggcttctctcagtcgctgacccagttggtcatcttccgcaccctccaggggctgggcggcgcgttgatgacgcccgtggggcgcatcatcgtggtgagctcggcgccgcgagagcgcctggtggccgccttgagctggttcaccatgcccgcgctggtgggcccgctggtggggcctccgttggcgggcctcatcctgggcgtcgcggactggccgtggattttcttcatcaacgtgcccgtgggcatcctgggcatgctcgcggtggcgcgcttcgttccgccgctgcaccagccggacccggggcccttcgacacgcggggcttcgtgctcgtggccgtcgccatcactacgctgattggcgcggcggagacggtgggcatcgggctgatgccgctgtcgttgcaactggggctcgcggccgtcgcgttcttgtcgctgggggcctacgtgtggcacgcgctgcgcgtggagcggcccgtgttgaatctccggttgctgcgcatcgacaccttccgggccagcatgattggcggaaccctgacgcgcatgggcctgggggcgtcgcccttcctcctgccgctgctgtttcaggtcggcttgggctggacgcccgtcgaggcagggctggtgaccattggcggcggcgtgggcgcgctcgcctgcaagtcggtggcgccctacatcatccggcggttcggcttccggcaaacgctcatcttcgccaacctgacgtccgctgtcctgaccgcgatgccggccttcttccggaacagcacgccgattccgctcatcgttggcgtgctcatggtcagcggattcatgcgctcgatgcagttcaccgcgatcaataccgtggcgtatgcggacatccccccagacacggtgagcaacgcgtccacgctgtccgtggtgacgatgcagatggcgctggggttgggcatcagcttcggcgggttgatgctgcacctggcgcgcggcgctggcgaggcgccgttgacgccggaccgcttcgtgctgccgttcatcgcggtgggcatcatgtcgtcgctggccggaccgctctatcgccggttgtcgcccaatgccggggcgcacatcgggggccgcagggtggggtga

SEQ ID NO: 3899 - DNA, 309 bp, Myxococcus xanthus
atggacggccagctcaacgaggcgctgctggaaggctatctgcgtctcaaatgcgaggagcgtccctcatacctggccacctacacccgtttcgcggcggaggtgaaacggcccgagaagctctccgcggaatggctcttggagctgccagagctccaccgcgtgaaggtggtgggcgagctggccatcatgtcgctggtcggcgggggcttccggacgtttggcttcggaaacatgaatggccacatgggcgggctctggcacgagccgcacgaatcgggctcctatcacgcctcggacgaactgtag

SEQ ID NO: 3900 - DNA, 882 bp, Myxococcus xanthus
atgaagggcatcatcctcgccggtggctcggggacgcggctgtacccactgacgcgcgtggtcagcaagcagttgctgcccgtgcatgacaagccgatgatctactaccccctgagcacactgatgctcgcgggtatccgggacgtgctggtcatctccacgccgcaggacctgccgcgcttccaagaactgctgggcagcggcgaccagtggggcatgcgtttcagctatgcggagcagcccaagccggacggcctggcccaggccttcgtcatcggccgggacttcgtgggcgctgacagcgtgtcgctggtgctgggcgacaacatcttctacggccacggcctgagcgagctggtgaagcgcgcggcgtcgcgtacctcgggagcgacggtgttcgggtactacgtgaaggacccggagcgttacggcgtggtggagctggacgcgaagaaccgagcggtgagcctggaggagaagccgctgaagccgaagtccaactacgccgtcaccgggctgtacttctacgacaaccaggtgctggacatcgccgcgggcctcaagccgagcaagcggggtgagttggagattaccgacgtcaacgcggagtacctgcgacgcggccagctcgacgtggagctcatggggcgtggctacgcgtggctggacaccggcacgcacgagtcgctgatgcaggcgtcgaacttcatcgaaatcatcgagcgccgccagggcctcaaggtgtcgtgcccggaggagattgcgttccgcatgggatacatcggcgcgcagcaactgctgacgctggccgagcccatgctcaagaacgactacggccagtacctgcgggcgctcgcggagaaccggggggccgtttcgtga

SEQ ID NO: 3901 - DNA, 462 bp, Myxococcus xanthus
atgctcgcgcccggctgcgccattgctcgcaccgccgtggtgtatggctggcctccggtggagggccggctcaacttcggtgcctggctggtgaccgcgctggagaaggggcagcaggtgcgcctcttcgaggaccagattgtgtcgcccagcttcgcggacaacgtggccgccatgctggtggagctggggacgcggcggctgggtggcgtgtggaacacttgcggcggaacggtcatcgaccgggtgggctttggccgcgcgctgtgcgaggtgttcgggttcgatgcgaagctcatcgtccccacccgcatggcggagctgaagctcgccagcccccgcccgctcaagagtggtctgcgcaccgacaaggtgcgtgccgaactttccgttcctcccttggcgctcgcggagtccttgtcgcgcttccatgcgacctggctcgcggctcggggacactga

SEQ ID NO: 3902 - DNA, 1020 bp, Myxococcus xanthus
gtactggtgacaggtggctgtggcttcatcgggtccaacctcgtgaagtatctgcgccgtgagcggcctgcctggacggtggtcaacctcgacaagctcacgtacgccggcaacctggagagcctgtccgagctggagggcgacccccagcacgtcttcatccggggcgacatcggcaatcgcgagctggtggagcacctgatgtccgtgcacgccatcgacgcggtgatgcacctggcggcggagagccacgtcgaccgctccatcctcgggccggaggtgttcgtcaccaccaacgtgctgggcacccagcagctcctggaggccagccgcgcccgcggcgtgaggcgcttcctcatggtgtccaccgacgaggtctacggctcgctggggcccacgggcgccttcaccgagtcctcgccgttgcagccctccagcccgtactcggccagcaagacgagctccgacctggtggcgctcgcgtatcaccacacgttcaacctggacgtcgtcgtcacgcgctgctcgaacaactacggccgctaccagttcccggagaagttgattccgttgatggtggtgaacgcgctgcacgacaagccgctgccggtgtacggcgacggcggcaacgtgcgcgactggctccacgtggaggaccactgccatgcgctgctattggcgctggagaagggccgggccggcgaggtctacaacatcggcggcggggcggagcggcggaacatcgacatcgtgaaggcgattctgggcctcgtgggcaagccggagtcgctcatccagtacgtgaaggaccggccggggcatgaccggcgctacgccatcgacccgtcgaagattcgcgcggagctgggctggacgcccgcgcacaccttcgagcaaggcctggcggagacggtgcgctggttcgtggaccaccctgcgtggtggcagcgcgtcacgagtggcgcctatcgccagtacttcgaaacgcagtaccgaacgcgcctgcaggggagggcctga

SEQ ID NO: 3903 - DNA, 408 bp, Myxococcus xanthus
atgctgctggggatgtttggccagcgggcccaggtgacggacccgacatcgggcttcagggtgtactcgcctcgggcggtggccacgttgttgcgcctcatgccggatgagtacccggagccagagtccgtcgcgctcgtcgcgctcgccgggcttcgaatcggagaggtctcggtcgcgatgcgcccacgcacgacggggacctcgagcctgacggggctcaaggggttccagttcatgacgaaggtggcttccgccctgttcgggttgcggctgcggtcgttgattcgcaaggagccgagcgcactcgtgccggcggcggaaggtgtcgcgccccccgtggtgtcgctcacccctcgagagcccgcttcacttccaccggcagaggaggggcggttgggcgggtag

SEQ ID NO: 3904 - DNA, 1464 bp, Myxococcus xanthus
tcggacctgacggaccgcttcgtcttcatcaagccaggtcctgaccgcgaagcgcacatgcgcgcgggggtggtggtcatcacctccagctatgagtcgctgaatctcacggcctacgaggcttccgtcgcgggcacccggctggtgctcaactcggcctgcctggccttcggtgacgacagccccttcgtcgacggggtccactgccacaagtatgacggcagcctggacgcgctggtggtggccatgcgcaaggcgttggaaggcccggagctggcccccgtccgctggacggtggaccgtccctattgggagcgccacgcgcgggaggcgctgcccacgcgaagccctcggtcgccgctggtcagcgtggtcatcatcaatcaggaccagggcatcttcctgcccatcgcgctgcaaggtgtcgccgccagcacgtacccggaagtggaagtcgtcatcgtggacgatgggtccacgagcgccttcgacatgcaggtcctgcagcgcctggagcggtccgcggctgaaggggaggggcttcgtgtcgtccgctccccgatccgccgcgggttcgcgggggctcgtaacctgggtgtccgcgccgcacgcggggaatacgtcgtgttcctggagtcggacgacagcctgtccccggacttcatccagcacgccgtcgccgcgctggaagcgcgacaggagttctcaggggtggtccccaccggaggccgcttccactccagcgaagagctggccaaccgccagttcaaagggttcatgacgtacctgggggattgtccgacgtacgcgctggccgcgaaccaggtctccgcgcccacggcgctgctgcgccgaaccgtcctggagcagcacgcctacaacgaaaccctgtccggctatgcggactgggatttcttcctgcggctcgcgcaggggggacaccgcttcctggtgacgaaccaggtccacttcttctcgcggcgggggcatgccatcaccccgtccgcgtcccagcagcgccagcacttccgctggctggtgcggctcttcgaaggcgtgcccgcgccactgcacccgtcgacgcggctcttcgcactgctcgcgcactcccgcgaggccatggtcgacccatatggcgcgctagacacgcatgagcgtcggccgtcctccgcggcgtccgcgtccctggagtccgcccaggcgctggccgaggccgcgcgcccgctgcgctacgacgtggtggatttgatgaacgcggccttgaagcgcctgcccctcgtgcaccccttgctcaagcaggccgtcgcgggcaaacccgctcccgccagcggagcggtggggagcgtgaatcccggggatgcgcctccgcttcgttacgtgctcgtggaccgcgcgaacacgctcttcaagcggatgcccgtcattcaccgcgcgattcggagcacggtcagccggctgacctga

SEQ ID NO: 3905 - DNA, 222 bp, Myxococcus xanthus
atgtctggtggtggcggttcgttcgacttcgacgatgacgagaaggagtccacgcgcggaggtggcaaggcgcacaaggacttcgactgtccttcgtgcaacgccaacaaccccgtggatgaagcgctcgcccagggggacgaggtgcgctgcaactactgcggctccgagttcaaggtcagcgtgaactcggaggggcgggtgaagttcaaggagatttga

SEQ ID NO: 3906 - DNA, 1095 bp, Myxococcus xanthus
atgaatcccgcggacctcctgtcggccatgaagcggacagtggagcagttggccgccttcaatgagatggcgaaggccctgacgtccacgctcgagctccgcgaggtgctggcgctggtgatgcagaaggtcagcagcctgctgctgcctcgcaactggtcgctcatcctccaggacgagcgcaccggaaagctctacttcgaaatcgcggtgggtgacggcgcggacgtgctcaagggcctccagctcaacccgggcgagggcattgccggcgccgtcttcacgtccggcgcggcgcggctcgtccatgacgtgggtggggaccccagcttctcgccacgcttcgatgaagcctccgccttccacacccgctccatcctcgcggtgccgctgctggcccggggccgggtcctgggcatcatcgaactggtgaacgggcccatggacccccccttcaccaacgaggacctcaccattctcaccgccatcgcggactacgcggccatcgcgattgagaacgcgcgcaacttccggcgggtgcaggagttgacgattacggacgagcacaccggctgctacaacgcccggcacctgcgcgccttgctggaccaggaggtgaagcgctcggagcgcttcagccacccgctgtcgctcgtcttcctggacctggaccacttcaagagcatcaacgacacccatgggcacctggtgggtagcgccaccttgaaggaagtgggggacctgctgatgaccctgggccggcagaacctggacgccgtcttccgctacggcggcgacgagttcgccatgttgctggtggagacggacccggagggcgcggccgtcatcggccagcgcgtctgcgaggcctttcgggggcggggcttcctcctggagcagggcctggacgtgcgcctcaccgccagcgtgggcgtggccacctacccggaccatgcctcgtccgcgctggacctcatccgcgcggcggacttcgccatgtacgcggccaaggcccggggccgggacgcgctctgcatcgccgagcccattgctccgaacggcggcacaggctcccacgagttcccggagcggtag

SEQ ID NO: 3907 - DNA, 645 bp, Myxococcus xanthus
gtgcggcaggagaatgacgcattgcgcttggagaacctccaactgcgcgcggcggtgcagtccctgggggagtcgcggatggagaacgagcggctgcgcaagctgctcaactacgcggaggccgagcccgggccggaaatccccgcgcgggtggtgggcgtcaatccggtggcgaagctgctgtcggtccgcatcagcagtggtgagcagcagggtgtgtttcgcggcatgtccgtggtgacgccggatggaatcgtgggacaggtcatccgggcgacgggcgggtatgcggatgtggcgctggtgacggacccgcagagccgggtggcggtgcgtgtgcagcgctcgcgggcccggggcacggcggcgggaacgggaggcgggcccctgaagttggagaacatgctgcgcaccgaggatgtggaggacggtgacctcatcatcaccgcgggcacggacggcatctatccgcccggcgtggtggtgggacgcgtgacgaacctggagaagaaggagcacggcatgttccagggcgcggacatcgtcccggcggtggatacgagcaagctggaagaggtgttggtggtgggcagcccctacagcgccatggcgccgggcagcgccgcggagggcgcgtcgaaatga

SEQ ID NO: 3908 - DNA, 501 bp, Myxococcus xanthus
atgaagttcctggtgtccgtcgcactggcgctggcgttgctcacgctggaatcggtcctggtgaagcaggcgggcctggagctcggccggattgacgtcaccgtggtgttggtggcgttcctggccctgcgggcttcgctgctcgaagggaccttctccgccttctccgtggggtatctgctcgacctgatgagcgggcagcccacctggctctacaccttcctggccgtgttcatcttcctggtgggaaggctggtgccgaccttcgtggaggtccggggtccgctggccttcgccttgttcgccatgggcgcggacgtgggccattcgctgctggccaccttcttcacctggctgacggtgaaggaggacggtccgggctcacagttggcggagatgccgctgcaggtggcgctcacgggcatcgcggcgctggcgctctacccgttgctgcggcgcttcgaggcgtctcaggagcggcccacggggttgctgcggtga

SEQ ID NO: 3909 - DNA, 1962 bp, Myxococcus xanthus
atggcgggcctggggctgatttccatccagctctaccgcctgcaaatcacccggggcgaggagtacgccgccaagagcgtggccaacttcgtcaaggaagtgcggctgcgcgccgaccgcggcgtcatcaaggacgcgcgcggcaccatcctggtggacagccgcccgtccttcgacgccttcatcaccccggccttctgcacggactgctacgagcaggtcatcccccgcctggcggagctgctccagtgggacccggaccagcgcaagaaggtggaggacatggtgcgcatggggcggcgcaacgcccccttccagccggtgccggtgcgcgtggacctgtcgcgcgacgagtacgaccggctggctgcgcgccgcgacatcctggacggcgtggaggtggcgcccgtgccgcaccggcactaccgcaccaactccgtgctgtcgcacgtgctgggctacatgaatgaaatcacccaggaggagctggagcgcctcaatggcgacggcgcccgctacgccctgggggactacattggccggcgcgggctggagcgctacttcgagcagcggctgcgcggcaccgacggcgtgcgcaaggaagtggtgaacgcgcgcgggcagaccattgaagagctgaacgacaagctgggcgacaacgctgtggtgtcgccgcgtccgggcaacaacctggtgctgtccatcgacatgcggttgcaggaggaggcggagcgggccttccccggcgtgacgggcgcggtggtcgccatcgacgccaacacgggcttcatccgcgcgctggtgtcgcgaccgggcttcgaccccaacctgctcactggccgcgtgacgcccgcgcagatggcgctcctgtcgagagatccgctggacccgatgatcaaccgcgtggccgccgagcactacagcccaggctccaccttcaaggtcgtcaccgcgctggccgcgttcaagtccggcgccttccgcccggagacggtggtgaactgccccggaggctaccgcctgggcgcgcgcacctggcgttgccacagggacgccggacacgggctcgtggatggcttcacggcgatgaagtcgtcctgcgacacctggtactacaaggtggcggacaccatcggcctggaccccattggagagatgggcaaggccctgggcctgggcagccccacgggcgtcaacgtggtggccgaggtcccaggcatcatgccgaccagcgcctatcacgacaaggcgtcgcccggcggctacaccaagggcatggcgctcaacagttccattggccagggcgacaacaacgtcacgcccctccagttggcgctggtgtacgcggccatcgccaacggcggcacgctctacaagccgcagatggtgaaccgtctggagaacctggacgggcagaccatcgagtcgttccagccggaggtggtgcggaaggtggacctgccgcccgcgcacctcaaggcggtggtggatagcctggtgatggtggcgcacgagccgggcggtaccgcctatcgcgcgcgcatgaatcacatgcgggacaaggacatcctggtggcgtccaagacggggaccgcgcaggtggcccgcctgggggcaatccggctgcggacgcaccagatgagctacttcgagcgcgaccacgcctggtacgcggggttcgcgccggcggacaagccggagctggtcatcgtcgtgctcaacgagcacggcggccacggcggttcggacgcggcgcccaccgcgatggcggtgttccagaagtacttcgatttgaagaagctggacgccacggctccgccgccgcgtcccaaccagccctacacgccgtcctccgtgacgcgcgcgccctcggccgacgaggcggcgctgacgcgaagggtacggccaccggcccggcttccgggcgatgaagaggaccgcacgcgtgcaactgcggattga

SEQ ID NO: 3910 - DNA, 1488 bp, Myxococcus xanthus
atgcaggagcagccccgtccgccagcggaggtcatcgccttcgagagcgacgtgcgcggcgcgcccctgtcctccctcatcgagctggtggcgaaggtcatccaccgtgactttggcgaccgcgtgctgctgctccggagcgcacccggcgggcatgacgcgcccgtcacgaagggggcggatggcgtcctgcgcgccacgctgcctccagcggaagctggcggtcccggtctgctgaccccatcggtgctccaacggctcacggccgagcacggcctccactacgtcctgctcgacggctgccgcgtggcggacatcgggatgccggggaagacggcgcggctggtgacgacattggacgcgcggaaggcgtcggcccctcgcgtgcttcccaccgtggtggtggagcctggccgtgcgtcacgcgcatcggagttgagtggcaagtccctgcatccccagtggcttccgccctgccccttgcggttgagcctggacaggatggcgcgggtgctcgtggatgaccgtccgctggacgccacggtgctgagccccgccgagcgggacgcactctcccgctgggcccgagccctcacccaccgtcgcgtgggcctggcgctcagtggcggtggcgtgtggggcttctaccatgtccacatcctgcgctggctggtgagccagggcgtgcccatcgacatcgtcagcggcgccagcatgggctcgctggtgggcgcgtacttctgcggcagcgcgctggatgggcacgacggtctggaaggactgcgacggctggaggagcgggccatgagccggcagctcaccctggccgccacggccgccatcgtgaccacgtattcgctggaacgcttcgtggagcaggacctgggccggctctgcctggaggaactggccatccgcttcctgcctgtcacgacggacctgaccagcggagactgcgtggcgctggagcaggggccggtggccctggcggtgcgcgccagcggctcggcgccgggtatctggggccccacggtggtgcctcccgcgcggtacgtggacggcgccttcaccagcatggtgcccgcgcacgtgctgttgaacgcgggcgcggacgtcatcttctccagcaacatcttccccttcggcgtccggcatgcgtccccgcggcggcagtccggcctggggcgcttcctggcgggactcaatccggtggcccgcgcgctggacctggctgccagtggcgtgctgctattgcaccgcagtggtgacgtggagagcctgctcgcggacgtccgctacgacatccaatccgcggaggcaccgctgctgaccgccatggagttcaccaaggcccgggacatcctcggacgggcggcggcggatgcgtcgctcgcgaagcggctggaggagatgaagcagcactggctccaggtcaaagcccggggtgtccgtgcccacgcgcatccaggaggacagcaagccgcatga

SEQ ID NO: 3911 - DNA, 417 bp, Myxococcus xanthus
atgcgaagcgaacagaccctcatcgtgaccgaagccgacttggagcgcctgcgccaggtggtggaccacaacggaggcggccgcacggccgagttcgcggaaatgcttgacgcggagctgacccgggcccgcgtcgtcgcttcggaagaggtgccgcccgacgtcgtgacgataaacagcaaggtcgtcttcgaggacgaacaatcgggagagcgccgggaggtcacccttgtctacccgcgcgacgccagcagcgacgatggccgcatctccgtcctggcccccatcggcagcgcgctcatcggactgaccgtggggcagaccatcacctggcccctgccgggcggacgctccaagcggctgcgcatcgtcgcggtgccctaccagcccgaggcctcgggccactacaacctctga

SEQ ID NO: 3912 - DNA, 1011 bp, Myxococcus xanthus
atgggctacctgggcatcagcatggtcgccgtgctggtggtgtgcctggtggactaccggtggattcagcgcatggcgctgcccatctacgtgggcaacatcttgctgctcatcgcgctgcgcttcttcggccacacggccaagggcgcggagagctggttcgtcatcggcccgttccgcatgcagcccgcggagttcatgaagattggcgtcgtgctgatgttggccaaggtctatcacgacgacttccagcccaacgcgccctcgtacaacctgacgcggctgtggaagccggtgctcgtcgtcttcgtgcccttcgcgctggtgctggtgcagccggacctgggcaccgcgctgatgattggcctgtcatcgctcaccatcgtcctcttcgggaaggtgcgctggtatctggtggccacgctggtggcgggcgtgttcgccgcgggcatcgtcatctggaacgactacatccgtgacgtgccggagcctcggcccaccatcgtccggcaccacctgaagaagcaccagagccagcgcatctccggttggctggaccccgaggcggacctgcgcggcagcggctatcacgcggcgcagtcgaaaatcgcggtgggcagcggcggcgtgtccggcaagggctggcgtgagggcacccagacgggcctgcgcttcctgcccgagcagcacaccgacttcatcttctccgtgtgggcggaggagcatggcttcgtcatgtgcatcgtcctgctggtgctctacggcgccatcttcatcttcggcctgggcgtgggtttcaacgcgcgtgacaggttcggcgccttcgtcgcggtgggcgtcgtggcgatgctcttctggcaggtgttcgagaacatcggcatggtgattggcctgctgccggtgacgggaatcaccctgccgttgatgagttatggcggctcatccctgctttccgtgatgctcagcatcggcttgctggtgaacatcagcatgcgccgtcacatgttctga

SEQ ID NO: 3913 - DNA, 495 bp, Myxococcus xanthus
atgaaccagggcgaggcggagcaccgtcactttccccgcgcccagctcgccacgcgcttcgaggtgtgggtggatgacgaggcgggcgagcgtcgcttcgaggcgagcctcgtgtccgtcaacgtcagcgtcagcggggcgttcctggagagcaccttctacttgccgctgggccccgtgctgggcgtgcgcttcgcgctggagccgggcgccgcgcccgtgcaggcgcgcgcggaaatcgtgcgggaggagcggggggacgggccggagggccgcagcggctttggcgtgcgcttcctcgacttcagcggtcagacggaggtggcactggcgcggctcttcgtggggatgcggctgagggccttcgcggaggactatctcaagtcccagcgggctcgctccctgcccaacgaggtggaacgcgtggtggacgtgctggcggcctgggagctgctcaaggcgacgtcgtccgtttccgacccttggcagggctga

SEQ ID NO: 3914 - DNA, 762 bp, Myxococcus xanthus
caaaaaattgatgacaagactgcaaatggatacgtgtttcccgtatgtcctcacggcactgtgacactcgcagcggtcgacccgtctgtctcggcgggtgaacacgcgaaatatgagaagacgctcaaaacgctccaggagcgcgtcttcgaactgcagatccagaactacctggcggggcggaaggccgtcatcgtcttcgagggctgggacgcctccggcaagggcggcgccattcgcaggctcaccacgctgatggacccgcgtggttacaaagtctggcccatctcctcgccgtcagaggaagagcgcagacaccattacctgtggcgcttctggcgcaagacgccgggcgcgggcgaggtctgcatgttcgaccggagctggtacggccgggtgctggtggagcgggtagagggcttcgcgaagccggcggaatggcggcgcgcctacgatgaaatcaatgcttttgaacacatgctcaccgcggacggtgtgcggatggtgaagttcttcatccacatcgacaagaagacgcagttgctgcggtttcgcgagcgcgaggcggacccggccaagcgctacaagctggggcccgaggactggcggaaccgggcgaagtggaagaagtacgaagcggccatccaggagatgctggaccgcacgcaccgccccgacgcgccgtggcacgtggtgcctgggaacgacaagcgctactcgcggttggaggtgctccgccgctgcgtggagttgctgggctga

SEQ ID NO: 3915 - DNA, 294 bp, Myxococcus xanthus
atggcggaaggcggcgtggccttccccctcatgcccgcggtccacttcgtccaactcgtgtcgggcgaagacacccaggggttggtggcccgggtgaagaccgaggagcaacttgcccgactgggtgccgagcagatggccgactcggtgctggtgggggacaacgcctatgaggttgttccagggtatgtagcggaggtcgccgccggcgcgcccaggccagagggcgcggacaagaaaccggactctgaagcagaccttctggctgccttcatcctcaacaagatgggctga

SEQ ID NO: 3916 - DNA, 816 bp, Myxococcus xanthus
atgagccacacgctcgtctcgctcgcctgccacgcgtatggcatcgccgctgtcgtctacctggcctacctggtccgccagtccgaggccctggccacggccgggcgcgtgctggtgggcggtggattggcgctgcatggcgtggcgctcttcgagttgctcggggtgcagagcgggcggccggtgggcctggcgcaaggcttctccgcgctggccttcctgctgctggccatcttcctgttcctggacgtgcgctaccgccggcccgtcatcggcgccttcctcacgccgctggcgctggccgcgttgctgcccggtctgctgttgcagggcgggcaggcgccgctgcctcccggggtgcgtcagccgctgttgccgctgcacatcaccctggcgctgatggggctggccgcgttcgcggtcgccgcgggagtgggcgtcatgtacgtgctcatggagcggcaggtgaaggcgaagcgcttcggtttgctgttctcccgcctgccctccctggagttcctggacacgctgaaccggcgcctggtggtgtggggcttcctggcgctgtccatcacgctcgccacgggggccttcttcgtgggcaccgcgccgggcccctggaccgtggatgggaagacgctggccaccctcgttgcgtgggcggtcttcgccgcgctgctggtggcgcgttccgtcgcgggctggcgggggcggcgggtggccttcctcaccatggcggggttctgcctggtcatggtgtccttcctgtcctcgtatgacgtgtcgtcgccctcggcggccatgaggatgccctga

SEQ ID NO: 3917 - DNA, 1326 bp, Myxococcus xanthus
atggagctcatttgcattggcctgtcccaccggacggcgcccctcaccgtccgcgagcgactggccttgccggagtcgcgtcaggtggacgtgctccagcggctggcccaggcgcccgtggaggccctctgggtgtccacctgcaaccgcgtggaggtgtacctgttcgcgccggacgcggcgatggcgcggcagcgcgccttgatggagctgcaggtgctgggcggggtggaagccctggagcacctctacgagcaccagggcgaggcggcgctggtgcacctgttccgcgtggcgtgcagcctggactccatggtgctgggcgaggctcagattctgggccaggtgaaggaagccttcgagcggggccagggcgcgggcgcggtgcgtggtgagttgatgcgcgcgtgcgcggcggccttcagctgcgccaagcgcgtgcgcacggagacggccattggccgcgcggccacgtccatggcggcggcggcggtgcaactggccagcaaggtgttcgatgggctcgcgggcaagacggtgctggtggtgggcgcgggggagatgggcgagctggcggcgcgccacttgaagcaggctggtgcgtcgaagctctacgtcaccaaccgcaccctgtcgcgagcggaggcgctggcggcggaggtgggcggacaggcgaggcccttcgaggagctgctcggtctggtggccgcggcggacgtggtggtgtgcagcacggcgtcgcaggcgccgctcttcacgcgggacaacgtgggcgccctggggcgcggacgccgggggcggccgctgttcatggtggacctggcggtgcctcgcgacatcgatccggcggtgggcacgctggactgggtacatgcatacgacgtggacgacatccagaagttcgtcgcggacaacgccgcggcgcgcgcggaagaggcgcagaaggcgggcgtgctcgtcgcgcaggaagtagcgcgtttcgtcaaggagcgtgcgctgcgtgagggcacgccggtgctggcgcgactgcgtcagcgcgcggaagccattgcccgctccgaggtggagcgcacgctgggcgccctgggcgacggactcaacgaaaagcaacgcaagagcatcgaggccatgggccgagccatcgtcaacaagctgctgcatgagcccaccgcgcggctgcgcgccgtggggccggaaggggagggcaaccgcctggcgggtgccgccgccgagctgttcggtctcctggaggaggaggtcggcaccgccgccgccgcgccctccgtcatggccgcgccagtccaggtcgccacggggggcaagtga

SEQ ID NO: 3918 - DNA, 942 bp, Myxococcus xanthus
atgacgcacgtgcgtatcgccacccggcagagtcccctggcgctctggcaggcgcgtcacgtgggcgcgctgctgacctcgcggcatcccggtttggaagtgaccctggtggagatgaccaccgagggagaccgcttcctgtccgcgccgttgtccgcggtgggcggcaagggcttgttcgtgaaggaaatcgaacaggcgctgctcgacggccgtgcggacatcgccgtgcatagcctcaaggacatgacgtccgtgttcccggaagggctgatactcgcggcggtgccggagcgggaggatccgcgcgacgtcttctgtggcctgggcgggctgacgttggacacgcttccgcagggcgcgcgcgtgggcacgtcgtcgctgcgccggagctgcatcttgcgctcgcgccggccggacgtggacatcgtcagcgtgcgcggcaacgtgcagacgcgcctggcgaggacgcgggagcaggggctcgcgggtgcgctgctggcctacgccggactcaagcgcctgggcctggaggacgtcatcacccaggtgctgccgcccgaggtgagcctgcccgcggtggggcagggcgtgttggccatccagtgccgcacggacgatgcgcgcgtgcgcgcgctgctggtgccgctggagcacgccaccactcgcatcgccgtcaccgccgagcgcgcgctgctggcgaagctggaggggggctgcaccgtgcccctggccgggtatgccaccgtgtcgggcgacaccgtcttcctgcgcggactcgtgggccgtccggatggcacacacgtggtgcggggcgaggtgcgcggccccgtgtcgcaggcccatgcactgggtgaatccctggcggatgacctgctttcgcgtggggcggcggacatcttgcgtgatttcgcgcgccgcttcgaggcgcgggagtcctag

SEQ ID NO: 3919 - DNA, 768 bp, Myxococcus xanthus
gaacggcgacttgaaggcaagagagtcttggtgacgcgcccgcgtgagcgggccgaggagttgtgcttcctcctggaggatgagggcgccgaagtgctgagcgtgccccttctggaactgcatcctccggaggacccacgtccgctggcgtctgcggccgagcacatccagcgctacacctgggtggtgttcgcgagcccgaccggcgtggatgcgctgatggaggccctgcgcgaggcgggcacccaggaccggatacagcgggtgaaggtggccaccgtggggccgcgcacgacgcgcgccgcggagggctacggcctggtcgtggtggccgaaccttccgagggcacgggcgcggccctgctcaacctcatcaaggatgcgctgcaaccgggtgacgaagtcctgcttcccgccgccgaggaaggccggcgtgagctggaagacgggctgagagagtacggcctcctggtgacgcgggtgacggcgtatcgcgccacgcccgcgcccctgccaccggagtcgctggccttactggatgcctcaccgccggacgtcgtgctcttcgcttcgccgcgcacggccgaggccttcgtggaagaggccggacgcgagcgcctggccaccgctcgggtggtggcaatcggtccgacgacggcgtccgccctggagcggctgggcgtgcccgcggcggccgtcgcggagcggccgacgccagagtccctggtggatgccgccgtgctcgcggtgacgagcaccgtgcactga

SEQ ID NO: 3920 - DNA, 1779 bp, Myxococcus xanthus
gtgctggaggcgctcgttgcccaggggctgctgcaaccccagcaggcccaggaggtgctggcccgcgagggcgccgcgcgcgcccgggtgctcaaggcccaccagggggccacggggggcagcaaggaggccgcgcggtacgacgtatctccggtggaaatcgtggcggcgttccaggtgccgctgtccaacggccgaggcgtgctggacgaggaccgcgtcacggaggctgccgcgcgcgccgccggcatgacctaccggaagattgacccgctcaagctcgacatggcgctggccacgcgcaccgtgtccaggccctacgcgcagaagcacgtgctgcttcccctggagcgcaccccgcagggccggctgctggtggcggtggccaaccctttcgaccgggaactcttcgaaagcttccaccgcctgacggggctgccggtggagcccgtcctcagcgcgaaggcggacatcctcaagtccatcagcgacatctacggcttcaagaagacgctggcgcgcgccgccgacgacttcagcgccgccgccggagcccaggtcgccaacttcgagcagctcgtctcgctcagcggcacccaggagttggaggcgtcggaccggcccgtggtgcaggcggtggactacctgctgcgctacgcgttcgacaatcgcgcctcggacatccacattgaacccaagcgcaccaccagcgtggtgcgtctgcgcatcgacggcgtgctgcacccggtgcacacgctgccggcgccggtgcatccgcccatcgtctcgcgcgtgaagatgctggcgcgcatcgacatctccgagcgccgcaagccgcaggacggccgcatcaagacggagcgcgacggccgcgaggtcgaactccgcgtgtccacgctgcccaccgcgttcggcgagaaggtggtcatccgcatcttcgacccggagacgctggtgcaggacatcgcccagctcggcttcgagcccgacgagaagagcgccttcgagtcctggattgaccagccacacggcctcatcctcgtcacgggccccacgggcagcgggaagacgacgacgctctactccgcgctcaaggcgctggcgggcccggacgtcaacgtcaccaccatcgaagaccccatcgaaatggtgtgggacgccttcaaccaggtgcaggtgcagcccaaggtggggctcgacttcgccggagcgctgcgccacatcctccgccaggacccggacgtcatcatggtgggcgagattcgcgacccggagacggcggagaacgcgattcaatccgcgctcaccggccacctggtgctgtccacgctgcacaccaacgacgcgctgggcgcggtggcgcgcatgcgggatttgggcgtgccgtccttcctcctggcgcagagcctcctgggcgtcatggcgcagcggctgctgcgccgggtgtgcagtcattgcgcgcaggagacgacgctgacaccggatgagctgctcgcgctccaggcgcccctgccgctgctgcccggtggtgtgcgcctgctcaagggggcagggtgcgtgcgttgccgtggcaccggcttcgtgggccgcacgggcgtcttcgaaatcgtcaccagcgcgggcgagctgagagacctcatcgcccgcgaggccccctattcgcagatggtggacgcggcccggcgctccggcatgcggacgctgcgcgaggccgccgtgcgcaagctggcccagggcttcaccgccttcgacgaggtggtgcggatgacgaccgtctga

SEQ ID NO: 3921 - DNA, 378 bp, Myxococcus xanthus
atgagccccctgcgcaccctcttcgcggccctgttgtcactgtccagcgtcagcgcctgggcccagctgccggacgcggaggcggacgcgccggaggctgagagcgccaaggccgaggagcccgaggcgcccctcaccgtggcaccgtgcaacgccgcgctgccggcgctgcgcacgcccctggcgttcatgccgggtgaggtgctcgagttcgacctcgacgccatgggcgctcaggcgggcaccatgacgatgcgcgtccacaagcagaaggatgggcatctccccatccaggtggaggcgcagaccaacaccttcttctccaaggtgcggcgcgtgcgcggcagtgccaccgcgtacctacaccctcgcacgctg

SEQ ID NO: 3922 - DNA, 813 bp, Myxococcus xanthus
ggcggcgccctgagctaccgcgagctgcgcgcgaagcatgacgccctggtgctggccatgggcgcgcgccgtccgcgcgagctggaagtccccggacgcgaactgtccggtgtcgtccaggccatggagtacctggagcaccagaaccggctcgtctcgggccatggccagaaggacccacgcctggacgcggccggccggcacgtcgtggtgctgggcggcggcgacaccggctcggactgcctgggtaccgcgctgcgtcagggggcggcgagcgtgcggcaggtggagctcctccccgcgccgcccccggtgcgcgcggagggcaacccctggccgaggtggcccgtcatcttccgcacctccaccagccaggaggaaggcggcgagcgccgcttcgcgctgatgacgaagcggctgacgggcagcgacggacggctccagacgctgcacgccgtggaaatcgagttccagcccggtcctggcgccctgccccgcctcattgaacgtcccggcaccgaggtgacgttcgaaacggacctgctggtgctggccatgggcttcacggggcccgaggcgggcaacctctccgaggagttgggggtgaagctgtcaccccgcggcacggtgcaggtggacgcgcgcttcgccacgtccgcggacggggtattctgcgccggggacgcgagccggggcgccagcctcatcgtctgggccctgtcggacggccgcgaagccgccaaggcctgcgatgcgtatctttctggggggcgttccgcgctgcccacccggggcacggactgcgccttctga

SEQ ID NO: 3923 - DNA, 1650 bp, Myxococcus xanthus
atgtcctccacgcaggagcctcaggtggtgtcgcccctggtcaaggtccggccgggggaagcagtgaagggacgcaaggaggcgcgcctcagcctcgcgcgcggtgagtgtgaggcagtgcaggtggtgcttcccggccgggtggagcgcccccccgtggagtcgctgacgttgaagggcccgggcgcggcgctgaaggccagcgtctggcgcgaggccttcatcgacgtgaagacgccgtccaacggccagggccacaagggcccgtggcccgacgcgctggttccggtggatgcgccgggacatgactcgaagctgcccaccgtcttctacgtggaggtgtgcgccccggagaagcaggagccggggacgtaccggggacagctgctggtgaaggcgggtggcgcgaagttccggccagtgccgttcaccgccgaggtgcagcccttcgccctgcccgccacgtcctcgctgcccaacagcttcggggtgtcgatgtacagcatcgcccggggccacggcgtggcgccggagtcggcggagtcacgcaagctgttgcgtgactacggacgcgcgctcctggagcaccgggtgagtgcccacggcatgagcatgacgccacctcccgtgcgcttcgagaagggccgcgcggtactggactggcgcgagtacgacgcggagatggcgcccttcctggacggcagcctgctgccctccggcgcccgcttcaccagcaccgacgtgcgtgacagcaagcaggcgaagacggacgcggagaagacggcgtactaccgcgccttcgccgagcacttccgcgagaagggctggcccgcgcagctcttcttctacgccaaggacgaacccaagcccgaggacgtgccgctggtgaaggcccagtccacgcgggtgcgcgcggcgggcaagattcccgtgctcgtcaccagcccgctggatgacgcgctgaatggctcggcggacatcctcacgcccacgctcaactgcttctacccgcgccccgggccgcagacgtgccgcagcgtggtggaggcgcgcgcgctgcgcaaacggctggcaggtgacacccgggtgtggtggtaccagagctgcaattcgcacggctgcaacggcggccccccggcggacaaggcggtggacgcggcctacagcggctgggcttcgtacatggtggaccaccccgccccgctcaaccgggccatgggcgtgctcgccttctcctccggcgtggacggcgagctctatttcgacaccgtcttcgcctacaacacgaagaaggacccctggaaggacgtcttcgagttcggcggcaacggcgacggcaccctcttctatccggggacacccgccagggtgggtccttctggccaccagcccatcctcacgctgcggctgaagcacatccgggacggactggaggactacgagtacctccggttgctcgctgagctgggggacgccaccttcgcccggacggccgcgcgcaagttggcgcgcaccggttgggacatcaacgcggatgcgggagaatgggaggcggtccgcgaggaagtcaccacccggctccggaagcgctgggcggagtccgaatatgcgaagcgcacggaccgtcagacgccgcagagcaccccgtag

SEQ ID NO: 3924 - DNA, 738 bp, Myxococcus xanthus
atggcccaggagtccgtgaacccggcgttcggccctggggagcagagctcctaccgcgtcaggtacctgggcatcaccgcgggaaccgcgcaggtgacggtgggtgcccacatgaagcagtggggccaggacgtgtggcccatcgtcgcggtggcacgctccaacgacatgctgggcgtgtggcctatcaaggacaagttcgtgtcctactggcagccggagagccagcgtgtggtgggcagtgacttgcacgcggatgagaacggctcacgccgccggcagcgcatcaagatggagccggacggcaagacggccttcgtggtgaagcagaaggaaggcgagtccccgcgcgagtccacccgcgaggtgatggagggcacgctggatgtcaccggtgcgacgttcgcattgcgcaaccgggagctggtcgtggggcaggagtatgcctatcccgtcttcaccggcagcaagcagttcacccttcgggcgaaggtggaagggcgtgaagtcctgggcacggcgatgggcgacaaagaggtcttcaagctcagcgtgaagacggagtttggcggcaacctcgcctcgaagcgggacatgttcgtctacttcaccacggactccagccacgtgccggtgcgggtggaggcggagttcgcgctgggcactatcgtcgcggagataaccgactacaagccgggccggagcatgacggtggcccgcgccgagaatggcgggtag

SEQ ID NO: 3925 - DNA, 675 bp, Myxococcus xanthus
agcgtcgcggagcggctggcgtcggtgcgggagcgggtggtggcggcctgtgcccgggcggggcggccggtggagtcggtgacgctggtggcggtgtccaagctgaagcccgcggacctcatccgcgaggcctatgccgccggtcagcgcgacttcggggagaactacgcgcaggaactgcgggacaaggccgcggagctggcggacctggagggcctgcgctggcattccattggggcgctccagacgaacaaggtgaagtacgtggcgcgggcggctggggccttccacgccctggaccggctggaggtcgctcgcgagctgtcgaagcgccgcgagggcgccccgcccctgcccgtctacgtcgaggtcaacgtgggcggcgaggccaccaagagcggcctggcgcccgacgcgctcggcgccttcctggatgaggtccgcgccctgcctggcctccaggcggtggggctgatggcgctgccgccccccacggaggacgaggcccgggcccgtgcggacttccaggccctgcgcgagctggcccgtgtgcacgggctgccgggcctgtccatgggcaccacccatgacttcgagtgggccattgaagaaggcgccaccgtcgtccgggtgggcaccgccatcttcggtgagcgcgcgctcaaatctccttga

SEQ ID NO: 3926 - DNA, 576 bp, Myxococcus xanthus
acgttgctcgtcctggcctcggcgtcgccgcgacgcagggaacttctggcacagctggacatccgtttcaccgtttccgcggcggacatcgacgaaacgccccacgccggcgaggcagcggaggcctatgtcgggcggctcgcccgggagaaggcccacgtggtggcctcccgccacccgggcgcctgggtgctggccgccgacaccaccgtcgccctgggcgccgagctgctgggcaagccccgggacgccgaggaagcccaggccatgctcacgcgcctgtccgggcggacgcatgacgtctacacgggcgtggccctggccggccggcatgaggagacgctggtggtccgcacccgcgtcaccttccgcgcactgagctccggggagatgtcctggtacgcgaacagcggcgagcccctggacaaggccggtgcctacgccatccagggcaagggcggtttcctggtggcgggcgtggaaggcagcacgtccaacgtcgtgggcctgccgctgggcgagacagtggccctgctggagcgggccggcctccccttgccctggagggcctcatga

SEQ ID NO: 3927 - DNA, 1371 bp, Myxococcus xanthus
atgagcttcctgcgctcgcagggcagcccggtgcccgagtcgctcgcccgccagttcggcatgcataaccaggtgctcgaccggttggtgaacacggagctgctggcccaggcggccgagcgccacggcatcgccgcgtccgacgatgagctgcgcaagctcatccaccagaacacggacttccagaaggatggccagttcgacttcgagcgctaccagcaggtgctgcgcgacttctaccggaagtccccgcaggacttcgaggcggagctgcgccggcaattggcggcccagaagatgatggacgtggtgcgcggcaacgcggtggtgtcggacgacgaggtccgcgcccgcttcgagaaggaaggcaaccaggcgaaggtcgtcttcgcgcgcttcctgccggccatgtacgccgacaaggtccccagccccaccgcggcgcagctggccgagtggaagaaggcgcacgagaaggacatcaaggagtacttcgaggccaaccgcttcgtgtaccagcagccggagcgcatccgtgcgcggcaggtgctggtgaagctgcccccggaggccaccgccgaccagaagaaggcggccctggagaaggcgcaggcgctgcgcaaggaaatcgagggcggcaaggacttcgcccaggtggcgcgtgacagcagcgaggacccgggcagcaaggcgcgcggtggcgacctgggctgggtggagcgcggcagctgggaaccggcgctggcggacgcggccttcgcgctgaagcagggcgaggtgacgcagccggtggagacgaagttcggcgtgcacctggtgaaggtggatgagaagcaggccgcccaggacaagaagctcgaggacgtccaggacgagattgccaccacgctctacaagcaggaccgcgccaagcagcaggcccgcgccgaggcggagaaggcgttggcctccgccaaggcgggccaggacctgaagacgctcttcccgccggagaaggagcagcccgcgctgctgcgcttcgagacggagacgcgcccggaggccgtggagacggacagcttcaccgccgagggtgaggcggtgcctcacctgggccccgcgcccgaactggtgaaggcggccttcgccgtcagcgccccgcagccgctcgacagcgtgttccccctgggtgagggcttcgtggtggcgcaggtggtggagcgccagaagccggacgccgagggctttgacaagcgcaaggaggaactgcgcgcccaggcccgtcaggccaagcagattgagctgacggagtccttcctcaaggcgctgcgtgagcagggctcggtggtaacgaacaccgccgccatcgactccgtggtgggcaccgggtga

SEQ ID NO: 3928 - DNA, 333 bp, Myxococcus xanthus
atggcaggcgcggacgtgacgaacatcggggatggcgatttcaagcagcaggtcctggactcccaggagcccgtgctggtggatttctgggcgacgtggtgcgcgccgtgccgcgccatcgcgccctccatcgaagcgctggcctcgcagtacaaggggcaggtgaagttcgccaagctcaacatcgatgagaaccaggacacgccgcaggagtacggcatccgttccatccccaccctgctcctgttcaagggcggccgcgtggtggagcagattgtcggcgcggtgcccaaggcccgcatcgaagaggcggtgaagaaggccctgacgtag

SEQ ID NO: 3929 - DNA, 2943 bp, Myxococcus xanthus
gcccgggaagacgccccggtgctggtgtccaccaagggtggagccctggtgcagtacccgctgcctcctggtgagccggtcatcacctacaagggccgcctggcgctggtggtgcgcgaggagccgggggcgcgcggcctgcgccgctacgtgctgcgctacgtggagaacgacgaggaggacgagctccccgagtcctcgctgcgcgcgctgccgccccgctccgacctgctgtccaccctgcgcgagggccgcgtgggcgaggcgcgggccttcacgctgcgaaagcaggcgctggtgctggacgacgagcgccgctgcgatgcgctgggcgcgctgctggccagccgcatcatggtgaagccgcaccaggtgggcgtggtgcagcgcgtgttgtccgccagccgtccgcgcttcgtgctggcggacgaggtgggcctgggcaagacgattgaggcgggcatggtgttcagcgcgctgcgcctgtccggactggcgcgccgctgcctggtggtggcgcccagccacctcaccgtgcagtggctggtggagctgttccacaagttcaaccagctcttcacgctgatggattcggaccgctacgcgcagtccctgaaggaagcgccggaggtgtccccttgggcgcgcttcccgctggtggtgaccagcctggagatgctccagcgcagcgaggagcaccgccgcgcgctggccggtgaggacgccttctgggatttggtcatcatcgacgaggcgcaccacctcaagggcgagcgcgccttcgaggccgcgcaggtgctggcgaagaacacgtggggcctgttgctgctcaccgccacgcccatgcagttggacccggcggagtaccacggcctgctcaccctcatcgacgcggccacggcgccctccgtcgcgggattcgaggagcgcctcaagcgccaggaggagctgtccgccgcggtgcgcgcgctgatggagggcggcaagccgtccgccgcggtgcaggcgctggcgaagcgcttccccgaggacgcgaagctgtcctcgctgaaggaccgcgacgcgctgctgcaacacctgtcggagacgtacagcctcagtgaccggctggtgcgcaaccgccgcgcggtggtgggcggcttctccacgcgccggttgcaccgccacccggtgacgctgcccgccgaggagctgacggtccgcgacgccgcgctggcagtgctcgccggggccagcctgcgcggcgcgccgctgggcaacgtgctgcgccggctggagtccagccccgccgccttcgcgggcgcggtgcgcgccaaccctgtgttcaaggggcatgcggacgcgctgcggttgccgtcgcgcgacgcgaagttcggcgccttcctgggcgtgctgcgcggcgtctggaagacggagccggcggcgaaggtgctcgtcttcacggagagccgcgacacgctggacgcgctccagtccgagctgggccgcgagggcgtggaggcgctggggtaccacggtgacttgcccctggtggagcgcgaccggcaggtggcgcgcttccgtgacccggaagggcccaaggtgctgctgtgcacggaggtgggcggcgagggccgcaacttccagttcgcgcaccacctggtgcactacgacctgccttggagcccggccacggtggagcagcgcattggccggctggaccgcatcggccagacgcatccggtggagattcacgtcttcgacccggcgggcacgctggcctccgacgtgctgatgctgctggcggacgcggtgggcgtcttcggcgagacggtgggcggcctggacgcggtgctggaagaggtggaggcgcggctggccgagctggcgctgatgccgcgcgaggcccgcatggcctacgcgcaggagctgaaggcccgcgtggaggcggcgcgcgcccaggtgaagcgcgcctatgacccgctcctggacgtgcgcagcttcgaccggcccgcggtggagcgcctggtgaagcgcgcccaggagcgcatgggcatcgaggccgacgaggaggacgaggacggcgaggcggaggcgtccggcgtggaggatggcctgtggggcatcgcgcgcgacctggacgagcggctggaggagacggtgacggagctggcgcgccgggtgggcatcggcgtggacaccgacgagcaggtggaggccttccaggtggccttccagttcggccacgcgctgaaggtggacggactgccgggcatcgacgtgatggaggaccgcacgcagctgggcaccttctggcgcgacaccgcggtggaggcggaggagttggagtacttcgccaccggccacccgctggtggaggcgctcttcggtttcctgcgtgacggcccctatgggcgcagcgccttccgcttcatcgagcggcgtggaccccagaagggacgcggcgtggagctgctcttccacgcccaactgccggagccagaggacacgtccccaggcgcccgggtgcccagccgccaactggcgcgcttcctggaacgcacactgctgcacgtggccgtggtggacggcgccggcggccccaagtccgaccccacgctgctgcccgcgctggagaaggaagggaagtcgctcaagggcgacgaggtgtcgcttgccttcccgggcttcgcggacttcgtggacgcggcggtgcccgtgggccagaaggccgccgagtcagagctggcgaagctggccacccgggcgcgcaaggccattgaagccgagcgcgacgccgccgtggcccgcctgcgcctgtccctggggcaccagggcctctccaccgaggccgtggaggcgcaactggacgcggagcgcacccactacgcccggctgctggacgcgctggcgggtgccaaggtggtgctcgactccgcctgcggcttcgtcctcaaccgctga

SEQ ID NO: 3930 - DNA, 681 bp, Myxococcus xanthus
atgatgctccaggcccgcatcctggcgcaggtggcggcataccgggcggtgcgcgcgggcagcatcaaccacggcaactgcctgccgatgatgcacgcggcgctggtgaccatgttgcccacggtggcgcgcacggacagctcggagaccctggctgcggccttttccccccgccgtcacaaccaattccgggtgcgtagctcctacgggcgcgacttcaacgagccgttgattgaaatcgtccgggagtcgccggatgccggctgggcgcaggagctgacggggggcgaggacctgctctttgatcagcccacggacaacgcggcggcgctgcgggcccgcacgttggagatacgcatggtggcctggtactacatgcgcgtccccttcgcgaactgggtgatgagccgcatgctgctggcccacttccggctccggcgctacacggcggccaacccgctgatgccggtgcagcgccgctccgcgtggtggggcgagacgagcgccacgctggggcgcgacggctggcccggcggtgatttgggcacgcgcatggtgcgctggagcgaccaggggcacttcgtgttccccatccaggtcaacgcggccatgcgaatgatgacgcccgtcatgtccgagtacttcatgggaggtcccgcgtgcaatctccacggctcgtga

SEQ ID NO: 3931 - DNA, 1455 bp, Myxococcus xanthus
atggtgctgatgacgctgggcttcggcatgcgcgccaaggagcgcgtcgaaatccagatggccgcggacgcggccgcctacagccaggcggtggccacggcgcgcgccttcaacgccatctcggtgatgaaccgcgcccaggtggcgcacatggtggccatggccggcacccagtcgctcatcagccacagcagccaggaatacgcggcgcacgacgtggcctgccccggctccatcccgccgccggtgtggttcgccgcggacgctgccgccgccacgcaggtgcggcagctccagggccgggccggcaacatgttccaggccgggctcaacatctacggcaagctcctgagcgagcacatcgcggagcaggagctcacccggcgtgtcgcgcaggcggtcaacccggagctccgcgcgccgtccgctggcgcggccaagagcttctccgagctcaatggtggcaacgacgtcccggagcgcgacgccgtcatccagtccatcaaggcgggcacctatggctgcggcgtgggggacggagcgctctgcccttcgggcggcggtacccccgcgctcaacgccaccatggggagcatggggtggacgtgggtccacaaccgtccgggaggcaccgctggtttcggcaccggcggcgccgccatctccaccagctttcgccgctacggctcggtgtcgcagatggacccctcgacgtaccacaccgtgtcgggccgcaactcgacggcgcatgaccacgggcgcgtcgtcatccccacgcgctgcacccgagcgccgacgcttccacccatcgcgacggatgcgtgggtgatgtccgacgaggagcagacgcacgaggaccagcacgtctacggcgcgcgcatgcccccgggccaggcgccggaggacggcaagcccacctacgagacgcatacgctgggcgcgtgcgtggtgtgccccggcatctggccctactccgttggctacaacgtggacgaactgcacgcgggcgcgtccaaccactacggccagcccaagctgtacagcatgctgtaccgggactacgcgagcgcggagcgccgggcccgcccggacccgtggaacctcttcttccgcttccgcttcgcggggaccgaaacagagttcgacaacagcagtccgctgggccgcatccgccccacgggccgcgaggacgtgcaccgcaaccaggtggccctctccgctggcatggtctactaccaccggccccagcccgcggtgcagggcggcggctggcgcgaaccccccaacttcctcaaccccttctggcgcgccacgctggtgagcgcggagggcgcccgggatgaccggcccgcggacagcctgtccgccgccggcttctccgggcacgcgcgggcgctgcgagagctgcactccgtgggctaccggggcggtggccccggcgacaggggctactga

SEQ ID NO: 3932 - DNA, 951 bp, Myxococcus xanthus
atgcgggttcgccatgcacgaggccagtcgctggtggagacggcgctgggggtgatggtgttcgtcaccatcctgctgttcggcatctacttcgccgaggtgggcgcgctgacgctcaaggtgcaggaggccgccaacttcgcgatgtggaacgccaccggccgggtgatgcacgacccgcaggacaacgagtggggccgacggggcacggtgctcgccgccgaggcggaggccaatggccgctacgcggacttcgacgggcgtcagcgcatgggccgcacgggcgtggccgtccagcaggccattgcccgcgcgcagcccatccaggtggattgccgcccggagctgccgggcaccgtgcgcggcctctccatggcggatgccgacccggacctggccggcaccatcgccatggggacgcagggcatggggtgcaccgcgtcctcgagcattcgcggcgtccggattggccgctatctggagaatggccgggaggggttcttcaaggtgtcccagcgccgggccgccgatgccttcacggtgtgcgccgccgggcgcgcctcgggtggccgctgcacggcgcgcttcggcatgctgctggatgactgggggctgggcggcgtggaggagggccgggcttgcgcgctcaacatcaacggcgcgcgccggtgcgccaacccggactactacgagtgggcgcagcgcgtgtaccgggccaacggtgcgggggggaacgccggctccgcgctcgcggcaatcaccggcgcggccggcgtcaacgaggaccagttcttcatgagcttccgcggcgaggaggacaactacgaggagaacctcggctccacgcacgccggcggccagacgcgctgggaggtgacgcccttcgacgcgcccaacatccgctcgtacaaggtgggccgcgcgagccactggctcggggtgccgcggtga

SEQ ID NO: 3933 - DNA, 696 bp, Myxococcus xanthus
gccggcgtagcgcaagggacgcgtgtcgtggacgtcgccacggggccgggcacgctcgcgctgctcgccgcgcgcgacggcgcccgcgtcacagcagtcgatttctccccggagatgattgccgccctgcgcggccggaccgcggaggcgaagctcgacgtcgacatcctggagggtgacggcatggcgctgcccttcgaggcgaacgcgttcgacgccgccttctccatgttcggcctgatgttcttcccggaccgggcacgtggcttccaggagcttcaccgggtactgaagccgggcggccgggccgtcgtgtccagttggacgccctttgaacgctcgaaagagctgcgcgccgtgtacacgcgcctctgggagcagatgggcgcgaagccatcacagccgggcgccatccccctgtccgaccccgacacctgtcagcgggagatgtccagcgcgggcttcacccacgtcacggtgaacgaagtggaaggctccatcgactacccgtccacagcggccatggtggatgccaccacccgctccagcgcgcccgtcgtgctggcacgcagggcgctgggcccgcagtgggagccgctgctctggtccatgcacgagtacgcgcaggcggagctgggaccggggccccagcgcgtcaccctcacggcctacctgacgacaggcaccaggccgtag

SEQ ID NO: 3934 - DNA, 435 bp, Myxococcus xanthus
atgctcaccgccatcgacgggcaccggggcatcacctacaccgtcatcttccagccgcagccggaccgcaccacgctgatgtacctcggtgaggccaatcacgccctgcgcagggacccggcggcggcgggggacttcgcgcccatgccgccccaggccagccaggtgctgcgcgtcaacagcgagagctcacgcacgctcgccttccacgtcccattgtccggcgaggccgtggacgccttctacgcccaggcgctcacgcgcgcgggctggaggctggaggaaggggagacgtccttctacgtgcgcacgggcgaggagctgcgcgtggtgcacgagccgggcgaggggaatcaacgggccgtggtgctggtgtatcgcggcgggcggagcgtgccaccgccgcctcctgggcccgccgctgtcgtgcgctga

SEQ ID NO: 3935 - DNA, 636 bp, Myxococcus xanthus
atggcagaaacctccgtggaaacgttgaagactgcggtgcaggcgctctatcgcgtccacgcggtggaaggcccgcccggcgagaatgggctgcgcaccgtctggcacctgtgcccggacggcgcggagctgatgtccctggtggattcagaggggcgcgtgcgccggcaggagctcacgctgctggaggaccactacgtgtgggccagcggtgagggcgtgcgcaccggctacctggagcgcggcggcggcaagcccacggccgcggcggtggtccagacggacccggagctcgtgccgcagcggctgatgcgcgccgcgctcgccatgggcacgtacacgggacaggaccgctacctgctccacatgcagcgggtgctggcgctggcacgcgaaggcttggagatgaagggcggcctgacccgtccctccgagcccacgctgcccgccgtggaggcgccagtcgtgtcgacggctcaggccgccgtcttcgacgtgccgcccgctgcggtggcggtggtggaggacgtcacgcctccggtggtgcggcgcggtgagggcgtgacgatgctgctggtgctcgccctggggttgctggtggggttcgggatgctggcgttcatcttgatgggctga

SEQ ID NO: 3936 - DNA, 363 bp, Myxococcus xanthus
atgagcgcgacaaaaaacttctccctcgcccgagcctggctggacgctttcaacgcctatgacgtggacgcgctggtggcgctctatgccgaggacgccacccacacgtcccccaaaatccgggtgctgcacccggagacaggcgggcggctggtggggcggcaggccctttccgcatggtggaaggcggccaacgcccggctgccggggctgcggtacgagctggtggccctcaccgcggacgaggaccgggtgttcatggagtacctgcgccatgcgccgggggaggcccccatgccggtggcggaggtctttgaggtgcgcgacggccggattgtcgcctcgcgggtgtaccacggctga

SEQ ID NO: 3937 - DNA, 330 bp, Myxococcus xanthus
atggcgaagaactcgaaccccagcgcattcgacagggacttcggttacctgatgccgttcctggaccgcgtggcggcggccgcctctgacctggaggatgcgtccgcgcgcgcggagctcacccggctgatggtggaggagaaggcgcgctggcagcgcatccaggagctgctcggaggggcggggggccgcggcgcagccgcgcccacgccggcccgggaagcgcccgccgaggcaccccggctggcgcggggctcggcggacgagctgcacgaagcggcccctttcgccacgggcctcacggtgggcagcctcaggggcagccgctga

SEQ ID NO: 3938 - DNA, 1173 bp, Myxococcus xanthus
atgggagacgcgctctttggttacgacatggtcctgcaggtcacccagaatgaaatcaactcgcagttctccaggttgatgcaacaggggtacatccgctccctgctgaagacgaacgggctggccaccgctggcggtgcctttggcggcggcgagatgaccttgacctcctacatgaggggctacatcgcggcgcccagcgtggcgcagccgatggtcatcctggcctctggtgacaacccccagcagtgcctgtttcagttcgccctgcaaagccagccgctcacgcagacggtcatggagcaactcggtttcacccaggcccaggtggacgccgcgttcgcttcccctcagccaggccctgataactcgcagtacgggctgctggtgaatcatgaggacatcgcattcgggagcaacggcgaggcccagacgctgccgaatcagacggtctactactggctgaagcggacgtcggtcacggtgggcaccaccacgacctattcgaactacctggtgccggcgttgttctacatgtcgggaggcctctaccccaccctggtggacctgtctggcctgccgctgcgcttcacggtgaacctggattccatccccaccacgccgcaaggcatcgccgaactggtcgacaaaggaatcatgccgccgcaggtgttggacaccatcaacggcagcggcttcaacagcgcgtatttctccttgaagcagttgttcctgaacttcgacaccaccgacttcacgcagtggagcacgaccgcgccgcctaccagcaccgcggtgacgggggcgtcgatcaacaccgccagcaacacgttctccgtctccaccaccaccctggcgcaactggtagcggacccgggcttcctcaccgaggtgagtgtcgcgctgcaatacgccttcggcgtgggggcgacctacgacggcaaccccgcgtccacgccgtacatcatcggcgtctcggtgacctcctccaacccggcgcagaccgaccccgacagcacccccctcctggtgcccacctcggtcggcttctccagcctccgcaacaacgccgacagcggactgtccgtcctgaactaccaggtgatggggcggcggcaacgtcaatcccatccagccggcgcccagcgtgggcacgaacttcgtcgcctctaa

SEQ ID NO: 3939 - DNA, 648 bp, Myxococcus xanthus
atgaccttcacctatcagacctcctatgagtggctggtccgcagcacgccgccaccggacaaccggctgaagacgggcacctatatgaaggtgacgcagaaggagagcccgaactacaccatcgcggtcagcggcaatacggtcaacgtctcgggctcgctgtccatcacccagaagctcgcggccacgctagaggtactcagcatcgaaatcccccttgtctggagcgtgacctgccagacctcgttctcgcaggcgctgactctggcggtgggcggaaatggctatgacctggtggtgaatcactctcaggccactttcagcaagccggtgaacggcccgctcgaatcgaataactgggaggcgggcctgagctccttcgtggtccagaccgcgtgggccatcatcgaccagttgtttcccacgtccaagttgattcaagagctgaacccggctcggtacacggtggatgtggtgcatgcgcagatcaacaacaccttcaacaagctcaactcccagttgaacaaggggctgacgggcggcgccaccggcaacttcatctcgcccacgggggccgtgtttctgctgaacgcaccgcgcttcaacgacgcattggcactgcaaatggacgtcacgtacggcgtttga

SEQ ID NO: 3940 - DNA, 1016 bp, Myxococcus xanthus
atgaagaattacctgccagcgctgccgattgcccccggcggccaggtcaccgccgcctgcgactccaacggctaccccatcgttttctcctttggagccgacagcggggatttctatgccatcgtcaacacgcgcaatgactccacgggctggagtcagattgacttgctgccaggggtgtccgcgctgggcaagccggtctatttcgccagcgggcaattgagcaacggcaacctctgcctgttcctggcttgccaggatgctgcctccggcgcggtgaatacctatgtggccggaccgctgtccaacaacctggaggtgaccgacctgtcgcagttggccgcgctgtggacccccaccggcaacccgctgtctggcgcgagcgtgagccgcgccagcatcagcccgctggacgatggcaagggctttggcatcccgatgatcgccgtggggctggtcgcccccggcgccacggacgtgctcacctacttgatgcaggccacggtcaacaccacgaccggcgccatcacctggaactggacctcctttccctcgcccaccgacgcccggacggtgctggactccgcgcccggagcggtctccgacctggggcagggcctgtacatgctgtacgccggccaggacggcagcacgcacctcgtcttcaagacgctgctcaacgagttcgggcgggactacgtgcgggcgctgcccgtgcccgcgggccagaacagtctacagaccaccgcgggcagcggcggcaccagctatctctatgccggcggcgcggcgggaatcgtgttctggagcgccagtgcccagctcgaatcgaacgcgccgggctggacggccgcgcagaccgtcgccacgggcgaacagctgccgggcatggccgctggtgggctcgtggtcccgcagagcttcagcaagtccaacgcgctctccgcctgggcgctctccggcagcaacctctacctgctcagccagttcgagtatcagggggccctgcactggac

SEQ ID NO: 3941 - DNA, 171 bp, Myxococcus xanthus
atggacggggtgacggactatgcgctgtgcttcctggaccggcacggccgggtgacggcgtggaacgcgggcgccgagcgcctcacgggctggtccgaggtggagctcgccggacgcgacgcggaccgcatctacccggtggacgaggtggccgcgggcgtgccccgcgcg

SEQ ID NO: 3942 - DNA, 561 bp, Myxococcus xanthus
atggccaaggacaaggacgacaacggcggcggcttctccggcaagcgcaacaagagctggcgcgaaatcgacgcggggcgcggcaagggcagcaagtacgcctcccgccaggacgaccccgcgcagcagaagctggagcgcagcgcgagctaccagaagtacaaggccgccgcggacgcgctcttcaccggcggcgagctgcccgaagggctggcgaagacgttcgaccccgagggcaagcgcaaggcccagaagcaggccatgcagaaggtcaccgagtccgagacgcgcgccgactgggtgaaggccgtggtggactacctggagaagtacccggagctgcccgaggacgcgtacttcctcgacagcctgctggaccacccgcgcgagcgcatcgtcgacaaggcgctggcgaagctggaggtgctcggggatgaaggcaagctgaagaccaaggtgccgcagagcctggaccagcgcctgaagtccgtcgagctgacgagcatggaccccgacatgcagggccgcgccaaggcgctgcgcgagaaactgcgcgcctga

SEQ ID NO: 3943 - DNA, 231 bp, Myxococcus xanthus
atgctggagctgggctggccgccgggactcacgtccgtcaagccggcggtgttggaggcggacacggatgccccgccagtgcctcagccgctgaaggactacgcggacgaggcgctcttcgaggcggagcaggacgaggagcagcccctgtcctcccaggaactggaggcggtgcggcgcctcgtccatcgcggactggcggcgctgtggggcgctcgcaaggagagatga

SEQ ID NO: 3944 - DNA, 783 bp, Myxococcus xanthus
atggcggggctgctcgtgggcagcccctgggccattgtcctgctgctcatcgcgggcggcttcgcggggcgctactacgacgcccagcacgccctaccgcccgaagacccggaggcgctgtccggcttctcccacgccccctacgcttccgcccatgacgccacgtcggaggcggcgctcgtgcctcgcgaggaggagccctacgagcagttcgccagtgacttgtgcgccgtgttcgtcgaggtggcccacgcggatggcgaggtccgccgcgacgaggtacgcgtggtgcggcgctacttccagacgaccctgggctacggccccgaggccctggaggtcgtccggagccacctcaaggtcttcctggcccacccgcccgacctggacgcggccgtcagcgcctgccatgcccagctcccctcggccgagcggcaccggctgctggacacgctctacgagctggcgctggccgacggaggaatgcagcgctccgaacgggaggtcctgcgccgcgtcgccgagggcctgggcatctccgaagcggacgagcaggccatcatcgccctgcacctgggcgccggggatgaacactacgccgcgctgggcctgatgccggacgccaccgacgtcgaggtgaagcgagccttccggcagctcgccgcggagcaccaccccgacaaatccgcccacctcggccgtcaggccgccgagcaggccgcccgtcgcttccagcagattcgcgacgcctacgaagagattcggcgcctgcgcgggctgtag

SEQ ID NO: 3945 - DNA, 225 bp, Myxococcus xanthus
atggccatcacccttcctgatgagcccatcgagacgcccttcgaggtccccgccaaccgccccgaagtcacggacgaacccaccgacgccttcatgaaggcgcaggtgagctgggatggctgggccgcgcacggaggcggccacgtcccggaagactacgcgtggacctccaatcccaaggagcgccaggacgaactgatgggcgaatggcccggcgagtcatga

SEQ ID NO: 3946 - DNA, 930 bp, Myxococcus xanthus
atggcgctggcgctggaggtgccgctgctgtccctggcgctggtcggctccggcatggatcggcgggtgcccttgtccgcgatgctgggactggccaccctgccgtggatgctggggttgatgggcaccgaggtcctgatggaccgggtgctggcctccctgccccggctggatacggtggaggcgggcctggtgcttgcgaccagcacgggagaggccatggcgccgcggctgctgggcgcctggacgagcaccgcgctgctgctggggctggcgctgggactggcgctggcgcacttcggccccacgggcttccgggagcctgcgggctcccgcaaccgcggactgctgctggccagcggcgtctccgcgtccctggcctcggtggccatggtgggcgcgctcgaggcccgccacctgctgagcttcctcaccagcctggcgcggatgccggacgcggagcgctcggagctgatcgccacggggctcgccgcgacggcgaacctgcgcgcgctgcggtggacgtgcaccggggtgctggcggtgctgggactgacgctgatggcccggcgcgccggagaagactcccactcgccgctgggctggtccgcccggctggtgcccgccaccgcggtggccgtgctgctggtgctggatgcgcacccggtgagctccgccacggaacacgcgccggtggccattcccgccgaacacggcgagagcccctcggggagcatgccgcagccgccctccggagacgtgagccccgctcagcccatcaagatgaacgccagcatcccgaaccccaccagcaaccccagggcgagcaccagcagcatcgtcacgccctcaccgcgccgcaccaccggaggcgtgacgtcctccaccaccgccaccgcagcgggcggcacgtcgaagacggcggcctga

SEQ ID NO: 3947 - DNA, 168 bp, Myxococcus xanthus
atgggcatgcacgtgcccctgctgctggccggcgtcctcgcctatggccgcatcggttgcaacggcggcgggtgtcccaagctctacctgctgggtgtgctcgtttctcccatcgcaggagtgctcgcgagcgtcatctactggctcgtgggtcgtcccccggtctaa

SEQ ID NO: 3948 - DNA, 1641 bp, Myxococcus xanthus
gtgacgctgctccgcgccgccaacgtccagctcagcttcggaagccgcaccgtcttccaggacctcaccttcaccatcgaggagggggaacgggtgggcctggtgggcgtcaacggctccggcaagtcgtcgctgatgaagatattggccggggccgcccgcgccgacacgggcgagctccaactgcgccgtggcgcccgcgtcacctacctgccccaggagccggagttccccgaaggcgccacggtggcctccgagctgtccgtgtcccaggggccgctgaaggaggcactggccgcccacgcggagctggcgaagcggatggagtcggccccggcggaagagcaggagaagctgatggcgcagttctccgcgctcagcgaccgcatcgagcagatgggcggctgggacaccgagcaccacgcgaagacgctgctggacaggctgggcgtgaaggactgggaccgtcccgtggcgcagctgtccggcggcctgcgcaagcgcgtggccatcgcccgggccctgctgacgcggccggacctgctgttgctggacgagcccaccaaccacctggacgcggacacggtggactggctggaggaggagctggacaagctgcctggggcgctgctgctcgtcacgcacgaccggtacttcctggacgggctggtggaccgcatcgtcgaaatccagcccggcgcgggcgtcacgtcctaccccggcaactaccaggcctacgtggagcagaagctggtggcgcaggagaacgccgcgctggcgcagcacaagcgcgagcgctggattgcccaggaagtggcctggctgcgcaagggcccggaagcccgccgcaccaagagcaaggcccgcatcgagcgcgcgcagaagctgatggcggagaagggcttcgagcgccccaaggtggcggacctgcgcgtggcggcggcgccccggctgggccacaccgtcatcgaggccgagggcgtgaacaaggcctttggcgaccgcaaggtgctggacggtgtggacttccgcctccagcgcggcgcgcgcgtgggcctggtgggccccaacggcgtgggcaagacgaccttcctgcgcgtgctgttgggcgaggtggagcccgacggcggcaagctcgtcatcgggaagaacacgaaggtggcgtactacgaccagagccgggcgcagctcgacctggaggccaccgtgtacgaagcggcctcgcagggcgaggactgggtggagctgggcgaccagaagattgccctacgcgactacctggacgacctgctcttccccgtgcccatgcagcgcatgaaggtgaaggcgctgtcgggcggcgagcgcaaccggctgctgctggcgcgcctgttcctggagggcgccaacgggctgctgctggacgagcccaccagcgcgctcgacgcggcgagcgaggccgcggtgggggaaggcctggtggccctgatgaaggggcgcacggtgctcgtcatcgcgcaccggctgtccacggtgcgtgacgcggacctgattgccgtggtggaggccggccgcgtggtggaggccggcacccacgcggagctgctcgccctgcggggccggtacacgcagctcctgggcgaaggcgccgtcgcggcgtga
